United States Patent 9,572,897 (MODIFIED POLYNUCLEOTIDES FOR THE PRODUCTION OF CYTOPLASMIC AND CYTOSKELETAL PROTEINS) - sequence listing, part 8

SEQ ID NO: 13106 - DNA, 471 bp, Artificial Sequence
  Description of Artificial Sequence: Synthetic coding sequence
atgagcagcgtgcagagccagcaggagcagctgagccagagcgaccccagccccagccccaacagctgcagcagcttcgagctgatcgacatggacgccggcagcctgtacgagcccgtgagcccccactggttctactgcaagatcatcgacagcaaggagacctggatccccttcaacagcgaggacagccagcagctggaggaggcctacagcagcggcaagggctgcaacggcagagtggtgcccaccgacggcggcagatacgacgtgcacctgggcgagagaatgagatacgccgtgtactgggacgagctggccagcgaggtgagaagatgcacctggttctacaagggcgacaaggacaacaagtacgtgccctacagcgagagcttcagccaggtgctggaggagacctacatgctggccgtgaccctggacgagtggaagaagaagctggagagcccctag

SEQ ID NO: 13107 - DNA, 14262 bp, Artificial Sequence; identical to SEQ ID NO: 9351
  Description of Artificial Sequence: Synthetic coding sequence

SEQ ID NO: 13108 - DNA, 390 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagcccctag

SEQ ID NO: 13109 - DNA, 867 bp, Artificial Sequence
  Description of Artificial Sequence: Synthetic coding sequence
atggagagagagcccagcgccagcgaggccgcccccgccgccgccgccctgttcgcctggggcgccaacagctacggccagctgggcctgggccacaaggaggacgtgctgctgccccagcagctgaacgacttctgcaagcccagaagcgtgagaagaatcaccggcggcggcggccacagcgccgtggtgaccgacggcggcgacctgttcgtgtgcggcctgaacaaggacggccagctgggcctgggccacaccgaggacatcccctacttcaccccctgcaagagcctgttcggctgccccatccagcaggtggcctgcggctgggacttcaccatcatgctgaccgagaacggccaggtgctgagctgcggcagcaacagcttcggccagctgggcgtgccccacggccccagaagatgcgtggtgccccaggccatcgagctgcacaaggagaaggtggtgtgcatcgccgccggcctgagacacgccgtggccgccaccgccagcggcatcgtgttccagtggggcaccggcctggccagctgcggcagaagactgtgccccggccagaccctgcccctgttcttcaccgccaaggagcccagcagagtgaccggcctggagaacagcaaggccatgtgcgtgctggccggcagcgaccacagcgccagcctgaccgacgccggcgaggtgtacgtgtggggcagcaacaagcacggccagctggccaacgaggccgccttcctgcccgtgccccagaagatcgaggcccactgcttccagaacgagaaggtgaccgccatctggagcggctggacccacctggtggcccagaccggcctgctgtggctgagagcctag

SEQ ID NO: 13110 - DNA, 372 bp, Artificial Sequence
  Description of Artificial Sequence: Synthetic coding sequence
atgaacagaagaagaaagttcctgctggccagcgtgctggccctgcagaacagcagcttcatctaccccagctgccagaagtgcttcagcagaatcatcctggtgagcaagagaagcaactgccccaagtgcggcagcaccggcgagagcggcaacgccaactacagatacaagctgagcctgaaggtggccgagagcaacaagctgttcgtgatcaccgtgttcggcagctgcctggacaccttcttcggcctgaccgccaccggcctgcacagatacatccaggaccccaacaagatccccgagaccctggacaacgacaccacccagaacctgctgaccaaggccgtggagacctgcttcgtgggctag

SEQ ID NO: 13111 - DNA, 324 bp, Artificial Sequence
  Description of Artificial Sequence: Synthetic coding sequence
atgctgagactgtaccccggccccatggtgaccgaggccgagggcaagggcggccccgagatggccagcctgagcagcagcgtggtgcccgtgagcttcatcagcaccctgagagagagcgtgctggaccccggcgtgggcggcgagggcgccagcgacaagcagagaagcaagctgagcctgagccacagcatgatccccgccgccaagatccacaccgagctgtgcctgcccgccttcttcagccccgccggcacccagagaagattccagcagccccagcaccacctgaccctgagcatcatccacaccgccgccagatag

SEQ ID NO: 13112 - DNA, 1653 bp, Artificial Sequence
  Description of Artificial Sequence: Synthetic coding sequence
atggagaccgacctgaacagccaggacagaaaggacctggacaagttcatcaagttcttcgccctgaagaccgtgcaggtgatcgtgcaggccagactgggcgagaagatctgcaccagaagcagcagcagccccaccggcagcgactggttcaacctggccatcaaggacatccccgaggtgacccacgaggccaagaaggccctggccggccagctgcccgccgtgggcagaagcatgtgcgtggagatcagcctgaagaccagcgagggcgacagcatggagctggagatctggtgcctggagatgaacgagaagtgcgacaaggagatcaaggtgagctacaccgtgtacaacagactgagcctgctgctgaagagcctgctggccatcaccagagtgacccccgcctacagactgagcagaaagcagggccacgagtacgtgatcctgtacagaatctacttcggcgaggtgcagctgagcggcctgggcgagggcttccagaccgtgagagtgggcaccgtgggcacccccgtgggcaccatcaccctgagctgcgcctacagaatcaacctggccttcatgagcaccagacagttcgagagaaccccccccatcatgggcatcatcatcgaccacttcgtggacagaccctaccccagcagcagccccatgcacccctgcaactacagaaccgccggcgaggacaccggcgtgatctaccccagcgtggaggacagccaggaggtgtgcaccaccagcttcagcaccagcccccccagccagtgcgtgttcaccgtgaccaaggcccacttccagacccccacccccgtggtgaccgacaccctgagagtgcccatggccggcctggccttcagccaccagctgagcagcagcagactgagctaccagcccgccgccctgggcgtgggcagcgccgacctggcctaccccgtggtgttcgccgccggcctgaacgccacccacccccaccagctgatggtgcccggcaaggagggcggcgtgcccctggcccccaaccagcccgtgcacggcacccaggccgaccaggagagactggccacctgcacccccagcgacagaacccactgcgccgccacccccagcagcagcgaggacaccgagaccgtgagcaacagcagcgagggcagagccagcccccacgacgtgctggagaccatcttcgtgagaaaggtgggcgccttcgtgaacaagcccatcaaccaggtgaccctgaccagcctggacatccccttcgccatgttcgcccccaagaacctggagctggaggacaccgaccccatggtgaacccccccgacagccccgagaccgagagccccctgcagggcagcctgcacagcgacggcagcagcggcggcagcagcggcaacacccacgacgacttcgtgatgatcgacttcaagcccgccttcagcaaggacgacatcctgcccatggacctgggcaccttctacagagagttccagaaccccccccagctgagcagcctgagcatcgacatcggcgcccagagcatggccgaggacctggacagcctgcccgagaagctggccgtgcacgagaagaacgtgagagagttcgacgccttcgtggagaccctgcagtag

SEQ ID NO: 13113 - DNA, 4104 bp, Artificial Sequence
  Description of Artificial Sequence: Synthetic coding sequence
atgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctacaagagcagaagcctggccagaagctgcctgagccacttcaagagcaaccagccctacgccagcagactgggcggccccacctgcaaggtgagcagaggcgtggcctacagcacccacagaaccaacgcccccggcaaggacttccagggcatcagcgccgccttcagcaccgagaacggcttccacagcgtgggccacgagctggccgacaaccacatcaccagcagagactgcaacggccacctgctgaactgctacggcagaaacgagagcatcgccagcaccccccccggcgaggacagaaagagccccagagtgctgatcaagaccctgggcaagctggacggctgcctgagagtggagttccacaacggcggcaaccccagcaaggtgcccgccgaggactgcagcgagcccgtgcagctgctgagatacagccccaccctggccagcgagaccagccccgtgcccgaggccagaagaggcagcagcgccgacagcctgcccagccacagacccagccccaccgacagcagactgagaagcagcaagggcagcagcctgagcagcgagagcagctggtacgacagcccctggggcaacgccggcgagctgagcgaggccgagggcagcttcctggcccccggcatgcccgaccccagcctgcacgccagcttcccccccggcgacgccaagaagcccttcaaccagagcagcagcctgagcagcctgagagagctgtacaaggacgccaacctgggcagcctgagccccagcggcatcagactgagcgacgagtacatgggcacccacgccagcctgagcaacagagtgagcttcgccagcgacatcgacgtgcccagcagagtggcccacggcgaccccatccagtacagcagcttcaccctgccctgcagaaagcccaaggccttcgtggaggacaccgccaagaaggacagcctgaaggccagaatgagaagaatcagcgactggaccggcagcctgagcagaaagaagagaaagctgcaggagcccagaagcaaggagggcagcgactacttcgacagcagaagcgacggcctgaacaccgacgtgcagggcagcagccaggccagcgccttcctgtggagcggcggcagcacccagatcctgagccagagaagcgagagcacccacgccatcggcagcgaccccctgagacagaacatctacgagaacttcatgagagagctggagatgagcagaaccaacaccgagaacatcgagaccagcaccgagaccgccgagagcagcagcgagagcctgagcagcctggagcagctggacctgctgttcgagaaggagcagggcgtggtgagaaaggccggctggctgttcttcaagcccctggtgaccgtgcagaaggagagaaagctggagctggtggccagaagaaagtggaagcagtactgggtgaccctgaagggctgcaccctgctgttctacgagacctacggcaagaacagcatggaccagagcagcgcccccagatgcgccctgttcgccgaggacagcatcgtgcagagcgtgcccgagcaccccaagaaggagaacgtgttctgcctgagcaacagcttcggcgacgtgtacctgttccaggccaccagccagaccgacctggagaactgggtgaccgccgtgcacagcgcctgcgccagcctgttcgccaagaagcacggcaaggaggacaccctgagactgctgaagaaccagaccaagaacctgctgcagaagatcgacatggacagcaagatgaagaagatggccgagctgcagctgagcgtggtgagcgaccccaagaacagaaaggccatcgagaaccagatccagcagtgggagcagaacctggagaagttccacatggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgctag

SEQ ID NO: 13114 - DNA, 45 bp, Artificial Sequence
  Description of Artificial Sequence: Synthetic coding sequence
atgaacggcaccctggaccaccccgaccagcccgacctggactag

SEQ ID NO: 13115 - DNA, 519 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgcagctgcccaagcccctgagcgaggccgacgtgagagtgctggaggagcaggcccagaacctgggcctggagggcaccctggtgagcctggccagagtgccccaggcctag

SEQ ID NO: 13116 - DNA, 27 bp, Artificial Sequence
  Description of Artificial Sequence: Synthetic coding sequence
atgttctggaagttcgacctgcactag

SEQ ID NO: 13117 - DNA, 411 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgtag

SEQ ID NO: 13118 - DNA, 5844 bp, Artificial Sequence
  Description of Artificial Sequence: Synthetic coding sequence
ggcagacccatcgaccccagagagggccccggcagaccccccctggacggcagagaccacttcggcagaccccccgtggacatcagagagaacctggtgagacccggcatcgaccacctgggcagaagagaccacttcggcttcaaccccgagaagccctggggccacagaggcgacttcgacgagagagagcacagagtgctgcccgtgtacggcggccccaagggcctgcacgaggagagaggcagattcagaagcggcaactacagattcgaccccagaagcggcccctggaacagaggcttcggccaggaggtgcacagagacttcgacgacagaagaagaccctgggagagacagagagacagagacgacagagacttcgacttctgcagagagatgaacggcaacagactgggcagagacagaatccagaacacctgggtgccccccccccacgccagagtgttcgactacttcgagggcgccaccagccagagaaagggcgacaacgtgccccaggtgaacggcgagaacaccgagagacacgcccagcccccccccatccccgtgcagaacgaccccgagctgtacgagaagctgaccagcagcaacgagatcaacaaggagaagagcgacaccgtggccgacatcgagagcgagcccgtggtggagagcaccgagaccgagggcacccccctgaccagcctgaccgccgagaccagaagacaggtgaagatgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctacaagagcagaagcctggccagaagctgcctgagccacttcaagagcaaccagccctacgccagcagactgggcggccccacctgcaaggtgagcagaggcgtggcctacagcacccacagaaccaacgcccccggcaaggacttccagggcatcagcgccgccttcagcaccgagaacggcttccacagcgtgggccacgagctggccgacaaccacatcaccagcagagactgcaacggccacctgctgaactgctacggcagaaacgagagcatcgccagcaccccccccggcgaggacagaaagagccccagagtgctgatcaagaccctgggcaagctggacggctgcctgagagtggagttccacaacggcggcaaccccagcaaggtgcccgccgaggactgcagcgagcccgtgcagctgctgagatacagccccaccctggccagcgagaccagccccgtgcccgaggccagaagaggcagcagcgccgacagcctgcccagccacagacccagccccaccgacagcagactgagaagcagcaagggcagcagcctgagcagcgagagcagctggtacgacagcccctggggcaacgccggcgagctgagcgaggccgagggcagcttcctggcccccggcatgcccgaccccagcctgcacgccagcttcccccccggcgacgccaagaagcccttcaaccagagcagcagcctgagcagcctgagagagctgtacaaggacgccaacctgggcagcctgagccccagcggcatcagactgagcgacgagtacatgggcacccacgccagcctgagcaacagagtgagcttcgccagcgacatcgacgtgcccagcagagtggcccacggcgaccccatccagtacagcagcttcaccctgccctgcagaaagcccaaggccttcgtggaggacaccgccaagaaggacagcctgaaggccagaatgagaagaatcagcgactggaccggcagcctgagcagaaagaagagaaagctgcaggagcccagaagcaaggagggcagcgactacttcgacagcagaagcgacggcctgaacaccgacgtgcagggcagcagccaggccagcgccttcctgtggagcggcggcagcacccagatcctgagccagagaagcgagagcacccacgccatcggcagcgaccccctgagacagaacatctacgagaacttcatgagagagctggagatgagcagaaccaacaccgagaacatcgagaccagcaccgagaccgccgagagcagcagcgagagcctgagcagcctggagcagctggacctgctgttcgagaaggagcagggcgtggtgagaaaggccggctggctgttcttcaagcccctggtgaccgtgcagaaggagagaaagctggagctggtggccagaagaaagtggaagcagtactgggtgaccctgaagggctgcaccctgctgttctacgagacctacggcaagaacagcatggaccagagcagcgcccccagatgcgccctgttcgccgaggacagcatcgtgcagagcgtgcccgagcaccccaagaaggagaacgtgttctgcctgagcaacagcttcggcgacgtgtacctgttccaggccaccagccagaccgacctggagaactgggtgaccgccgtgcacagcgcctgcgccagcctgttcgccaagaagcacggcaaggaggacaccctgagactgctgaagaaccagaccaagaacctgctgcagaagatcgacatggacagcaagatgaagaagatggccgagctgcagctgagcgtggtgagcgaccccaagaacagaaaggccatcgagaaccagatccagcagtgggagcagaacctggagaagttccacatggacctgttcagaatgagatgctacctggccagcctgcagggcggcgagctgcccaaccccaagagcctgctggccgccgccagcagacccagcaagctggccctgggcagactgggcatcctgagcgtgagcagcttccacgccctggtgtgcagcagagacgacagcgccctgagaaagagaaccctgagcctgacccagagaggcagaaacaagaagggcatcttcagcagcctgaagggcctggacaccctggccagaaagggcaaggagaagagacccagcatcacccaggtggacgagctgctgcacatctacggcagcaccgtggacggcgtgcccagagacaacgcctgggagatccagacctacgtgcacttccaggacaaccacggcgtgaccgtgggcatcaagcccgagcacagagtggaggacatcctgaccctggcctgcaagatgagacagctggagcccagccactacggcctgcagctgagaaagctggtggacgacaacgtggagtactgcatccccgccccctacgagtacatgcagcagcaggtgtacgacgagatcgaggtgttccccctgaacgtgtacgacgtgcagctgaccaagaccggcagcgtgtgcgacttcggcttcgccgtgaccgcccaggtggacgagagacagcacctgagcagaatcttcatcagcgacgtgctgcccgacggcctggcctacggcgagggcctgagaaagggcaacgagatcatgaccctgaacggcgaggccgtgagcgacctggacctgaagcagatggaggccctgttcagcgagaagagcgtgggcctgaccctgatcgccagaccccccgacaccaaggccaccctgtgcaccagctggagcgacagcgacctgttcagcagagaccagaagagcctgctgcccccccccaaccagagccagctgctggaggagttcctggacaacttcaagaagaacaccgccaacgacttcagcaacgtgcccgacatcaccaccggcctgaagagaagccagaccgacggcaccctggaccaggtgagccacagagagaagatggagcagaccttcagaagcgccgagcagatcaccgccctgtgcagaagcttcaacgacagccaggccaacggcatggagggccccagagagaaccaggaccccccccccagaagcctggccagacacctgagcgacgccgacagactgagaaaggtgatccaggagctggtggacaccgagaagagctacgtgaaggacctgagctgcctgttcgagctgtacctggagcccctgcagaacgagaccttcctgacccaggacgagatggagagcctgttcggcagcctgcccgagatgctggagttccagaaggtgttcctggagaccctggaggacggcatcagcgccagcagcgacttcaacaccctggagacccccagccagttcagaaagctgctgttcagcctgggcggcagcttcctgtactacgccgaccacttcaagctgtacagcggcttctgcgccaaccacatcaaggtgcagaaggtgctggagagagccaagaccgacaaggccttcaaggccttcctggacgccagaaaccccaccaagcagcacagcagcaccctggagagctacctgatcaagcccgtgcagagagtgctgaagtaccccctgctgctgaaggagctggtgagcctgaccgaccaggagagcgaggagcactaccacctgaccgaggccctgaaggccatggagaaggtggccagccacatcaacgagatgcagaagatctacgaggactacggcaccgtgttcgaccagctggtggccgagcagagcggcaccgagaaggaggtgaccgagctgagcatgggcgagctgctgatgcacagcaccgtgagctggctgaaccccttcctgagcctgggcaaggccagaaaggacctggagctgaccgtgttcgtgttcaagagagccgtgatcctggtgtacaaggagaactgcaagctgaagaagaagctgcccagcaacagcagacccgcccacaacagcaccgacctggaccccttcaagttcagatggctgatccccatcagcgccctgcaggtgagactgggcaaccccgccggcaccgagaacaacagcatctgggagctgatccacaccaagagcgagatcgagggcagacccgagaccatcttccagctgtgctgcagcgacagcgagagcaagaccaacatcgtgaaggtgatcagaagcatcctgagagagaacttcagaagacacatcaagtgcgagctgcccctggagaagacctgcaaggacagactggtgcccctgaagaacagagtgcccgtgagcgccaagctggccagcagcagaagcctgaaggtgctgaagaacagcagcagcaacgagtggaccggcgagaccggcaagggcaccctgctggacagcgacgagggcagcctgagcagcggcacccagagcagcggctgccccaccgccgagggcagacaggacagcaagagcaccagccccggcaagtacccccaccccggcctggccgacttcgccgacaacctgatcaaggagagcgacatcctgagcgacgaggacgacgaccacagacagaccgtgaagcagggcagccccaccaaggacatcgagatccagttccagagactgagaatcagcgaggaccccgacgtgcaccccgaggccgagcagcagcccggccccgagagcggcgagggccagaagggcggcgagcagcccaagctggtgagaggccacttctgccccatcaagagaaaggccaacagcaccaagagagacagaggcaccctgctgaaggcccagatcagacaccagagcctggacagccagagcgagaacgccaccatcgacctgaacagcgtgctggagagagagttcagcgtgcagagcctgaccagcgtggtgagcgaggagtgcttctacgagaccgagagccacggcaagagctag

SEQ ID NO: 13119 - DNA, 294 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaaggacgccaagaccaccaacggccacggcggcgaggccgccgagggcaagagcctgggcagcgccctgaagcccggcgagggcagaagcgccctgttcgccggcaacgagtggagaagacccatcatccagttcgtggagagcggcgacgacaagaacagcaactacttcagcatggactag

SEQ ID NO: 13120 - DNA, 117 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaagtag

SEQ ID NO: 13121 - DNA, 1455 bp, Artificial Sequence
  Description of Artificial Sequence: Synthetic coding sequence
atggccatcggcaagagactggccaccctgcccaccaaggagcagaagacccagagactgatcagcgagctgagcctgctgaaccacaagctgcccgccagagtgtggctgcccaccgccggcttcgaccaccacgtggtgagagtgccccacacccaggccgtggtgctgaacagcaaggacaaggccccctacctgatctacgtggaggtgctggagtgcgagaacttcgacaccaccagcgtgcccgccagaatccccgagaacagaatcagaagcaccagaagcgtggagaacctgcccgagtgcggcatcacccacgagcagagagccggcagcttcagcaccgtgcccaactacgacaacgacgacgaggcctggagcgtggacgacatcggcgagctgcaggtggagctgcccgaggtgcacaccaacagctgcgacaacatcagccagttcagcgtggacagcatcaccagccaggagagcaaggagcccgtgttcatcgccgccggcgacatcagaagaagactgagcgagcagctggcccacacccccaccgccttcaagagagaccccgaggaccccagcgccgtggccctgaaggagccctggcaggagaaggtgagaagaatcagagagggcagcccctacggccacctgcccaactggagactgctgagcgtgatcgtgaagtgcggcgacgacctgagacaggagctgctggccttccaggtgctgaagcagctgcagagcatctgggagcaggagagagtgcccctgtggatcaagccctacaagatcctggtgatcagcgccgacagcggcatgatcgagcccgtggtgaacgccgtgagcatccaccaggtgaagaagcagagccagctgagcctgctggactacttcctgcaggagcacggcagctacaccaccgaggccttcctgagcgcccagagaaacttcgtgcagagctgcgccggctactgcctggtgtgctacctgctgcaggtgaaggacagacacaacggcaacatcctgctggacgccgagggccacatcatccacatcgacttcggcttcatcctgagcagcagccccagaaacctgggcttcgagaccagcgccttcaagctgaccaccgagttcgtggacgtgatgggcggcctggacggcgacatgttcaactactacaagatgctgatgctgcagggcctgatcgccgccagaaagcacatggacaaggtggtgcagatcgtggagatcatgcagcagggcagccagctgccctgcttccacggcagcagcaccatcagaaacctgaaggagagattccacatgagcatgaccgaggagcagctgcagctgctggtggagcagatggtggacggcagcatgagaagcatcaccaccaagctgtacgacggcttccagtacctgaccaacggcatcatgtag

SEQ ID NO: 13122 - DNA, 228 bp, Artificial Sequence
  Description of Artificial Sequence: Synthetic coding sequence
atggccatccccatcaccgtgctggactgcgacctgctgctgtacggcagaggccacagaaccctggacagattcaagctggacgacgtgaccgacgagtacctgatgagcatgtacggcttccccagacagttcatctactacctggtggagctgctgggcgccaacctgagcagacccacccagagaagcagagccatcagccccgagacccaggtgctggcctag

SEQ ID NO: 13123 - DNA, 2754 bp, Artificial Sequence
  Description of Artificial Sequence: Synthetic coding sequence
atggacggcgccgccggccccggcgacggccccgccagagaggccctgcagagcctgagccagagactgagagtgcaggagcaggagatggagctggtgaaggccgccctggccgaggccctgagactgctgagactgcaggtgccccccagcagcctgcagggcagcggcacccccgccccccccggcgacagcctggccgccccccccggcctgccccccacctgcacccccagcctggtgagcagaggcacccagaccgagaccgaggtggagctgaagagcagccccggcccccccggcctgagcaacggcccccccgccccccagggcgccagcgaggagcccagcggcacccagagcgagggcggcggcagcagcagcagcggcgccggcagccccggcccccccggcatcctgagacccctgcagcccccccagagagccgacacccccagaagaaacagcagcagcagcagcagccccagcgagagacccagacagaagctgagcagaaaggccatcagcagcgccaacctgctggtgagaagcggcagcaccgagagcagaggcggcaaggaccccctgagcagccccggcggccccggcagcagaagaagcaactacaacctggagggcatcagcgtgaagatgttcctgagaggcagacccatcaccatgtacatccccagcggcatcagaagcctggaggagctgcccagcggccccccccccgagaccctgagcctggactgggtgtacggctacagaggcagagacagcagaagcaacctgttcgtgctgagaagcggcgaggtggtgtacttcatcgcctgcgtggtggtgctgtacagacccggcggcggccccggcggccccggcggcggcggccagagacactacagaggccacaccgactgcgtgagatgcctggccgtgcaccccgacggcgtgagagtggccagcggccagaccgccggcgtggacaaggacggcaagcccctgcagcccgtggtgcacatctgggacagcgagaccctgctgaagctgcaggagatcggcctgggcgccttcgagagaggcgtgggcgccctggccttcagcgccgccgaccagggcgccttcctgtgcgtggtggacgacagcaacgagcacatgctgagcgtgtgggactgcagcagaggcatgaagctggccgagatcaagagcaccaacgacagcgtgctggccgtgggcttcaaccccagagacagcagctgcatcgtgaccagcggcaagagccacgtgcacttctggaactggagcggcggcgtgggcgtgcccggcaacggcaccctgaccagaaagcagggcgtgttcggcaagtacaagaagcccaagttcatcccctgcttcgtgttcctgcccgacggcgacatcctgaccggcgacagcgagggcaacatcctgacctggggcagaagccccagcgacagcaagacccccggcagaggcggcgccaaggagacctacggcatcgtggcccaggcccacgcccacgagggcagcatcttcgccctgtgcctgagaagagacggcaccgtgctgagcggcggcggcagagacagaagactggtgcagtggggccccggcctggtggccctgcaggaggccgagatccccgagcacttcggcgccgtgagagccatcgccgagggcctgggcagcgagctgctggtgggcaccaccaagaacgccctgctgagaggcgacctggcccagggcttcagccccgtgatccagggccacaccgacgagctgtggggcctgtgcacccaccccagccagaacagattcctgacctgcggccacgacagacagctgtgcctgtgggacggcgagagccacgccctggcctggagcatcgacctgaaggagaccggcctgtgcgccgacttccaccccagcggcgccgtggtggccgtgggcctgaacaccggcagatggctggtgctggacaccgagaccagagagatcgtgagcgacgtgatcgacggcaacgagcagctgagcgtggtgagatacagccccgacggcctgtacctggccatcggcagccacgacaacgtgatctacatctacagcgtgagcagcgacggcgccaagagcagcagattcggcagatgcatgggccacagcagcttcatcacccacctggactggagcaaggacggcaacttcatcatgagcaacagcggcgactacgagatcctgtactgggacgtggccggcggctgcaagcagctgaagaacagatacgagagcagagacagagagtgggccacctacacctgcgtgctgggcttccacgtgtacgtgcccgtgagaagctgccagggcgccgagccccacgtgagaggccccagacagcccagagaccagagacccatccacgccagaagactggcccccagactggccggcagacagggcagacagcacctgcccgtggccagcgccggcagatggggcagaggcgccggcgccagacacgccctgagcaaccccctgcccgtgcccagactgctgcccagaagactgatcgccgcctggagagacagactggccagaagaagaggccccgcccccccctgccccagcctggcccagagccccaccaccagaggcagactgttccccggcctgaccagcagacacagcagaagcagaatcttcctggagggcgccaacggcgcccccgcccacaccgtgtag

SEQ ID NO: 13124 - DNA, 321 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagtag

SEQ ID NO: 13125 - DNA, 228 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatactag

SEQ ID NO: 13126 - DNA, 1275 bp, Artificial Sequence; identical to SEQ ID NO: 11943
  Description of Artificial Sequence: Synthetic coding sequence

SEQ ID NO: 13127 - DNA, 288 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaaggacgccaagaccaccaacggccacggcggcgaggccgccgagggcaagagcctgggcagcgccctgaagcccggcgagggcagaagcgccctgttcgccggcaacgagtggagaagacccatcatccagttcgtggagagcggcgacgacaagaacagcaactacttcagctag

SEQ ID NO: 13128 - DNA, 3144 bp, Artificial Sequence
  Description of Artificial Sequence: Synthetic coding sequence
atggcccccagactgcagctggagaaggccgcctggagatgggccgagaccgtgagacccgaggaggtgagccaggagcacatcgagaccgcctacagaatctggctggagccctgcatcagaggcgtgtgcagaagaaactgcaagggcaaccccaactgcctggtgggcatcggcgagcacatctggctgggcgagatcgacgagaacagcttccacaacatcgacgaccccaactgcgagagaagaaagaagaacagcttcgtgggcctgaccaacctgggcgccacctgctacgtgaacaccttcctgcaggtgtggttcctgaacctggagctgagacaggccctgtacctgtgccccagcacctgcagcgactacatgctgggcgacggcatccaggaggagaaggactacgagccccagaccatctgcgagcacctgcagtacctgttcgccctgctgcagaacagcaacagaagatacatcgaccccagcggcttcgtgaaggccctgggcctggacaccggccagcagcaggacgcccaggagttcagcaagctgttcatgagcctgctggaggacaccctgagcaagcagaagaaccccgacgtgagaaacatcgtgcagcagcagttctgcggcgagtacgcctacgtgaccgtgtgcaaccagtgcggcagagagagcaagctgctgagcaagttctacgagctggagctgaacatccagggccacaagcagctgaccgactgcatcagcgagttcctgaaggaggagaagctggagggcgacaacagatacttctgcgagaactgccagagcaagcagaacgccaccagaaagatcagactgctgagcctgccctgcaccctgaacctgcagctgatgagattcgtgttcgacagacagaccggccacaagaagaagctgaacacctacatcggcttcagcgagatcctggacatggagccctacgtggagcacaagggcggcagctacgtgtacgagctgagcgccgtgctgatccacagaggcgtgagcgcctacagcggccactacatcgcccacgtgaaggacccccagagcggcgagtggtacaagttcaacgacgaggacatcgagaagatggagggcaagaagctgcagctgggcatcgaggaggacctggagcccagcaagagccagaccagaaagcccaagtgcggcaagggcacccactgcagcagaaacgcctacatgctggtgtacagactgcagacccaggagaagcccaacaccaccgtgcaggtgcccgccttcctgcaggagctggtggacagagacaacagcaagttcgaggagtggtgcatcgagatggccgagatgagaaagcagagcgtggacaagggcaaggccaagcacgaggaggtgaaggagctgtaccagagactgcccgccggcgccgagccctacgagttcgtgagcctggagtggctgcagaagtggctggacgagagcacccccaccaagcccatcgacaaccacgcctgcctgtgcagccacgacaagctgcaccccgacaagatcagcatcatgaagagaatcagcgagtacgccgccgacatcttctacagcagatacggcggcggccccagactgaccgtgaaggccctgtgcaaggagtgcgtggtggagagatgcagaatcctgagactgaagaaccagctgaacgaggactacaagaccgtgaacaacctgctgaaggccgccgtgaagggcagcgacggcttctgggtgggcaagagcagcctgagaagctggagacagctggccctggagcagctggacgagcaggacggcgacgccgagcagagcaacggcaagatgaacggcagcaccctgaacaaggacgagagcaaggaggagagaaaggaggaggaggagctgaacttcaacgaggacatcctgtgcccccacgccgtgttcttcttcagcaagtacatcttcctgaacagcggcgagctgtgcatcagcgagaacgagagaagactggtgagcaaggaggcctggagcaagctgcagcagtacttccccaaggcccccgagttccccagctacaaggagtgctgcagccagtgcaagatcctggagagagagggcgaggagaacgaggccctgcacaagatgatcgccaacgagcagaagaccagcctgcccaacctgttccaggacaagaacagaccctgcctgagcaactggcccgaggacaccgacgtgctgtacatcgtgagccagttcttcgtggaggagtggagaaagttcgtgagaaagcccaccagatgcagccccgtgagcagcgtgggcaacagcgccctgctgtgcccccacggcggcctgatgttcaccttcgccagcatgaccaaggaggacagcaagctgatcgccctgatctggcccagcgagtggcagatgatccagaagctgttcgtggtggaccacgtgatcaagatcaccagaatcgaggtgggcgacgtgaaccccagcgagacccagtacatcagcgagcccaagctgtgccccgagtgcagagagggcctgctgtgccagcagcagagagacctgagagagtacacccaggccaccatctacgtgcacaaggtggtggacaacaagaaggtgatgaaggacagcgcccccgagctgaacgtgagcagcagcgagaccgaggaggacaaggaggaggccaagcccgacggcgagaaggaccccgacttcaaccagagcaacggcggcaccaagagacagaagatcagccaccagaactacatcgcctaccagaagcaggtgatcagaagaagcatgagacacagaaaggtgagaggcgagaaggccctgctggtgagcgccaaccagaccctgaaggagctgaagatccagatcatgcacgccttcagcgtggcccccttcgaccagaacctgagcatcgacggcaagatcctgagcgacgactgcgccaccctgggcaccctgggcgtgatccccgagagcgtgatcctgctgaaggccgacgagcccatcgccgactacgccgccatggacgacgtgatgcaggtgtgcatgcccgaggagggcttcaagggcaccggcctgctgggccactag

SEQ ID NO: 13129 - DNA, 1443 bp, Artificial Sequence; identical to SEQ ID NO: 12577
  Description of Artificial Sequence: Synthetic coding sequence

SEQ ID NO: 13130 - DNA, 2376 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgaacgaggagaagatcatccagagactggtggagatcgtgcaccccagccaggaggaggacagacacagcaacgccagccagagcctgtgcgagatcgtgagactgagcagagaccagatgctgcagatccagaacagcaccgagcccgaccccctgctggccaccctggagaagcaggagatcatcgagcagctgctgagcaacatcttccacaaggagaagaacgagagcgccatcgtgagcgccatccagatcctgctgaccctgctggagaccagaagacccaccttcgagggccacatcgagatctgcccccccggcatgagccacagcgcctgcagcgtgaacaagagcgtgctggaggccatcagaggcagactgggcagcttccacgagctgctgctggagccccccaagaacatgttcttcaagtacacctggaacaacttcctgcacacccaggtggagatctgcatcgccctgatcctggccagccccttcgagaacaccgagaacgccaccatcaccgaccaggacagcaccggcgacaacctgctgctgaagcacctgttccagaagtgccagctgatcgagagaatcctggaggcctgggagatgaacgagaagaagcaggccgagggcggcagaagacacggctacatgggccacctgaccagaatcgccaactgcatcgtgcacagcaccgacaagggccccaacagcgccctggtgcagcagctgatcaaggacctgcccgacgaggtgagagagagatgggagaccttctgcaccagcagcctgggcgagaccaacaagagaaacaccgtggacctggccttcagcgactaccagatgcagcagatgaccagcaacttcatcgaccagttcggcttcaacgacgagaagttcgccgaccaggacgacatcggcaacgtgagcttcgacagagtgagcgacatcaacttcaccctgaacaccaacgagagcggcaacatcgccctgttcgaggcctgctgcaaggagagaatccagcagttcgacgacggcggcagcgacgaggaggacatctgggaggagaagcacatcgccttcacccccgagagccagagaagaagcagcagcggcagcaccgacagcgaggagagcaccgacagcgaggaggaggacggcgccaagcaggacctgttcgagcccagcagcgccaacaccgaggacaagatggaggtggacctgagcgagccccccaactggagcgccaacttcgacgtgcccatggagaccacccacggcgcccccctggacagcgtgggcagcgacgtgtggagcaccgaggagcccatgcccaccaaggagaccggctgggccagcttcagcgagttcaccagcagcctgagcaccaaggacagcctgagaagcaacagccccgtggagatggagaccagcaccgagcccatggaccccctgacccccagcgccgccgccctggccgtgcagcccgaggccgccggcagcgtggccatggaggccagcagcgacggcgaggaggacgccgagagcaccgacaaggtgaccgagaccgtgatgaacggcggcatgaaggagaccctgagcctgaccgtggacgccaagaccgagaccgccgtgttcaagagcgaggagggcaagctgagcaccagccaggacgccgcctgcaaggacgccgaggagtgccccgagaccgccgaggccaagtgcgccgcccccagaccccccagcagcagccccgagcagagcggcgtggagatccccgccctgcccggccagtggagccagcagtag

SEQ ID NO: 13131 - DNA, 1500 bp, Artificial Sequence
  Description of Artificial Sequence: Synthetic coding sequence
atgttcggcgacgccagcaccagcctggtggtgcccgagaaggtgaagacccccatgaagagcagcaagaccgacctgcagggcagcgccagccccagcaaggtggagggcgtgcacacccccagacagaagagaagcacccccctgaaggagagacagctgagcaagcccctgagcgagagaaccaacagcagcgacagcgagagaagccccgacctgggccacagcacccagatccccagaaaggtggtgtacgaccagctgaaccagatcctggtgagcgacgccgccctgcccgagaacgtgatcctggtgaacaccaccgactggcagggccagtacgtggccgagctgctgcaggaccagagaaagcccgtggtgtgcacctgcagcaccgtggaggtgcaggccgtgctgagcgccctgctgaccagaatccagagatactgcaactgcaacagcagcatgcccagacccgtgaaggtggccgccgtgggcggccagagctacctgagcagcatcctgagattcttcgtgaagagcctggccaacaagaccagcgactggctgggctacatgagattcctgatcatccccctgggcagccaccccgtggccaagtacctgggcagcgtggacagcaagtacagcagcagcttcctggacagcggctggagagacctgttcagcagaagcgagccccccgtgagcgagcagctggacgtggccggcagagtgatgcagtacgtgaacggcgccgccaccacccaccagctgcccgtggccgaggccatgctgacctgcagacacaagttccccgacgaggacagctaccagaagttcatccccttcatcggcgtggtgaaggtgggcctggtggaggacagccccagcaccgccggcgacggcgacgacagccccgtggtgagcctgaccgtgcccagcaccagcccccccagcagcagcggcctgagcagagacgccaccgccaccccccccagcagccccagcatgagcagcgccctggccatcgtgggcagccccaacagcccctacggcgacgtgatcggcctgcaggtggactactggctgggccaccccggcgagagaagaagagagggcgacaagagagacgccagcagcaagaacaccctgaagagcgtgttcagaagcgtgcaggtgagcagactgccccacagcggcgaggcccagctgagcggcaccatggccatgaccgtggtgaccaaggagaagaacaagaaggtgcccaccatcttcctgagcaagaagcccagagagaaggaggtggacagcaagagccaggtgatcgagggcatcagcagactgatctgcagcgccaagcagcagcagaccatgctgagagtgagcatcgacggcgtggagtggagcgacatcaagttcttccagctggccgcccagtggcccacccacgtgaagcacttccccgtgggcctgttcagcggcagcaaggccacctag

SEQ ID NO: 13132 - DNA, 435 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgccagactgctgctgcagggcctgccccccggcaccaccccccagagactggagcagcacgtgcaggccctgctgagagccagcggcctgcccgtgcagccctgctgcgccctggccagccccagacccgacagagccctggtgcagctgcccaagcccctgagcgagtag

SEQ ID NO: 13133 - DNA, 513 bp, Artificial Sequence; identical to SEQ ID NO: 9958
  Description of Artificial Sequence: Synthetic coding sequence

SEQ ID NO: 13134 - DNA, 270 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgccccccccagagcccccgcctag

SEQ ID NO: 13135 - DNA, 1206 bp, Artificial Sequence
  Description of Artificial Sequence: Synthetic coding sequence
atgtgcgtggagatcagcctgaagaccagcgagggcgacagcatggagctggagatctggtgcctggagatgaacgagaagtgcgacaaggagatcaaggtgagctacaccgtgtacaacagactgagcctgctgctgaagagcctgctggccatcaccagagtgacccccgcctacagactgagcagaaagcagggccacgagtacgtgatcctgtacagaatctacttcggcgaggtgcagctgagcggcctgggcgagggcttccagaccgtgagagtgggcaccgtgggcacccccgtgggcaccatcaccctgagctgcgcctacagaatcaacctggccttcatgagcaccagacagttcgagagaaccccccccatcatgggcatcatcatcgaccacttcgtggacagaccctaccccagcagcagccccatgcacccctgcaactacagaaccgccggcgaggacaccggcgtgatctaccccagcgtggaggacagccaggaggtgtgcaccaccagcttcagcaccagcccccccagccagctgatggtgcccggcaaggagggcggcgtgcccctggcccccaaccagcccgtgcacggcacccaggccgaccaggagagactggccacctgcacccccagcgacagaacccactgcgccgccacccccagcagcagcgaggacaccgagaccgtgagcaacagcagcgagggcagagccagcccccacgacgtgctggagaccatcttcgtgagaaaggtgggcgccttcgtgaacaagcccatcaaccaggtgaccctgaccagcctggacatccccttcgccatgttcgcccccaagaacctggagctggaggacaccgaccccatggtgaacccccccgacagccccgagaccgagagccccctgcagggcagcctgcacagcgacggcagcagcggcggcagcagcggcaacacccacgacgacttcgtgatgatcgacttcaagcccgccttcagcaaggacgacatcctgcccatggacctgggcaccttctacagagagttccagaaccccccccagctgagcagcctgagcatcgacatcggcgcccagagcatggccgaggacctggacagcctgcccgagaagctggccgtgcacgagaagaacgtgagagagttcgacgccttcgtggagaccctgcagtag

SEQ ID NO: 13136 - DNA, 2148 bp, Artificial Sequence; identical to SEQ ID NO: 9921
  Description of Artificial Sequence: Synthetic coding sequence

SEQ ID NO: 13137 - DNA, 336 bp, Artificial Sequence
  Description of Artificial Sequence: Synthetic coding sequence
atgaccggcagcaacagccacatcaccatcctgaccctgaaggtgctgccccacttcgagagcctgggcaagcaggagaagatccccaacaagatgagcgccttcagaaaccactgcccccacctggacagcgtgggcgagatcaccaaggaggacctgatccagaagagcctgggcacctgccaggactgcaaggtgcagggccccaacctgtgggcctgcctggagaacagatgcagctacgtgggctgcggcgagagccaggtggaccacagcaccatccacagccaggagaccaagcactacctgaccgtgaacctgaccaccctgagatag

SEQ ID NO: 13138 - DNA, 228 bp, Artificial Sequence
  Description of Artificial Sequence: Synthetic coding sequence
atggccggccaggaggaccccgtgcagagagagatccaccaggactgggccaacagagagtacatcgagatcatcaccagcagcatcaagaagatcgccgacttcctgaacagcttcgacatgagctgcagaagcagactggccaccctgaacgagaagctgaccgccctggagagaagaatcgagtacatcgaggccagagtgaccaagggcgagaccctgacctag

SEQ ID NO: 13139 - DNA, 348 bp, Artificial Sequence; identical to SEQ ID NO: 9946
  Description of Artificial Sequence: Synthetic coding sequence

SEQ ID NO: 13140 - DNA, 1077 bp, Artificial Sequence; identical to SEQ ID NO: 11551
  Description of Artificial Sequence: Synthetic coding sequence

SEQ ID NO: 13141 - DNA, 4047 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcaccacccagggcttccccgtgagaaacgtgagacccgtgcagaacgccatgaaccaggtgggcatcgtgctgaacgtgcagcagggccagaccgtgagacccatcaccctggtgcccgcccccggcacccagttcgtgaagcccaccgtgggcgtgccccaggtgttcagccagatgacccccgtgagacccggcagcaccatgcccgtgagacccaccaccaacaccttcaccaccgtgatccccgccaccctgaccatcagaagcaccgtgccccagagccagagccagcagaccaagagcacccccagcaccagcaccacccccaccgccacccagcccaccagcctgggccagctggccgtgcagagccccggccagagcaaccagaccaccaaccccaagctggtgagcatcgccagcttcgtgaccgtgaagagacccggcgtgaccggcgagaacagcaacgaggtggccaagctggtgaacaccctgaacaccatccccagcctgggccagagccccggccccgtggtggtgagcaacaacagcagcgcccacggcagccagagaaccagcggccccgagagcagcatgaaggtgaccagcagcatccccgtgttcgacctgcaggacggcggcagaaagatctgccccagatgcaacgcccagttcagagtgaccgaggccctgagaggccacatgtgctactgctgccccgagatggtggagtaccagaagaagggcaagagcctggacagcgagcccagcgtgcccagcgccgccaagccccccagccccgagaagaccgcccccgtggccagcacccccagcagcacccccatccccgccctgagcccccccaccaaggtgcccgagcccaacgagaacgtgggcgacgccgtgcagaccaagctgatcatgctggtggacgacttctactacggcagagacggcggcaaggtggcccagctgaccaacttccccaaggtggccaccagcttcagatgcccccactgcaccaagagactgaagaacaacatcagattcatgaaccacatgaagcaccacgtggagctggaccagcagaacggcgaggtggacggccacaccatctgccagcactgctacagacagttcagcacccccttccagctgcagtgccacctggagaacgtgcacagcccctacgagagcaccaccaagtgcaagatctgcgagtgggccttcgagagcgagcccctgttcctgcagcacatgaaggacacccacaagcccggcgagatgccctacgtgtgccaggtgtgccagtacagaagcagcctgtacagcgaggtggacgtgcacttcagaatgatccacgaggacaccagacacctgctgtgcccctactgcctgaaggtgttcaagaacggcaacgccttccagcagcactacatgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 13142 - DNA, 561 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcccagaacagaaagctgatcgagttcctgctgaaggccgagtgcctggaggacctggtgagcttcatcatcgaggagcccccccaggacatggacgagaagatcagatacaagtaccccaacatcagctgcgagctgctgaccagcgacgtgagccagatgaacgacagactgggcgaggacgagagcctgctgatgaagctgtacagcttcctgctgaacgacagccccctgaaccccctgctggccagcttcttcagcaaggtgctgagcatcctgatcagcagaaagcccgagcagatcgtggacttcctgaagaagaagcacgacttcgtggacctgatcatcaagcacatcggcaccagcgccatcatggacctgctgctgagactgctgacctgcatcgagcccccccagcccagacaggacgtgctgaactggctgtag

SEQ ID NO: 13143 - DNA, 288 bp, Artificial Sequence
  Description of Artificial Sequence: Synthetic coding sequence
atgagccagagcggcgccgtgagctgctgccccggcgccaccaacggcagcctgggcagaagcgacggcgtggccaagatgagccccaaggacctgttcgagcagagaaagaagtacagcaacagcaacgtgatcatgcacgagaccagccagtaccacgtgcagcacctggccaccttcatcatggacaagagcgaggccatcaccagcgtggacgacgccatcagaaagctggtgcagctgagcagcaaggagaagatctggacccaggagatgctgctgcagtag

SEQ ID NO: 13144 - DNA, 1740 bp, Artificial Sequence
  Description of Artificial Sequence: Synthetic coding sequence
atggacgacagcaagcaggagagcaccaccagcaaggaggaggagaccaacatcatcagcagcatcgtgcccagcacccaggacatctaccagagacagaacagcagcgacgtgcacaagagcctgctgcccgccgtggacgagaccacctgcggccacacccacttccagcagatgatcgacaagtacatcaacgaggccaacctgatccccgagaagaccgacctgcaggagctggagcacatcttccccaacctgcaccaccagctgttcaagcccctggagccccaccccgacttcgacctgagcagcagcagcagcggcatcagccccgacaacagagacttctaccagagaagcgacagcagcagcgagagccactgcgccaccggcctgagcaagagcaccgtgtacttcaccgccctgagaagaaccagcatgcacagcagcctgaacaccagccccaaccagcagcccgacaccaacctggcccacgtgggcgcccacagcttcgccaccgagaacatcatcggcggcagcgagcagtgcttcgagcagctgcagcccgagtacagcagccaggaggagagccagcacgccgacctgcccagcatcttcagcatcgaggccagagacagcagccagggcatgaagaaccagaactaccccagcgaggagcacaccgagatcctgcagaacaagaagaagatcgtgcacttccagctgagcatcggcaacctgagcagcgtgtacagcagcagcgacgaggccaacgtgttcgaccagctgaacgtgcagcacagcaccccctgcggcagcaacagcagcgagtgcagcaccaagcaccagctggagagcagaaaggagagcatgggcttcgaggagctgagcaagagaggcgtggtgaccatgctgcagagccagggcctgatcgaggacaacaagaacgagacctgcagagtgctggacatcaacccccaggtggaggagaccgacagcagactgtgcgtgagaaccgtggagatgggcaccagcatccaggccccctacagcctgaccacccagaacgagaagtacttcgagaacagcgccgagaccgacatccccaagatcaccaagaagctgagccagctgggcgagagcgagctgttcgccagcagcggcagcttcagcctgcagagcagcatccccgtgtgggagaccgagaccggccacggcatcatggaggagcccgagctgaccctgatcagcaccaccgacaccagcatcgccgagatggacttcgccaacctgaccctggaggagaagagcgagaacgaggccaagtgcttcttccaggtgagcgagttcctgcccctggtgagcgccaccgaggccagcgactaccccgccgtgagcgagctgagcatcgagaagcccagaaccgccagcaccgccgagacccccagaagactgacccccgtgcccggcagcctgcaggaggccttcatcaagagaaagaagagcttcatggagagaagccaccagagacagaaggagatcagaaacaagatccacgtgagcgagaacagccagatcaagaccgtgaaggagaagcccagcatcagcagcagcgtgagcagactgaagggcgtgaacaaggtgagagccagcttccccgaggacagaaagaccacccaggccctgagacaccagagaggcctgagactgtacaaccagctggccgaggtgaagcagtag

SEQ ID NO: 13145 - DNA, 435 bp, Artificial Sequence; identical to SEQ ID NO: 13132
  Description of Artificial Sequence: Synthetic coding sequence

SEQ ID NO: 13146 - DNA, 246 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagatag

SEQ ID NO: 13147 - DNA, 1539 bp, Artificial Sequence
  Description of Artificial Sequence: Synthetic coding sequence
atggccgccttcaagctggacttcctgcccgagatgatggtggaccactgcagcctgaacagcagccccgtgagcaagaagatgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagaacgccctgcacaacatgaaggtgctgcccggcatgcaccaccccatccagatgaagcccgccgacagcgagaagaacaacgtggaggacagaaagctgttcatcggcatgatcagcaagaagtgcaccgagaacgacatcagagtgatgttcagcagcttcggccagatcgaggagtgcagaatcctgagaggccccgacggcctgagcagaggctgcgccttcgtgaccttcaccaccagagccatggcccagaccgccatcaaggccatgcaccaggcccagaccatggagggctgcagcagccccatggtggtgaagttcgccgacacccagaaggacaaggagcagaagagaatggcccagcagctgcagcagcagatgcagcagatcagcgccgccagcgtgtggggcaacctggccggcctgaacaccctgggcccccagtacctggccctgtacctgcagctgctgcagcagaccgccagcagcggcaacctgaacaccctgagcagcctgcaccccatgggcggcctgaacgccatgcagctgcagaacctggccgccctggccgccgccgccagcgccgcccagaacacccccagcggcaccaacgccctgaccaccagcagcagccccctgagcgtgctgaccagcagcggcagcagccccagcagcagcagcagcaacagcgtgaaccccatcgccagcctgggcgccctgcagaccctggccggcgccaccgccggcctgaacgtgggcagcctggccggcatggccgccctgaacggcggcctgggcagcagcggcctgagcaacggcaccggcagcaccatggaggccctgacccaggcctacagcggcatccagcagtacgccgccgccgccctgcccaccctgtacaaccagaacctgctgacccagcagagcatcggcgccgccggcagccagaaggagggccccgagggcgccaacctgttcatctaccacctgccccaggagttcggcgaccaggacctgctgcagatgttcatgcccttcggcaacgtggtgagcgccaaggtgttcatcgacaagcagaccaacctgagcaagtgcttcggcttcgtgagctacgacaaccccgtgagcgcccaggccgccatccagagcatgaacggcttccagatcggcatgaagagactgaaggtgcagctgaagagaagcaagaacgacagcaagccctactag

SEQ ID NO: 13148 - DNA, 1131 bp, Artificial Sequence
  Description of Artificial Sequence: Synthetic coding sequence
atgaaggacgtgcccggcttcctgcagcagagccagaacagcggccccggccagcccgccgtgtggcacagactggaggagctgtacaccaagaagctgtggcaccagctgaccctgcaggtgctggacttcgtgcaggacccctgcttcgcccagggcgacggcctgatcaagctgtacgagaacttcatcagcgagttcgagcacagagtgaaccccctgagcctggtggagatcatcctgcacgtggtgagacagatgaccgaccccaacgtggccctgaccttcctggagaagaccagagagaaggtgaagagcagcgacgaggccgtgatcctgtgcaagaccgccatcggcgccctgaagctgaacatcggcgacctgcaggtgaccaaggagaccatcgaggacgtggaggagatgctgaacaacctgcccggcgtgaccagcgtgcacagcagattctacgacctgagcagcaagtactaccagaccatcggcaaccacgccagctactacaaggacgccctgagattcctgggctgcgtggacatcaaggacctgcccgtgagcgagcagcaggagagagccttcaccctgggcctggccggcctgctgggcgagggcgtgttcaacttcggcgagctgctgatgcaccccgtgctggagagcctgagaaacaccgacagacagtggctgatcgacaccctgtacgccttcaacagcggcaacgtggagagattccagaccctgaagaccgcctggggccagcagcccgacctggccgccaacgaggcccagctgctgagaaagatccagctgctgtgcctgatggagatgaccttcaccagacccgccaaccacagacagctgaccttcgaggagatcgccaagagcgccaagatcaccgtgaacgaggtggagctgctggtgatgaaggccctgagcgtgggcctggtgaagggcagcatcgacgaggtggacaagagagtgcacatgacctgggtgcagcccagagtgctggacctgcagcagatcaagggcatgaaggacagactggagttctggtgcaccgacgtgaagagcatggagatgctggtggagcaccaggcccacgacatcctgacctag

SEQ ID NO: 13149 - DNA, 489 bp, Artificial Sequence
  Description of Artificial Sequence: Synthetic coding sequence
atgaccagcaagaagctggtgaacagcgtggccggctgcgccgacgacgccctggccggcctggtggcctgcaaccccaacctgcagctgctgcagggccacagagtggccctgagaagcgacctggacagcctgaagggcagagtggccctgctgagcggcggcggcagcggccacgagcccgcccacgccggcttcatcggcaagggcatgctgaccggcgtgatcgccggcgccgtgttcaccagccccgccgtgggcagcatcctggccgccatcagagccgtggcccaggccggcaccgtgggcaccctgctgatcgtgaagaactacaccggcgacagactgaacttcggcctggccagagagcaggccagagccgagggcatccccgtggagatggtggtgatcggcgacgacagcgccttcaccgtgctgaagaaggccggcagaagaggcctgtgcggcaccgtgctgatccacaagtag

SEQ ID NO: 13150 - DNA, 7854 bp, Artificial Sequence
  Description of Artificial Sequence: Synthetic coding sequence
atgctgaccgacagcggcggcggcggcaccagcttcgaggaggacctggacagcgtggcccccagaagcgcccccgccggcgccagcgagccccccccccccggcggcgtgggcctgggcatcagaaccgtgagactgttcggcgaggccggccccgccagcggcgtgggcagcagcggcggcggcggcagcggcagcggcaccggcggcggcgacgccgccctggacttcaagctggccgccgccgtgctgagaaccggcggcggcggcggcgccagcggcagcgacgaggacgaggtgagcgaggtggagagcttcatcctggaccaggaggacctggacaaccccgtgctgaagaccaccagcgagatcttcctgagcagcaccgccgagggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgaaggccgagaacagccacaacgccggccaggtggacaccagaagcctggccgaggcctgcagcgacggcgacgtgaacgccgtgagaaagctgctggacgagggcagaagcgtgaacgagcacaccgaggagggcgagagcctgctgtgcctggcctgcagcgccggctactacgagctggcccaggtgctgctggccatgcacgccaacgtggaggacagaggcaacaagggcgacatcacccccctgatggccgccagcagcggcggctacctggacatcgtgaagctgctgctgctgcacgacgccgacgtgaacagccagagcgccaccggcaacaccgccctgacctacgcctgcgccggcggcttcgtggacatcgtgaaggtgctgctgaacgagggcgccaacatcgaggaccacaacgagaacggccacacccccctgatggaggccgccagcgccggccacgtggaggtggccagagtgctgctggaccacggcgccggcatcaacacccacagcaacgagttcaaggagagcgccctgaccctggcctgctacaagggccacctggacatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccaacctggaggaggtgaacgacgagggctacacccccctgatggaggccgccagagagggccacgaggagatggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacctgtgcaccgtgcagttcctgatcagcaagggcgccaacgtgaacagagccaccgccaacaacgaccacaccgtggtgagcctggcctgcgccggcggccacctggccgtggtggagctgctgctggcccacggcgccgaccccacccacagactgaaggacggcagcaccatgctgatcgaggccgccaagggcggccacaccaacgtggtgagctacctgctggactaccccaacaacgtgctgagcgtgcccaccaccgacgtgagccagctgcccccccccagccaggaccagagccaggtgcccagagtgcccacccacaccctggccatggtggtgcccccccaggagcccgacagaaccagccaggagaacagccccgccctgctgggcgtgcagaagggcaccagcaagcagaagagcagcagcctgcaggtggccgaccaggacctgctgcccagcttccacccctaccagcccctggagtgcatcgtggaggagaccgagggcaagctgaacgagctgggccagagaatcagcgccatcgagaaggcccagctgaagagcctggagctgatccagggcgagcccctgaacaaggacaagatcgaggagctgaagaagaacagagaggagcaggtgcagaagaagaagaagatcctgaaggagctgcagaaggtggagagacagctgcagatgaagacccagcagcagttcaccaaggagtacctggagaccaagggccagaaggacaccgtgagcctgcaccagcagtgcagccacagaggcgtgttccccgagggcgagggcgacggcagcctgcccgaggaccacttcagcgagctgccccaggtggacaccatcctgttcaaggacaacgacgtggacgacgagcagcagagcccccccagcgccgagcagatcgacttcgtgcccgtgcagcccctgagcagcccccagtgcaacttcagcagcgacctgggcagcaacggcaccaacagcctggagctgcagaaggtgagcggcaaccagcagatcgtgggccagccccagatcgccatcaccggccacgaccagggcctgctggtgcaggagcccgacggcctgatggtggccacccccgcccagaccctgaccgacaccctggacgacctgatcgccgccgtgagcaccagagtgcccaccggcagcaacagcagcagccagaccaccgagtgcctgacccccgagagctgcagccagaccaccagcaacgtggccagccagagcatgccccccgtgtaccccagcgtggacatcgacgcccacaccgagagcaaccacgacaccgccctgaccctggcctgcgccggcggccacgaggagctggtgagcgtgctgatcgccagagacgccaagatcgagcacagagacaagaagggcttcacccccctgatcctggccgccaccgccggccacgtgggcgtggtggagatcctgctggacaagggcggcgacatcgaggcccagagcgagagaaccaaggacacccccctgagcctggcctgcagcggcggcagacaggaggtggtggacctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacgtgcccgccgtgaagctgctgctggacatgggcagcgacatcaacgcccagatcgagaccaacagaaacaccgccctgaccctggcctgcttccagggcagagccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatccacagaggcgcccacatcgacgtgagaaacaagaagggcaacacccccctgtggctggccagcaacggcggccacttcgacgtggtgcagctgctggtgcaggccggcgccgacgtggacgccgccgacaacagaaagatcacccccctgatgagcgccttcagaaagggccacgtgaaggtggtgcagtacctggtgaaggaggtgaaccagttccccagcgacatcgagtgcatgagatacatcgccaccatcaccgacaaggagctgctgaagaagtgccaccagtgcgtggagaccatcgtgaaggccaaggaccagcaggccgccgaggccaacaagaacgccagcatcctgctgaaggagctggacctggagaagagcagagaggagagcagaaagcaggccctggccgccaagagagagaagagaaaggagaagagaaagaagaagaaggaggagcagaagagaaagcaggaggaggacgaggagaacaagcccaaggagaacagcgagctgcccgaggacgaggacgaggaggagaacgacgaggacgtggagcaggaggtgcccatcgagccccccagcgccaccaccaccaccaccatcggcatcagcgccaccagcgccaccttcaccaacgtgttcggcaagaagagagccaacgtggtgaccacccccagcaccaacagaaagaacaagaagaacaagaccaaggagaccccccccaccgcccacctgatcctgcccgagcagcacatgagcctggcccagcagaaggccgacaagaacaagatcaacggcgagcccagaggcggcggcgccggcggcaacagcgacagcgacaacctggacagcaccgactgcaacagcgagagcagcagcggcggcaagagccaggagctgaacttcgtgatggacgtgaacagcagcaagtaccccagcctgctgctgcacagccaggaggagaagaccagcaccgccaccagcaagacccagaccagactggagggcgaggtgacccccaacagcctgagcaccagctacaagaccgtgagcctgcccctgagcagccccaacatcaagctgaacctgaccagccccaagagaggccagaagagagaggagggctggaaggaggtggtgagaagaagcaagaagctgagcgtgcccgccagcgtggtgagcagaatcatgggcagaggcggctgcaacatcaccgccatccaggacgtgaccggcgcccacatcgacgtggacaagcagaaggacaagaacggcgagagaatgatcaccatcagaggcggcaccgagagcaccagatacgccgtgcagctgatcaacgccctgatccaggaccccgccaaggagctggaggacctgatccccaagaaccacatcagaacccccgccagcaccaagagcatccacgccaacttcagcagcggcgtgggcaccaccgccgccagcagcaagaacgccttccccctgggcgcccccaccctggtgaccagccaggccaccaccctgagcaccttccagcccgccaacaagctgaacaagaacgtgcccaccaacgtgagaagcagcttccccgtgagcctgcccctggcctacccccacccccacttcgccctgctggccgcccagaccatgcagcagatcagacaccccagactgcccatggcccagttcggcggcaccttcagccccagccccaacacctggggccccttccccgtgagacccgtgaaccccggcaacaccaacagcagccccaagcacaacaacaccagcagactgcccaaccagaacggcaccgtgctgcccagcgagagcgccggcctggccaccgccagctgccccatcaccgtgagcagcgtggtggccgccagccagcagctgtgcgtgaccaacaccagaacccccagcagcgtgagaaagcagctgttcgcctgcgtgcccaagaccagcccccccgccaccgtgatcagcagcgtgaccagcacctgcagcagcctgcccagcgtgagcagcgcccccatcaccagcggccaggcccccaccaccttcctgcccgccagcaccagccaggcccagctgagcagccagaagatggagagcttcagcgccgtgccccccaccaaggagaaggtgagcacccaggaccagcccatggccaacctgtgcacccccagcagcaccgccaacagctgcagcagcagcgccagcaacacccccggcgcccccgagacccaccccagcagcagccccacccccaccagcagcaacacccaggaggaggcccagcccagcagcgtgagcgacctgagccccatgagcatgcccttcgccagcaacagcgagcccgcccccctgaccctgaccagccccagaatggtggccgccgacaaccaggacaccagcaacctgccccagctggccgtgcccgcccccagagtgagccacagaatgcagcccagaggcagcttctacagcatggtgcccaacgccaccatccaccaggacccccagagcatcttcgtgaccaaccccgtgaccctgacccccccccagggcccccccgccgccgtgcagctgagcagcgccgtgaacatcatgaacggcagccagatgcacatcaaccccgccaacaagagcctgccccccaccttcggccccgccaccctgttcaaccacttcagcagcctgttcgacagcagccaggtgcccgccaaccagggctggggcgacggccccctgagcagcagagtggccaccgacgccagcttcaccgtgcagagcgccttcctgggcaacagcgtgctgggccacctggagaacatgcaccccgacaacagcaaggcccccggcttcagaccccccagccagagagtgagcaccagccccgtgggcctgcccagcatcgaccccagcggcagcagccccagcagcagcagcgcccccctggccagcttcagcggcatccccggcaccagagtgttcctgcagggccccgcccccgtgggcacccccagcttcaacagacagcacttcagcccccacccctggaccagcgccagcaacagcagcaccagcgccccccccaccctgggccagcccaagggcgtgagcgccagccaggacagaaagatccccccccccatcggcaccgagagactggccagaatcagacagggcggcagcgtggcccaggcccccgccggcaccagcttcgtggcccccgtgggccacagcggcatctggagcttcggcgtgaacgccgtgagcgagggcctgagcggctggagccagagcgtgatgggcaaccaccccatgcaccagcagctgagcgaccccagcaccttcagccagcaccagcccatggagagagacgacagcggcatggtggcccccagcaacatcttccaccagcccatggccagcggcttcgtggacttcagcaagggcctgcccatcagcatgtacggcggcaccatcatccccagccacccccagctggccgacgtgcccggcggccccctgttcaacggcctgcacaaccccgaccccgcctggaaccccatgatcaaggtgatccagaacagcaccgagtgcaccgacgcccagcaggccagcctgctgcccagcgtgcccgccctgaagggcgagatccccagcccccagctgaccagacccaagaagagaatcggcagacccatggtggccagccccaaccagagacaccaggaccacctgagacccaaggtgcccgccggcgtgcaggagctgacccactgccccgacacccccctgctgccccccagcgacagcagaggccacaacagcagcaacagccccagcctgcaggccggcggcgccgagggcgccggcgacagaggcagagacaccagatag

SEQ ID NO: 13151 - DNA, 753 bp, Artificial Sequence
  Description of Artificial Sequence: Synthetic coding sequence
atgggcgacatccccgccgtgggcctgagcagctggaaggccagccccggcaaggtgaccgaggccgtgaaggaggccatcgacgccggctacagacacttcgactgcgcctacttctaccacaacgagagagaggtgggcgccggcatcagatgcaagatcaaggagggcgccgtgagaagagaggacctgttcatcgccaccaagctgtggtgcacctgccacaagaagagcctggtggagaccgcctgcagaaagagcctgaaggccctgaagctgaactacctggacctgtacctgatccactggcccatgggcttcaagcccccccaccccgagtggatcatgagctgcagcgagctgagcttctgcctgagccaccccagagtgcaggacctgcccctggacgagagcaacatggtgatccccagcgacaccgacttcctggacacctgggaggccatggaggacctggtgatcaccggcctggtgaagaacatcggcgtgagcaacttcaaccacgagcagctggagagactgctgaacaagcccggcctgagattcaagcccctgaccaaccagatcctgatcagattccagatccagagaaacgtgatcgtgatccccggcagcatcacccccagccacatcaaggagaacatccaggtgttcgacttcgagctgacccagcacgacatggacaacatcctgagcctgaacagaaacctgagactggccatgttccccatgtag

SEQ ID NO: 13152 - DNA, 525 bp, Artificial Sequence
  Description of Artificial Sequence: Synthetic coding sequence
atgctgaccgagaacggccaggtgctgagctgcggcagcaacagcttcggccagctgggcgtgccccacggccccagaagatgcgtggtgccccaggccatcgagctgcacaaggagaaggtggtgtgcatcgccgccggcctgagacacgccgtggccgccaccgccagcggcatcgtgttccagtggggcaccggcctggccagctgcggcagaagactgtgccccggccagaccctgcccctgttcttcaccgccaaggagcccagcagagtgaccggcctggagaacagcaaggccatgtgcgtgctggccggcagcgaccacagcgccagcctgaccgacgccggcgaggtgtacgtgtggggcagcaacaagcacggccagctggccaacgaggccgccttcctgcccgtgccccagaagatcgaggcccactgcttccagaacgagaaggtgaccgccatctggagcggctggacccacctggtggcccagaccggcctgctgtggctgagagcctag

SEQ ID NO: 13153 - DNA, 228 bp, Artificial Sequence
  Description of Artificial Sequence: Synthetic coding sequence
atgaacagaagaagaaagttcctgctggccagcgtgctggccctgcagaacagcagcttcatctaccccagctgccagaagtgcttcagcagaatcatcctggtgagcaagagaagcaactgccccaagtgcggcagcaccggcgagagcggcaacgccaactacagatacaagctgagcctgaaggtggccgagagcaacaagctgttcgtgatcaccgtgttctag

SEQ ID NO: 13154 - DNA, 252 bp, Artificial Sequence
  Description of Artificial Sequence: Synthetic coding sequence
atggtggccatggccgaggccgaggccggcgtggccgtggaggtgagaggcctgccccccgccgtgcccgacgagctgctgaccctgtacttcgagaacagaagaagaagcggcggcggccccgtgctgagctggcagagactgggctgcggcggcgtgctgaccttcagagagcccgccgacgccgagagagtgctggcccaggccgaccacgagctgcacggcgcccagctgagcctgagacccgcctag

SEQ ID NO: 13155 - DNA, 528 bp, Artificial Sequence
  Description of Artificial Sequence: Synthetic coding sequence
atgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatcagcaagaagttcggcgacatgagctacagcatcagacacagcatcagcatgcccgccatgagaaacagccccaccttcaagagcttcgaggagagagtggagaccaccgtgaccagcctgaagaccaaggtgggcggcaccaaccccaacggcggcagcttcgaggaggtgctgagcagcaccgcccacgccagcgcccagagcctggccggcggcagcagaagaaccaaggaggaggagctgcagtgctag

SEQ ID NO: 13156 - DNA, 231 bp, Artificial Sequence
  Description of Artificial Sequence: Synthetic coding sequence
atgaacagaagaagaaagttcctgctggccagcgtgctggccctgcagaacagcagcttcatctaccccagctgccagaagtgcttcagcagaatcatcctggtgagcaagagaagcaactgccccaagtgcggcagcaccggcgagagcggcaacgccaactacagatacaagctgagcctgaaggtggccgagagcaacaagctgttcgtgatcaccgtgttcggctag

SEQ ID NO: 13157 - DNA, 456 bp, Artificial Sequence
  Description of Artificial Sequence: Synthetic coding sequence
atgagcatccccttcagcaacacccactacagaatcccccagggcttcggcaacctgctggagggcctgaccagagagatcctgagagagcagcccgacaacatccccgccttcgccgccgcctacttcgagagcctgctggagaagagagagaagaccaacttcgaccccgccgagtggggcagcaaggtggaggacagattctacaacaaccacgccttcgaggagcaggagccccccgagaagagcgaccccaagcaggaggagagccagatcagcggcaaggaggaggagaccagcgtgaccatcctggacagcagcgaggaggacaaggagaaggaggaggtggccgccgtgaagatccaggccgccttcagaggccacatcgccagagaggaggccaagaagatgaagaccaacagcctgcagaacgaggagaaggaggagaacaagtag

SEQ ID NO: 13158 - DNA, 270 bp, Artificial Sequence
  Description of Artificial Sequence: Synthetic coding sequence
atggaggccgccgacgccagcagaagcaacggcagcagccccgaggccagagacgccagaagccccagcggccccagcggcagcctggagaacggcaccaaggccgacggcaaggacgccaagaccaccaacggccacggcggcgaggccgccgagggcaagagcctgggcagcgccctgaagcccggcgagggcagaagcgccctgttcgccggcaacgagtggagaagacccatcatccagttcgtggagagcggcgacgacaagtag

SEQ ID NO: 13159 - DNA, 1542 bp, Artificial Sequence
  Description of Artificial Sequence: Synthetic coding sequence
atggaggtgggcatcaccatccagcacgcctacgagaagcagcacccctggatcgacctgaccagcatcggcttcagctacgtgatcgacttcaacaccatgggccagatcaacagacagacccagagacagagaagagtgagaagaagactggacctgatctaccccatggtgaccggcaccctgcccaaggcccagagctggcccgtgagccccggccccgccaccagcccccccatgagcccctgcagctgcccccagtgcgtgctggtgatgagcgtgaaggccgccgtggtgaacggcagcaccggccccctgcagctgcccgtgaccagaaagaacatgcccccccccggcgtggtgaagctgccccccctgcccggcagcggcgccaagcccctggacagcaccggcaccatcagaggccccctgaagaccgcccccagccaggtgatcagaagacaggccagcagcatgcccaccggcaccaccatgggcagccccgccagcccccccggccccaacagcaagaccggcagagtggccctggccaccctgaacagaaccaacctgcagagactggccatcgcccagagcagagtgctgatcgccagcggcgtgcccaccgtgcccgtgaagaacctgaacggcagcagccccgtgaaccccgccctggccggcatcaccggcatcctgatgagcgccgccggcctgcccgtgtgcctgaccagaccccccaagctggtgctgcaccccccccccgtgagcaagagcgagatcaagagcatccccggcgtgagcaacaccagcagaaagaccaccaagaagcaggccaagaagggcaagacccccgaggaggtgctgaagaagtacctgcagaaggtgagacacccccccgacgaggactgcaccatctgcatggagagactgaccgcccccagcggctacaagggcccccagcccaccgtgaagcccgacctggtgggcaagctgagcagatgcggccacgtgtaccacatctactgcctggtggccatgtacaacaacggcaacaaggacggcagcctgcagtgccccacctgcaagaccatctacggcgtgaagaccggcacccagccccccggcaagatggagtaccacctgatcccccacagcctgcccggccaccccgactgcaagaccatcagaatcatctacagcatcccccccggcatccagggccccgagcaccccaaccccggcaagagcttcagcgccagaggcttccccagacactgctacctgcccgacagcgagaagggcagaaaggtgctgaagctgctgctggtggcctgggacagaagactgatcttcgccatcggcaccagcagcaccaccggcgagagcgacaccgtgatctggaacgaggtgcaccacaagaccgagttcggcagcaacctgaccggccacggctaccccgacgccaactacctggacaacgtgctggccgagctggccgcccagggcatcagcgaggacagcaccgcccaggagaaggactag

SEQ ID NO: 13160 - DNA, 414 bp, Artificial Sequence
  Description of Artificial Sequence: Synthetic coding sequence
atgagcagcgtgcagagccagcaggagcagctgagccagagcgaccccagccccagccccaacagctgcagcagcttcgagctgatcgacatggacgccggcagcctgtacgagcccgtgagcccccactggttctactgcaagatcatcgacagcaaggagacctggatccccttcaacagcgaggacagccagcagctggaggaggcctacagcagcggcaagggctgcaacggcagagtggtgcccaccgacggcggcagatacgacgtgcacctgggcgagagaatgagatacgccgtgtactgggacgagctggccagcgaggtgagaagatgcacctggttctacaagggcgacaaggacaacaagtacgtgccctacagcgagagcttcagccaggtgctggagtag

SEQ ID NO: 13161 - DNA, 120 bp, Artificial Sequence
  Description of Artificial Sequence: Synthetic coding sequence
atgttctggaagttcgacctgcacagcagcagccacatcgacaccctgctggagagagaggacgtgaccctgaaggagctgatggacgaggaggacgtgctgcaggagtgcaaggcctag

SEQ ID NO: 13162 - DNA, 2157 bp, Artificial Sequence
  Description of Artificial Sequence: Synthetic coding sequence
atgctgatgaccctggagatgaccgagctgaccgacccccaccacaccatgggcgactacaaggtggcccacccccaggacccccaccaccccagcgagaagcccgtgatccactgccacaagtgcggcgagccctgcaagggcgaggtgctgagagtgcagaccaagcacttccacatcaagtgcttcacctgcaaggtgtgcggctgcgacctggcccagggcggcttcttcatcaagaacggcgagtacctgtgcaccctggactaccagagaatgtacggcaccagatgccacggctgcggcgagttcgtggagggcgaggtggtgaccgccctgggcaagacctaccaccccaactgcttcgcctgcaccatctgcaagagacccttcccccccggcgacagagtgaccttcaacggcagagactgcctgtgccagctgtgcgcccagcccatgagcagcagccccaaggagaccaccttcagcagcaactgcgccggctgcggcagagacatcaagaacggccaggccctgctggccctggacaagcagtggcacctgggctgcttcaagtgcaagagctgcggcaaggtgctgaccggcgagtacatcagcaaggacggcgccccctactgcgagaaggactaccagggcctgttcggcgtgaagtgcgaggcctgccaccagttcatcaccggcaaggtgctggaggccggcgacaagcactaccaccccagctgcgccagatgcagcagatgcaaccagatgttcaccgagggcgaggagatgtacctgcagggcagcaccgtgtggcaccccgactgcaagcagagcaccaagaccgaggagaagctgagacccaccagaaccagcagcgagagcatctacagcagacccggcagcagcatccccggcagccccggccacaccatctacgccaaggtggacaacgagatcctggactacaaggacctggccgccatccccaaggtgaaggccatctacgacatcgagagacccgacctgatcacctacgagcccttctacaccagcggctacgacgacaagcaggagagacagagcctgggcgagagccccagaaccctgagccccacccccagcgccgagggctaccaggacgtgagagacagaatgatccacagaagcaccagccagggcagcatcaacagccccgtgtacagcagacacagctacacccccaccaccagcagaagcccccagcacttccacagacccggcaacgagcccagcagcggcagaaacagccccctgccctacagacccgacagcagacccctgacccccacctacgcccaggcccccaagcacttccacgtgcccgaccagggcatcaacatctacagaaagccccccatctacaagcagcacgccgccctggccgcccagagcaagagcagcgaggacatcatcaagttcagcaagttccccgccgcccaggcccccgaccccagcgagacccccaagatcgagaccgaccactggcccggcccccccagcttcgccgtggtgggccccgacatgaagagaagaagcagcggcagagaggaggacgacgaggagctgctgagaagaagacagctgcaggaggagcagctgatgaagctgaacagcggcctgggccagctgatcctgaaggaggagatggagaaggagagcagagagagaagcagcctgctggccagcagatacgacagccccatcaacagcgccagccacatccccagcagcaagaccgccagcctgcccggctacggcagaaacggcctgcacagacccgtgagcaccgacttcgcccagtacaacagctacggcgacgtgagcggcggcgtgagagacttccagaccctgcccgacggccacatgcccgccatgagaatggacagaggcgtgagcatgcccaacatgctggagcccaagatcttcccctacgagatgctgatggtgaccaacagaggcagaaacaagatcctgagagaggtggacagaaccagactggagagacacctggcccccgaggtgttcagagagatcttcggcatgagcatccaggagttcgacagactgcccctgtggagaagaaacgacatgaagaagaaggccaagctgttctag

SEQ ID NO: 13163 - DNA, 2148 bp, Artificial Sequence; identical to SEQ ID NO: 9921
  Description of Artificial Sequence: Synthetic coding sequence

SEQ ID NO: 13164 - DNA, 360 bp, Artificial Sequence
  Description of Artificial Sequence: Synthetic coding sequence
atggagaccgacctgaacagccaggacagaaaggacctggacaagttcatcaagttcttcgccctgaagaccgtgcaggtgatcgtgcaggccagactgggcgagaagatctgcaccagaagcagcagcagccccaccggcagcgactggttcaacctggccatcaaggacatccccgaggtgacccacgaggccaagaaggccctggccggccagctgcccgccgtgggcagaagcatgtgcgtggagatcagcctgaagaccagcgagggcgacagcatggagctggagatctggtgcctggagatgaacgagaagtgcgacaaggagatcaaggtgagctacaccgtgtacaactag

SEQ ID NO: 13165 - DNA, 420 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgtgagcgtgagccagcagcccgtgagcgcccccgtgcccatcgccgcccacgccagcgtggccggccacctgagcaccagcaccaccgtgagcagcagcggcgcccagaacagcgacagcaccaagaagaccctggtgaccctgatcgccaacaacaacgccggcaaccccctggtgcagcagggcggccagcccctgatcctgacccagaaccccgcccccggcctgggcaccatggtgacccagcccgtgctgagacccgtgcaggtgatgcagaacgccaaccacgtgacctag

SEQ ID NO: 13166 - DNA, 492 bp, Artificial Sequence
  Description of Artificial Sequence: Synthetic coding sequence
atgcacgacaagggcatcaccaccgccgccgtgtgcgtgtaccccgccagagtgtgcgacgccgtgaaggccctgaaggccgccggctgcaacatccccgtggccagcgtggccgccggcttccccgccggccagacccacctgaagaccagactggaggagatcagactggccgtggaggacggcgccaccgagatcgacgtggtgatcaacagaagcctggtgctgaccggccagtgggaggccctgtacgacgagatcagacagttcagaaaggcctgcggcgaggcccacctgaagaccatcctggccaccggcgagctgggcaccctgaccaacgtgtacaaggccagcatgatcgccatgatggccggcagcgacttcatcaagaccagcaccggcaaggagaccgtgaacgccaccttccccgtggccatcgtgatgctgagagccatcagagacttcttctggaagaccggcaacaaggtgtag

SEQ ID NO: 13167 - DNA, 456 bp, Artificial Sequence
  Description of Artificial Sequence: Synthetic coding sequence
atggccgacaccgacctgttcatggagtgcgaggaggaggagctggagccctggcagaagatcagcgacgtgatcgaggacagcgtggtggaggactacaacagcgtggacaagaccaccaccgtgagcgtgagccagcagcccgtgagcgcccccgtgcccatcgccgcccacgccagcgtggccggccacctgagcaccagcaccaccgtgagcagcagcggcgcccagaacagcgacagcaccaagaagaccctggtgaccctgatcgccaacaacaacgccggcaaccccctggtgcagcagggcggccagcccctgatcctgacccagaaccccgcccccggcctgggcaccatggtgacccagcccgtgctgagacccgtgcaggtgatgcagaacgccaaccacgtgaccagcagccccgtggccagccagcccatcttcatcacctag

SEQ ID NO: 13168 - DNA, 252 bp, Artificial Sequence
  Description of Artificial Sequence: Synthetic coding sequence
atgagccagagcggcgccgtgagctgctgccccggcgccaccaacggcagcctgggcagaagcgacggcgtggccaagatgagccccaaggacctgttcgagcagagaaagaagtacagcaacagcaacgtgatcatgcacgagaccagccagtaccacgtgcagcacctggccaccttcatcatggacaagagcgaggccatcaccagcgtggacgacgccatcagaaagctggtgcagctgagcagctag

SEQ ID NO: 13169 - DNA, 366 bp, Artificial Sequence
  Description of Artificial Sequence: Synthetic coding sequence
atggccggcagacccctgagaatcggcgaccagctggtgctggaggaggactacgacgagacctacatccccagcgagcaggagatcctggagttcgccagagagatcggcatcgaccccatcaaggagcccgagctgatgtggctggccagagagggcatcgtggcccccctgcccggcgagtggaagccctgccaggacatcaccggcgacatctactacttcaacttcgccaacggccagagcatgtgggaccacccctgcgacgagcactacagaagcctggtgatccaggagagagccaagctgagcaccagcggcgccatcaagaagaagaagaagaagaaggagaagaaggacaagtag

SEQ ID NO: 13170 - DNA, 2997 bp, Artificial Sequence; identical to SEQ ID NO: 12130
  Description of Artificial Sequence: Synthetic coding sequence

SEQ ID NO: 13171 - DNA, 504 bp, Artificial Sequence
  Description of Artificial Sequence: Synthetic coding sequence
atgggcaccaccgcccccggccccatccacctgctggagctgtgcgaccagaagctgatggagttcctgtgcaacatggacaacaaggacctggtgtggctggaggagatccaggaggaggccgagagaatgttcaccagagagttcagcaaggagcccgagctgatgcccaagacccccagccagaagaacagaagaaagaagagaagaatcagctacgtgcaggacgagaacagagaccccatcagaagaagactgagcagaagaaagagcagaagcagccagctgagcagcagaagactgagaagcaaggacagcgtggagaagctggccaccgtggtgggcgagaacggcagcgtgctgagaagagtgaccagagccgccgccgccgccgccgccgccaccatggccctggccgcccccagcagccccacccccgagagccccaccatgctgaccaagaagcccgaggacaaccacacccagtgccagctggtgccctag

SEQ ID NO: 13172 - DNA, 615 bp, Artificial Sequence
  Description of Artificial Sequence: Synthetic coding sequence
atggaggcccaggcccagggcctgctggagaccgagcccctgcagggcaccgacgaggacgccgtggccagcgccgacttcagcagcatgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatcagcaagaagttcggcgacatgagctacagcatcagacacagcatcagcatgcccgccatgagaaacagccccaccttcaagagcttcgaggagagagtggagaccaccgtgaccagcctgaagaccaaggtgggcggcaccaaccccaacggcggcagcttcgaggaggtgctgagcagcaccgcccacgccagcgcccagagcctggccggcggcagcagaagaaccaaggaggaggagctgcagtgctag

SEQ ID NO: 13173 - DNA, 1023 bp, Artificial Sequence
  Description of Artificial Sequence: Synthetic coding sequence
atggccgccgccagagacccccccgaggtgagcctgagagaggccacccagagaaagctgagaagattcagcgagctgagaggcaagctggtggccagaggcgagttctgggacatcgtggccatcaccgccgccgacgagaagcaggagctggcctacaaccagcagctgagcgagaagctgaagagaaaggagctgcccctgggcgtgcagtaccacgtgttcgtggaccccgccggcgccaagatcggcaacggcggcagcaccctgtgcgccctgcagtgcctggagaagctgtacggcgacaagtggaacagcttcaccatcctgctgatccacagcggcggctacagccagagactgcccaacgccagcgccctgggcaagatcttcaccgccctgcccctggacatccccgagtgcagcggcaagaccagctgcatcatccagagcatcctggacagcagatgcagcgtggcccccggcagcgtggtggagtacagcagactgggccccgacgtgagcgtgggcgagaactgcatcatcagcggcagctacatcctgaccaaggccgccctgcccgcccacagcttcgtgtgcagcctgagcctgaagatgaacagatgcctgaagtacgccaccatggccttcggcgtgcaggacaacctgaagaagagcgtgaagaccctgagcgacatcaagctgctgcagttcttcggcgtgtgcttcctgagctgcctggacgtgtggaacctgaaggtgaccgaggagctgttcagcggcaacaagacctgcctgagcctgtggaccgccagaatcttccccgtgtgcagcagcctgagcgacagcgtgatcaccagcctgaagatgctgaacgccgtgaagaacaagagcgccttcagcctgaacagctacaagctgctgagcatcgaggagatgctgatctacaaggacgtggaggacatgatcacctacagagagcagatcttcctggagatcagcctgaagagcagcctgatgtag

SEQ ID NO: 13174 - DNA, 873 bp, Artificial Sequence
  Description of Artificial Sequence: Synthetic coding sequence
atggccgagctgaccgccctggagagcctgatcgagatgggcttccccagaggcagagccgagaaggccctggccctgaccggcaaccagggcatcgaggccgccatggactggctgatggagcacgaggacgaccccgacgtggacgagcccctggagacccccctgggccacatcctgggcagagagcccaccagcagcgagcagggcggcctggagggcagcggcagcgccgccggcgagggcaagcccgccctgagcgaggaggagagacaggagcagaccaagagaatgctggagctggtggcccagaagcagagagagagagaggagagagaggagagagaggccctggagagagagagacagagaagaagacagggccaggagctgagcgccgccagacagagactgcaggaggacgagatgagaagagccgccgaggagagaagaagagagaaggccgaggagctggccgccagacagagagtgagagagaagatcgagagagacaaggccgagagagccaagaagtacggcggcagcgtgggcagccagcccccccccgtggcccccgagcccggccccgtgcccagcagccccagccaggagccccccaccaagagagagtacgaccagtgcagaatccaggtgagactgcccgacggcaccagcctgacccagaccttcagagccagagagcagctggccgccgtgagactgtacgtggagctgcacagaggcgaggagctgggcggcggccaggaccccgtgcagctgctgagcggcttccccagaagagccttcagcgaggccgacatggagagacccctgcaggagctgggcctggtgcccagcgccgtgctgatctag

SEQ ID NO: 13175 - DNA, 309 bp, Artificial Sequence; identical to SEQ ID NO: 11300
  Description of Artificial Sequence: Synthetic coding sequence

SEQ ID NO: 13176 - DNA, 279 bp, Artificial Sequence
  Description of Artificial Sequence: Synthetic coding sequence
atgctgagcgaggaggagaaggaggagctgaaggccgagctggtgcagctggaggacgagatcaccaccctgagacaggtgctgagcgccaaggagagacacctggtggagatcaagcagaagctgggcatgaacctgatgaacgagctgaagcagaacttcagcaagagctggcacgacatgcagaccaccaccgcctacaagaagacccacgagaccctgagccacgccggccagaaggccaccgccgccttcagcaacgtgggcaccgccatctag

SEQ ID NO: 13177 - DNA, 3735 bp, Artificial Sequence; identical to SEQ ID NO: 10414
  Description of Artificial Sequence: Synthetic coding sequence

SEQ ID NO: 13178 - DNA, 2676 bp, Artificial Sequence
  Description of Artificial Sequence: Synthetic coding sequence
atggaccagcccgaggccccctgcagcagcaccggccccagactggccgtggccagagagctgctgctggccgccctggaggagctgagccaggagcagctgaagagattcagacacaagctgagagacgtgggccccgacggcagaagcatcccctggggcagactggagagagccgacgccgtggacctggccgagcagctggcccagttctacggccccgagcccgccctggaggtggccagaaagaccctgaagagagccgacgccagagacgtggccgcccagctgcaggagagaagactgcagagactgggcctgggcagcggcaccctgctgagcgtgagcgagtacaagaagaagtacagagagcacgtgctgcagctgcacgccagagtgaaggagagaaacgccagaagcgtgaagatcaccaagagattcaccaagctgctgatcgcccccgagagcgccgcccccgaggaggccatgggccccgccgaggagcccgagcccggcagagccagaagaagcgacacccacaccttcaacagactgttcagaagagacgaggagggcagaagacccctgaccgtggtgctgcagggccccgccggcatcggcaagaccatggccgccaagaagatcctgtacgactgggccgccggcaagctgtaccagggccaggtggacttcgccttcttcatgccctgcggcgagctgctggagagacccggcaccagaagcctggccgacctgatcctggaccagtgccccgacagaggcgcccccgtgccccagatgctggcccagccccagagactgctgttcatcctggacggcgccgacgagctgcccgccctgggcggccccgaggccgccccctgcaccgaccccttcgaggccgccagcggcgccagagtgctgggcggcctgctgagcaaggccctgctgcccaccgccctgctgctggtgaccaccagagccgccgcccccggcagactgcagggcagactgtgcagcccccagtgcgccgaggtgagaggcttcagcgacaaggacaagaagaagtacttctacaagtacttcagagacgagagaagagccgagagagcctacagattcgtgaaggagaacgagaccctgttcgccctgtgcttcgtgcccttcgtgtgctggatcgtgtgcaccgtgctgagacagcagctggagctgggcagagacctgagcagaaccagcaagaccaccaccagcgtgtacctgctgttcatcaccagcgtgctgagcagcgcccccgtggccgacggccccagactgcagggcgacctgagaaacctgtgcagactggccagagagggcgtgctgggcagaagagcccagttcgccgagaaggagctggagcagctggagctgagaggcagcaaggtgcagaccctgttcctgagcaagaaggagctgcccggcgtgctggagaccgaggtgacctaccagttcatcgaccagagcttccaggagttcctggccgccctgagctacctgctggaggacggcggcgtgcccagaaccgccgccggcggcgtgggcaccctgctgagaggcgacgcccagccccacagccacctggtgctgaccaccagattcctgttcggcctgctgagcgccgagagaatgagagacatcgagagacacttcggctgcatggtgagcgagagagtgaagcaggaggccctgagatgggtgcagggccagggccagggctgccccggcgtggcccccgaggtgaccgagggcgccaagggcctggaggacaccgaggagcccgaggaggaggaggagggcgaggagcccaactaccccctggagctgctgtactgcctgtacgagacccaggaggacgccttcgtgagacaggccctgtgcagattccccgagctggccctgcagagagtgagattctgcagaatggacgtggccgtgctgagctactgcgtgagatgctgccccgccggccaggccctgagactgatcagctgcagactggtggccgcccaggagaagaagaagaagagcctgggcaagagactgcaggccagcctgggcggcggcagcagccagggcaccaccaagcagctgcccgccagcctgctgcaccccctgttccaggccatgaccgaccccctgtgccacctgagcagcctgaccctgagccactgcaagctgcccgacgccgtgtgcagagacctgagcgaggccctgagagccgcccccgccctgaccgagctgggcctgctgcacaacagactgagcgaggccggcctgagaatgctgagcgagggcctggcctggccccagtgcagagtgcagaccgtgagagtgcagctgcccgacccccagagaggcctgcagtacctggtgggcatgctgagacagagccccgccctgaccaccctggacctgagcggctgccagctgcccgcccccatggtgacctacctgtgcgccgtgctgcagcaccagggctgcggcctgcagaccctgagcctggccagcgtggagctgagcgagcagagcctgcaggagctgcaggccgtgaagagagccaagcccgacctggtgatcacccaccccgccctggacggccacccccagccccccaaggagctgatcagcaccttctag

SEQ ID NO: 13179 - DNA, 240 bp, Artificial Sequence
  Description of Artificial Sequence: Synthetic coding sequence
atgagccagagcggcgccgtgagctgctgccccggcgccaccaacggcagcctgggcagaagcgacggcgtggccaagatgagccccaaggacctgttcgagcagagaaagaagtacagcaacagcaacgtgatcatgcacgagaccagccagtaccacgtgcagcacctggccaccttcatcatggacaagagcgaggccatcaccagcgtggacgacgccatcagaaagctggtgtag

SEQ ID NO: 13180 - DNA, 543 bp, Artificial Sequence
  Description of Artificial Sequence: Synthetic coding sequence
atgggcgacaagaagagccccaccagacccaagagacagcccaagcccagcagcgacgagggctactgggactgcagcgtgtgcaccttcagaaacagcgccgaggccttcaagtgcatgatgtgcgacgtgagaaagggcaccagcaccagaaagcccagacccgtgagccagctggtggcccagcaggtgacccagcagttcgtgccccccacccagagcaagaaggagaagaaggacaaggtggagaaggagaagagcgagaaggagaccaccagcaagaagaacagccacaagaagaccagacccagactgaagaacgtggacagaagcagcgcccagcacctggaggtgaccgtgggcgacctgaccgtgatcatcaccgacttcaaggagaagaccaagagcccccccgccagcagcgccgccagcgccgaccagcacagccagagcggcagcagcagcgacaacaccgagagaggcatgagcagaagcagcagccccagaggcgaggccagcagcctgaacggcgagagccactag

SEQ ID NO: 13181 - DNA, 2196 bp, Artificial Sequence
  Description of Artificial Sequence: Synthetic coding sequence
atgggcagcggcgaggagcccggccagagcggcgccagcctgagaaccggccccatggtgcagggcagaggcatcatgaccaccggcagcggccaggagcccggccagagcggcaccagcctgagaaccggccccatgggcagcctgggccaggccgagcaggtgagcagcatgcccatgggcagcctggagcacgagggcctggtgagcctgagacccgtgggcctgcaggagcaggagggccccatgagcctgggccccgtgggcagcgccggccccgtggagaccagcaagggcctgctgggccaggagggcctggtggagatcgccatggacagccccgagcaggagggcctggtgggccccatggagatcaccatgggcagcctggagaaggccggccccgtgagccccggctgcgtgaagctggccggccaggagggcctggtggagatggtgctgctgatggagcccggcgccatgagattcctgcagctgtaccacgaggacctgctggccggcctgggcgacgtggccctgctgcccctggagggccccgacatgaccggcttcagactgtgcggcgcccaggccagctgccaggccgccgaggagttcctgagaagcctgctgggcagcatcagctgccacgtgctgtgcctggagcaccccggcagcgccagattcctgctgggccccgagggccagcacctgctgcagggcctggaggcccagttccagtgcgtgttcggcaccgagagactggccaccgccaccctggacaccggcctggaggaggtggaccccaccgaggccctgcccgtgctgcccggcaacgcccacaccctgtggacccccgacagcaccggcggcgaccaggaggacgtgagcctggaggaggtgagagagctgctggccaccctggagggcctggacctggacggcgaggactggctgcccagagagctggaggaggagggcccccaggagcagcccgaggaggaggtgacccccggccacgaggaggaggagcccgtggcccccagcaccgtggcccccagatggctggaggaggaggccgccctgcagctggccctgcacagaagcctggagccccagggccaggtggccgagcaggaggaggccgccgccctgagacaggccctgaccctgagcctgctggagcagccccccctggaggccgaggagccccccgacggcggcaccgacggcaaggcccagctggtggtgcacagcgccttcgagcaggacgtggaggagctggacagagccctgagagccgccctggaggtgcacgtgcaggaggagaccgtgggcccctggagaagaaccctgcccgccgagctgagagccagactggagagatgccacggcgtgagcgtggccctgagaggcgactgcaccatcctgagaggcttcggcgcccaccccgccagagccgccagacacctggtggccctgctggccggcccctgggaccagagcctggccttccccctggccgccagcggccccaccctggccggccagaccctgaagggcccctggaacaacctggagagactggccgagaacaccggcgagttccaggaggtggtgagagccttctacgacaccctggacgccgccagaagcagcatcagagtggtgagagtggagagagtgagccaccccctgctgcagcagcagtacgagctgtacagagagagactgctgcagagatgcgagagaagacccgtggagcaggtgctgtaccacggcaccaccgcccccgccgtgcccgacatctgcgcccacggcttcaacagaagcttctgcggcagaaacgccaccgtgtacggcaagggcgtgtacttcgccagaagagccagcctgagcgtgcaggacagatacagcccccccaacgccgacggccacaaggccgtgttcgtggccagagtgctgaccggcgactacggccagggcagaagaggcctgagagccccccccctgagaggccccggccacgtgctgctgagatacgacagcgccgtggactgcatctgccagcccagcatcttcgtgatcttccacgacacccaggccctgcccacccacctgatcacctgcgagcacgtgcccagagccagccccgacgaccccagcggcctgcccggcagaagccccgacacctag

SEQ ID NO: 13182 - DNA, 1083 bp, Artificial Sequence
  Description of Artificial Sequence: Synthetic coding sequence
atgcaggtgtacgagggcctggacatcatcaccaacaaggtgagcgcccaggagcagagaatctgcagacaccacatgatcagcttcgtggaccccctggtgaccaactacaccgtggtggacttcagaaacagagccaccgccctgatctacctgcccgagaccaagttcctgctgctgtgggaggagcccatcatcaccctgaacctgtgcagcggcaagttcctgagcatccccagaagcctgcaggtgttcgaggagaccggcatcagccacagcgagttcctgcacagacagcacaccgaggagggcggcggccccctgggcggccccctgaagttcagcaacccctgcatcctgtggctgcacgccgaccaggccgtgctggacgagagactggacaagagagtggacgacatgctggccgccggcctgctggaggagctgagagacttccacagaagatacaaccagaagaacgtgagcgagaacagccaggactaccagcacggcatcttccagagcatcggcttcaaggagttccacgagtacctgatcaccgagggcaagtgcaccctggagaccagcaaccagctgctgaagaagggcatcgaggccctgaagcaggtgaccaagagatacgccagaaagcagaacagatgggtgaagaacagattcctgagcagacccggccccatcgtgccccccgtgtacggcctggaggtgagcgacgtgagcaagtgggaggagagcgtgctggagcccgccctggagatcgtgcagagcttcatccagggccacaagcccaccgccacccccatcaagatgccctacaacgaggccgagaacaagagaagctaccacctgtgcgacctgtgcgacagaatcatcatcggcgacagagagtgggccgcccacatcaagagcaagagccacctgaaccagctgaagaagagaagaagactggacagcgacgccgtgaacaccatcgagagccagagcgtgagccccgaccacaacaaggagcccaaggagaagggcagccccggccagaacgaccaggagctgaagtgcagcgtgtag

SEQ ID NO: 13183 - DNA, 828 bp, Artificial Sequence; identical to SEQ ID NO: 12370
  Description of Artificial Sequence: Synthetic coding sequence

SEQ ID NO: 13184 - DNA, 1692 bp, Artificial Sequence
  Description of Artificial Sequence: Synthetic coding sequence
atggagaccgccaagcagaaggccctggaggtggccaacagactgtaccagaaggacctgagagcccccgacgtggtgatcggcgccgacaccatcgtgaccgtgggcggcctgatcctggagaagcccgtggacaagcaggacgcctacagaatgctgagcagactgagcggcagagagcacagcgtgttcaccggcgtggccatcgtgcactgcagcagcaaggaccaccagctggacaccagagtgagcgagttctacgaggagaccaaggtgaagttcagcgagctgagcgaggagctgctgtgggagtacgtgcacagcggcgagcccatggacaaggccggcggctacggcatccaggccctgggcggcatgctggtggagagcgtgcacggcgacttcctgaacgtggtgggcttccccctgaaccacttctgcaagcagctggtgaagctgtactacccccccagacccgaggacctgagaagaagcgtgaagcacgacagcatccccgccgccgacaccttcgaggacctgagcgacgtggagggcggcggcagcgagcccacccagagagacgccggcagcagagacgagaaggccgaggccggcgaggccggccaggccaccgccgaggccgagtgccacagaaccagagagaccctgccccccttccccaccagactgctggagctgatcgagggcttcatgctgagcaagggcctgctgaccgcctgcaagctgaaggtgttcgacctgctgaaggacgaggccccccagaaggccgccgacatcgccagcaaggtggacgccagcgcctgcggcatggagagactgctggacatctgcgccgccatgggcctgctggagaagaccgagcagggctacagcaacaccgagaccgccaacgtgtacctggccagcgacggcgagtacagcctgcacggcttcatcatgcacaacaacgacctgacctggaacctgttcacctacctggagttcgccatcagagagggcaccaaccagcaccacagagccctgggcaagaaggccgaggacctgttccaggacgcctactaccagagccccgagaccagactgagattcatgagagccatgcacggcatgaccaagctgaccgcctgccaggtggccaccgccttcaacctgagcagattcagcagcgcctgcgacgtgggcggctgcaccggcgccctggccagagagctggccagagagtaccccagaatgcaggtgaccgtgttcgacctgcccgacatcatcgagctggccgcccacttccagccccccggcccccaggccgtgcagatccacttcgccgccggcgacttcttcagagaccccctgcccagcgccgagctgtacgtgctgtgcagaatcctgcacgactggcccgacgacaaggtgcacaagctgctgagcagagtggccgagagctgcaagcccggcgccggcctgctgctggtggagaccctgctggacgaggagaagagagtggcccagagagccctgatgcagagcctgaacatgctggtgcagaccgagggcaaggagagaagcctgggcgagtaccagtgcctgctggagctgcacggcttccaccaggtgcaggtggtgcacctgggcggcgtgctggacgccatcctggccaccaaggtggccccctag

SEQ ID NO: 13185 - DNA, 828 bp, Artificial Sequence; identical to SEQ ID NO: 12370
  Description of Artificial Sequence: Synthetic coding sequence

SEQ ID NO: 13186 - DNA, 999 bp, Artificial Sequence
  Description of Artificial Sequence: Synthetic coding sequence
atggagtacctgggcggcggcagcgccctggacctgctgaagcccggccccctggaggagacctacatcgccaccatcctgagagagatcctgaagggcctggactacctgcacagcgagagaaagatccacagagacatcaaggccgccaacgtgctgctgagcgagcagggcgacgtgaagctggccgacttcggcgtggccggccagctgaccgacacccagatcaagagaaacaccttcgtgggcacccccttctggatggcccccgaggtgatcaagcagagcgcctacgacttcaaggccgacatctggagcctgggcatcaccgccatcgagctggccaagggcgagccccccaacagcgacctgcaccccatgagagtgctgttcctgatccccaagaacagcccccccaccctggagggccagcacagcaagcccttcaaggagttcgtggaggcctgcctgaacaaggaccccagattcagacccaccgccaaggagctgctgaagcacaagttcatcaccagatacaccaagaagaccagcttcctgaccgagctgatcgacagatacaagagatggaagagcgagggccacggcgaggagagcagcagcgaggacagcgacatcgacggcgaggccgaggacggcgagcagggccccatctggaccttcccccccaccatcagacccagcccccacagcaagctgcacaagggcaccgccctgcacagcagccagaagcccgccgagcccgtgaagagacagcccagaagccagtgcctgagcaccctggtgagacccgtgttcggcgagctgaaggagaagcacaagcagagcggcggcagcgtgggcgccctggaggagctggagaacgccttcagcctggccgaggagagctgccccggcatcagcgacaagctgatggtgcacctggtggagagagtgcagagattcagccacaacagaaaccacctgaccagcaccagatag

SEQ ID NO: 13187 - DNA, 279 bp, Artificial Sequence
  Description of Artificial Sequence: Synthetic coding sequence
atgaacttcacccccacccacacccccgtgtgcagaaagagaaccgtggtgagcaagagaggcgtggccgtgagcggccccaccaagagaagaggcatggccgacagcctggagagcacccccctgcccagccccgaggacagactggccaagctgcaccccagcaaggagctgctggagtactaccagaagaagatggccgagtgcgaggccgagaacgaggacctgctgaagaagctggagctgtacaaggaggcctgcgagggccagcacaagtag

SEQ ID NO: 13188 - DNA, 429 bp, Artificial Sequence
  Description of Artificial Sequence: Synthetic coding sequence
atggcccagaaggagaacagctacccctggccctacggcagacagaccgcccccagcggcctgagcaccctgccccagagagtgctgagaaaggagcccgtgacccccagcgccctggtgctgatgagcagaagcaacgtgcagcccaccgccgcccccggccagaaggtgatggagaacagcagcggcacccccgacatcctgaccagaagacacttcaccatcgacgacttcgagatcggcagacccctgggcaagggcaagttcggcaacgtgtacctggccagagagaagaagagccacttcatcgtggccctgaaggtgctgttcaagagccagatcgagaaggagggcgtggagcaccagctgagaagagagatcgagatccaggcccacctgcagagctggagaagctggcagatgctgtag

SEQ ID NO: 13189 - DNA, 501 bp, Artificial Sequence
  Description of Artificial Sequence: Synthetic coding sequence
atggaccaggaggacagcgagagcaagaccgtgagcgagcacggcgagagagactggatgaccgccaagaagttctggaagcccggcgacagcctggccccccccgaggtggacttcgacagactgctggccagcctgcaggacctgagcgagctggtggtggagggcgacacccaggtgacccccgtgcccggcggcgccagactgagaaccctggagcccatccccctgaagctgtacagaaacggcatcatgatgttcgacggccccttccagcccttctacgaccccagcacccagagatgcctgagagacatcctggacggcttcttccccagcgagctgcagagactgtaccccaacggcgtgcccttcaaggtgatcagctgcagcagcaaccacaccttcggcgacttcgagggcagcggcgacacccagcccccccagaccccccccatcctgagaggcagcagatgcaccccctggggcacccccgtgtag

SEQ ID NO: 13190 - DNA, 1473 bp, Artificial Sequence
  Description of Artificial Sequence: Synthetic coding sequence
atgcagagcctggacgacgccaccaagcagctggacttcaccagaaagaccctggccgagaagaagcaggagctggacaagctgagaaacgagtgggccagccacaccgccgccctgaccaacaagcacagccaggagctgaccaacgagaaggagaaggccctgcaggcccaggtgcagtaccagcagcagcacgagcagcagaagaaggacctggagatcctgcaccagcagaacatccaccagctgcagaacagactgagcgagctggaggccgccaacaaggacctgaccgagagaaagtacaagggcgacagcaccatcagagagctgaaggccaagctgagcggcgtggaggaggagctgcagagaaccaagcaggaggtgctgagcctgagaagagagaacagcaccctggacgtggagtgccacgagaaggagaagcacgtgaaccagctgcagaccaaggtggccgtgctggagcaggagatcaaggacaaggaccagctggtgctgagaaccaaggaggccttcgacaccatccaggagcagaaggtggtgctggaggagaacggcgagaagaaccaggtgcagctgggcaagctggaggccaccatcaagagcctgagcgccgagctgctgaaggccaacgagatcatcaagaagctgcagggcgacctgaagaccctgatgggcaagctgaagctgaagaacaccgtgaccatccagcaggagaagctgctggccgagaaggaggagaagctgcagaaggagcagaaggagctgcaggacgtgggccagagcctgagaatcaaggagcaggaggtgtgcaagctgcaggagcagctggaggccaccgtgaagaagctggaggagagcaagcagctgctgaagaacaacgagaagctgatcacctggctgaacaaggagctgaacgagaaccagctggtgagaaagcaggacgtgctgggccccagcaccaccccccccgcccacagcagcagcaacaccatcagaagcggcatcagccccaacctgaacgtggtggacggcagactgacctaccccacctgcggcatcggctaccccgtgagcagcgccttcgccttccagaacaccttcccccacagcatcagcgccaagaacaccagccaccccggcagcggcaccaaggtgcagttcaacctgcagttcaccaagcccaacgccagcctgggcgacgtgcagagcggcgccaccatcagcatgccctgcagcaccgacaaggagaacggcgagaacgtgggcctggagagcaagtacctgaagaagagagaggacagcatccccctgagaggcctgagccagaacctgttcagcaacagcgaccaccagagagacggcaccctgggcgccctgcacaccagcagcaagcccaccgccctgcccagcgccagcagcgcctacttccccggccagctgcccaacagctag

SEQ ID NO: 13191 - DNA, 3015 bp, Artificial Sequence
  Description of Artificial Sequence: Synthetic coding sequence
atgctgagaaccgccggcagagacggcctgtgcagactgagcacctacctggaggagctggaggccgtggagctgaagaagttcaagctgtacctgggcaccgccaccgagctgggcgagggcaagatcccctggggcagcatggagaaggccggccccctggagatggcccagctgctgatcacccacttcggccccgaggaggcctggagactggccctgagcaccttcgagagaatcaacagaaaggacctgtgggagagaggccagagagaggacctggtgagagacaccccccccggcggccccagcagcctgggcaaccagagcacctgcctgctggaggtgagcctggtgacccccagaaaggacccccaggagacctacagagactacgtgagaagaaagttcagactgatggaggacagaaacgccagactgggcgagtgcgtgaacctgagccacagatacaccagactgctgctggtgaaggagcacagcaaccccatgcaggtgcagcagcagctgctggacaccggcagaggccacgccagaaccgtgggccaccaggccagccccatcaagatcgagaccctgttcgagcccgacgaggagagacccgagccccccagaaccgtggtgatgcagggcgccgccggcatcggcaagagcatgctggcccacaaggtgatgctggactgggccgacggcaagctgttccagggcagattcgactacctgttctacatcaactgcagagagatgaaccagagcgccaccgagtgcagcatgcaggacctgatcttcagctgctggcccgagcccagcgcccccctgcaggagctgatcagagtgcccgagagactgctgttcatcatcgacggcttcgacgagctgaagcccagcttccacgacccccagggcccctggtgcctgtgctgggaggagaagagacccaccgagctgctgctgaacagcctgatcagaaagaagctgctgcccgagctgagcctgctgatcaccaccagacccaccgccctggagaagctgcacagactgctggagcaccccagacacgtggagatcctgggcttcagcgaggccgagagaaaggagtacttctacaagtacttccacaacgccgagcaggccggccaggtgttcaactacgtgagagacaacgagcccctgttcaccatgtgcttcgtgcccctggtgtgctgggtggtgtgcacctgcctgcagcagcagctggagggcggcggcctgctgagacagaccagcagaaccaccaccgccgtgtacatgctgtacctgctgagcctgatgcagcccaagcccggcgcccccagactgcagcccccccccaaccagagaggcctgtgcagcctggccgccgacggcctgtggaaccagaagatcctgttcgaggagcaggacctgagaaagcacggcctggacggcgaggacgtgagcgccttcctgaacatgaacatcttccagaaggacatcaactgcgagagatactacagcttcatccacctgagcttccaggagttcttcgccgccatgtactacatcctggacgagggcgagggcggcgccggccccgaccaggacgtgaccagactgctgaccgagtacgccttcagcgagagaagcttcctggccctgaccagcagattcctgttcggcctgctgaacgaggagaccagaagccacctggagaagagcctgtgctggaaggtgagcccccacatcaagatggacctgctgcagtggatccagagcaaggcccagagcgacggcagcaccctgcagcagggcagcctggagttcttcagctgcctgtacgagatccaggaggaggagttcatccagcaggccctgagccacttccaggtgatcgtggtgagcaacatcgccagcaagatggagcacatggtgagcagcttctgcctgaagagatgcagaagcgcccaggtgctgcacctgtacggcgccacctacagcgccgacggcgaggacagagccagatgcagcgccggcgcccacaccctgctggtgcagctgcccgagagaaccgtgctgctggacgcctacagcgagcacctggccgccgccctgtgcaccaaccccaacctgatcgagctgagcctgtacagaaacgccctgggcagcagaggcgtgaagctgctgtgccagggcctgagacaccccaactgcaagctgcagaacctgagactgaagagatgcagaatcagcagcagcgcctgcgaggacctgagcgccgccctgatcgccaacaagaacctgaccagaatggacctgagcggcaacggcgtgggcttccccggcatgatgctgctgtgcgagggcctgagacacccccagtgcagactgcagatgatccagctgagaaagtgccagctggagagcggcgcctgccaggagatggccagcgtgctgggcaccaacccccacctggtggagctggacctgaccggcaacgccctggaggacctgggcctgagactgctgtgccagggcctgagacaccccgtgtgcagactgagaaccctgtggctgaagatctgcagactgaccgccgccgcctgcgacgagctggccagcaccctgagcgtgaaccagagcctgagagagctggacctgagcctgaacgagctgggcgacctgggcgtgctgctgctgtgcgagggcctgagacaccccacctgcaagctgcagaccctgagactgggcatctgcagactgggcagcgccgcctgcgagggcctgagcgtggtgctgcaggccaaccacaacctgagagagctggacctgagcttcaacgacctgggcgactggggcctgtggctgctggccgagggcctgcagcaccccgcctgcagactgcagaagctgtggctgttcggcatggacctgaacaagatgacccacagcagactggccgccctgagagtgaccaagccctacctggacatcggctgctag

SEQ ID NO: 13192 - DNA, 2517 bp, Artificial Sequence; identical to SEQ ID NO: 10075
  Description of Artificial Sequence: Synthetic coding sequence

SEQ ID NO: 13193 - DNA, 165 bp, Artificial Sequence
  Description of Artificial Sequence: Synthetic coding sequence
atgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctag

SEQ ID NO: 13194 - DNA, 1269 bp, Artificial Sequence
  Description of Artificial Sequence: Synthetic coding sequence
atggccagcctgagcagagccctgagagtggccgccgcccaccccagacagagccccaccagaggcatgggcccctgcaacctgagcagcgccgccggccccaccgccgagaagagcgtgccctaccagagaaccctgaaggagggccagggcaccagcgtggtggcccagggccccagcagacccctgcccagcaccgccaacgtggtggtgatcggcggcggcagcctgggctgccagaccctgtaccacctggccaagctgggcatgagcggcgccgtgctgctggagagagagagactgaccagcggcaccacctggcacaccgccggcctgctgtggcagctgagacccagcgacgtggaggtggagctgctggcccacaccagaagagtggtgagcagagagctggaggaggagaccggcctgcacaccggctggatccagaacggcggcctgttcatcgccagcaacagacagagactggacgagtacaagagactgatgagcctgggcaaggcctacggcgtggagagccacgtgctgagccccgccgagaccaagaccctgtaccccctgatgaacgtggacgacctgtacggcaccctgtacgtgccccacgacggcaccatggaccccgccggcacctgcaccaccctggccagagccgccagcgccagaggcgcccaggtgatcgagaactgccccgtgaccggcatcagagtgtggaccgacgacttcggcgtgagaagagtggccggcgtggagacccagcacggcagcatccagaccccctgcgtggtgaactgcgccggcgtgtgggccagcgccgtgggcagaatggccggcgtgaaggtgcccctggtggccatgcaccacgcctacgtggtgaccgagagaatcgagggcatccagaacatgcccaacgtgagagaccacgacgccagcgtgtacctgagactgcagggcgacgccctgagcgtgggcggctacgaggccaaccccatcttctgggaggaggtgagcgacaagttcgccttcggcctgttcgacctggactgggaggtgttcacccagcacatcgagggcgccatcaacagagtgcccgtgctggagaagaccggcatcaagagcaccgtgtgcggccccgagagcttcacccccgaccacaagcccctgatgggcgaggcccccgagctgagaggcttcttcctgggctgcggcttcaacagcgccggcgagagcggccaggccctgctggccccctag

SEQ ID NO: 13195 - DNA, 327 bp, Artificial Sequence
  Description of Artificial Sequence: Synthetic coding sequence
atgagcatgctgaagcccagcggcctgaaggcccccaccaagatcctgaagcccggcagcaccgccctgaagacccccaccgccgtggtggcccccgtggagaagaccatcagcagcgagaaggccagcagcacccccagcagcgagacccaggaggagttcgtggacgacttcagagtgggcgagagagtgtgggtgaacggcaacaagcccggcttcatccagttcctgggcgagacccagttcgcccccggccagtgggccggcatcgtgctggacgagcccatcggcaagaacgacggcagcgtggccggcgtgagatactag

SEQ ID NO: 13196 - DNA, 2148 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagcggcagcgagccccccgagctgggctacgtggacatcagaaccctggccgacagcgtgtgcagatacgacctgaacgacatggacgccgcctggctggagctgaccaacgaggagttcaaggagatgggcatgcccgagctggacgagtacaccatggagagagtgctggaggagttcgagcagagatgctacgacaacatgaaccacgccatcgagaccgaggagggcctgggcatcgagtacgacgaggacgtggtgtgcgacgtgtgccagagccccgacggcgaggacggcaacgagatggtgttctgcgacaagtgcaacatctgcgtgcaccaggcctgctacggcatcctgaaggtgcccgagggcagctggctgtgcagaacctgcgccctgggcgtgcagcccaagtgcctgctgtgccccaagaagggcggcgccatgaagcccaccagaagcggcaccaagtgggtgcacgtgagctgcgccctgtggatccccgaggtgagcatcggcagccccgagaagatggagcccatcaccaaggtgagccacatccccagcagcagatgggccctggtgtgcagcctgtgcaacgagaagttcggcgccagcatccagtgcagcgtgaagaactgcagaaccgccttccacgtgacctgcgccttcgacagaggcctggagatgaagaccatcctggccgagaacgacgaggtgaagttcaagagctactgccccaagcacagcagccacagaaagcccgaggagagcctgggcaagggcgccgcccaggagaacggcgcccccgagtgcagccccagaaaccccctggagcccttcgccagcctggagcagaacagagaggaggcccacagagtgagcgtgagaaagcagaagctgcagcagctggaggacgagttctacaccttcgtgaacctgctggacgtggccagagccctgagactgcccgaggaggtggtggacttcctgtaccagtactggaagctgaagagaaaggtgaacttcaacaagcccctgatcacccccaagaaggacgaggaggacaacctggccaagagagagcaggacgtgctgttcagaagactgcagctgttcacccacctgagacaggacctggagagagtgagaaacctgacctacatggtgaccagaagagagaagatcaagagaagcgtgtgcaaggtgcaggagcagatcttcaacctgtacaccaagctgctggagcaggagagagtgagcggcgtgcccagcagctgcagcagcagcagcctggagaacatgctgctgttcaacagccccagcgtgggccccgacgcccccaagatcgaggacctgaagtggcacagcgccttcttcagaaagcagatgggcaccagcctggtgcacagcctgaagaagccccacaagagagaccccctgcagaacagccccggcagcgagggcaagaccctgctgaagcagcccgacctgtgcggcagaagagagggcatggtggtgcccgagagcttcctgggcctggagaagaccttcgccgaggccagactgatcagcgcccagcagaagaacggcgtggtgatgcccgaccacggcaagagaagagacaacagattccactgcgacctgatcaagggcgacctgaaggacaagagcttcaagcagagccacaagcccctgagaagcaccgacgtgagccagagacacctggacaacaccagagccgccgccatctggagattcagagtgatctggcagggccccgccgcctag

SEQ ID NO: 13197 - DNA, 162 bp, Artificial Sequence
  Description of Artificial Sequence: Synthetic coding sequence
atgggcagaagaagcaccagcagcaccaagagcggcaagttcatgaaccccaccgaccaggccagaaaggaggccagaaagagagagctgaagaagaacaagaagcagagaatgatggtgagagccgccgtgctgaagatgaaggaccccaagcagatctag

SEQ ID NO: 13198 - DNA, 1035 bp, Artificial Sequence
  Description of Artificial Sequence: Synthetic coding sequence
atgaccaccagaagcgtgctggacgtggagaccttcgtggccgacatcctgaagggcgagaacctgagcaagaaggccaaggagaagagagagagcctgatcaagaagatcaaggacgtgaagagcatctacctgcaggagttccaggacaagggcgacgccgaggacggcgaggagtacgacgaccccttcgccggcccccccgacaccatcagcctggccagcgagagatacgacaaggacgacgaggcccccagcgacggcgcccagttcccccccatcgccgcccaggacctgcccttcgtgctgaaggccggctacctggagaagagaagaaaggaccacagcttcctgggcttcgagtggcagaagagatggtgcgccctgagcaagaccgtgttctactactacggcagcgacaaggacaagcagcagaagggcgagttcgccatcgacggctacagcgtgagaatgaacaacaccctgagaaaggacggcaagaaggactgctgcttcgagatcagcgcccccgacaagagaatctaccagttcaccgccgccagccccaaggacgccgaggagtgggtgcagcagctgaagttcgtgctgcaggacatggagagcgacatcatccccgaggactacgacgagagaggcgagctgtacgacgacgtggaccaccccctgcccatcagcaaccccctgaccagcagccagcccatcgacgacgagatctacgaggagctgcccgaggaggaggaggacagcgcccccgtgaaggtggaggagcagagaaagatgagccaggacagcgtgcaccacaccagcggcgacaagagcaccgactacgccaacttctaccagggcctgtgggactgcaccggcgccttcagcgacgagctgagcttcaagagaggcgacgtgatctacatcctgagcaaggagtacaacagatacggctggtgggtgggcgagatgaagggcgccatcggcctggtgcccaaggcctacatcatggagatgtacgacatctag

SEQ ID NO: 13199 - DNA, 2868 bp, Artificial Sequence; identical to SEQ ID NO: 11317
  Description of Artificial Sequence: Synthetic coding sequence

SEQ ID NO: 13200 - DNA, 834 bp, Artificial Sequence
  Description of Artificial Sequence: Synthetic coding sequence
atgctgagccagaaggaggtggccgtggccgacgccaagaagagcctggagctgaaccccaacaacagcaccgccatgctgagaaagggcatctgcgagtaccacgagaagaactacgccgccgccctggagaccttcaccgagggccagaagctggacagcgccgacgccaacttcagcgtgtggatcaagagatgccaggaggcccagaacggcagcgagagcgaggtgtggacccaccagagcaagatcaagtacgactggtaccagaccgagagccaggtggtgatcaccctgatgatcaagaacgtgcagaagaacgacgtgaacgtggagttcagcgagaaggagctgagcgccctggtgaagctgcccagcggcgaggactacaacctgaagctggagctgctgcaccccatcatccccgagcagagcaccttcaaggtgctgagcaccaagatcgagatcaagctgaagaagcccgaggccgtgagatgggagaagctggagggccagggcgacgtgcccacccccaagcagttcgtggccgacgtgaagaacctgtaccccagcagcagcccctacaccagaaactgggacaagctggtgggcgagatcaaggaggaggagaagaacgagaagctggagggcgacgccgccctgaacagactgttccagcagatctacagcgacggcagcgacgaggtgaagagagccatgaacaagagcttcatggagagcggcggcaccgtgctgagcaccaactggagcgacgtgggcaagagaaaggtggagatcaacccccccgacgacatggagtggaagaagtactag

SEQ ID NO: 13201 - DNA, 807 bp, Artificial Sequence
  Description of Artificial Sequence: Synthetic coding sequence
atgggcagcgccaagagcgtgcccgtgacccccgccagaccccccccccacaacaagcacctggccagagtggccgaccccagaagccccagcgccggcatcctgagaacccccatccaggtggagagcagcccccagcccggcctgcccgccggcgagcagctggagggcctgaagcacgcccaggacagcgaccccagaagccccaccctgggcatcgccagaacccccatgaagaccagcagcggcgacccccccagccccctggtgaagcagctgagcgaggtgttcgagaccgaggacagcaagagcaacctgccccccgagcccgtgctgccccccgaggcccccctgagcagcgagctggacctgcccctgggcacccagctgagcgtggaggagcagatgcccccctggaaccagaccgagttccccagcaagcaggtgttcagcaaggaggaggccagacagcccaccgagacccccgtggccagccagagcagcgacaagcccagcagagaccccgagacccccagaagcagcggcagcatgagaaacagatggaagcccaacagcagcaaggtgctgggcagaagccccctgaccatcctgcaggacgacaacagccccggcaccctgaccctgagacagggcaagagacccagccccctgagcgagaacgtgagcgagctgaaggagggcgccatcctgggcaccggcagactgctgaagaccggcggcagagcctgggagcagggccaggaccacgacaaggagaaccagcacttccccctggtggagagctag

SEQ ID NO: 13202 - DNA, 1140 bp, Artificial Sequence
  Description of Artificial Sequence: Synthetic coding sequence
atggtgttcaagctgaagaccaaggaggagcagcacagcatgctgggcagcggcttcaaggccgagagactgagagtgaacctgagactggtgatcaacagactgaagctgctggagaagaagaagaccgagctggcccagaaggccagaaaggagatcgccgactacctggccgccggcaaggacgagagagccagaatcagagtggagcacatcatcagagaggactacctggtggaggccatggagatcctggagctgtactgcgacctgctgctggccagattcggcctgatccagagcatgaaggagctggacagcggcctggccgagagcgtgagcaccctgatctgggccgcccccagactgcagagcgaggtggccgagctgaagatcgtggccgaccagctgtgcgccaagtacagcaaggagtacggcaagctgtgcagaaccaaccagatcggcaccgtgaacgacagactgatgcacaagctgagcgtggaggccccccccaagatcctggtggagagatacctgatcgagatcgccaagaactacaacgtgccctacgagcccgacagcgtggtgatggccgaggccccccccggcgtggagaccgacctgatcgacgtgggcttcaccgacgacgtgaagaagggcggccccggcagaggcggcagcggcggcttcaccgcccccgtgggcggccccgacggcaccgtgcccatgcccatgcccatgcccatgcccatgcccagcgccaacacccccttcagctaccccctgcccaagggccccagcgacttcaacggcctgcccatgggcacctaccaggccttccccaacatccaccccccccagatccccgccaccccccccagctacgagagcgtggacgacatcaacgccgacaagaacatcagcagcgcccagatcgtgggccccggccccaagcccgaggccagcgccaagctgcccagcagacccgccgacaactacgacaacttcgtgctgcccgagctgcccagcgtgcccgacaccctgcccaccgccagcgccggcgccagcaccagcgccagcgaggacatcgacttcgacgacctgagcagaagattcgaggagctgaagaagaagacctag

SEQ ID NO: 13203 - DNA, 903 bp, Artificial Sequence
  Description of Artificial Sequence: Synthetic coding sequence
atggccagacccctgagcacccccagcagcagccagatgcaggccagaaagaagcacagaggcatcatcgagaagagaagaagagacagaatcaacagcagcctgagcgagctgagaagactggtgcccaccgccttcgagaagcagggcagcagcaagctggagaaggccgaggtgctgcagatgaccgtggaccacctgaagatgctgcacgccaccggcggcaccggcttcttcgacgccagagccctggccgtggacttcagaagcatcggcttcagagagtgcctgaccgaggtgatcagatacctgggcgtgctggagggccccagcagcagagccgaccccgtgagaatcagactgctgagccacctgaacagctacgccgccgagatggagcccagccccacccccaccggccccctggccttccccgcctggccctggagcttcttccacagctgccccggcctgcccgccctgagcaaccagctggccatcctgggcagagtgcccagccccgtgctgcccggcgtgagcagccccgcctaccccatccccgccctgagaaccgcccccctgagaagagccaccggcatcatcctgcccgccagaagaaacgtgctgcccagcagaggcgccagcagcaccagaagagccagacccctggagagacccgccacccccgtgcccgtggcccccagcagcagagccgccagaagcagccacatcgcccccctgctgcagagcagcagccccaccccccccggccccaccggcagcgccgcctacgtggccgtgcccacccccaacagcagcagccccggccccgccggcagacccgccggcgccatgctgtaccacagctgggtgagcgagatcaccgagatcggcgccttctag

SEQ ID NO: 13204 - DNA, 318 bp, Artificial Sequence
  Description of Artificial Sequence: Synthetic coding sequence
atgagcgtggtgccccccaacagaagccagaccggctggcccagaggcgtgacccagttcggcaacaagtacatccagcagaccaagcccctgaccctggagagaaccatcaacctgtaccccctgaccaactacaccttcggcaccaaggagcccctgtacgagaaggacagcagcgtggccgccagattccagagaatgagagaggagttcgacaagatcggcatgagaagaaccgtggagggcgtgctgatcgtgcacgagcacagactgccccacgtgctgctgctgagcagattcaacttcatctacaactag

SEQ ID NO: 13205 - DNA, 588 bp, Artificial Sequence
  Description of Artificial Sequence: Synthetic coding sequence
atgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctacaagagcagaagcctggccagaagctgcctgagccacttcaagagcaaccagccctacgccagcagactgggcggccccacctgcaaggtgagcagaggcgtggcctacagcacccacagaaccaacgcccccggcaaggacttccagggcatcagcgccgccttcagcaccgagaacggcttccacagcgtgggccacgagctggccgacaaccacatcaccagcagagactgcaacggccacctgctgaactgctacggcagaaacgagagcatcgccagcaccccccccggcgaggacagaaagagccccagagtgctgatcaagaccctgggcaagctggacggctgcctgagagtggagttccacaacggcggcaaccccagcaaggtgcccgccgaggactgcagcgagcccgtgtag

SEQ ID NO: 13206 - DNA, 1581 bp, Artificial Sequence
  Description of Artificial Sequence: Synthetic coding sequence
atggtgcccggcgaggagaaccagctggtgcccaaggaggacgtgttctggagatgcagacagaacatcttcgacgagatgaagaagaagttcctgcagatcgagaacgccgccgaggagcccagagtgctgtgcatcatccaggacaccaccaacagcaagaccgtgaacgagagaatcaccctgaacctgcccgccagcacccccgtgagaaagctgttcgaggacgtggccaacaaggtgggctacatcaacggcaccttcgacctggtgtggggcaacggcatcaacaccgccgacatggcccccctggaccacaccagcgacaagagcctgctggacgccaacttcgagcccggcaagaagaacttcctgcacctgaccgacaaggacggcgagcagccccagatcctgctggaggacagcagcgccggcgaggacagcgtgcacgacagattcatcggccccctgcccagagagggcagcggcggcagcaccagcgactacgtgagccagagctacagctacagcagcatcctgaacaagagcgagaccggctacgtgggcctggtgaaccaggccatgacctgctacctgaacagcctgctgcagaccctgttcatgacccccgagttcagaaacgccctgtacaagtgggagttcgaggagagcgaggaggaccccgtgaccagcatcccctaccagctgcagagactgttcgtgctgctgcagaccagcaagaagagagccatcgagaccaccgacgtgaccagaagcttcggctgggacagcagcgaggcctggcagcagcacgacgtgcaggagctgtgcagagtgatgttcgacgccctggagcagaagtggaagcagaccgagcaggccgacctgatcaacgagctgtaccagggcaagctgaaggactacgtgagatgcctggagtgcggctacgagggctggagaatcgacacctacctggacatccccctggtgatcagaccctacggcagcagccaggccttcgccagcgtggaggaggccctgcacgccttcatccagcccgagatcctggacggccccaaccagtacttctgcgagagatgcaagaagaagtgcgacgccagaaagggcctgagattcctgcacttcccctacctgctgaccctgcagctgaagagattcgacttcgactacaccaccatgcacagaatcaagctgaacgacagaatgaccttccccgaggagctggacatgagcaccttcatcgacgtggaggacgagaagagcccccagaccgagagctgcaccgacagcggcgccgagaacgagggcagctgccacagcgaccagatgagcaacgacttcagcaacgacgacggcgtggacgagggcatctgcctggagaccaacagcggcaccgagaagatcagcaagagcggcctggagaagaacagcctgatctacgagctgttcagcgtgatggtgcacagcggcagcgccgccggcggccactactacgcctgcatcaagagcagcgtgatgagcagcggcaccgccagcatgatcaacatgagcgccggctag

SEQ ID NO: 13207 - DNA, 963 bp, Artificial Sequence
  Description of Artificial Sequence: Synthetic coding sequence
atgggcaaggagcaggagctgctggaggccgccagaaccggccacctgcccgccgtggagaagctgctgagcggcaagagactgagcagcggcttcggcggcggcggcggcggcggcagcggcggcggcggcggcggcagcggcggcggcggcggcggcctgggcagcagcagccaccccctgagcagcctgctgagcatgtggagaggccccaacgtgaactgcgtggacagcaccggctacacccccctgcaccacgccgccctgaacggccacaaggacgtggtggaggtgctgctgagaaacgacgccctgaccaacgtggccgacagcaagggctgctaccccctgcacctggccgcctggaagggcgacgcccagatcgtgagactgctgatccaccagggccccagccacaccagagtgaacgagcagaacaacgacaacgagaccgccctgcactgcgccgcccagtacggccacaccgaggtggtgaaggtgctgctggaggagctgaccgaccccaccatgagaaacaacaagttcgagacccccctggacctggccgccctgtacggcagactggaggtggtgaagatgctgctgaacgcccaccccaacctgctgagctgcaacaccaagaagcacacccccctgcacctggccgccagaaacggccacaaggccgtggtgcaggtgctgctggacgccggcatggacagcaactaccagaccgagatgggcagcgccctgcacgaggccgccctgttcggcaagaccgacgtggtgcagatcctgctggccgccggcaccgacgtgaacatcaaggacaaccacggcctgaccgccctggacaccgtgagagagctgcccagccagaagagccagcagatcgccgccctgatcgaggacctggacaccctgcagttctacttcatcagctgccccttccagggcctgtag

SEQ ID NO: 13208 - DNA, 660 bp, Artificial Sequence
  Description of Artificial Sequence: Synthetic coding sequence
atggtgatccacaagaacccccccgacacccccaccgagagccagttcaccagattcctgtgcagcagccccctggaggccgagaccccccccaacggccccgactgcggctacggcagcttccaccagcagtactggctggacggcaagatcatcgccgtgggcgtgatcgacatcctgcccaactgcgtgagcagcgtgtacctgtactacgaccccgactacagcttcctgagcctgggcgtgtacagcgccctgagagagatcgccttcaccagacagctgcacgagaagaccagccagctgagctactactacatgggcttctacatccacagctgccccaagatgaagtacaagggccagtacagacccagcgacctgctgtgccccgagacctacgtgtgggtgcccatcgagcagtgcctgcccagcctggagaacagcaagtactgcagattcaaccaggaccccgaggccgtggacgaggacagaagcaccgagcccgacagactgcaggtgttccacaagagagccatcatgccctacggcgtgtacaagaagcagcagaaggaccccagcgaggaggccgccgtgctgcagtacgccagcctggtgggccagaagtgcagcgagagaatgctgctgttcagaaactag

SEQ ID NO: 13209 - DNA, 1791 bp, Artificial Sequence
  Description of Artificial Sequence: Synthetic coding sequence
atgcagcagaaggagctgggcaccttcgcccagagcagcatcgccctgcaccaccagtacaaccccaagttccagaccctgttccagccctgcaacctgatgggcgccatgcagctgatcgaggacttcagcacccacgtgagcatcgactgcagcccccacaagaccgtgaagaagaccgccaacgagttcccctgcctgcccaagcaggtggcctggatcctggccaccagcaaggtgttcatgtaccccgagctgctgcccgtgtgcagcctgaaggccaagaacccccaggacaagatcctgttcaccaaggccgaggacaacaagtacctgctgacctgcaagaccgccagacagctgaccgtgagaatcaagaacctgaacatgaacagagcccccgacaacatcatcaagttctacaagaagaccaagcagctgcccgtgctgggcaagtgctgcgaggagatccagccccaccagtggaagccccccatcgagagagaggagcacagactgcccttctggctgaaggccagcctgcccagcatccaggaggagctgagacacatggccgacggcgccagagaggtgggcaacatgaccggcaccaccgagatcaacagcgaccagggcctggagaaggacaacagcgagctgggcagcgagaccagataccccctgctgctgcccaagggcgtggtgctgaagctgaagcccgtggccgacagattccccaagaaggcctggagacagaagagaagcagcgtgctgaagcccctgctgatccagcccagccccagcctgcagcccagcttcaaccccggcaagacccccgcccagagcacccacagcgaggccccccccagcaagatggtgctgagaatcccccaccccatccagcccgccaccgtgctgcagaccgtgcccggcgtgccccccctgggcgtgagcggcggcgagagcttcgagagccccgccgccctgcccgccatgccccccgaggccagaaccagcttccccctgagcgagagccagaccctgctgagcagcgcccccgtgcccaaggtgatgatgcccagccccgccagcagcatgttcagaaagccctacgtgagaagaagacccagcaagagaagaggcgccagagccttcagatgcatcaagcccgcccccgtgatccaccccgccagcgtgatcttcaccgtgcccgccaccaccgtgaagatcgtgagcctgggcggcggctgcaacatgatccagcccgtgaacgccgccgtggcccagagcccccagaccatccccatcgccaccctgctggtgaaccccaccagcttcccctgccccctgaaccagcccctggtggccagcagcgtgagccccctgatcgtgagcggcaacagcgtgaacctgcccatccccagcacccccgaggacaaggcccacatgaacgtggacatcgcctgcgccgtggccgacggcgagaacgccttccagggcctggagcccaagctggagccccaggagctgagccccctgagcgccaccgtgttccccaaggtggagcacagccccggccccccccccgtggacaagcagtgccaggagggcctgagcgagaacagcgcctacagatggaccgtggtgaagaccgaggagggcagacaggccctggagcccctgccccagggcatccaggagagcctgaacaacagcagccccggcgacctggaggaggtggtgaagatggagcccgaggacgccaccgaggagatcagcggcttcctgtag

SEQ ID NO: 13210 - DNA, 912 bp, Artificial Sequence
  Description of Artificial Sequence: Synthetic coding sequence
atggccgacaagagcaagttcatcgagtacatcgacgaggccctggagaagagcaaggagaccgccctgagccacctgttcttcacctaccagggcatcccctaccccatcaccatgtgcaccagcgagaccttccaggccctggacaccttcgaggccagacacgacgacatcgtgctggccagctaccccaagtgcggcagcaactggatcctgcacatcgtgagcgagctgatctacgccgtgagcaagaagaagtacaagtaccccgagttccccgtgctggagtgcggcgacagcgagaagtaccagagaatgaagggcttccccagccccagaatcctggccacccacctgcactacgacaagctgcccggcagcatcttcgagaacaaggccaagatcctggtgatcttcagaaaccccaaggacaccgccgtgagcttcctgcacttccacaacgacgtgcccgacatccccagctacggcagctgggacgagttcttcagacagttcatgaagggccaggtgagctggggcagatacttcgacttcgccatcaactggaacaagcacctggacggcgacaacgtgaagttcatcctgtacgaggacctgaaggagaacctggccgccggcatcaagcagatcgccgagttcctgggcttcttcctgaccggcgagcagatccagaccatcagcgtgcagagcaccttccaggccatgagagccaagagccaggacacccacggcgccgtgggccccttcctgttcagaaagggcgaggtgggcgactggaagaacctgttcagcgagatccagaaccaggagatggacgagaagttcaaggagtgcctggccggcaccagcctgggcgccaagctgaagtacgagagctactgccagggctag

SEQ ID NO: 13211 - DNA, 366 bp, Artificial Sequence
  Description of Artificial Sequence: Synthetic coding sequence
atgggcgtgcccgagatccccggcgagaagctggtgaccgagagaaacaagaagagactggagaaggagaagcacgagaagggcgcccagaagaccgactgccagaagaacctgggcaccgtgggcgccgtggccctggactgcaagggcaacgtggcctacgccaccagcaccggcggcatcgtgaacaagatggtgggcagagtgggcgacagcccctgcctgggcagaaccaagggctgcctgctgcccctgcccctgttcagcagaccccaggccttcctgaccctgtacagcctgcccctgagcgtgagctgctgcgtgcccttcctgctgctggtgcagctgcaggacgtgtgggagtag

SEQ ID NO: 13212 - DNA, 579 bp, Artificial Sequence
  Description of Artificial Sequence: Synthetic coding sequence
atgaccctgggcagcaagagccagcagccccccgaggacatcaaggccctgagctggaacagacaggcccagcacatcctgagcagcgcccaccccagcggcaaggccgtggtgtgggacctgagaaagaacgagcccatcatcaaggtgagcgaccacagcaacagaatgcactgcagcggcctggcctggcaccccgacatcgccacccagctggtgctgtgcagcgaggacgacagactgcccgtgatccagctgtgggacctgagattcgccagcagccccctgaaggtgctggagagccacagcagaggcatcctgagcgtgagctggagccaggccgacgccgagctgctgctgaccagcgccaaggacagccagatcctgtgcagaaacctgggcagcagcgaggtggtgtacaagctgcccacccagagcagctggtgcttcgacgtgcagtggtgccccagagaccccagcgtgttcagcgccgccagcttcaacggctggatcagcctgtacagcgtgatgggcagaagctgggaggtgcagcacatgagacaggccgacaaggtgtag

SEQ ID NO: 13213 - DNA, 621 bp, Artificial Sequence
  Description of Artificial Sequence: Synthetic coding sequence
atgaaggacgtggacaacctgaagagcatcaaggaggagtgggtgtgcgagaccggcagcgacaaccagcccctgggcaacaaccagcagagcaactgcgagtacttcgtggacagcctgttcgaggaggcccagaaggtgagcagcaagtgcgtgagccccgccgagcagaagaagcaggtggacgtgaacatcaagctgtggaagaacggcttcaccgtgaacgacgacttcagaagctacagcgacggcgccagccagcagttcctgaacagcatcaagaagggcgagctgcccagcgagctgcagggcatcttcgacaaggaggaggtggacgtgaaggtggaggacaagaagaacgagatctgcctgagcaccaagcccgtgttccagcccttcagcggccagggccacagactgggcagagtgagccacatcaaggacttcatcgagaagtaccagggcagccagagaagcccccccttcagcctggccaccgccctgcccgtgctgagactgctggacgagaccctgaccctggaggaggccgacctgcagaacgccgtgatcatccagagactgcagaagaccgccagcttcagagagctgagcgagcactag

SEQ ID NO: 13214 - DNA, 1359 bp, Artificial Sequence
  Description of Artificial Sequence: Synthetic coding sequence
atgagaggctgcagctacggcctgtgcagaagaggcctgctgttctgcgtgatcctggacgaccagagcggcaagaagagcgtgaacgacaagaacctgaagaagaccgtggaggacgaggaccaggacagcgaggaggagaaggacaacgacagctacatcaaggagagaagcgacatccccagcggcaccagcaagcacctgcagaagaaggccaagaagcaggccaagaagcaggccaagaaccagagaagacagcagaagatccagggcaaggtgctgcacctgaacgacatctgcaccatcgaccaccccgaggacagcgagtacgaggccgagatgagcctgcagggcgaggtgaacatcaagagcaaccacatcagccaggagggcgtgatgcacaaggagtactgcgtgaaccagaaggacctgaacggccaggccaagatgatcgagagcgtgaccgacaaccagaagagcaccgaggaggtggacatgaagaacatcaacatggacaacgacctggaggtgctgaccagcagccccaccagaaacctgaacggcgcctacctgaccgagggcagcaacggcgaggtggacatcagcaacggcttcaagaacctgaacctgaacgccgccctgcaccccgacgagatcaacatcgagatcctgaacgacagccacacccccggcaccaaggtgtacgaggtggtgaacgaggaccccgagaccgccttctgcaccctggccaacagagaggtgttcaacaccgacgagtgcagcatccagcactgcctgtaccagttcaccagaaacgagaagctgagagacgccaacaagctgctgtgcgaggtgtgcaccagaagacagtgcaacggccccaaggccaacatcaagggcgagagaaagcacgtgtacaccaacgccaagaagcagatgctgatcagcctggccccccccgtgctgaccctgcacctgaagagattccagcaggccggcttcaacctgagaaaggtgaacaagcacatcaagttccccgagatcctggacctggcccccttctgcaccctgaagtgcaagaacgtggccgaggagaacaccagagtgctgtacagcctgtacggcgtggtggagcacagcggcaccatgagaagcggccactacaccgcctacgccaaggccagaaccgccaacagccacctgagcaacctggtgctgcacggcgacatcccccaggacttcgagatggagagcaagggccagtggttccacatcagcgacacccacgtgcaggccgtgcccaccaccaaggtgctgaacagccaggcctacctgctgttctacgagagaatcctgtag

SEQ ID NO: 13215 - DNA, 450 bp, Artificial Sequence
  Description of Artificial Sequence: Synthetic coding sequence
atggagagaatcgagggcgccagcgtgggcagatgcgccgccagcccctacctgagacccctgaccctgcactacagacagaacggcgcccagaagagctgggacttcatgaagacccacgacagcgtgaccgtgctgctgttcaacagcagcagaagaagcctggtgctggtgaagcagttcagacccgccgtgtacgccggcgaggtggagagaagattccccggcagcctggccgccgtggaccaggacggccccagagagctgcagcccgccctgcccggcagcgccggcgtgaccgtggagctgtgcgccggcctggtggaccagcccggcctgagcctggaggaggtggcctgcaaggaggcctgggaggagtgcggctaccacctggcccccagcgacctgagaagagtggccacctactgggacgccaccatgggcagctag

SEQ ID NO: 13216 - DNA, 489 bp, Artificial Sequence
  Description of Artificial Sequence: Synthetic coding sequence
atgaacagcaacgccagcgagcacaccggcatgctgagaacctgctggagccacagccactgggaccccttcagcagcggcagcgtgaccgccatgtgggccacccacagccccaccagcaaggcctgggccggcatccagggcagaggcagatgggccctgggcttcccctggagaggccagggcgtgctgcacgtgatcgccagccagaaggccgccgtgaccgaggccgtggacctgagaaccggcgccgccagccaggccatgagcgaggccttcgtgagaagcggcatgttctacctgagacccgccttcgtgctgctgtgctacaagtggggcaagctgagacacagcgaggtgagcaacctgctgggcgtggcctggcccgtgagcgaggaggcctgcatgggcacctggggcagcctggccgtggccgtgaccctgcccgcccagggcctgggcacctggggcagagacgagggcgagtag

SEQ ID NO: 13217 - DNA, 1320 bp, Artificial Sequence; identical to SEQ ID NO: 11005
  Description of Artificial Sequence: Synthetic coding sequence

SEQ ID NO: 13218 - DNA, 867 bp, Artificial Sequence
  Description of Artificial Sequence: Synthetic coding sequence
atggccaagtggggcgagggcgaccccagatggatcgtggaggagagagccgacgccaccaacgtgaacaactggcactggaccgagagagacgccagcaactggagcaccgacaagctgaagaccctgttcctggccgtgcaggtgcagaacgaggagggcaagtgcgaggtgaccgaggtgagcaagctggacggcgaggccagcatcaacaacagaaagggcaagctgatcttcttctacgagtggagcgtgaagctgaactggaccggcaccagcaagagcggcgtgcagtacaagggccacgtggagatccccaacctgagcgacgagaacagcgtggacgaggtggagatcagcgtgagcctggccaaggacgagcccgacaccaacctggtggccctgatgaaggaggagggcgtgaagctgctgagagaggccatgggcatctacatcagcaccctgaagaccgagttcacccagggcatgatcctgcccaccatgaacggcgagagcgtggaccccgtgggccagcccgccctgaagaccgaggagagaaaggccaagcccgcccccagcaagacccaggccagacccgtgggcgtgaagatccccacctgcaagatcaccctgaaggagaccttcctgaccagccccgaggagctgtacagagtgttcaccacccaggagctggtgcaggccttcacccacgcccccgccaccctggaggccgacagaggcggcaagttccacatggtggacggcaacgtgagcggcgagttcaccgacctggtgcccgagaagcacatcgtgatgaagtggagattcaagagctggcccgagggcagccactgccacagcggctag

SEQ ID NO: 13219 - DNA, 1053 bp, Artificial Sequence
  Description of Artificial Sequence: Synthetic coding sequence
atgcccagcttcatcagacacggccccaccatccccagaagaaccgacatctgcctgcccgacagcagccccaacgccttcagcaccagcggcgacgtggtgagcagaaaccagagcttcctgagaacccccatccagagaaccccccacgagatcatgagaagagagagcaacagactgagcgcccccagctacctggccagaagcctggccgacgtgcccagagagtacggcagcagccagagcttcgtgaccgaggtgagcttcgccgtggagaacggcgacagcggcagcagatactactacagcgacaacttcttcgacggccagagaaagagacccctgggcgacagagcccacgaggactacagatactacgagtacaaccacgacctgttccagagaatgccccagaaccagggcagacacgccagcggcatcggcagagtggccgccaccagcctgggcaacctgaccaaccacggcagcgaggacctgcccctgccccccggctggagcgtggactggaccatgagaggcagaaagtactacatcgaccacaacaccaacaccacccactggagccaccccctggagagagagggcctgccccccggctgggagagagtggagagcagcgagttcggcacctactacgtggaccacaccaacaagaaggcccagtacagacacccctgcgcccccagcgtgcccagatacgaccagcccccccccgtgacctaccagccccagcagaccgagagaaaccagagcctgctggtgcccgccaacccctaccacaccgccgagatccccgactggctgcaggtgtacgccagagcccccgtgaagtacgaccacatcctgaagtgggagctgttccagctggccgacctggacacctaccagggcatgctgaagctgctgttcatgaaggagctggagcagatcgtgaagatgtacgaggcctacagacaggccctgctgaccgagctggagaacagaaagcagagacagcagtggtacgcccagcagcacggcaagaacttctag

SEQ ID NO: 13220 - DNA, 537 bp, Artificial Sequence
  Description of Artificial Sequence: Synthetic coding sequence
atgaccttcagagagggccaccagtgggagaagatccccctgagcggcagcaaccaggagatcagaagacagaaggagagaatcaccgagcagcccctgaaggaggaggaggacgaggacagaaagaacaagggccaccaggccgccgagatcgagtggctgggcttcagaaagcccagccaggccgacatgctgcacagcaagcacgacgaggagcagaaggtgtgggacgaggagatcgacgacgacgacgacgacaactgcaacaacgacgaggacgaggtgagagtgatcgagttcaagaagaagcacgaggaggtgagccagttcaaggaggagggcgacgccagcgaggacagccccctgagcagcgccagcagccaggccgtgacccccgacgagcagcccaccctgggcaagaagagcgacatcagcagaaacgcctacagcagatacaacaccatcagctacagaaagatcagaaagggcaacaccaagcagagaatcgacgagttcgagagcatgatgcacctgtag

SEQ ID NO: 13221 - DNA, 312 bp, Artificial Sequence
  Description of Artificial Sequence: Synthetic coding sequence
atggccgccttcaagctggacttcctgcccgagatgatggtggaccactgcagcctgaacagcagccccgtgagcaagaagatgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagtag

SEQ ID NO: 13222 - DNA, 1917 bp, Artificial Sequence
  Description of Artificial Sequence: Synthetic coding sequence
atgccccccatcaacctgcaggagaagcaggtgatctgcctgagcggcgacgacagcagcacctgcatcggcatcctggccaaggaggtggagatcgtggccagcagcgacagcagcatcagcagcaaggccagaggcagcaacaaggtgaagatccagcccgtggccaagtacgactgggagcagaagtactactacggcaacctgatcgccgtgagcaacagcttcctggcctacgccatcagagccgccaacaacggcagcgccatggtgagagtgatcagcgtgagcaccagcgagagaaccctgctgaagggcttcaccggcagcgtggccgacctggccttcgcccacctgaacagcccccagctggcctgcctggacgaggccggcaacctgttcgtgtggagactggccctggtgaacggcaagatccaggaggagatcctggtgcacatcagacagcccgagggcacccccctgaaccacttcagaagaatcatctggtgccccttcatccccgaggagagcgaggactgctgcgaggagagcagccccaccgtggccctgctgcacgaggacagagccgaggtgtgggacctggacatgctgagaagcagccacagcacctggcccgtggacgtgagccagatcaagcagggcttcatcgtggtgaagggccacagcacctgcctgagcgagggcgccctgagccccgacggcaccgtgctggccaccgccagccacgacggctacgtgaagttctggcagatctacatcgagggccaggacgagcccagatgcctgcacgagtggaagccccacgacggcagacccctgagctgcctgctgttctgcgacaaccacaagaagcaggaccccgacgtgcccttctggagattcctgatcaccggcgccgaccagaacagagagctgaagatgtggtgcaccgtgagctggacctgcctgcagaccatcagattcagccccgacatcttcagcagcgtgagcgtgccccccagcctgaaggtgtgcctggacctgagcgccgagtacctgatcctgagcgacgtgcagagaaaggtgctgtacgtgatggagctgctgcagaaccaggaggagggccacgcctgcttcagcagcatcagcgagttcctgctgacccaccccgtgctgagcttcggcatccaggtggtgagcagatgcagactgagacacaccgaggtgctgcccgccgaggaggagaacgacagcctgggcgccgacggcacccacggcgccggcgccatggagagcgccgccggcgtgctgatcaagctgttctgcgtgcacaccaaggccctgcaggacgtgcagatcagattccagccccagctgaaccccgacgtggtggcccccctgcccacccacaccgcccacgaggacttcaccttcggcgagagcagacccgagctgggcagcgagggcctgggcagcgccgcccacggcagccagcccgacctgagaagaatcgtggagctgcccgcccccgccgacttcctgagcctgagcagcgagaccaagcccaagctgatgacccccgacgccttcatgacccccagcgccagcctgcagcagatcaccgccagccccagcagcagcagcagcggcagcagcagcagcagcagcagcagcagcagcagcctgaccgccgtgagcgccatgagcagcaccagcgccgtggaccccagcctgaccagaccccccgaggagctgaccctgagccccaagctgcagctggacggcagcctgaccatgagcagcagcggcagcctgcaggccagccccagaggcctgctgcccggcctgctgcccgcccccgccgacaagctgacccccaagggccccggccaggtgtgcgactgggtgtgcgtgtag

SEQ ID NO: 13223 - DNA, 495 bp, Artificial Sequence
  Description of Artificial Sequence: Synthetic coding sequence
atgagaatcctgatcctgggcctggacggcgccggcaagaccaccatcctgtacagactgcaggtgggcgaggtggtgaccaccatccccaccatcggcttcaacgtggagaccgtgacctacaagaacctgaagttccaggtgtgggacctgggcggccagaccagcatcagaccctactggagatgctactacagcaacaccgacgccgtgatctacgtggtggacagctgcgacagagacagaatcggcatcagcaagagcgagctggtggccatgctggaggaggaggagctgagaaaggccatcctggtggtgttcgccaacaagcaggacatggagcaggccatgaccagcagcgagatggccaacagcctgggcctgcccgccctgaaggacagaaagtggcagatcttcaagaccagcgccaccaagggcaccggcctggacgaggccatggagtggctggtggagaccctgaagagcagacagtag

SEQ ID NO: 13224 - DNA, 1944 bp, Artificial Sequence
  Description of Artificial Sequence: Synthetic coding sequence
atggcccagggcagcgtgagcttcaacgacgtgaccgtggacttcacccaggaggagtggcagcacctggaccacgcccagaagaccctgtacatggacgtgatgctggagaactactgccacctgatcagcgtgggctgccacatgaccaagcccgacgtgatcctgaagctggagagaggcgaggagccctggaccagcttcgccggccacacctgcctggaggagaactggaaggccgaggacttcctggtgaagttcaaggagcaccaggagaagtacagcagaagcgtggtgagcatcaaccacaagaagctggtgaaggagaagagcaagatctacgagaagaccttcaccctgggcaagaaccccgtgaacagcaagaacctgccccccgagtacgacacccacggcagaatcctgaagaacgtgagcgagctgatcatcagcaacctgaaccccgccagaaagagactgagcgagtacaacggctacggcaagagcctgctgagcaccaagcaggagaccacccaccccgaggtgaagagccacaaccagagcgccagagccttcagccacaacgaggtgctgatgcagtaccagaagaccgagacccccgcccagagcttcggctacaacgactgcgagaagagcttcctgcagagaggcggcctgatcacccacagcagaccctacaagggcgagaaccccagcgtgtacaacaagaagagaagagccaccaacatcgagaagaagcacacctgcaacgagtgcggcaagagcttctgcagaaagagcgtgctgatcctgcaccagggcatccacagcgaggagaagccctaccagtgccaccagtgcggcaacgccttcagaagaaagagctacctgatcgaccaccagagaacccacaccggcgagaagcccttcgtgtgcaacgagtgcggcaagagcttcagactgaagaccgccctgaccgaccaccagagaacccacaccggcgagaagagctacgagtgcctgcagtgcagaaacgccttcagactgaagagccacctgatcagacaccagagaacccacaccggcgagaagccctacgagtgcaacgactgcggcaagagcttcagacagaagaccaccctgagcctgcaccagagaatccacaccggcgagaagccctacatctgcaaggagtgcggcaagagcttccaccagaaggccaacctgaccgtgcaccagagaacccacaccggcgagaagccctacatctgcaacgagtgcggcaagagcttcagccagaagaccaccctggccctgcacgagaagacccacaacgaggagaagccctacatctgcagcgagtgcggcaagagcttcagacagaagaccaccctggtggcccaccagagaacccacaccggcgagaagagctacgagtgcccccactgcggcaaggccttcagaatgaagagctacctgatcgaccaccacagaacccacaccggcgagaagccctacgagtgcaacgagtgcggcaagagcttcagccagaagaccaacctgaacctgcaccagagaatccacaccggcgagaagccctacgtgtgcaacgagtgcggcaagagcttcagacagaaggccaccctgaccgtgcaccagaagatccacaccggccagaagagctacgagtgcccccagtgcggcaaggccttcagcagaaagagctacctgatccaccaccagagaacccacaccggcgagaagccctacaagtgcagcgagtgcggcaagtgcttcagacagaagaccaacctgatcgtgcaccagagaacccacaccggcgagaagccctacgtgtgcaacgagtgcggcaagagcttcagctacaagagaaacctgatcgtgcaccagagaacccacaagggcgagaacatcgagatgcagtag

SEQ ID NO: 13225 - DNA, 3570 bp, Artificial Sequence
  Description of Artificial Sequence: Synthetic coding sequence
atgaagctggagtgcatccccgcccccatcacccccagcaccgtgcccagcttcccccccaccccccccaccccccccgccagccccccccacacccccgtgatcgtgcccgccgccgccaccaccgtgagcagccccagcgccgccatcaccgtgcagagagtgctggaggaggacgagagcatcagaacctgcctgagcgaggacgccaaggagatccagaacaagatcgaggtggaggccgacggccagaccgaggagatcctggacagccagaacctgaacagcagaagaagccccgtgcccgcccagatcgccatcaccgtgcccaagacctggaagaagcccaaggacagaaccagaaccaccgaggagatgctggaggccgagctggagctgaaggccgaggaggagctgagcatcgacaaggtgctggagagcgagcaggacaagatgagccagggcttccaccccgagagagaccccagcgacctgaagaaggtgaaggccgtggaggagaacggcgaggaggccgagcccgtgagaaacggcgccgagagcgtgagcgagggcgagggcatcgacgccaacagcggcagcaccgacagcagcggcgacggcgtgaccttccccttcaagcccgagagctggaagcccaccgacaccgagggcaagaagcagtacgacagagagttcctgctggacttccagttcatgcccgcctgcatccagaagcccgagggcctgccccccatcagcgacgtggtgctggacaagatcaaccagcccaagctgcccatgagaaccctggaccccagaatcctgcccagaggccccgacttcacccccgccttcgccgacttcggcagacagacccccggcggcagaggcgtgcccctgctgaacgtgggcagcagaagaagccagcccggccagagaagagagcccagaaagatcatcaccgtgagcgtgaaggaggacgtgcacctgaagaaggccgagaacgcctggaagcccagccagaagagagacagccaggccgacgaccccgagaacatcaagacccaggagctgttcagaaaggtgagaagcatcctgaacaagctgaccccccagatgttcaaccagctgatgaagcaggtgagcggcctgaccgtggacaccgaggagagactgaagggcgtgatcgacctggtgttcgagaaggccatcgacgagcccagcttcagcgtggcctacgccaacatgtgcagatgcctggtgaccctgaaggtgcccatggccgacaagcccggcaacaccgtgaacttcagaaagctgctgctgaacagatgccagaaggagttcgagaaggacaaggccgacgacgacgtgttcgagaagaagcagaaggagctggaggccgccagcgcccccgaggagagaaccagactgcacgacgagctggaggaggccaaggacaaggccagaagaagaagcatcggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcgtgaaggagagaaagaccagcagcagaatcagattcatgctgcaggacgtgatcgacctgagactgtgcaactgggtgagcagaagagccgaccagggccccaagaccatcgagcagatccacaaggaggccaagatcgaggagcaggaggagcagagaaaggtgcagcagctgatgaccaaggagaagagaagacccggcgtgcagagagtggacgagggcggctggaacaccgtgcagggcgccaagaacagcagagtgctggaccccagcaagttcctgaagatcaccaagcccaccatcgacgagaagatccagctggtgcccaaggcccagctgggcagctggggcaagggcagcagcggcggcgccaaggccagcgagaccgacgccctgagaagcagcgccagcagcctgaacagattcagcgccctgcagccccccgcccccagcggcagcacccccagcacccccgtggagttcgacagcagaagaaccctgaccagcagaggcagcatgggcagagagaagaacgacaagcccctgcccagcgccaccgccagacccaacaccttcatgagaggcggcagcagcaaggacctgctggacaaccagagccaggaggagcagagaagagagatgctggagaccgtgaagcagctgaccggcggcgtggacgtggagagaaacagcaccgaggccgagagaaacaagaccagagagagcgccaagcccgagatcagcgccatgagcgcccacgacaaggccgccctgagcgaggaggagctggagagaaagagcaagagcatcatcgacgagttcctgcacatcaacgacttcaaggaggccatgcagtgcgtggaggagctgaacgcccagggcctgctgcacgtgttcgtgagagtgggcgtggagagcaccctggagagaagccagatcaccagagaccacatgggccagctgctgtaccagctggtgcagagcgagaagctgagcaagcaggacttcttcaagggcttcagcgagaccctggagctggccgacgacatggccatcgacatcccccacatctggctgtacctggccgagctggtgacccccatgctgaaggagggcggcatcagcatgagagagctgaccatcgagttcagcaagcccctgctgcccgtgggcagagccggcgtgctgctgagcgagatcctgcacctgctgtgcaagcagatgagccacaagaaggtgggcgccctgtggagagaggccgacctgagctggaaggacttcctgcccgagggcgaggacgtgcacaacttcctgctggagcagaagctggacttcatcgagagcgacagcccctgcagcagcgaggccctgagcaagaaggagctgagcgccgaggagctgtacaagagactggagaagctgatcatcgaggacaaggccaacgacgagcagatcttcgactgggtggaggccaacctggacgagatccagatgagcagccccaccttcctgagagccctgatgaccgccgtgtgcaaggccgccatcatcgccgacagcagcaccttcagagtggacaccgccgtgatcaagcagagagtgcccatcctgctgaagtacctggacagcgacaccgagaaggagctgcaggccctgtacgccctgcaggccagcatcgtgaagctggaccagcccgccaacctgctgagaatgttcttcgactgcctgtacgacgaggaggtgatcagcgaggacgccttctacaagtgggagagcagcaaggaccccgccgagcagaacggcaagggcgtggccctgaagagcgtgaccgccttcttcacctggctgagagaggccgaggaggagagcgaggacaactag

SEQ ID NO: 13226 - DNA, 591 bp, Artificial Sequence
  Description of Artificial Sequence: Synthetic coding sequence
atgtggagcgtgctgcaggacggccccatcagcagagtgatcgtgttcagcctgagcgccgccaaggagaccaaggacagacccctgcaggacgagtacagcgtgctggtggccagcatgctggagcccgccgtggtgtacagagacctgctgaacagaggcctggaggaccagctgctgctgcccggcagcgaccagttcgacagcgtgctgtgcagcctggtgaccgacgtggacctggacggcagacccgaggtgctggtggccacctacggccaggagctgctgtgctacaagtacagaggccccgagagcggcctgcccgaggcccagcacggcttccacctgctgtggcagagaagcttcagcagccccctgctggccatggcccacgtggacctgaccggcgacggcctgcaggagctggccgtggtgagcctgaagggcgtgcacatcctgcagcacagcctgatccaggccagcgagctggtgctgaccagactgagacaccaggtggagcagagaagaagaagactgcagggcctggaggacggcgccggcgccggccccgccgagaacgccgccagctag

SEQ ID NO: 13227 - DNA, 1056 bp, Artificial Sequence
  Description of Artificial Sequence: Synthetic coding sequence
atggtgagccacaccttccacatgagaaccgaggagagcgacgccagccaggagggcgacgacctgcccaagagcagcgccaacaccagccaccccaagcaggacgacagccccaagagcagcgaggagaccatccagcccaaggagggcgacatccccaaggcccccgaggagaccatccagagcaagaaggaggacctgcccaagagcagcgagaaggccatccagcccaaggagagcaacatccccaagagcagcgccaagcccatccagcccaagctgggcaacatccccaagaccagcgtgaagcccagccagcccaaggagagcgacatccccaagagccccgaggaggccatccagcccaaggagggcgacatccccaagagcctggaggaggccatccagcccaaggagggcgacatccccaagagccccgaggagaccatccagcccaagaagggcgacatccccaagagccccgaggaggccatccagcccaaggagggcgacatccccaagagccccaagcaggccatccagcccaaggagggcgacatccccaagagcctggaggaggccatcccccccaaggagatcgacatccccaagagccccgaggagaccatccagcccaaggaggacgacagccccaagagcctggaggaggccacccccagcaaggagggcgacatcctgaagcccgaggaggagaccatggagttccccgagggcgacaaggtgaaggtgatcctgagcaaggaggacttcgaggccagcctgaaggaggccggcgagagactggtggccgtggacttcagcgccacctggtgcggcccctgcagaaccatcagacccttcttccacgccctgagcgtgaagcacgaggacgtggtgttcctggaggtggacgccgacaactgcgaggaggtggtgagagagtgcgccatcatgtgcgtgcccaccttccagttctacaagaaggaggagaaggtggacgagctgtgcggcgccctgaaggagaagctggaggccgtgatcgccgagctgaagtag

SEQ ID NO: 13228 - DNA, 1473 bp, Artificial Sequence
  Description of Artificial Sequence: Synthetic coding sequence
atgcccgacggcaagatccagaagctgatcatcaccgaggagaccgccaagatcagacccttcgccgtggccgccgtgctgagaaacatcaagttcaccaaggacagatacgacagcttcatcgagctgcaggagaagctgcaccagaacatctgcagaaagagagccctggtggccatcggcacccacgacctggacaccctgagcggccccttcacctacaccgccaagagacccagcgacatcaagttcaagcccctgaacaagaccaaggagtacaccgcctgcgagctgatgaacatctacaagaccgacaaccacctgaagcactacctgcacatcatcgagaacaagcccctgtaccccgtgatctacgacagcaacggcgtggtgctgagcatgccccccatcatcaacggcgaccacagcagaatcaccgtgaacaccagaaacatcttcatcgagtgcaccggcaccgacttcaccaaggccaagatcgtgctggacatcatcgtgaccatgttcagcgagtactgcgagaaccagttcaccgtggaggccgccgaggtggtgttccccaacggcaagagccacaccttccccgagctggcctacagaaaggagatggtgagagccgacctgatcaacaagaaggtgggcatcagagagacccccgagaacctggccaagctgctgaccagaatgtacctgaagagcgaggtgatcggcgacggcaaccagatcgagatcgagatcccccccaccagagccgacatcatccacgcctgcgacatcgtggaggacgccgccatcgcctacggctacaacaacatccagatgaccctgcccaagacctacaccatcgccaaccagttccccctgaacaagctgaccgagctgctgagacacgacatggccgccgccggcttcaccgaggccctgaccttcgccctgtgcagccaggaggacatcgccgacaagctgggcgtggacatcagcgccaccaaggccgtgcacatcagcaaccccaagaccgccgagttccaggtggccagaaccaccctgctgcccggcctgctgaagaccatcgccgccaacagaaagatgcccctgcccctgaagctgttcgagatcagcgacatcgtgatcaaggacagcaacaccgacgtgggcgccaagaactacagacacctgtgcgccgtgtactacaacaagaaccccggcttcgagatcatccacggcctgctggacagaatcatgcagctgctggacgtgccccccggcgaggacaagggcggctacgtgatcaaggccagcgagggccccgccttcttccccggcagatgcgccgagatcttcgccagaggccagagcgtgggcaagctgggcgtgctgcaccccgacgtgatcaccaagttcgagctgaccatgccctgcagcagcctggagatcaacgtgggccccttcctgtag

SEQ ID NO: 13229 - DNA, 1458 bp, Artificial Sequence; identical to SEQ ID NO: 11305
  Description of Artificial Sequence: Synthetic coding sequence

SEQ ID NO: 13230 - DNA, 204 bp, Artificial Sequence
  Description of Artificial Sequence: Synthetic coding sequence
atggccctgctggccgagcacctgctgaagcccctgcccgccgacaagcagatcgagaccggccccttcctggaggccgtgagccacctgccccccttcttcgactgcctgggcagccccgtgttcacccccatcaaggccgacatcagcggcaacatcaccatgagaaagctgagactgagaggcgtggagggcctggcctag

SEQ ID NO: 13231 - DNA, 816 bp, Artificial Sequence
  Description of Artificial Sequence: Synthetic coding sequence
atctgcgagagaatcagaagcaccgtggacgagaaggagcagaagcagctgctgatggacctggacgtggtgatgagaagcagcgactgcccctacatcgtgcagttctacggcgccctgttcagagagggcgactgctggatctgcatggagctgatgagcaccagcttcgacaagttctacaagtacgtgtacagcgtgctggacgacgtgatccccgaggagatcctgggcaagatcaccctggccaccgtgaaggccctgaaccacctgaaggagaacctgaagatcatccacagagacatcaagcccagcaacatcctgctggacagaagcggcaacatcaagctgtgcgacttcggcatcagcggccagctggtggacagcatcgccaagaccagagacgccggctgcagaccctacatggcccccgagagaatcgaccccagcgccagcagacagggctacgacgtgagaagcgacgtgtggagcctgggcatcaccctgtacgagctggccaccggcagattcccctaccccaagtggaacagcgtgttcgaccagctgacccaggtggtgaagggcgaccccccccagctgagcaacagcgaggagagagagttcagccccagcttcatcaacttcgtgaacctgtgcctgaccaaggacgagagcaagagacccaagtacaaggagctgctgaagcaccccttcatcctgatgtacgaggagagagccgtggaggtggcctgctacgtgtgcaagatcctggaccagatgcccgccacccccagcagccccatgtacgtggactag

SEQ ID NO: 13232 - DNA, 291 bp, Artificial Sequence
  Description of Artificial Sequence: Synthetic coding sequence
atgagcgagaaggtggactggctgcagagccagaacggcgtgtgcaaggtggacgtgtacagccccggcgacaaccaggcccaggactggaagatggacaccagcaccgaccccgtgagagtgctgagctggctgagaagagacctggagaagagcaccgccgagttccaggacgtgagattcaagcccggcgagagcttcggcggcgagaccagcaacagcggcgacccccacaagggcttcagcgtggactactacaacaccaccaccaagggcacccccgagagatag

SEQ ID NO: 13233 - DNA, 792 bp, Artificial Sequence; identical to SEQ ID NO: 9911
  Description of Artificial Sequence: Synthetic coding sequence

SEQ ID NO: 13234 - DNA, 867 bp, Artificial Sequence; identical to SEQ ID NO: 9909
  Description of Artificial Sequence: Synthetic coding sequence

SEQ ID NO: 13235 - DNA, 549 bp, Artificial Sequence; identical to SEQ ID NO: 11366
  Description of Artificial Sequence: Synthetic coding sequence

SEQ ID NO: 13236 - DNA, 999 bp, Artificial Sequence
  Description of Artificial Sequence: Synthetic coding sequence
atggaccagcccgccggcctgcaggtggactacgtgttcagaggcgtggagcacgccgtgagagtgatggtgagcggccaggtgctggagctggaggtggaggacagaatgaccgccgaccagtggagaggcgagttcgacgccggcttcatcgaggacctgacccacaagaccggcaacttcaagcagttcaacatcttctgccacatgctggagagcgccctgacccagagcagcgagagcgtgaccctggacctgctgacctacaccgacctggagagcctgagaaacagaaagatgggcggcagacccggcagcctggcccccagaagcgcccagctgaacagcaagagatacctgatcctgatctacagcgtggagttcgacagaatccactaccccctgcccctgccctaccagggcaagcccgaccccgtggtgctgcagggcatcatcagaagcctgaaggaggagctgggcagactgcagggcctggacggccagaacaccagagacaccagagagaacgagatctggcacctgagagagcagcagcagcagagaaacagactgggcagcggcggcagcggcgacggccccagcgtgagctggagcagacagacccagccccccgccgccctgaccggcagaggcgacgcccccaacagaagcagaaacagaagcagcagcgtggacagcttcagaagcagatgcagcagcgccagcagctgcagcgacctggaggacttcagcgagagcctgagcagaggcggccacagaagaagaggcaagccccccagccccaccccctggagcggcagcaacatgaagagcccccccgtggagagaagccaccaccagaagagcctggccaacagcggcggctgggtgcccatcaaggagtacagcagcgagcaccaggccgccgacatggccgagatcgacgccagactgaaggccctgcaggagtacatgaacagactggacatgagaagctag

SEQ ID NO: 13237 - DNA, 516 bp, Artificial Sequence
  Description of Artificial Sequence: Synthetic coding sequence
atgagcagcaagagaaccaagaccaagaccaagaagagaccccagagagccaccagcaacgtgttcgccatgttcgaccagagccagatccaggagttcaaggaggccttcaacatgatcgaccagaacagagacggcttcatcgacaaggaggacctgcacgacatgctggccagcctgggcaagaaccccaccgacgagtacctggacgccatgatgaacgaggcccccggccccatcaacttcaccatgttcctgaccatgttcggcgagaagctgaacggcaccgaccccgaggacgtgatcagaaacgccttcgcctgcttcgacgaggaggccaccggcaccatccaggaggactacctgagagagctgctgaccaccatgggcgacagattcaccgacgaggaggtggacgagctgtacagagaggcccccatcgacaagaagggcaacttcaactacatcgagttcaccagaatcctgaagcacggcgccaaggacaaggacgactag

SEQ ID NO: 13238 - DNA, 2391 bp, Artificial Sequence
  Description of Artificial Sequence: Synthetic coding sequence
atgagcctggacgacaacctgagcggcaccagcggcatggaggtggacgacagagtgagcgccctggagcagagactgcagctgcaggaggacgagctggccgtgctgaaggccgccctggccgacgccctgagaagactgagagcctgcgaggagcagggcgccgccctgagagccagaggcacccccaagggcagagccccccccagactgggcaccaccgccagcgtgtgccagctgctgaagggcctgcccaccagaacccccctgaacggcagcggcccccccagaagagtgggcggctacgccaccagccccagcagccccaagaaggaggccaccagcggcagaagcagcgtgagaagatacctgagccccgagagactggccagcgtgagaagagaggaccccagaagcagaaccaccagcagcagcagcaactgcagcgccaagaaggagggcaagaccaaggaggtgatcttcagcgtggaggacggcagcgtgaagatgttcctgagaggcagacccgtgcccatgatgatccccgacgagctggcccccacctacagcctggacaccagaagcgagctgcccagctgcagactgaagctggagtgggtgtacggctacagaggcagagactgcagagccaacctgtacctgctgcccaccggcgagatcgtgtacttcgtggccagcgtggccgtgctgtacagcgtggaggagcagagacagagacactacctgggccacaacgacgacatcaagtgcctggccatccaccccgacatggtgaccatcgccaccggccaggtggccggcaccaccaaggagggcaagcccctgcccccccacgtgagaatctgggacagcgtgagcctgagcaccctgcacgtgctgggcctgggcgtgttcgacagagccgtgtgctgcgtgggcttcagcaagagcaacggcggcaacctgctgtgcgccgtggacgagagcaacgaccacatgctgagcgtgtgggactgggccaaggagaccaaggtggtggacgtgaagtgcagcaacgaggccgtgctggtggccaccttccaccccaccgaccccaccgtgctgatcacctgcggcaagagccacatctacttctggaccctggagggcggcagcctgagcaagagacagggcctgttcgagaagcacgagaagcccaagtacgtgctgtgcgtgaccttcctggagggcggcgacgtggtgaccggcgacagcggcggcaacctgtacgtgtggggcaagggcggcaacagaatcacccaggccgtgctgggcgcccacgacggcggcgtgttcggcctgtgcgccctgagagacggcaccctggtgagcggcggcggcagagacagaagagtggtgctgtggggcagcgactacagcaagctgcaggaggtggaggtgcccgaggacttcggccccgtgagaaccgtggccgagggccacggcgacaccctgtacgtgggcaccaccagaaacagcatcctgcagggcagcgtgcacaccggcttcagcctgctggtgcagggccacgtggaggagctgtggggcctggccacccaccccagcagagcccagttcgtgacctgcggccaggacaagctggtgcacctgtggagcagcgacagccaccagcccctgtggagcagaatcatcgaggaccccgccagaagcgccggcttccaccccagcggcagcgtgctggccgtgggcaccgtgaccggcagatggctgctgctggacaccgagacccacgacctggtggccatccacaccgacggcaacgagcagatcagcgtggtgagcttcagccccgacggcgcctacctggccgtgggcagccacgacaacctggtgtacgtgtacaccgtggaccagggcggcagaaaggtgagcagactgggcaagtgcagcggccacagcagcttcatcacccacctggactgggcccaggacagcagctgcttcgtgaccaacagcggcgactacgagatcctgtactgggaccccgccacctgcaagcagatcaccagcgccgacgccgtgagaaacatggagtgggccaccgccacctgcgtgctgggcttcggcgtgttcggcatctggagcgagggcgccgacggcaccgacatcaacgccgtggccagaagccacgacggcaagctgctggccagcgccgacgacttcggcaaggtgcacctgttcagctacccctgctgccagcccagagccctgagccacaagtacggcggccacagcagccacgtgaccaacgtggccttcctgtgggacgacagcatggccctgaccaccggcggcaaggacaccagcgtgctgcagtggagagtggtgtag

SEQ ID NO: 13239 - DNA, 1059 bp, Artificial Sequence
  Description of Artificial Sequence: Synthetic coding sequence
atggccctgctgggccaggccctgaagtggcagcagcaccagggcctgctgccccccggcatgaccatcgacctgttcagaggcaaggccgccgtgaaggacgtggaggaggagaagttccccacccagctgagcagacacatcaagttcggccagaagagccacgtggagtgcgccagattcagccccgacggccagtacctggtgaccggcagcgtggacggcttcatcgaggtgtggaacttcaccaccggcaagatcagaaaggacctgaagtaccaggcccaggacaacttcatgatgatggacgacgccgtgctgtgcatgtgcttcagcagagacaccgagatgctggccaccggcgcccaggacggcaagatcaaggtgtggaagatccagagcggccagtgcctgagaagattcgagagagcccacagcaagggcgtgacctgcctgagcttcagcaaggacagcagccagatcctgagcgccagcttcgaccagaccatcagaatccacggcctgaagagcggcaagaccctgaaggagttcagaggccacagcagcttcgtgaacgaggccaccttcacccaggacggccactacatcatcagcgccagcagcgacggcaccgtgaagatctggaacatgaagaccaccgagtgcagcaacaccttcaagagcctgggcagcaccgccggcaccgacatcaccgtgaacagcgtgatcctgctgcccaagaaccccgagcacttcgtggtgtgcaacagaagcaacaccgtggtgatcatgaacatgcagggccagatcgtgagaagcttcagcagcggcaagagagagggcggcgacttcgtgtgctgcgccctgagccccagaggcgagtggatctactgcgtgggcgaggacttcgtgctgtactgcttcagcaccgtgaccggcaagctggagagaaccctgaccgtgcacgagaaggacgtgatcggcatcgcccaccacccccaccagaacctgatcgccacctacagcgaggacggcctgctgaagctgtggaagccctag

SEQ ID NO: 13240 - DNA, 951 bp, Artificial Sequence
  Description of Artificial Sequence: Synthetic coding sequence
atgcagagctgggtgctgatcagcaaggagctgatcagcctgctgcacctgagcctgctgcacctggaggaggacaagaccaccgtgagccaggagagcagaagagccgagaccctggtgtgctgctgcttcgacctgctgaagaagctgagagccaagctgcagagcctgaaggccgagagagaggaggccagacacagagaggagatggccctgagaggcaaggacgccgccgagatcgtgctggaggccttctgcgcccacgccagccagagaatcagccagctggagcaggacctggccagcatgagagagttcagaggcctgctgaaggacgcccagacccagctggtgggcctgcacgccaagcaggaggagctggtgcagcagaccgtgagcctgaccagcaccctgcagcaggactggagaagcatgcagctggactacaccacctggaccgccctgctgagcagaagcagacagctgaccgagaagctgaccgtgaagagccagcaggccctgcaggagagagacgtggccatcgaggagaagcaggaggtgagcagagtgctggagcaggtgagcgcccagctggaggagtgcaagggccagaccgagcagctggagctggagaacagcagactggccaccgacctgagagcccagctgcagatcctggccaacatggacagccagctgaaggagctgcagagccagcacacccactgcgcccaggacctggccatgaaggacgagctgctgtgccagctgacccagagcaacgaggagcaggccgcccagtggcagaaggaggagatggccctgaagcacatgcaggccgagctgcagcagcagcaggccgtgctggccaaggaggtgagagacctgaaggagaccctggagttcgccgaccaggagaaccaggtggcccacctggagctggcctggtag

SEQ ID NO: 13241 - DNA, 597 bp, Artificial Sequence; identical to SEQ ID NO: 10225
  Description of Artificial Sequence: Synthetic coding sequence

SEQ ID NO: 13242 - DNA, 591 bp, Artificial Sequence
  Description of Artificial Sequence: Synthetic coding sequence
atggtgcccagaccctggagcggcagccccggccccggcgagtgcctgcacagcctgctgagcgagagactgtggatctgcagagacatcagcgcccagagaagaagcgcccccggcagccccagacccagcgactgccagcagctgagcttcctgcccggcaaccagcccaccttcctgtgcctgcaggccctggccgccctggtgcccggcgtgacccaggtggacaacaagagcggcttcctgcagaagagaccccacagacagcaccccggcatcctgaagctgccccacgtgagactgccccaggccctggccaacggcgcccagctgctgctgctgggcagcgccggccccaccatggagaaccaggtgcagaccctgaccagctacctgtggagcagacacctgcccgtggagcccgaggagctgcagagaagagccagacacctggagaagaagttcctggagaaccccggccccgacttccagagcctgttcagcccccagacctacctgagacagagaagaaacttcgtggagcagtgctacacccactacgtgaagctgcccaccatcggcaagaactag

SEQ ID NO: 13243 - DNA, 1131 bp, Artificial Sequence
  Description of Artificial Sequence: Synthetic coding sequence
atgcccgacgtggtgcagaccagacagcaggcctacagagacaagctggcccagcagcaggccgccgccgccgccgccgccgccgccgccgccagccagcagggcagcgccaagaacggcgagaacaccgccaacggcgaggagaacggcgcccacaccatcgccagaatctggaacctgagcgagaacagcaccagcggcagcacccagctggtgctgagacactgcatcagagagggcggccaggacgtgcccagcaacaaggacgtgaccagcctggactggaacagcgagggcaccctgctggccaccggcagctacgacggcttcgccagaatctggaccaaggacggcaacctggccagcaccctgggccagcacaagggccccatcttcgccctgaagtggaacaagaagggcaacttcatcctgagcgccggcgtggacaagaccaccatcatctgggacgcccacaccggcgaggccaagcagcagttccccttccacagcgcccccgccctggacgtggactggcagagcaacaacaccttcgccagctgcagcaccgacatgtgcatccacgtgtgcaagctgggccaggacagacccatcaagaccttccagggccacaccaacgaggtgaacgccatcaagtgggaccccaccggcaacctgctggccagctgcagcgacgacatgaccctgaagatctggagcatgaagcaggacaactgcgtgcacgacctgcaggcccacaacaaggagatctacaccatcaagtggagccccaccggccccggcaccaacaaccccaacgccaacctgatgctggccagcgccagcttcgacagcaccgtgagactgtgggacgtggacagaggcatctgcatccacaccctgaccaagcaccaggagcccgtgtacagcgtggccttcagccccgacggcagatacctggccagcggcagcttcgacaagtgcgtgcacatctggaacacccagaccggcgccctggtgcacagctacagaggcaccggcggcatcttcgaggtgtgctggaacgccgccggcgacaaggtgggcgccagcgccagcgacggcagcgtgtgcgtgctggacctgagaaagtag

SEQ ID NO: 13244 - DNA, 1116 bp, Artificial Sequence
  Description of Artificial Sequence: Synthetic coding sequence
atgcacatcaagagcatcatcctggagggcttcaagagctacgcccagagaaccgaggtgaacggcttcgaccccctgttcaacgccatcaccggcctgaacggcagcggcaagagcaacatcctggacagcatctgcttcctgctgggcatcagcaacctgagccaggtgagagccagcaacctgcaggacctggtgtacaagaacggccaggccggcatcaccaaggccagcgtgagcatcaccttcgacaacagcgacaagaagcagagccccctgggcttcgaggtgcacgacgagatcaccgtgaccagacaggtggtgatcggcggcagaaacaagtacctgatcaacggcgtgaacgccaacaacaccagagtgcaggacctgttctgcagcgtgggcctgaacgtgaacaacccccacttcctgatcatgcagggcagaatcaccaaggtgctgaacatgaagccccccgagatcctgagcatgatcgaggaggccgccggcaccagaatgtacgagtacaagaagatcgccgcccagaagaccatcgagaagaaggaggccaagctgaaggagatcaagaccatcctggaggaggagatcacccccaccatccagaagctgaaggaggagagaagcagctacctggagtaccagaaggtgatgagagagatcgagcacctgagcagactgtacatcgcctaccagttcctgctggccgaggacaccaaggtgagaagcgccgaggagctgaaggagatgcaggacaaggtgatcaagctgcaggaggagctgagcgagaacgacaagaagatcaaggccctgaaccacgagatcgaggagctggagaagagaaaggacaaggagaccggcggcatcctgagaagcctggaggacgccctggccgaggcccagagagtgaacaccaagagccagagcgccttcgacctgaagaagaagaacctggcctgcgaggagagcaagagaaaggagctggagaagaacatggtggaggacagcaagaccctggccgccaaggagaaggagaagatcaagagaaaggccttctggaagagcgccggcagctgcctggtgatcctggtggactag

SEQ ID NO: 13245 - DNA, 507 bp, Artificial Sequence
  Description of Artificial Sequence: Synthetic coding sequence
cacaagctgcagagcggcatcggcagactgatcctgaaggaggagatgaaggccagaagcagcagctacgccgacccctggaccccccccagaagcagcaccagcagcagagaggccctgcacaccgccggctacgagatgagcctgaacggcagccccagaagccactacctggccgacagcgaccccctgatcagcaagagcgccagcctgcccgcctacagaagaaacggcctgcacagaacccccagcgccgacctgttccactacgacagcatgaacgccgtgaactggggcatgagagagtacaagatctacccctacgagctgctgctggtgaccaccagaggcagaaacagactgcccaaggacgtggacagaaccagactggagagacacctgagccaggaggagttctaccaggtgttcggcatgaccatcagcgagttcgacagactggccctgtggaagagaaacgagctgaagaagcaggccagactgttctag

SEQ ID NO: 13246 - DNA, 1770 bp, Artificial Sequence; identical to SEQ ID NO: 10185
  Description of Artificial Sequence: Synthetic coding sequence

SEQ ID NO: 13247 - DNA, 1287 bp, Artificial Sequence
  Description of Artificial Sequence: Synthetic coding sequence
atgagcatgctgaagcccagcggcctgaaggcccccaccaagatcctgaagcccggcagcaccgccctgaagacccccaccgccgtggtggcccccgtggagaagaccatcagcagcgagaaggccagcagcacccccagcagcgagacccaggaggagttcgtggacgacttcagagtgggcgagagagtgtgggtgaacggcaacaagcccggcttcatccagttcctgggcgagacccagttcgcccccggccagtgggccggcatcgtgctggacgagcccatcggcaagaacgacggcagcgtggccggcgtgagatacttccagtgcgagcccctgaagggcatcttcaccagacccagcaagctgaccagaaaggtgcaggccgaggacgaggccaacggcctgcagaccacccccgccagcagagccaccagccccctgtgcaccagcaccgccagcatggtgagcagcagccccagcacccccagcaacatcccccagaagcccagccagcccgccgccaaggagcccagcgccaccccccccatcagcaacctgaccaagaccgccagcgagagcatcagcaacctgagcgaggccggcagcatcaagaagggcgagagagagctgaagatcggcgacagagtgctggtgggcggcaccaaggccggcgtggtgagattcctgggcgagaccgacttcgccaagggcgagtggtgcggcgtggagctggacgagcccctgggcaagaacgacggcgccgtggccggcaccagatacttccagtgccagcccaagtacggcctgttcgcccccgtgcacaaggtgaccaagatcggcttccccagcaccacccccgccaaggccaaggccaacgccgtgagaagagtgatggccaccaccagcgccagcctgaagagaagccccagcgccagcagcctgagcagcatgagcagcgtggccagcagcgtgagcagcagacccagcagaaccggcctgcacgtgctggagctggaggccaagatggaccagctgagaaccatggtggaggccgccgacagagagaaggtggagctgctgaaccagctggaggaggagaagagaaaggtggaggacctgcagttcagagtggaggaggagagcatcaccaagggcgacctggagcagaagagccagatcagcgaggaccccgagaacgtgagaggccacctgaccgtgtggatcttccccctgctgaccaagatcgaccacagactgaagtgcctgctgatctacagctag

SEQ ID NO: 13248 - DNA, 3483 bp, Artificial Sequence
  Description of Artificial Sequence: Synthetic coding sequence
atggtggtgaccctgggccccggccccgactgcctgatcctggaggccagcagacagccccagctggtgcccaagcccgagagaatggccagcgacggcgccagcgccctgcccggccccgacatgagcatgaagcccagcgccgcccccagccccagccccgccctgcccttcctgccccccaccagcgacccccccgaccacccccccagagagccccccccccagcccatcatgcccagcgtgttcagccccgacaaccccctgatgctgagcgccttccccagcagcctgctggtgaccggcgacggcggcccctgcctgagcggcgccggcgccggcaaggtgatcgtgaaggtgaagaccgagggcggcagcgccgagcccagccagacccagaacttcatcctgacccagaccgccctgaacagcaccgcccccggcaccccctgcggcggcctggagggccccgccccccccttcgtgaccgccagcaacgtgaagaccatcctgcccagcaaggccgtgggcgtgagccaggagggcccccccggcctgcccccccagccccccccccccgtggcccagctggtgcccatcgtgcccctggagaaggcctggcccggcccccacggcaccaccggcgagggcggccccgtggccaccctgagcaagcccagcctgggcgacagaagcaagatcagcaaggacgtgtacgagaacttcagacagtggcagagatacaaggccctggccagaagacacctgagccagagccccgacaccgaggccctgagctgcttcctgatccccgtgctgagaagcctggccagactgaagcccaccatgaccctggaggagggcctgcccctggccgtgcaggagtgggagcacaccagcaacttcgacagaatgatcttctacgagatggccgagagattcatggagttcgaggccgaggagatgcagatccagaacacccagctgatgaacggcagccagggcctgagccccgccacccccctgaagctggaccccctgggccccctggccagcgaggtgtgccagcagcccgtgtacatccccaagaaggccgccagcaagaccagagcccccagaagaagacagagaaaggcccagagaccccccgcccccgaggcccccaaggagatcccccccgaggccgtgaaggagtacgtggacatcatggagtggctggtgggcacccacctggccaccggcgagagcgacggcaagcaggaggaggagggccagcagcaggaggaggagggcatgtaccccgaccccggcctgctgagctacatcaacgagctgtgcagccagaaggtgttcgtgagcaaggtggaggccgtgatccacccccagttcctggccgacctgctgagccccgagaagcagagagaccccctggccctgatcgaggagctggagcaggaggagggcctgaccctggcccagctggtgcagaagagactgatggccctggaggaggaggaggacgccgaggccccccccagcttcagcggcgcccagctggacagcagccccagcggcagcgtggaggacgaggacggcgacggcagactgagacccagccccggcctgcagggcgccggcggcgccgcctgcctgggcaaggtgagcagcagcggcaagagagccagagaggtgcacggcggccaggagcaggccctggacagccccagaggcatgcacagagacggcaacaccctgcccagccccagcagctgggacctgcagcccgagctggccgccccccagggcacccccggccccctgggcgtggagagaagaggcagcggcaaggtgatcaaccaggtgagcctgcaccaggacggccacctgggcggcgccggcccccccggccactgcctggtggccgacagaaccagcgaggccctgcccctgtgctggcagggcggcttccagcccgagagcacccccagcctggacgccggcctggccgagctggcccccctgcagggccagggcctggagaagcaggtgctgggcctgcagaagggccagcagaccggcggcagaggcgtgctgccccagggcaaggagcccctggccgtgccctgggagggcagcagcggcgccatgtggggcgacgacagaggcacccccatggcccagagctacgaccagaaccccagccccagagccgccggcgagagagacgacgtgtgcctgagccccggcgtgtggctgagcagcgagatggacgccgtgggcctggagctgcccgtgcagatcgaggaggtgatcgagagcttccaggtggagaagtgcgtgaccgagtaccaggagggctgccagggcctgggcagcagaggcaacatcagcctgggccccggcgagaccctggtgcccggcgacaccgagagcagcgtgatcccctgcggcggcaccgtggccgccgccgccctggagaagagaaactactgcagcctgcccggccccctgagagccaacagcccccccctgagaagcaaggagaaccaggagcagagctgcgagaccgtgggccaccccagcgacctgtgggccgagggctgcttccccctgctggagagcggcgacagcaccctgggcagcagcaaggagaccctgccccccacctgccagggcaacctgctgatcatgggcaccgaggacgccagcagcctgcccgaggccagccaggaggccggcagcagaggcaacagcttcagccccctgctggagaccatcgagcccgtgaacatcctggacgtgaaggacgactgcggcctgcagctgagagtgagcgaggacacctgccccctgaacgtgcacagctacgacccccagggcgagggcagagtggaccccgacctgagcaagcccaagaacctggcccccctgcaggagagccaggagagctacaccaccggcacccccaaggccaccagcagccaccagggcctgggcagcaccctgcccagaagaggcaccagaaacgccatcgtgcccagagagaccagcgtgagcaagacccacagaagcgccgacagagccaagggcaaggagaagaagaagaaggaggccgaggaggaggacgaggagctgagcaacttcgcctacctgctggccagcaagctgagcctgagccccagagagcaccccctgagcccccaccacgccagcggcggccagggcagccagagagccagccacctgctgcccgccggcgccaagggccccagcaagctgccctaccccgtggccaagagcggcaagagagccctggccggcggccccgcccccaccgagaagaccccccacagcggcgcccagctgggcgtgcccagagagaagcccctggccctgggcgtggtgagacccagccagcccagaaagagaagatgcgacagcttcgtgaccggcagaagaaagaagagaagaagaagccagtag

SEQ ID NO: 13249 - DNA, 1548 bp, Artificial Sequence
  Description of Artificial Sequence: Synthetic coding sequence
ctgaacagccagtgcagaaacaagaaccccttcgccgccggccccagacccccccaccaccagttcttccagagaccccagatccagccccccagagccaccatccccaacagcagccccagcatcagacccggcgcccagacccccaccgccgtgtaccaggccaaccagcacatcatgatggtgaaccacctgcccatgccctaccccgtgccccagggcccccagtactgcatcccccagtacagacacagcggccccccctacgtgggccccccccagcagtaccccgtgcagccccccggccccggccccttctaccccggccccggccccggcgacttccccaacgcctacggcacccccttctaccccagccagcccgtgtaccagagcgcccccatcatcgtgcccacccagcagcagcccccccccgccaagagagagaagaagaccatcagaatcagagaccccaaccagggcggcaaggacatcaccgaggagatcatgagcggcggcggcagcagaaaccccaccccccccatcggcagacccaccagcacccccacccccccccagcagctgcccagccaggtgcccgagcacagccccgtggtgtacggcaccgtggagagcgcccacctggccgccagcacccccgtgaccgccgccagcgaccagaagcaggaggagaagcccaagcccgaccccgtgctgaagagccccagccccgtgctgagactggtgctgagcggcgagaagaaggagcaggagggccagaccagcgagaccaccgccatcgtgagcatcgccgagctgcccctgccccccagccccaccaccgtgagcagcgtggccagaagcaccatcgccgcccccaccagcagcgccctgagcagccagcccatcttcaccaccgccatcgacgacagatgcgagctgagcagccccagagaggacaccatccccatccccagcctgaccagctgcaccgagaccagcgaccccctgcccaccaacgagaacgacgacgacatctgcaagaagccctgcagcgtggcccccaacgacatccccctggtgagcagcaccaacctgatcaacgagatcaacggcgtgagcgagaagctgagcgccaccgagagcatcgtggagatcgtgaagcaggaggtgctgcccctgaccctggagctggagatcctggagaacccccccgaggagatgaagctggagtgcatccccgcccccatcacccccagcaccgtgcccagcttcccccccaccccccccaccccccccgccagccccccccacacccccgtgatcgtgcccgccgccgccaccaccgtgagcagccccagcgccgccatcaccgtgcagagagtgctggaggaggacgagagcatcagaacctgcctgagcgaggacgccaaggagatccagaacaagatcgaggtggaggccgacggccagaccgaggagatcctggacagccagaacctgaacagcagaagaagccccgtgcccgagaccagcaacgagtgctag

SEQ ID NO: 13250 - DNA, 204 bp, Artificial Sequence; identical to SEQ ID NO: 13230
  Description of Artificial Sequence: Synthetic coding sequence

SEQ ID NO: 13251 - DNA, 2418 bp, Artificial Sequence
  Description of Artificial Sequence: Synthetic coding sequence
atgatgcagaacgtgcacctggcccccgagaccgacgaggacgacctgtacagcggctacaacgactacaaccccatctacgacatcgaggagctggagaacgacgccgccttccagcaggccgtgagaaccagccacggcagaagaccccccagcaagaccagcctggccagcagcatcggcagacccatgaccggcgccatccaggacggcgtgaccagacccatgaccgccgtgagagccgccggcttcaccaaggccgccctgagaggcagcgccttcgaccccctgagccagagcagaggccccgccagccccctggaggccaagaagaaggacagccccgaggagaagatcaagcagctggagaaggaggtgaacgagctggtggaggagagctgcatcgccaacagctgcggcgacctgaagctggccctggagaaggccaaggacgccggcagaaaggagagagtgctggtgagacagagagagcaggtgaccacccccgagaacatcaacctggacctgacctacagcgtgctgttcaacctggccagccagtacagcgtgaacgagatgtacgccgaggccctgaacacctaccaggtgatcgtgaagaacaagatgttcagcaacgccggcatcctgaagatgaacatgggcaacatctacctgaagcagagaaactacagcaaggccatcaagttctacagaatggccctggaccaggtgcccagcgtgaacaagcagatgagaatcaagatcatgcagaacatcggcgtgaccttcatccaggccggccagtacagcgacgccatcaacagctacgagcacatcatgagcatggcccccaacctgaaggccggctacaacctgaccatctgctacttcgccatcggcgacagagagaagatgaagaaggccttccagaagctgatcaccgtgcccctggagatcgacgaggacaagtacatcagccccagcgacgacccccacaccaacctggtgaccgaggccatcaagaacgaccacctgagacagatggagagagagagaaaggccatggccgagaagtacatcatgaccagcgccaagctgatcgcccccgtgatcgagaccagcttcgccgccggctacgactggtgcgtggaggtggtgaaggccagccagtacgtggagctggccaacgacctggagatcaacaaggccgtgacctacctgagacagaaggactacaaccaggccgtggagatcctgaaggtgctggagaagaaggacagcagagtgaagagcgccgccgccaccaacctgagcgccctgtactacatgggcaaggacttcgcccaggccagcagctacgccgacatcgccgtgaacagcgacagatacaaccccgccgccctgaccaacaagggcaacaccgtgttcgccaacggcgactacgagaaggccgccgagttctacaaggaggccctgagaaacgacagcagctgcaccgaggccctgtacaacatcggcctgacctacgagaagctgaacagactggacgaggccctggactgcttcctgaagctgcacgccatcctgagaaacagcgccgaggtgctgtaccagatcgccaacatctacgagctgatggagaaccccagccaggccatcgagtggctgatgcaggtggtgagcgtgatccccaccgacccccaggtgctgagcaagctgggcgagctgtacgacagagagggcgacaagagccaggccttccagtactactacgagagctacagatacttcccctgcaacatcgaggtgatcgagtggctgggcgcctactacatcgacacccagttctgggagaaggccatccagtacttcgagagagccagcctgatccagcccacccaggtgaagtggcagctgatggtggccagctgcttcagaagaagcggcaactaccagaaggccctggacacctacaaggacacccacagaaagttccccgagaacgtggagtgcctgagattcctggtgagactgtgcaccgacctgggcctgaaggacgcccaggagtacgccagaaagctgaagagactggagaagatgaaggagatcagagagcagagaatcaagagcggcagagacggcagcggcggcagcagaggcaagagagagggcagcgccagcggcgacagcggccagaactacagcgccagcagcaagggcgagagactgagcgccagactgagagccctgcccggcaccaacgagccctacgagagcagcagcaacaaggagatcgacgccagctacgtggaccccctgggcccccagatcgagagacccaagaccgccgccaagaagagaatcgacgaggacgacttcgccgacgaggagctgggcgacgacctgctgcccgagtag

SEQ ID NO: 13252 - DNA, 765 bp, Artificial Sequence
  Description of Artificial Sequence: Synthetic coding sequence
atggcccccggcagcttcgccgagtacaccgtggtgcccgccagcatcgccacccccgtgcccagcgtgaagcccgagtacctgaccctgctggtgagcggcaccaccgcctacatcagcctgaaggagctgggcggcctgagcgagggcaagaaggtgctggtgaccgccgccgccggcggcaccggccagttcgccatgcagctgagcaagaaggccaagtgccacgtgatcggcacctgcagcagcgacgagaagagcgccttcctgaagagcctgggctgcgacagacccatcaactacaagaccgagcccgtgggcaccgtgctgaagcaggagtaccccgagggcgtggacgtggtgtacgagagcgtgggcggcgccatgttcgacctggccgtggacgccctggccaccaagggcagactgatcgtgatcggcttcatcagcggctaccagacccccaccggcctgagccccgtgaaggccggcaccctgcccgccaagctgctgaagaagagcgccagcgtgcagggcttcttcctgaaccactacctgagcaagtaccaggccgccatgagccacctgctggagatgtgcgtgagcggcgacctggtgtgcgaggtggacctgggcgacctgagccccgagggcagattcaccggcctggagagcatcttcagagccgtgaactacatgtacatgggcaagaacaccggcaagatcgtggtggagctgccccacagcgtgaacagcaagctgtag

SEQ ID NO: 13253 - DNA, 1212 bp, Artificial Sequence
  Description of Artificial Sequence: Synthetic coding sequence
atgcaccaccccatccagatgaagcccgccgacagcgagaagagcaacgccgtggaggacagaaagctgttcatcggcatggtgagcaagaagtgcaacgagaacgacatcagagtgatgttcagccccttcggccagatcgaggagtgcagaatcctgagaggccccgacggcctgagcagaggctgcgccttcgtgaccttcagcaccagagccatggcccagaacgccatcaaggccatgcaccagagccagaccatggagggctgcagcagccccatcgtggtgaagttcgccgacacccagaaggacaaggagcagagaagactgcagcagcagctggcccagcagatgcagcagctgaacaccgccacctggggcaacctgaccggcctgggcggcctgaccccccagtacctggccctgctgcagcaggccaccagcagcagcaacctgggcgccttcagcggcatccagcagatggccggcatgaacgccctgcagctgcagaacctggccaccctggccgccgccgccgccgccgcccagaccagcgccaccagcaccaacgccaaccccctgagcaccaccagcagcgccctgggcgccctgaccagccccgtggccgccagcacccccaacagcaccgccggcgccgccatgaacagcctgaccagcctgggcaccctgcagggcctggccggcgccaccgtgggcctgaacaacatcaacgccctggccgtggcccagatgctgagcggcatggccgccctgaacggcggcctgggcgccaccggcctgaccaacggcaccgccggcaccatggacgccctgacccaggcctacagcggcatccagcagtacgccgccgccgccctgcccaccctgtacagccagagcctgctgcagcagcagagcgccgccggcagccagaaggagggccccgagggcgccaacctgttcatctaccacctgccccaggagttcggcgaccaggacatcctgcagatgttcatgcccttcggcaacgtgatcagcgccaaggtgttcatcgacaagcagaccaacctgagcaagtgcttcggcttcgtgagctacgacaaccccgtgagcgcccaggccgccatccaggccatgaacggcttccagatcggcatgaagagactgaaggtgcagctgaagagaagcaagaacgacagcaagccctactag

SEQ ID NO: 13254 - DNA, 1332 bp, Artificial Sequence
  Description of Artificial Sequence: Synthetic coding sequence
atggccgagttcctgaagcaggtgaagccctacgtggaggagggcctgcacccccagatcatcatcagagccttcagaaccgccacccagctggccgtgaacaagatcaaggagatcgccgtgaccgtgaagaaggccgacaaggtggagcagagaaagctgctggagaagtgcgccatgaccgccctgagcagcaagctgatcagccagcagaaggccttcttcgccaagatggtggtggacgccgtgatgatgctggacgacctgctgcagctgaagatgatcggcatcaagaaggtgcagggcggcgccctggaggacagccagctggtggccggcgtggccttcaagaagaccttcagctacgccggcttcgagatgcagcccaagaagtaccacaaccccaagatcgccctgctgaacgtggagctggagctgaaggccgagaaggacaacgccgagatcagagtgcacaccgtggaggactaccaggccatcgtggacgccgagtggaacatcctgtacgacaagctggagaagatccaccacagcggcgccaaggtggtgctgagcaagctgcccatcggcgacgtggccacccagtacttcgccgacagagacatgttctgcgccggcagagtgcccgaggaggacctgaagagaaccatgatggcctgcggcggcagcatccagaccagcgtgaacgccctgagcgccgacgtgctgggcagatgccaggtgttcgaggagacccagatcggcggcgagagatacaacttcttcaccggctgccccaaggccaagacctgcaccttcatcctgagaggcggcgccgagcagttcatggaggagaccgagagaagcctgcacgacgccatcatgatcgtgagaagagccatcaagaacgacagcgtggtggccggcggcggcgccatcgagatggagctgagcaagtacctgagagactacagcagaaccatccccggcaagcagcagctgctgatcggcgcctacgccaaggccctggagatcatccccagacagctgtgcgacaacgccggcttcgacgccaccaacatcctgaacaagctgagagccagacacgcccagggcggcacctggtacggcgtggacatcaacaacgaggacatcgccgacaacttcgaggccttcgtgtgggagcccgccatggtgagaatcaacgccctgaccgccgccagcgaggccgcctgcctgatcgtgagcgtggacgagaccatcaagaaccccagaagcaccgtggacgcccccaccgccgccggcagaggcagaggcagaggcagaccccactag

SEQ ID NO: 13255 - DNA, 2193 bp, Artificial Sequence
  Description of Artificial Sequence: Synthetic coding sequence
atgcagctgttcgagcagccctgccccggcgaggaccccagacccggcggccagatcggcgaggtggagctgagcagctacaccccccccgccggcgtgcccggcaagcccgccgccccccacttcctgcccgtgctgtgcagcgtgagccccagcggcagcagagtgccccacgacctgctgggcggcagcggcggcttcaccctggaggacgccctgttcggcctgctgttcggcgccgacgccaccctgctgcagagccccgtggtgctgtgcggcctgcccgacggccagctgtgctgcgtgatcctgaaggccctggtgaccagcagaagcgcccccggcgaccccaacgccctggtgaagatcctgcaccacctggaggagcccgtgatcttcatcggcgccctgaagaccgagccccaggccgccgaggccgccgagaacttcctgcccgacgaggacgtgcactgcgactgcctggtggccttcggccaccacggcagaatgctggccatcaaggccagctgggacgagagcggcaagctggtgcccgagctgagagagtactgcctgcccggccccgtgctgtgcgccgcctgcggcggcggcggcagagtgtaccacagcacccccagcgacctgtgcgtggtggacctgagcagaggcagcacccccctgggccccgagcagcccgaggagggccccggcggcctgccccccatgctgtgccccgccagcctgaacatctgcagcgtggtgagcctgagcgccagccccagaacccacgagggcggcaccaagctgctggccctgagcgccaagggcagactgatgacctgcagcctggacctggacagcgagatgcccggccccgccagaatgaccaccgagagcgccggccagaagatcaaggagctgctgagcggcatcggcaacatcagcgagagagtgagcttcctgaagaaggccgtggaccagagaaacaaggccctgaccagcctgaacgaggccatgaacgtgagctgcgccctgctgagcagcggcaccggccccagacccatcagctgcaccaccagcaccacctggagcagactgcagacccaggacgtgctgatggccacctgcgtgctggagaacagcagcagcttcagcctggaccagggctggaccctgtgcatccaggtgctgaccagcagctgcgccctggacctggacagcgcctgcagcgccatcacctacaccatccccgtggaccagctgggccccggcgccagaagagaggtgaccctgcccctgggccccggcgagaacggcggcctggacctgcccgtgaccgtgagctgcaccctgttctacagcctgagagaggtggtgggcggcgccctggcccccagcgacagcgaggaccccttcctggacgagtgccccagcgacgtgctgcccgagcaggagggcgtgtgcctgcccctgagcagacacaccgtggacatgctgcagtgcctgagattccccggcctggcccccccccacaccagagcccccagccccctgggccccaccagagaccccgtggccaccttcctggagacctgcagagagcccggcagccagcccgccggccccgccagcctgagagccgagtacctgccccccagcgtggccagcatcaaggtgagcgccgagctgctgagagccgccctgaaggacggccacagcggcgtgcccctgtgctgcgccaccctgcagtggctgctggccgagaacgccgccgtggacgtggtgagagccagagccctgagcagcatccagggcgtggcccccgacggcgccaacgtgcacctgatcgtgagagaggtggccatgaccgacctgtgccccgccggccccatccaggccgtggagatccaggtggagagcagcagcctggccgacatctgcagagcccaccacgccgtggtgggcagaatgcagaccatggtgaccgagcaggccacccagggcagcagcgcccccgacctgagagtgcagtacctgagacagatccacgccaaccacgagaccctgctgagagaggtgcagaccctgagagacagactgtgcaccgaggacgaggccagcagctgcgccaccgcccagagactgctgcaggtgtacagacagctgagacaccccagcctgatcctgctgtag

SEQ ID NO: 13256 - DNA, 4179 bp, Artificial Sequence
  Description of Artificial Sequence: Synthetic coding sequence
atgagcatgctgaagcccagcggcctgaaggcccccaccaagatcctgaagcccggcagcaccgccctgaagacccccaccgccgtggtggcccccgtggagaagaccatcagcagcgagaaggccagcagcacccccagcagcgagacccaggaggagttcgtggacgacttcagagtgggcgagagagtgtgggtgaacggcaacaagcccggcttcatccagttcctgggcgagacccagttcgcccccggccagtgggccggcatcgtgctggacgagcccatcggcaagaacgacggcagcgtggccggcgtgagatacttccagtgcgagcccctgaagggcatcttcaccagacccagcaagctgaccagaaaggtgcaggccgaggacgaggccaacggcctgcagaccacccccgccagcagagccaccagccccctgtgcaccagcaccgccagcatggtgagcagcagccccagcacccccagcaacatcccccagaagcccagccagcccgccgccaaggagcccagcgccaccccccccatcagcaacctgaccaagaccgccagcgagagcatcagcaacctgagcgaggccggcagcatcaagaagggcgagagagagctgaagatcggcgacagagtgctggtgggcggcaccaaggccggcgtggtgagattcctgggcgagaccgacttcgccaagggcgagtggtgcggcgtggagctggacgagcccctgggcaagaacgacggcgccgtggccggcaccagatacttccagtgccagcccaagtacggcctgttcgcccccgtgcacaaggtgaccaagatcggcttccccagcaccacccccgccaaggccaaggccaacgccgtgagaagagtgatggccaccaccagcgccagcctgaagagaagccccagcgccagcagcctgagcagcatgagcagcgtggccagcagcgtgagcagcagacccagcagaaccggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacgtgggcgagatcgagcaggagctggccctggccagagacggccacgaccagcacgtgctggagctggaggccaagatggaccagctgagaaccatggtggaggccgccgacagagagaaggtggagctgctgaaccagctggaggaggagaagagaaaggtggaggacctgcagttcagagtggaggaggagagcatcaccaagggcgacctggaggtggccaccgtgagcgagaagagcagaatcatggagctggagaaggacctggccctgagagtgcaggaggtggccgagctgagaagaagactggagagcaacaagcccgccggcgacgtggacatgagcctgagcctgctgcaggagatcagcagcctgcaggagaagctggaggtgaccagaaccgaccaccagagagagatcaccagcctgaaggagcacttcggcgccagagaggagacccaccagaaggagatcaaggccctgtacaccgccaccgagaagctgagcaaggagaacgagagcctgaagagcaagctggagcacgccaacaaggagaacagcgacgtgatcgccctgtggaagagcaagctggagaccgccatcgccagccaccagcaggccatggaggagctgaaggtgagcttcagcaagggcctgggcaccgagaccgccgagttcgccgagctgaagacccagatcgagaagatgagactggactaccagcacgagatcgagaacctgcagaaccagcaggacagcgagagagccgcccacgccaaggagatggaggccctgagagccaagctgatgaaggtgatcaaggagaaggagaacagcctggaggccatcagaagcaagctggacaaggccgaggaccagcacctggtggagatggaggacaccctgaacaagctgcaggaggccgagatcaaggtgaaggagctggaggtgctgcaggccaagtgcaacgagcagaccaaggtgatcgacaacttcaccagccagctgaaggccaccgaggagaagctgctggacctggacgccctgagaaaggccagcagcgagggcaagagcgagatgaagaagctgagacagcagctggaggccgccgagaagcagatcaagcacctggagatcgagaagaacgccgagagcagcaaggccagcagcatcaccagagagctgcagggcagagagctgaagctgaccaacctgcaggagaacctgagcgaggtgagccaggtgaaggagaccctggagaaggagctgcagatcctgaaggagaagttcgccgaggccagcgaggaggccgtgagcgtgcagagaagcatgcaggagaccgtgaacaagctgcaccagaaggaggagcagttcaacatgctgagcagcgacctggagaagctgagagagaacctggccgacatggaggccaagttcagagagaaggacgagagagaggagcagctgatcaaggccaaggagaagctggagaacgacatcgccgagatcatgaagatgagcggcgacaacagcagccagctgaccaagatgaacgacgagctgagactgaaggagagagacgtggaggagctgcagctgaagctgaccaaggccaacgagaacgccagcttcctgcagaagagcatcgaggacatgaccgtgaaggccgagcagagccagcaggaggccgccaagaagcacgaggaggagaagaaggagctggagagaaagctgagcgacctggagaagaagatggagaccagccacaaccagtgccaggagctgaaggccagatacgagagagccaccagcgagaccaagaccaagcacgaggagatcctgcagaacctgcagaagaccctgctggacaccgaggacaagctgaagggcgccagagaggagaacagcggcctgctgcaggagctggaggagctgagaaagcaggccgacaaggccaaggccgcccagaccgccgaggacgccatgcagatcatggagcagatgaccaaggagaagaccgagaccctggccagcctggaggacaccaagcagaccaacgccaagctgcagaacgagctggacaccctgaaggagaacaacctgaagaacgtggaggagctgaacaagagcaaggagctgctgaccgtggagaaccagaagatggaggagttcagaaaggagatcgagaccctgaagcaggccgccgcccagaagagccagcagctgagcgccctgcaggaggagaacgtgaagctggccgaggagctgggcagaagcagagacgaggtgaccagccaccagaagctggaggaggagagaagcgtgctgaacaaccagctgctggagatgaagaagagagagagcaagttcatcaaggacgccgacgaggagaaggccagcctgcagaagagcatcagcatcaccagcgccctgctgaccgagaaggacgccgagctggagaagctgagaaacgaggtgaccgtgctgagaggcgagaacgccagcgccaagagcctgcacagcgtggtgcagaccctggagagcgacaaggtgaagctggagctgaaggtgaagaacctggagctgcagctgaaggagaacaagagacagctgagcagcagcagcggcaacaccgacacccaggccgacgaggacgagagagcccaggagagccagatcgacttcctgaacagcgtgatcgtggacctgcagagaaagaaccaggacctgaagatgaaggtggagatgatgagcgaggccgccctgaacggcaacggcgacgacctgaacaactacgacagcgacgaccaggagaagcagagcaagaagaagcccagactgttctgcgacatctgcgactgcttcgacctgcacgacaccgaggactgccccacccaggcccagatgagcgaggaccccccccacagcacccaccacggcagcagaggcgaggagagaccctactgcgagatctgcgagatgttcggccactgggccaccaactgcaacgacgacgagaccttctag

SEQ ID NO: 13257 - DNA, 492 bp, Artificial Sequence
  Description of Artificial Sequence: Synthetic coding sequence
atgttcagaaagatcggcatcgaggccctgaagcaggtgaccaagagatacgccagaaagcagaacagatgggtgaagaacagattcctgagcagacccggccccatcgtgccccccgtgtacggcctggaggtgagcgacgtgagcaagtgggaggagagcgtgctggagcccgccctggagatcgtgcagagcttcatccagggccacaagcccaccgccacccccatcaagatgccctacaacgaggccgagaacaagagaagctaccacctgtgcgacctgtgcgacagaatcatcatcggcgacagagagtgggccgcccacatcaagagcaagagccacctgaaccagctgaagaagagaagaagactggacagcgacgccgtgaacaccatcgagagccagagcgtgagccccgaccacaacaaggagcccaaggagaagggcagccccggccagaacgaccaggagctgaagtgcagcgtgtag

SEQ ID NO: 13258 - DNA, 1602 bp, Artificial Sequence
  Description of Artificial Sequence: Synthetic coding sequence
atggccagccccggcaaggacaactacagaatgaagagctacaagaacaacgccctgaaccccgaggagatgagaagaagaagagaggaggagggcatccagctgagaaagcagaagagagagcagcagctgttcaagagaagaaacgtggagctgatcaacgaggaggccgccatgttcgacagcctgctgatggacagctacgtgagcagcaccaccggcgagagcgtgatcaccagagagatggtggagatgctgttcagcgacgacagcgacctgcagctggccaccacccagaagttcagaaagctgctgagcaaggagcccagcccccccatcgacgaggtgatcaacacccccagagtggtggacagattcgtggagttcctgaagagaaacgagaactgcaccctgcagttcgaggccgcctgggccctgaccaacatcgccagcggcaccagccagcagaccaagatcgtgatcgaggccggcgccgtgcccatcttcatcgagctgctgaacagcgacttcgaggacgtgcaggagcaggccgtgtgggccctgggcaacatcgccggcgacagcagcgtgtgcagagactacgtgctgaactgcagcatcctgaaccccctgctgaccctgctgaccaagagcaccagactgaccatgaccagaaacgccgtgtgggccctgagcaacctgtgcagaggcaagaaccccccccccgagttcgccaaggtgagcccctgcctgcccgtgctgagcagactgctgttcagcagcgacagcgacctgctggccgacgcctgctgggccctgagctacctgagcgacggccccaacgagaagatccaggccgtgatcgacagcggcgtgtgcagaagactggtggagctgctgatgcacaacgactacaaggtggccagccccgccctgagagccgtgggcaacatcgtgaccggcgacgacatccagacccaggtgatcctgaactgcagcgccctgccctgcctgctgcacctgctgagcagccccaaggagagcatcagaaaggaggcctgctggaccatcagcaacatcaccgccggcaacagagcccagatccaggccgtgatcgacgccaacatcttccccgtgctgatcgagatcctgcagaaggccgagttcagaaccagaaaggaggccgcctgggccatcaccaacgccaccagcggcggcacccccgagcagatcagatacctggtgagcctgggctgcatcaagcccctgtgcgacctgctgaccgtgatggacagcaagatcgtgcaggtggccctgaacggcctggagaacatcctgagactgggcgagcaggagggcaagagaagcggcagcggcgtgaacccctactgcggcctgatcgaggaggcctacggcctggacaagatcgagttcctgcagagccacgagaaccaggagatctaccagaaggccttcgacctgatcgagcactacttcggcgtggaggacgacgacagcagcctggccccccaggtggacgagacccagcagcagttcatcttccagcagcccgaggcccccatggagggcttccagctgtag

SEQ ID NO: 13259 - DNA, 993 bp, Artificial Sequence; identical to SEQ ID NO: 11499
  Description of Artificial Sequence: Synthetic coding sequence

SEQ ID NO: 13260 - DNA, 576 bp, Artificial Sequence
  Description of Artificial Sequence: Synthetic coding sequence
atgagcagagagagaggcagcagaagcgaggagcccggcgccggcaacagagagagcggcagcagagagcccggcctggccgccgccgccatgagcaccgtggacctggccagagtgggcgcctgcatcctgaagcacgccgtgaccggcgaggccgtggagctgagaagcctgtggagagagcacgcctgcgtggtggccggcctgagaagattcggctgcgtggtgtgcagatggatcgcccaggacctgagcagcctggccggcctgctggaccagcacggcgtgagactggtgggcgtgggccccgaggccctgggcctgcaggagttcctggacggcgactacttcgccggcgagctgtacctggacgagagcaagcagctgtacaaggagctgggcttcaagagatacaacagcctgagcatcctgcccgccgccctgggcaagcccgtgagagacgtggccgccaagagccccggcgactacgtgcccaaggagcacatcctgcaggtgctgggcatcagcgccgaggtgtgcgccagcgaccccccccagtgcgacagagaggtgtag

SEQ ID NO: 13261 - DNA, 1050 bp, Artificial Sequence
  Description of Artificial Sequence: Synthetic coding sequence
aacaccatccacgacgtgctggacgtggaggccgccgtggtgaacctggacaacagcgtggtggacctggagaccctgcaggccctgtacgagaacagagcccagagcgacgagctggagaagatcgagaagcacggcagaagcagcaaggacaaggagaacgccaagagcctggacaagcccgagcagttcctgtacgagctgagcctgatccccaacttcagcgagagagtgttctgcatcctgttccagagcaccttcagcgagagcatctgcagcatcagaagaaagctggagctgctgcagaagctgtgcgagaccctgaagaacggccccggcgtgatgcaggtgctgggcctggtgctggccttcggcaactacatgaacggcggcaacaagaccagaggccaggccgacggcttcggcctggacatcctgcccaagctgaaggacgtgaagagcagcgacaacagcagaagcctgctgagctacatcgtgagctactacctgagaaacttcgacgaggacgccggcaaggagcagtgcctgttccccctgcccgagccccaggacctgttccaggccagccagatgaagttcgaggacttccagaaggacctgagaaagctgaagaaggacctgaaggcctgcgaggtggaggccggcaaggtgtaccaggtgagcagcaaggagcacatgcagcccttcaaggagaacatggagcagttcatcatccaggccaagatcgaccaggaggccgaggagaacagcctgaccgagacccacaagtgcttcctggagaccaccgcctacttcttcatgaagcccaagctgggcgagaaggaggtgagccccaacgccttcttcagcatctggcacgagttcagcagcgacttcaaggacttctggaagaaggagaacaagctgctgctgcaggagagagtgaaggaggccgaggaggtgtgcagacagaagaagggcaagagcctgtacaagatcaagcccagacacgacagcggcatcaagaacaacaacagcatgcacacctag

SEQ ID NO: 13262 - DNA, 570 bp, Artificial Sequence
  Description of Artificial Sequence: Synthetic coding sequence
atgaccgccagcgccagcagcttcagcagcagccagggcgtgcagcagcccagcatctacagcttcagccagatcaccagaagcctgttcctgagcaacggcgtggccgccaacgacaagctgctgctgagcagcaacagaatcaccgccatcgtgaacgccagcgtggagggccagagaatcctgagaggcatccagtacatcaaggtgcccgtgaccgacgccagagacagcagactgtacgacttcttcgaccccatcgccgacctgatccacaccatcgacatgagacagggcagaaccctgctgcactgcatggccggcgtgagcagaagcgccagcctgtgcctggcctacctgatgaagtaccacagcatgagcctgctggacgcccacacctggaccaagagcagaagacccatcatcagacccaacaacggcttctgggagcagctgatcaactacgagttcaagctgttcaacaacaacaccgtgagaatgatcaacagccccgtgggcaacatccccgacatctacgagaaggacctgagaatgatgatcagcatgtag

SEQ ID NO: 13263 - DNA, 549 bp, Artificial Sequence; identical to SEQ ID NO: 9755
  Description of Artificial Sequence: Synthetic coding sequence

SEQ ID NO: 13264 - DNA, 387 bp, Artificial Sequence
  Description of Artificial Sequence: Synthetic coding sequence
atggtgttcagaagattcgtggaggtgggcagagtggcctacgtgagcttcggcccccacgccggcaagctggtggccatcgtggacgtgatcgaccagaacagagccctggtggacggcccctgcacccaggtgagaagacaggccatgcccttcaagtgcatgcagctgaccgacttcatcctgaagttcccccacagcgcccaccagaagtacgtgagacaggcctggcagaaggccgacatcaacaccaagtgggccgccaccagatgggccaagaagatcgaggccagagagagaaaggccaagatgaccgacttcgacagattcaaggtgatgaaggccaagaagatgagaaacagaatcatcaagaacgacaccagatag

SEQ ID NO: 13265 - DNA, 492 bp, Artificial Sequence; identical to SEQ ID NO: 13257
  Description of Artificial Sequence: Synthetic coding sequence

SEQ ID NO: 13266 - DNA, 1224 bp, Artificial Sequence
  Description of Artificial Sequence: Synthetic coding sequence
atggccgccgagctgtacgcccccgccagcgccgccgccgccgacctggccaacagcaacgccggcgccgccgtgggcagaaaggccggccccagaagcccccccagcgcccccgcccccgccccccccccccccgcccccgccccccccaccctgggcaacaaccaccaggagagccccggctggagatgctgcagacccaccctgagagagagaaacgccctgatgttcaacaacgagctgatggccgacgtgcacttcgtggtgggcccccccggcgccaccagaaccgtgcccgcccacaagtacgtgctggccgtgggcagcagcgtgttctacgccatgttctacggcgacctggccgaggtgaagagcgagatccacatccccgacgtggagcccgccgccttcctgatcctgctgaagtacatgtacagcgacgagatcgacctggaggccgacaccgtgctggccaccctgtacgccgccaagaagtacatcgtgcccgccctggccaaggcctgcgtgaacttcctggagaccagcctggaggccaagaacgcctgcgtgctgctgagccagagcagactgttcgaggagcccgagctgacccagagatgctgggaggtgatcgacgcccaggccgagatggccctgagaagcgagggcttctgcgagatcgacagacagaccctggagatcatcgtgaccagagaggccctgaacaccaaggaggccgtggtgttcgaggccgtgctgaactgggccgaggccgagtgcaagagacagggcctgcccatcacccccagaaacaagagacacgtgctgggcagagccctgtacctggtgagaatccccaccatgaccctggaggagttcgccaacggcgccgcccagagcgacatcctgaccctggaggagacccacagcatcttcctgtggtacaccgccaccaacaagcccagactggacttccccctgaccaagagaaagggcctggccccccagagatgccacagattccagagcagcgcctacagaagcaaccagtggagatacagaggcagatgcgacagcatccagttcgccgtggacagaagagtgttcatcgccggcctgggcctgtacggcagcagcagcggcaaggccgagtacagcgtgaagatcgagctgaagagactgggcgtggtgctggcccagaacctgaccaagttcatgagctag

SEQ ID NO: 13267 - DNA, 603 bp, Artificial Sequence
  Description of Artificial Sequence: Synthetic coding sequence
atgctggagctggtggcccagaagcagagagagagagaggagagagaggagagagaggccctggagagagagagacagagaagaagacagggccaggagctgagcgccgccagacagagactgcaggaggacgagatgagaagagccgccgaggagagaagaagagagaaggccgaggagctggccgccagacagagagtgagagagaagatcgagagagacaaggccgagagagccaagaagtacggcggcagcgtgggcagccagcccccccccgtggcccccgagcccggccccgtgcccagcagccccagccaggagccccccaccaagagagagtacgaccagtgcagaatccaggtgagactgcccgacggcaccagcctgacccagaccttcagagccagagagcagctggccgccgtgagactgtacgtggagctgcacagaggcgaggagctgggcggcggccaggaccccgtgcagctgctgagcggcttccccagaagagccttcagcgaggccgacatggagagacccctgcaggagctgggcctggtgcccagcgccgtgctgatcgtggccaagaagtgccccagctag

SEQ ID NO: 13268 - DNA, 885 bp, Artificial Sequence
  Description of Artificial Sequence: Synthetic coding sequence
atgggcctggccagctggagccagctggccagcacccccagagcccccggcagcagagacgccagatgggagagaagagagcccgccctgagaggcgccaaggacagactgaccatcggcaagcacctggacatgggcagcccccagctgagaaccagagacagaggctggcccagccccagacccgagagagagaagagaaccagccagagcgccagaagacccacctgcaccgagagcagatggaagagcgaggaggaggtggagagcgacgacgagtacctggccctgcccgccagactgacccaggtgagcagcctggtgagctacctgggcagcatcagcaccctggtgaccctgcccaccggcgacatcaagggccagagccccctggaggtgagcgacagcgacggccccgccagcttccccagcagcagcagccagagccagctgccccccggcgccgccctgcagggcagcggcgaccccgagggccagaacccctgcttcctgagaagcttcgtgagagcccacgacagcgccggcgagggcagcctgggcagcagccaggccctgggcgtgagcagcggcctgctgaagaccagacccagcctgcccgccagactggacagatggcccttcagcgaccccgacgtggagggccagctgcccagaaagggcggcgagcagggcaaggagagcctggtgcagtgcgtgaaggtgatgaccctgaacgtgagaaagctgtgcgtgcaggtgagctgcctgttcccccagagcaccaacatcatcatcaagcacgtgcacgtggaccaggccctgttcatgtgccaggccctgtgctgcaccctgagctacagcgtgctgaccaccttcaccagatag

SEQ ID NO: 13269 - DNA, 354 bp, Artificial Sequence
  Description of Artificial Sequence: Synthetic coding sequence
atggtgagaaagatcaccctggtgagcgccgcccccggcaaggtgatctgcgagatgaaggtggaggaggagcacaccaacgccatcggcaccctgcacggcggcctgaccgccaccctggtggacaacatcagcaccatggccctgctgtgcaccgagagaggcgcccccggcgtgagcgtggacatgaacatcacctacatgagccccgccaagctgggcgaggacatcgtgatcaccgcccacgtgctgaagcagggcaagaccctggccttcaccagcgtggacctgaccaacaaggccaccggcaagctgatcgcccagggcagacacaccaagcacctgggcaactag

SEQ ID NO: 13270 - DNA, 840 bp, Artificial Sequence
  Description of Artificial Sequence: Synthetic coding sequence
atgaccagcggcaagatcaagaagttcatccaggagaacatcttcggcatctgcccccacatgaccgaggacaacaaggacctgatccagggcaaggacctgctgatcgcctactacgacgtggactacgagaagaacgccaagggcagcaactactggagaaacagagtgatgatggtggccaagaagttcctggacgccggccacaagctgaacttcgccgtggccagcagaaagaccttcagccacgagctgagcgacttcggcctggagagcaccgccggcgagatccccgtggtggccatcagaaccgccaagggcgagaagttcgtgatgcaggaggagttcagcagagacggcaaggccctggagagattcctgcaggactacttcgacggcaacctgaagagatacctgaagagcgagcccatccccgagagcaacgacggccccgtgaaggtggtggtggccgagaacttcgacgagatcgtgaacaacgagaacaaggacgtgctgatcgagttctacgccccctggtgcggccactgcaagaacctggagcccaagtacaaggagctgggcgagaagctgagcaaggaccccaacatcgtgatcgccaagatggacgccaccgccaacgacgtgcccagcccctacgaggtgagaggcttccccaccatctacttcagccccgccaacaagaagctgaaccccaagaagtacgagggcggcagagagctgagcgacttcatcagctacctgcagagagaggccaccaacccccccgtgatccaggaggagaagcccaagaagaagaagaaggcccaggaggacctgtag

SEQ ID NO: 13271 - DNA, 3228 bp, Artificial Sequence
  Description of Artificial Sequence: Synthetic coding sequence
atgagccagggcttccaccccgagagagaccccagcgacctgaagaaggtgaaggccgtggaggagaacggcgaggaggccgagcccgtgagaaacggcgccgagagcgtgagcgagggcgagggcatcgacgccaacagcggcagcaccgacagcagcggcgacggcgtgaccttccccttcaagcccgagagctggaagcccaccgacaccgagggcaagaagcagtacgacagagagttcctgctggacttccagttcatgcccgcctgcatccagaagcccgagggcctgccccccatcagcgacgtggtgctggacaagatcaaccagcccaagctgcccatgagaaccctggaccccagaatcctgcccagaggccccgacttcacccccgccttcgccgacttcggcagacagacccccggcggcagaggcgtgcccatctgcaaggtgcagagcagacacggcctgcccatcctggagcagagcaaggcccccacctgcccccccctggtgatgagccacccccccatgaagagcctgcccctgggcctgctgaacgtgggcagcagaagaagccagcccggccagagaagagagcccagaaagatcatcaccgtgagcgtgaaggaggacgtgcacctgaagaaggccgagaacgcctggaagcccagccagaagagagacagccaggccgacgaccccgagaacatcaagacccaggagctgttcagaaaggtgagaagcatcctgaacaagctgaccccccagatgttcaaccagctgatgaagcaggtgagcggcctgaccgtggacaccgaggagagactgaagggcgtgatcgacctggtgttcgagaaggccatcgacgagcccagcttcagcgtggcctacgccaacatgtgcagatgcctggtgaccctgaaggtgcccatggccgacaagcccggcaacaccgtgaacttcagaaagctgctgctgaacagatgccagaaggagttcgagaaggacaaggccgacgacgacgtgttcgagaagaagcagaaggagctggaggccgccagcgcccccgaggagagaaccagactgcacgacgagctggaggaggccaaggacaaggccagaagaagaagcatcggcaacatcaagttcatcggcgagctgttcaagctgaagatgctgaccgaggccatcatgcacgactgcgtggtgaagctgctgaagaaccacgacgaggagagcctggagtgcctgtgcagactgctgaccaccatcggcaaggacctggacttcgagaaggccaagcccagaatggaccagtacttcaaccagatggagaagatcgtgaaggagagaaagaccagcagcagaatcagattcatgctgcaggacgtgatcgacctgagactgtgcaactgggtgagcagaagagccgaccagggccccaagaccatcgagcagatccacaaggaggccaagatcgaggagcaggaggagcagagaaaggtgcagcagctgatgaccaaggagaagagaagacccggcgtgcagagagtggacgagggcggctggaacaccgtgcagggcgccaagaacagcagagtgctggaccccagcaagttcctgaagatcaccaagcccaccatcgacgagaagatccagctggtgcccaaggcccagctgggcagctggggcaagggcagcagcggcggcgccaaggccagcgagaccgacgccctgagaagcagcgccagcagcctgaacagattcagcgccctgcagccccccgcccccagcggcagcacccccagcacccccgtggagttcgacagcagaagaaccctgaccagcagaggcagcatgggcagagagaagaacgacaagcccctgcccagcgccaccgccagacccaacaccttcatgagaggcggcagcagcaaggacctgctggacaaccagagccaggaggagcagagaagagagatgctggagaccgtgaagcagctgaccggcggcgtggacgtggagagaaacagcaccgaggccgagagaaacaagaccagagagagcgccaagcccgagatcagcgccatgagcgcccacgacaaggccgccctgagcgaggaggagctggagagaaagagcaagagcatcatcgacgagttcctgcacatcaacgacttcaaggaggccatgcagtgcgtggaggagctgaacgcccagggcctgctgcacgtgttcgtgagagtgggcgtggagagcaccctggagagaagccagatcaccagagaccacatgggccagctgctgtaccagctggtgcagagcgagaagctgagcaagcaggacttcttcaagggcttcagcgagaccctggagctggccgacgacatggccatcgacatcccccacatctggctgtacctggccgagctggtgacccccatgctgaaggagggcggcatcagcatgagagagctgaccatcgagttcagcaagcccctgctgcccgtgggcagagccggcgtgctgctgagcgagatcctgcacctgctgtgcaagcagatgagccacaagaaggtgggcgccctgtggagagaggccgacctgagctggaaggacttcctgcccgagggcgaggacgtgcacaacttcctgctggagcagaagctggacttcatcgagagcgacagcccctgcagcagcgaggccctgagcaagaaggagctgagcgccgaggagctgtacaagagactggagaagctgatcatcgaggacaaggccaacgacgagcagatcttcgactgggtggaggccaacctggacgagatccagatgagcagccccaccttcctgagagccctgatgaccgccgtgtgcaaggccgccatcatcgccgacagcagcaccttcagagtggacaccgccgtgatcaagcagagagtgcccatcctgctgaagtacctggacagcgacaccgagaaggagctgcaggccctgtacgccctgcaggccagcatcgtgaagctggaccagcccgccaacctgctgagaatgttcttcgactgcctgtacgacgaggaggtgatcagcgaggacgccttctacaagtgggagagcagcaaggaccccgccgagcagaacggcaagggcgtggccctgaagagcgtgaccgccttcttcacctggctgagagaggccgaggaggagagcgaggacaactag

SEQ ID NO: 13272 - DNA, 474 bp, Artificial Sequence
  Description of Artificial Sequence: Synthetic coding sequence
atgaagtgcatcccctacagcgtgctgctgaaggacctggagatgagaaacctgagagagctggaggacctgatcatcgaggccgtgtacaccgacatcatccagggcaagctggaccagagaaaccagctgctggaggtggacttctgcatcggcagagacatcagaaagaaggacatcaacaacatcgtgaagaccctgcacgagtggtgcgacggctgcgaggccgtgctgctgggcatcgagcagcaggtgctgagagccaaccagtacaaggagaaccacaacagaacccagcagcaggtggaggccgaggtgaccaacatcaagaagaccctgaaggccaccgccagcagcagcgcccaggagatggagcagcagctggccgagagagagtgccccccccacgccgagcagagacagcccaccaagaagatgagcaaggtgaagggcctggtgagcagcagacactag

SEQ ID NO: 13273 - DNA, 837 bp, Artificial Sequence
  Description of Artificial Sequence: Synthetic coding sequence
atggactgcagagagatggacctgtacgaggactaccagagccccttcgacttcgacgccggcgtgaacaagagctacctgtacctgagccccagcggcaacagcagcccccccggcagccccaccctgcagaagttcggcctgctgagaaccgaccccgtgcccgaggagggcgaggacgtggccgccaccatcagcgccaccgagaccctgagcgaggaggagcaggaggagctgagaagagagctggccaaggtggaggaggagatccagaccctgagccaggtgctggccgccaaggagaagcacctggccgagatcaagagaaagctgggcatcaacagcctgcaggagctgaagcagaacatcgccaagggctggcaggacgtgaccgccaccagcgcctacaagaagaccagcgagaccctgagccaggccggccagaaggccagcgccgccttcagcagcgtgggcagcgtgatcaccaagaagctggaggacgtgaagaacagccccaccttcaagagcttcgaggagaaggtggagaacctgaagggcagccccaagaacgtggagagcttcgccagcatgctgagacacagccccctgacccagatgggccccgccaaggacaagctggtgatcggcagaatcttccacatcgtggagaacgacctgtacatcgacttcggcggcaagttccactgcgtgtgcagaagacccgaggtggacggcgagagccccatcagctggtacgccgtgtggagaagattcagccaggtgatgatcacctgcttcagcagcaacagcgacttcggcaagcacagaaagagatag

SEQ ID NO: 13274 - DNA, 3123 bp, Artificial Sequence; identical to SEQ ID NO: 10213
  Description of Artificial Sequence: Synthetic coding sequence

SEQ ID NO: 13275 - DNA, 1809 bp, Artificial Sequence
  Description of Artificial Sequence: Synthetic coding sequence
atgagcgacaagagcgacctgaaggccgagctggagagaaagaagcagagactggcccagatcagagaggagaagaagagaaaggaggaggagagaaagaagaaggaggccgacatgcagcagaagaaggagcccgtgcaggacgacagcgacctggacagaaagagaagagagaccgaggccctgctgcagagcatcggcatcagccccgagccccccctggtgcccacccccatgagccccagcagcaagagcgtgagcacccccagcgaggccggcagccaggacagcggcgacctgggccccctgaccagaagaagactgcacaagctgggcgtgagcaaggtgacccaggtggacttcctgcccagagaggtggtgagctacagcaaggagacccagacccccctggccacccaccagagcgaggaggacgaggaggacgaggagatggtggagagcaaggtgggccaggacagcgagctggagaaccaggacaagaagcaggaggtgaaggaggccccccccagagagctgaccgaggaggagaagcagcagatcctgcacagcgaggagttcctgatcttcttcgacagaaccatcagagtgatcgagagagccctggccgaggacagcgacatcttcttcgactacagcggcagagagctggaggagaaggacggcgacgtgcaggccggcgccaacctgagcttcaacagacagttctacgacgagcactggagcaagcacagagtggtgacctgcatggactggagcctgcagtaccccgagctgatggtggccagctacaacaacaacgaggacgccccccacgagcccgacggcgtggccctggtgtggaacatgaagttcaagaagaccacccccgagtacgtgttccactgccagagcagcgtgatgagcgtgtgcttcgccagattccaccccaacctggtggtgggcggcacctacagcggccagatcgtgctgtgggacaacagaagccacagaagaacccccgtgcagagaacccccctgagcgccgccgcccacacccaccccgtgtactgcgtgaacgtggtgggcacccagaacgcccacaacctgatcaccgtgagcaccgacggcaagatgtgcagctggagcctggacatgctgagcaccccccaggagagcatggagctggtgtacaacaagagcaagcccgtggccgtgaccggcatggccttccccaccggcgacgtgaacaacttcgtggtgggcagcgaggagggcaccgtgtacaccgcctgcagacacggcagcaaggccggcatcggcgaggtgttcgagggccaccagggccccgtgaccggcatcaactgccacatggccgtgggccccatcgacttcagccacctgttcgtgaccagcagcttcgactggaccgtgaagctgtggaccaccaagcacaacaagcccctgtacagcttcgaggacaacgccgactacgtgtacgacgtgatgtggagccccgtgcaccccgccctgttcgcctgcgtggacggcatgggcagactggacctgtggaacctgaacaacgacaccgaggtgcccaccgccagcgtggccatcgagggcgccagcgccctgaacagagtgagatgggcccaggccggcaaggaggtggccgtgggcgacagcgagggcagaatctgggtgtacgacgtgggcgagggcctggccatgctgcccggctggagccagaacagctggacccaggccatcctgctgtgctggccccccaaggtgctgggcctgcagacctag

SEQ ID NO: 13276 - DNA, 2847 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccagcacatgcagatgaccatccaggccctgcaggacgagctgagaatccagagagacctgaaccagctgttccagcaggacagcagcagcagaaccggcgagccctgcgtggccgagctgaccgaggagaacttccagagactgcacgccgagcacgagagacaggccaaggagctgttcctgctgagaaagaccctggaggagatggagctgagaatcgagacccagaagcagaccctgaacgccagagacgagagcatcaagaagctgctggagatgctgcagagcaagggcctgagcgccaaggccaccgaggaggaccacgagagaaccagaagactggccgaggccgagatgcacgtgcaccacctggagagcctgctggagcagaaggagaaggagaacagcatgctgagagaggagatgcacagaagattcgagaacgcccccgacagcgccaagaccaaggccctgcagaccgtgatcgagatgaaggacagcaagatcagcagcatggagagaggcctgagagacctggaggaggagatccagatgctgaagagcaacggcgccctgagcaccgaggagagagaggaggagatgaagcagatggaggtgtacagaagccacagcaagttcatgaagaacaagatcggccaggtgaagcaggagctgagcagaaaggacaccgagctgctggccctgcagaccaagctggagaccctgaccaaccagttcagcgacagcaagcagcacatcgaggtgctgaaggagagcctgaccgccaaggagcagagagccgccatcctgcagaccgaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagcctgttcagcagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccaggacgaggaggagggcatctgggcctag

SEQ ID NO: 13277 - DNA, 2742 bp, Artificial Sequence
  Description of Artificial Sequence: Synthetic coding sequence
atggaggtgggcagcgaggaggagaagtgggagaagctggacgccgagttcgaccacttcgtggtggacatgaagcccttcgtgctgaagctgccccacagaaccgagagacagagatgcgccctgtggatcagaaagctgtgcgagcccagcggcaccggcgccggcatcatgggcagaaagaacagaaacctgtacgccaagctgctgctgcacatgctgaagagaggcgccctggagggccccttcacccacagacccgagcccggcaccctgaagatcctgcccagctacatgagcatctacttcgacgagcccaaccccgccagagccaagggcagcagccccgagggcctgcccgcctgggtgctgggcgagctggagaccagcgagcacaagctgaacgagagctggaagctgagcagcggcgaggacaacaccctggtgcagagccccaccgacgtgtacagcagagagcagtacaccggcaagctgagagtgagaagccacagcctgagccccacccacagagaggacggccagaacatcacccccaagatctgcgaggtgtacagcaagaagagccccgtgagcctggacgacagcgacatcgaggccagactgaacagctggaacctgggcctggacatgaagaccaagatgatggaggccaagttccacgaggagaagctgaagctgcagcagaagcacgacgccgacgtgcagaagatcctggagagaaagaacaacgagatcgaggagctgaagaccctgtacagaagcaagcagcacgagaccgaggagaccatcagaaagctggagaagaaggtgcagaccctgatcagagactgccaggtgatcagagagaccaaggaggaccagatcgccgagctgaagaagatctgcgagcagagcaccgagagcctgaacaacgactgggagaagaagctgcacaacgccgtggccgagatggagcaggagaagttcgacctgcagaagcagcacaccgagaacatccaggagctgctggaggacaccaacgtgagactgaacaagatggagagcgagtacatggcccagacccagagcaccaaccacatgatcaaggagctggaggccagagtgcagcagctgaccggcgaggccgagaacagcaacctgcagagacagaagctgatccaggagaaggccgagctggagagatgctaccagatcacctgcagcgagctgcaggaggtgaaggccagaagaaacaccctgcacaaggagaaggaccacctggtgaacgactacgagcagaacatgaagctgctgcagaccaagtacgacgccgacatcaacctgctgaagcaggagcacgccctgagcgccagcaaggccagcagcatgatcgaggagctggagcagaacgtgtgccagctgaagcagcagctgcaggagagcgagctgcagagaaagcagcagctgagagaccaggagaacaagttccagatggagaagagccacctgaagcacatctacgagaagaaggcccacgacctgcagagcgagctggacaagggcaaggaggacacccagaagaagatccacaagttcgaggaggccctgaaggagaaggaggagcagctgaccagagtgaccgaggtgcagagactgcaggcccagcaggccgacgccgccctggaggagttcaagagacaggtggagctgaacagcgagaaggtgtacgccgagatgaaggagcagatggagaaggtggaggccgacctgaccagaagcaagagcctgagagagaagcagagcaaggagttcctgtggcagctggaggacatcagacagagatacgagcagcagatcgtggagctgaagctggagcacgagcaggagaagacccacctgctgcagcagcacaacgccgagaaggacagcctggtgagagaccacgagagagagatcgagaacctggagaagcagctgagagccgccaacatggagcacgagaaccagatccaggagttcaagaagagagacgcccaggtgatcgccgacatggaggcccaggtgcacaagctgagagaggagctgatcaacgtgaacagccagagaaagcagcagctggtggagctgggcctgctgagagaggaggagaagcagagagccaccagagagcacgagatcgtggtgaacaagctgaaggccgagagcgagaagatgaagatcgagctgaagaagacccacgccgccgagaccgagatgaccctggagaaggccaacagcaagctgaagcagatcgagaaggagtacacccagaagctggccaagagcagccagatcatcgccgagctgcagaccaccatcagcagcctgaaggaggagaacagccagcagcagctggccgccgagagaagactgcaggacgtgagacagaagttcgaggacgagaagaagcagctgatcagagacaacgaccaggccatcaaggtgctgcaggacgagctggagaacagaagcaaccaggtgagatgcgccgagaagaagctgcagcacaaggagctggagagccaggagcagatcacctacatcagacaggagtacgagaccaagctgaagggcctgatgcccgccagcctgagacaggagctggaggacaccatcagcagcctgaagagccaggtgaacttcctgcagaagagagccagcatcctgcaggaggagctgaccacctaccagggcagaagatag

SEQ ID NO: 13278 - DNA, 825 bp, Artificial Sequence
  Description of Artificial Sequence: Synthetic coding sequence
atgcaggacgagaagctgagagacgagaccgagcagcccgtgagcaaggtgatcgagagaaacagactgagaaccgtgctgaagaacctgagcctgctgaagctgctgaagagcagcaacagaagaatccaggagctgcacaagctggccaagagatgctggcacagcctgctgagcgtgcccaagatcctgagaatcagcagcggcgagaacagcgcctgcaacaagaccaagcagaacaacgaggagttccaggagatcggctgcagcgagaaggagctgaagagcaagaagctggagagcaccggcgaccccaagaagaaggagtacaaggagtggaagagccaggtgcagagcggcatgagaaacaaggagaagaccagcctggccgccatgcccagaaaggagaagcacatcgagcccgaggtgcccagaaccagcagagacgacagcctgaaccccggcgtgcagggcagacagcccctgaccgagggccccagagtgatcttcatcaagccctacagaaacagaacccccatgggccacatgaagcagctggacgtggccgaccagtggatctggttcgagggcctgcccaccagaatccacctgcccgcccccagagtgatgtgcagaagcagcaccctgagatgggtgaagagaagatgcaccagattctgcagcgccagcctggagatgcccatgtggcacccctacaaggtggacgtgacctggaccagagccagaggcgccagcagaggctggagaagcagacaccagctgaagggcagaaacggctggagaaacagcagagtgtacaagtag

SEQ ID NO: 13279 - DNA, 156 bp, Artificial Sequence
  Description of Artificial Sequence: Synthetic coding sequence
atgcagctgagacacatcggcgacaacatcgaccacagaatggtgagagaggacctgcagcaggacggcagagacgccctggaccacttcgtgttcttcttcttcagaagagtgcaggtgctgctgcacttcttctggaacaaccacctgctgtag

SEQ ID NO: 13280 - DNA, 444 bp, Artificial Sequence
  Description of Artificial Sequence: Synthetic coding sequence
atggccggcggcgccagagaggtgctgaccctgcagctgggccacttcgccggcttcgtgggcgcccactggtggaaccagcaggacgccgccctgggcagagccaccgacagcaaggagccccccggcgagctgtgccccgacgtgctgtacagaaccggcagaaccctgcacggccaggagacctacacccccagactgatcctgatggacctgaagggcagcctgagcagcctgaaggaggagggcggcctgtacagagacaagcagctggacgccgccatcgcctggcagggcaagctgaccacccacaaggaggagctgtaccccaagaacccctacctgcaggacttcctgagcgccgaggtgagagccagcgtgctgaacttcctgaccagatgccacaacctgagagtgagcatcggcgccggcagcgccgagtag

SEQ ID NO: 13281 - DNA, 1677 bp, Artificial Sequence
  Description of Artificial Sequence: Synthetic coding sequence
atgagcgtgagcgtgcacgagaccagaaagagcagaagcagcaccggcagcatgaacgtgaccctgttccacaaggccagccaccccgactgcgtgctggccgccagcagcagatacttcgaggccatgttcagccacggcctgagagagagcagagacgacaccgtgaacttccaggacaacctgcaccccgaggtgctggagctgctgctggacttcgcctacagcagcagaatcgccatcaacgaggagaacgccgagagcctgctggaggccggcgacatgctgcagttccacgacgtgagagacgccgccgccgagttcctggagaagaacctgttccccagcaactgcctgggcatgatgctgctgagcgacgcccaccagtgcagaagactgtacgagttcagctggagaatgtgcctggtgcacttcgagaccgtgagacagagcgaggacttcaacagcctgagcaaggacaccctgctggacctgatcagcagcgacgagctggagaccgaggacgagagagtggtgttcgaggccatcctgcagtgggtgaagcacgacctggagcccagaaaggtgcacctgcccgagctgctgagaagcgtgagactggccctgctgcccagcgactgcctgcaggaggccgtgagcagcgaggccctgctgatggccgacgagagaaccaagctgatcatggacgaggccctgagatgcaagaccagaatcctgcagaacgacggcgtggtgaccagcccctgcgccagacccagaaaggccggccacaccctgctgatcctgggcggccagaccttcatgtgcgacaagatctaccaggtggaccacaaggccaaggagatcatccccaaggccgacctgcccagccccagaaaggagttcagcgccagcgccatcggctgcaaggtgtacgtgaccggcggcagaggcagcgagaacggcgtgagcaaggacgtgtgggtgtacgacaccgtgcacgaggagtggagcaaggccgcccccatgctgatcgccagattcggccacggcagcgccgagctggagaactgcctgtacgtggtgggcggccacaccagcctggccggcgtgttccccgccagccccagcgtgagcctgaagcaggtggagaagtacgaccccggcgccaacaagtggatgatggtggcccccctgagagacggcgtgagcaacgccgccgtggtgagcgccaagctgaagctgttcgtgttcggcggcaccagcatccacagagacatggtgagcaaggtgcagtgctacgaccccagcgagaacagatggaccatcaaggccgagtgcccccagccctggagatacaccgccgccgccgtgctgggcagccagatcttcatcatgggcggcgacaccgagttcaccgccgccagcgcctacagattcgactgcgagaccaaccagtggaccagaatcggcgacatgaccgccaagagaatgagctgccacgccctggccagcggcaacaagctgtacgtggtgggcggctacttcggcacccagagatgcaagaccctggactgctacgaccccaccagcgacacctggaactgcatcaccaccgtgccctacagcctgatccccaccgccttcgtgagcacctggaagcacctgcccgcctag

SEQ ID NO: 13282 - DNA, 2916 bp, Artificial Sequence
  Description of Artificial Sequence: Synthetic coding sequence
atgaacttcctgagaggcgtgatgggcggccagagcgccggcccccagcacaccgaggccgagaccgtgagaggcgccgccggcctgggcctgggcaagggcagcggccagggcagaggcagaagcaccagaagacccgaggagtgcggcctgaagttcagacacagcttcagactggtgaagcacatcctgtaccacgtgaccatcaacgtgagcgacagcgagatcatcggctacgccctggacaccctgtacaacatcatcagcaacgaggaggaggaggaggtgggcggcagccaggaggagaacagcaccagacagagcgaggacctgggcagccagttcaccgagatcttcatcaagcagcaggagaacgtgaccctgctgctgagcctgctggaggagttcgacttccacgtgagatggcccggcgtgaagctgctgaccagcctgctgaagcagctgggcccccaggtgcagcagatcatcctggtgagccccatgggcgtgagcagactgatggacctgctggccgacagcagagaggtgatcagaaacgacggcgtgctgctgctgcaggccctgaccagaagcaacggcgccatccagaagatcgtggccttcgagaacgccttcgagagactgctggacatcatcagcgaggagggcaacagcgacggcggcatcgtggtggaggactgcctgatcctgctgcagaacctgctgaagaacaacaacagcaaccagaacttcttcaaggagggcagctacatccagagaatgaagccctggttcgaggtgggcgacgagaacagcggctggagcgcccagaaggtgaccaacctgcacctgatgctgcagctggtgagagtgctggtgagccccaccaacccccccggcgccaccagcagctgccagaaggccatgttccagtgcggcctgctgcagcagctgtgcaccatcctgatggccaccggcgtgcccgccgacatcctgaccgagaccatcaacaccgtgagcgaggtgatcagaggctgccaggtgaaccaggactacttcgccagcgtgaacgcccccagcaacccccccagacccgccatcgtggtgctgctgatgagcatggtgaacgagagacagcccttcgtgctgagatgcgccgtgctgtactgcttccagtgcttcctgtacaagaaccagaagggccagggcgagatcgtgagcaccctgctgcccagcaccatcgacgccaccggcaacagcgtgagcgccggccagctgctgtgcggcggcctgttcagcaccgacagcctgagcaactggtgcgccgccgtggccctggcccacgccctgcaggagaacgccacccagaaggagcagctgctgagagtgcagctggccaccagcatcggcaacccccccgtgagcctgctgcagcagtgcaccaacatcctgagccagggcgacaagatcgacagaagaggcagcaagatccagaccagagtgggcctgctgatgctgctgtgcacctggctgagcaactgccccatcgccgtgacccacttcctgcacaacagcgccaacgtgcccttcctgaccggccagatcgccgagaacctgggcgaggaggagcagctggtgcagggcctgtgcgccctgctgctgggcatcagcatctacttcaacgacaacagcctggagagctacatgaaggagaagctgaagcagctgatcgagaagagaatcggcaaggagaacttcatcgagaagctgggcttcatcagcaagcacgagctgtacagcagagccagccagaagccccagcccaacttccccagccccgagtacatgatcttcgaccacgagttcaccaagctggtgaaggagctggagggcgtgatcaccaaggccatctacaagagcagcgaggaggacaagaaggaggaggaggtgaagaagaccctggagcagcacgacaacatcgtgacccactacaagaacatgatcagagagcaggacctgcagctggaggagctgagacagcaggtgagcaccctgaagtgccagaacgagcagctgcagaccgccgtgacccagcaggtgagccagatccagcagcacaaggaccagtacaacctgctgaagatccagctgggcaaggacaaccagcaccagggcagctacagcgagggcgcccagatgaacggcatccagcccgaggagatcggcagactgagagaggagatcgaggagctgaagagaaaccaggagctgctgcagagccagctgaccgagaaggacagcatgatcgagaacatgaagagcagccagaccagcggcaccaacgagcagagcagcgccatcgtgagcgccagagacagcgagcaggtggccgagctgaagcaggagctggccaccctgaagagccagctgaacagccagagcgtggagatcaccaagctgcagaccgagaagcaggagctgctgcagaagaccgaggccttcgccaagagcgtggaggtgcagggcgagaccgagaccatcatcgccaccaagaccaccgacgtggagggcagactgagcgccctgctgcaggagaccaaggagctgaagaacgagatcaaggccctgagcgaggagagaaccgccatcaaggagcagctggacagcagcaacagcaccatcgccatcctgcagaccgagaaggacaagctggagctggagatcaccgacagcaagaaggagcaggacgacctgctggtgctgctggccgaccaggaccagaagatcctgagcctgaagaacaagctgaaggacctgggccaccccgtggaggaggaggacgagctggagagcggcgaccaggaggacgaggacgacgagagcgaggaccccggcaaggacctggaccacatctag

SEQ ID NO: 13283 - DNA, 258 bp, Artificial Sequence
  Description of Artificial Sequence: Synthetic coding sequence
atgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgccggctacaagagcagaagcctggccagaagctgcctgagccacttcaagagcaaccagccctacgccagcagactgggcggccccacctgcaaggtgtag

SEQ ID NO: 13284 - DNA, 174 bp, Artificial Sequence
  Description of Artificial Sequence: Synthetic coding sequence
tgaggcagagcccccggccccgccatcggcggcagaagagccggcgacagctgccccggctggagaagaagaagcagaagcagaggcagaggccagagactgagccacggccccagaagaagaccccagctgctgaccgagaccagaagacccgtgctggtgcagtggctgtag

SEQ ID NO: 13285 - DNA, 936 bp, Artificial Sequence
  Description of Artificial Sequence: Synthetic coding sequence
atggtgagcctgagagtgaaccccctgagcctggtggagatcatcctgcacgtggtgagacagatgaccgaccccaacgtggccctgaccttcctggagaagaccagagagaaggtgaagagcagcgacgaggccgtgatcctgtgcaagaccgccatcggcgccctgaagctgaacatcggcgacctgcaggtgaccaaggagaccatcgaggacgtggaggagatgctgaacaacctgcccggcgtgaccagcgtgcacagcagattctacgacctgagcagcaagtactaccagaccatcggcaaccacgccagctactacaaggacgccctgagattcctgggctgcgtggacatcaaggacctgcccgtgagcgagcagcaggagagagccttcaccctgggcctggccggcctgctgggcgagggcgtgttcaacttcggcgagctgctgatgcaccccgtgctggagagcctgagaaacaccgacagacagtggctgatcgacaccctgtacgccttcaacagcggcaacgtggagagattccagaccctgaagaccgcctggggccagcagcccgacctggccgccaacgaggcccagctgctgagaaagatccagctgctgtgcctgatggagatgaccttcaccagacccgccaaccacagacagctgaccttcgaggagatcgccaagagcgccaagatcaccgtgaacgaggtggagctgctggtgatgaaggccctgagcgtgggcctggtgaagggcagcatcgacgaggtggacaagagagtgcacatgacctgggtgcagcccagagtgctggacctgcagcagatcaagggcatgaaggacagactggagttctggtgcaccgacgtgaagagcatggagatgctggtggagcaccaggcccacgacatcctgacctag

SEQ ID NO: 13286 - DNA, 1161 bp, Artificial Sequence
  Description of Artificial Sequence: Synthetic coding sequence
atgaagagcctgaaggcctgcaagagagagatcaagagcgtgatgaacaccgccggcaacagcgcccccagcctgttcctgaagagcaacttcgagtacctgagaggcaactacagaaaggccgtgaagctgctgaacagcagcaacatcgccgagcaccccggcttcatgaagaccggcgagtgcctgagatgcatgttctggaacaacctgggctgcatccacttcgccatgagcaagcacaacctgggcatcttctacttcaagaaggccctgcaggagaacgacaacgtgtgcgcccagctgagcgccggcagcaccgaccccggcaagaagttcagcggcagacccatgtgcaccctgctgaccaacaagagatacgagctgctgtacaactgcggcatccagctgctgcacatcggcagacccctggccgccttcgagtgcctgatcgaggccgtgcaggtgtaccacgccaaccccagactgtggctgagactggccgagtgctgcatcgccgccaacaagggcaccagcgagcaggagaccaagggcctgcccagcaagaagggcatcgtgcagagcatcgtgggccagggctaccacagaaagatcgtgctggccagccagagcatccagaacaccgtgtacaacgacggccagagcagcgccatccccgtggccagcatggagttcgccgccatctgcctgagaaacgccctgctgctgctgcccgaggagcagcaggaccccaagcaggagaacggcgccaagaacagcaaccagctgggcggcaacaccgagagcagcgagagcagcgagacctgcagcagcaagagccacgacggcgacaagttcatccccgccccccccagcagccccctgagaaagcaggagctggagaacctgaagtgcagcatcctggcctgcagcgcctacgtggccctggccctgggcgacaacctgatggccctgaaccacgccgacaagctgctgcagcagcccaagctgagcggcagcctgaagttcctgggccacctgtacgccgccgaggccctgatcagcctggacagaatcagcgacgccatcacccacctgaaccccgagaacgtgaccgacgtgagcctgggcatcagcagcaacgagcaggaccagggctag

SEQ ID NO: 13287 - DNA, 1596 bp, Artificial Sequence
  Description of Artificial Sequence: Synthetic coding sequence
atgctgcaggagctgaacttcggcgcctacctgggcctgcccgccttcctgctgcccctgaaccaggaggacaacaccaacctggccagagtgctgaccaaccacatccacaccggccaccacagcagcatgttctggatgagagtgcccctggtggcccccgaggacctgagagacgacatcatcgagaacgcccccaccacccacaccgaggagtacagcggcgaggagaagacctggatgtggtggcacaacttcagaaccctgtgcgactacagcaagagaatcgccgtggccctggagatcggcgccgacctgcccagcaaccacgtgatcgacagatggctgggcgagcccatcaaggccgccatcctgcccaccagcatcttcctgaccaacaagaagggcttccccgtgctgagcaagatgcaccagagactgatcttcagactgctgaagctggaggtgcagttcatcatcaccggcaccaaccaccacagcgagaaggagttctgcagctacctgcagtacctggagtacctgagccagaacagacccccccccaacgcctacgagctgttcgccaagggctacgaggactacctgcagagccccctgcagcccctgatggacaacctggagagccagacctacgaggtgttcgagaaggaccccatcaagtacagccagtaccagcaggccatctacaagtgcctgctggacagagtgcccgaggaggagaaggacaccaacgtgcaggtgctgatggtgctgggcgccggcagaggccccctggtgaacgccagcctgagagccgccaagcaggccgacagaagaatcaagctgtacgccgtggagaagaaccccaacgccgtggtgaccctggagaactggcagttcgaggagtggggcagccaggtgaccgtggtgagcagcgacatgagagagtgggtggcccccgagaaggccgacatcatcgtgagcgagctgctgggcagcttcgccgacaacgagctgagccccgagtgcctggacggcgcccagcacttcctgaaggacgacggcgtgagcatccccggcgagtacaccagcttcctggcccccatcagcagcagcaagctgtacaacgaggtgagagcctgcagagagaaggacagagaccccgaggcccagttcgagatgccctacgtggtgagactgcacaacttccaccagctgagcgccccccagccctgcttcaccttcagccaccccaacagagaccccatgatcgacaacaacagatactgcaccctggagttccccgtggaggtgaacaccgtgctgcacggcttcgccggctacttcgagaccgtgctgtaccaggacatcaccctgagcatcagacccgagacccacagccccggcatgttcagctggttccccatcctgttccccatcaagcagcccatcaccgtgagagagggccagaccatctgcgtgagattctggagatgcagcaacagcaagaaggtgtggtacgagtgggccgtgaccgcccccgtgtgcagcgccatccacaaccccaccggcagaagctacaccatcggcctgtag

SEQ ID NO: 13288 - DNA, 789 bp, Artificial Sequence; identical to SEQ ID NO: 10456
  Description of Artificial Sequence: Synthetic coding sequence

SEQ ID NO: 13289 - DNA, 1131 bp, Artificial Sequence
  Description of Artificial Sequence: Synthetic coding sequence
atggccgcccccagccccagcggcacccccgtgagcagcatgcagggcaagagaaaggccctgaagctgaacttcgccaacccccccttcaagagcaccgccagattcaccctgaaccccaaccccaccggcgtgcagaacccccacatcgagagactgagaacccacagcatcgagagcagcggcaagctgaagatcagccccgagcagcactgggacttcaccgccgaggacctgaaggacctgggcgagatcggcagaggcgcctacggcagcgtgaacaagatggtgcacaagcccagcggccagatcatggccgtgaagagaatcagaagcaccgtggacgagaaggagcagaagcagctgctgatggacctggacgtggtgatgagaagcagcgactgcccctacatcgtgcagttctacggcgccctgttcagagagggcgactgctggatctgcatggagctgatgagcaccagcttcgacaagttctacaagtacgtgtacagcgtgctggacgacgtgatccccgaggagatcctgggcaagatcaccctggccaccgtgaaggccctgaaccacctgaaggagaacctgaagatcatccacagagacatcaagcccagcaacatcctgctggacagaagcggcaacatcaagctgtgcgacttcggcatcagcggccagctggtggacagcatcgccaagaccagagacgccggctgcagaccctacatggcccccgagagaatcgaccccagcgccagcagacagggctacgacgtgagaagcgacgtgtggagcctgggcatcaccctgtacgagctggccaccggcagattcccctaccccaagtggaacagcgtgttcgaccagctgacccaggtggtgaagggcgaccccccccagctgagcaacagcgaggagagagagttcagccccagcttcatcaacttcgtgaacctgtgcctgaccaaggacgagagcaagagacccaagtacaaggagctgctgaagcaccccttcatcctgatgtacgaggagagagccgtggaggtggcctgctacgtgtgcaagatcctggaccagatgcccgccacccccagcagccccatgtacgtggactag

SEQ ID NO: 13290 - DNA, 1035 bp, Artificial Sequence
  Description of Artificial Sequence: Synthetic coding sequence
atggccggcagcggctgcgcctggggcgccgagccccccagattcctggaggccttcggcagactgtggcaggtgcagagcagactgggcagcggcagcagcgccagcgtgtacagagtgagatgctgcggcaaccccggcagcccccccggcgccctgaagcagttcctgccccccggcaccaccggcgccgccgccagcgccgccgagtacggcttcagaaaggagagagccgccctggagcagctgcagggccacagaaacatcgtgaccctgtacggcgtgttcaccatccacttcagccccaacgtgcccagcagatgcctgctgctggagctgctggacgtgagcgtgagcgagctgctgctgtacagcagccaccagggctgcagcatgtggatgatccagcactgcgccagagacgtgctggaggccctggccttcctgcaccacgagggctacgtgcacgccgacctgaagcccagaaacatcctgtggagcgccgagaacgagtgcttcaagctgatcgacttcggcctgagcttcaaggagggcaaccaggacgtgaagtacatccagaccgacggctacagagcccccgaggccgagctgcagaactgcctggcccaggccggcctgcagagcgacaccgagtgcaccagcgccgtggacctgtggagcctgggcatcatcctgctggagatgttcagcggcatgaagctgaagcacaccgtgagaagccaggagtggaaggccaacagcagcgccatcatcgaccacatcttcgccagcaaggccgtggtgaacgccgccatccccgcctaccacctgagagacctgatcaagagcatgctgcacgacgaccccagcagaagaatccccgccgagatggccctgtgcagccccttcttcagcatccccttcgccccccacatcgaggacctggtgatgctgcccacccccgtgctgagactgctgaacgtgctggacgacgactacctggagaacgaggaggagtacgagggcctgtgctag

SEQ ID NO: 13291 - DNA, 1467 bp, Artificial Sequence
  Description of Artificial Sequence: Synthetic coding sequence
atggccctgaagatgaacaccctgagcagcaacagagccaacatgctgaaggaggtgcagctgatgaacagactgagccaccccaacatcctgagattcatgggcgtgtgcgtgcaccagggccagctgcacgccctgaccgagtacatcaacagcggcaacctggagcagctgctggacagcaacctgcacctgccctggaccgtgagagtgaagctggcctacgacatcgccgtgggcctgagctacctgcacttcaagggcatcttccacagagacctgaccagcaagaactgcctgatcaagagagacgagaacggctacagcgccgtggtggccgacttcggcctggccgagaagatccccgacgtgagcatgggcagcgagaagctggccgtggtgggcagccccttctggatggcccccgaggtgctgagagacgagccctacaacgagaaggccgacgtgttcagctacggcatcatcctgtgcgagatcatcgccagaatccaggccgaccccgactacctgcccagaaccgagaacttcggcctggactacgacgccttccagcacatggtgggcgactgcccccccgacttcctgcagctgaccttcaactgctgcaacatggaccccaagctgagacccagcttcgtggagatcggcaagaccctggaggagatcctgagcagactgcaggaggaggagcaggagagagacagaaagctgcagcccaccgccagaggcctgctggagaaggcccccggcgtgaagagactgagcagcctggacgacaagatcccccacaagagcccctgccccagaagaaccatctggctgagcagaagccagagcgacatcttcagcagaaagccccccagaaccgtgagcgtgctggacccctactacagacccagagacggcgccgccagaacccccaaggtgaaccccttcagcgccagacaggacctgatgggcggcaagatcaagttcttcgacctgcccagcaagagcgtgatcagcctggtgttcgacctggacgcccccggccccggcaccatgcccctggccgactggcaggagcccctggccccccccatcagaagatggagaagcctgcccggcagccccgagttcctgcaccaggaggcctgccccttcgtgggcagagaggagagcctgagcgacggccccccccccagactgagcagcctgaagtacagagtgaaggagatcccccccttcagagccagcgccctgcccgccgcccaggcccacgaggccatggactgcagcatcctgcaggaggagaacggcttcggcagcagaccccagggcaccagcccctgccccgccggcgccagcgaggagatggaggtggaggagagacccgccggcagcacccccgccaccttcagcaccagcggcatcggcctgcagacccagggcaagcaggacggctag

SEQ ID NO: 13292 - DNA, 1458 bp, Artificial Sequence
  Description of Artificial Sequence: Synthetic coding sequence
atgaccctgtggatcctgcccaagttcaaggccgtggacttcagccccagcctggccgcctacacccacacctggctgctgcccagattcctggagatcctgatccagtgcggccactgcaagagactggcccccgagtacgaggccgccgccaccagactgaagggcatcgtgcccctggccaaggtggactgcaccgccaacaccaacacctgcaacaagtacggcgtgagcggctaccccaccctgaagatcttcagagacggcgaggaggccggcgcctacgacggccccagaaccgccgacggcatcgtgagccacctgaagaagcaggccggccccgccagcgtgcccctgagaaccgaggaggagttcaagaagttcatcagcgacaaggacgccagcatcgtgggcttcttcgacgacagcttcagcgaggcccacagcgagttcctgaaggccgccagcaacctgagagacaactacagattcgcccacaccaacgtggagagcctggtgaacgagtacgacgacaacggcgagggcatcatcctgttcagacccagccacctgaccaacaagttcgaggacaagaccgtggcctacaccgagcagaagatgaccagcggcaagatcaagaagttcatccaggagaacatcttcggcatctgcccccacatgaccgaggacaacaaggacctgatccagggcaaggacctgctgatcgcctactacgacgtggactacgagaagaacgccaagggcagcaactactggagaaacagagtgatgatggtggccaagaagttcctggacgccggccacaagctgaacttcgccgtggccagcagaaagaccttcagccacgagctgagcgacttcggcctggagagcaccgccggcgagatccccgtggtggccatcagaaccgccaagggcgagaagttcgtgatgcaggaggagttcagcagagacggcaaggccctggagagattcctgcaggactacttcgacggcaacctgaagagatacctgaagagcgagcccatccccgagagcaacgacggccccgtgaaggtggtggtggccgagaacttcgacgagatcgtgaacaacgagaacaaggacgtgctgatcgagttctacgccccctggtgcggccactgcaagaacctggagcccaagtacaaggagctgggcgagaagctgagcaaggaccccaacatcgtgatcgccaagatggacgccaccgccaacgacgtgcccagcccctacgaggtgagaggcttccccaccatctacttcagccccgccaacaagaagctgaaccccaagaagtacgagggcggcagagagctgagcgacttcatcagctacctgcagagagaggccaccaacccccccgtgatccaggaggagaagcccaagaagaagaagaaggcccaggaggacctgtag

SEQ ID NO: 13293 - DNA, 885 bp, Artificial Sequence
  Description of Artificial Sequence: Synthetic coding sequence
atgagcgcccagcacttcgtgagcaccgagcaggtggagctgcccggccccggccagtgggtggtggccgagtgccccgccagagtggacttcagcggcggctggagcgacaccccccccctggcctacgagctgggcggcgccgtgctgggcctggccgtgagagtggacggcagaagacccatcggcgccagagccagaagaatccccgagcccgagctgtggctggccgtgggccccagacaggacgagatgaccgtgaagatcgtgtgcagatgcctggccgacctgagagactactgccagccccacgcccccggcgccctgctgaaggccgccttcatctgcgccggcatcgtgcacgtgcacagcgagctgcagctgagcgagcagctgctgagaaccttcggcggcggcttcgagctgcacacctggagcgagctgccccacggcagcggcctgggcaccagcagcatcctggccggcaccgccctggccgccctgcagagagccgccggcagagtggtgggcaccgaggccctgatccacgccgtgctgcacctggagcaggtgctgaccaccggcggcggctggcaggaccaggtgggcggcctgatgcccggcatcaaggtgggcagaagcagagcccagctgcccctgaaggtggaggtggaggaggtgaccgtgcccgagggcttcgtgcagaagctgaacgaccacctgctgctggtgtacaccggcaagaccagactggccagaaacctgctgcaggacgtgctgagaagctggtacgccagactgcccgccgtggtgcagaacgcccacagcctggtgagacagaccgaggagtgcgccgagggcttcagacagggcagccacatctag

SEQ ID NO: 13294 - DNA, 945 bp, Artificial Sequence
  Description of Artificial Sequence: Synthetic coding sequence
gtgggcagaatggagggctgcagcagccccatcgtggtgaagttcgccgacacccagaaggacaaggagcagagaagactgcagcagcagctggcccagcagatgcagcagctgaacaccgccacctggggcaacctgaccggcctgggcggcctgaccccccagtacctggccctgctgcagcaggccaccagcagcagcaacctgggcgccttcagcggcatccagcagatggccggcatgaacgccctgcagctgcagaacctggccaccctggccgccgccgccgccgccgcccagaccagcgccaccagcaccaacgccaaccccctgagcaccaccagcagcgccctgggcgccctgaccagccccgtggccgccagcacccccaacagcaccgccggcgccgccatgaacagcctgaccagcctgggcaccctgcagggcctggccggcgccaccgtgggcctgaacaacatcaacgccctggccggcatggccgccctgaacggcggcctgggcgccaccggcctgaccaacggcaccgccggcaccatggacgccctgacccaggcctacagcggcatccagcagtacgccgccgccgccctgcccaccctgtacagccagagcctgctgcagcagcagagcgccgccggcagccagaaggagggccccgagggcgccaacctgttcatctaccacctgccccaggagttcggcgaccaggacatcctgcagatgttcatgcccttcggcaacgtgatcagcgccaaggtgttcatcgacaagcagaccaacctgagcaagtgcttcggcttcgtgagctacgacaaccccgtgagcgcccaggccgccatccaggccatgaacggcttccagatcggcatgaagagactgaaggtgcagctgaagagaagcaagaacgacagcaagccctactag

SEQ ID NO: 13295 - DNA, 1083 bp, Artificial Sequence
  Description of Artificial Sequence: Synthetic coding sequence
agcatggagaagacctacaccagcaccagcaacaacagcatcagcggcagcctgaagagactggaggacaccaccgccagattcaccaacgccaacttccaggaggtgagcgcccacaccagcagcggcaaggacgtgagcgagaccagaggcagcgagggcaagggcaagaagagcagcgcccacagcagcggccagagaggcagaaagcccggcggcggcagaaaccccggcaccaccgtgagcgccgccagccccttcccccaggccggctacaagagagcccagaccagcggcatcgaggaggagaccgtgaaggagaagaagagaaagggcaacaagcagagcaagcacggccccggcagacccaagggcaacaagaaccaggagaacgtgagccacctgagcgtgagcagcgccagccccaccagcagcgtggccagcgccgccggcagcatcaccagcagcagcctgcagaagagccccaccctgctgagaaacggcagcctgcagagcctgagcgtgggcagcagccccgtgggcagcgagatcagcatgcagtacagacacgacggcgcctgccccaccaccaccttcagcgagctgctgaacgccatccacaacgacagaggcgacagcagcaccctgaccaagcaggagctgaagttcatcggcatctacaacagcaacgacgtggccgtgagcttccccaacgtggtgagcggcagcggcagcagcacccccgtgagcagcagccacctgccccagcagagcagcggccacctgcagcaggtgggcgccctgagccccagcgccgtgagcagcgccgcccccgccgtggccaccacccaggccaacaccctgagcggcagcagcctgagccaggcccccagccacatgtacggcaacagaagcaacagcagcatggccgccctgatcgcccagagcgagaacaaccagaccgaccaggacctgggcgacaacagcagaaacctggtgggcagaggcagcagccccagaggcagcctgagccccagaagccccgtgagcagcctgcagatcagatacgaccagcccggctag

SEQ ID NO: 13296 - DNA, 924 bp, Artificial Sequence
  Description of Artificial Sequence: Synthetic coding sequence
atgcagagcctgaccctggacctgctgggccccagcgagctgctgctggccctgaacatgggcaacaccagcttcaacgaggtgatggaggcccagctgcccagccacggcggccccaagcccagcgccgagagcgacatgggcaccagaagagactacatcatggccaagtacgtggagcacagattcgccagaagatgcacccccgagccccagagactgtggaccgccatctgcaacagagacctgctgagcgtgctggaggccttcgccaacggccaggacttcggccagcccctgcccggccccgacgcccaggcccccgaggagctggtgctgcacctggccgtgaaggtggccaaccaggccagcctgcccctggtggacttcatcatccagaacggcggccacctggacgccaaggccgccgacggcaacaccgccctgcactacgccgccctgtacaaccagcccgactgcctgaagctgctgctgaagggcagagccctggtgggcaccgtgaacgaggccggcgagaccgccctggacatcgccagaaagaagcaccacaaggagtgcgaggagctgctggagcaggcccaggccggcaccttcgccttccccctgcacgtggactacagctgggtgatcagcaccgagcccggcagcgacagcgaggaggacgaggaggagaagagatgcctgctgaagctgcccgcccaggcccactgggccagcggcagactggacatcagcaacaagacctacgagaccgtggccagcctgggcgccgccaccccccagggcgagagcgaggactgccccccccccctgcccgtgaagaacagcagcagaaccctggtgcagggctgcgccagacacgccagcggcggcagaagagaggagagagccagaagagagtag

SEQ ID NO: 13297 - DNA, 1497 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagcctgccctacagccccgtgagcagcccccagagcagccccagactgcccagaagacccaccgtggagagccaccacgtgagcatcaccggcatgcaggactgcgtgcagctgaaccagtacaccctgaaggacgagatcggcaagggcagctacggcgtggtgaagctggcctacaacgagaacgacaacacctactacgccatgaaggtgctgagcaagaagaagctgatcagacaggccggcttccccagaagacccccccccagaggcaccagacccgcccccggcggctgcatccagcccagaggccccatcgagcaggtgtaccaggagatcgccatcctgaagaagctggaccaccccaacgtggtgaagctggtggaggtgctggacgaccccaacgaggaccacctgtacatggtgttcgagctggtgaaccagggccccgtgatggaggtgcccaccctgaagcccctgagcgaggaccaggccagattctacttccaggacctgatcaagggcatcgagtacctgcactaccagaagatcatccacagagacatcaagcccagcaacctgctggtgggcgaggacggccacatcaagatcgccgacttcggcgtgagcaacgagttcaagggcagcgacgccctgctgagcaacaccgtgggcacccccgccttcatggcccccgagagcctgagcgagaccagaaagatcttcagcggcaaggccctggacgtgtgggccatgggcgtgaccctgtactgcttcgtgttcggccagtgccccttcatggacgagagaatcatgtgcctgcacagcaagatcaagagccaggccctggagttccccgaccagcccgacatcgccgaggacctgaaggacctgatcaccagaatgctggacaagaaccccgagagcagaatcgtggtgcccgagatcaagatcctggtgaagaccatgatcagaaagagaagcttcggcaaccccttcgagggcagcagaagagaggagagaagcctgagcgcccccggcaacctgctgaccaagcagggcagcgaggacaacctgcagggcaccgaccccccccccgtgggcgaggaggaggtgctgctgtag

SEQ ID NO: 13298 - DNA, 600 bp, Artificial Sequence; identical to SEQ ID NO: 10263
  Description of Artificial Sequence: Synthetic coding sequence

SEQ ID NO: 13299 - DNA, 1248 bp, Artificial Sequence
  Description of Artificial Sequence: Synthetic coding sequence
atgtggagaaaggtgtacacccccagaagcagcttcgagctgagcgcccagccccccagctgggagcagagaaagctgctggagaagtgcgccatgaccgccctgagcagcaagctgatcagccagcagaaggccttcttcgccaagatggtggtggacgccgtgatgatgctggacgacctgctgcagctgaagatgatcggcatcaagaaggtgcagggcggcgccctggaggacagccagctggtggccggcgtggccttcaagaagaccttcagctacgccggcttcgagatgcagcccaagaagtaccacaaccccaagatcgccctgctgaacgtggagctggagctgaaggccgagaaggacaacgccgagatcagagtgcacaccgtggaggactaccaggccatcgtggacgccgagtggaacatcctgtacgacaagctggagaagatccaccacagcggcgccaaggtggtgctgagcaagctgcccatcggcgacgtggccacccagtacttcgccgacagagacatgttctgcgccggcagagtgcccgaggaggacctgaagagaaccatgatggcctgcggcggcagcatccagaccagcgtgaacgccctgagcgccgacgtgctgggcagatgccaggtgttcgaggagacccagatcggcggcgagagatacaacttcttcaccggctgccccaaggccaagacctgcaccttcatcctgagaggcggcgccgagcagttcatggaggagaccgagagaagcctgcacgacgccatcatgatcgtgagaagagccatcaagaacgacagcgtggtggccggcggcggcgccatcgagatggagctgagcaagtacctgagagactacagcagaaccatccccggcaagcagcagctgctgatcggcgcctacgccaaggccctggagatcatccccagacagctgtgcgacaacgccggcttcgacgccaccaacatcctgaacaagctgagagccagacacgcccagggcggcacctggtacggcgtggacatcaacaacgaggacatcgccgacaacttcgaggccttcgtgtgggagcccgccatggtgagaatcaacgccctgaccgccgccagcgaggccgcctgcctgatcgtgagcgtggacgagaccatcaagaaccccagaagcaccgtggacgcccccaccgccgccggcagaggcagaggcagaggcagaccccactag

SEQ ID NO: 13300 - DNA, 3117 bp, Artificial Sequence; identical to SEQ ID NO: 11268
  Description of Artificial Sequence: Synthetic coding sequence

SEQ ID NO: 13301 - DNA, 1443 bp, Artificial Sequence
  Description of Artificial Sequence: Synthetic coding sequence
atgagactgagaagactggccctgttccccggcgtggccctgctgctggccgccgccagactggccgccgccagcgagttcttcgccccctggtgcggccactgcaagagactggcccccgagtacgaggccgccgccaccagactgaagggcatcgtgcccctggccaaggtggactgcaccgccaacaccaacacctgcaacaagtacggcgtgagcggctaccccaccctgaagatcttcagagacggcgaggaggccggcgcctacgacggccccagaaccgccgacggcatcgtgagccacctgaagaagcaggccggccccgccagcgtgcccctgagaaccgaggaggagttcaagaagttcatcagcgacaaggacgccagcatcgtgggcttcttcgacgacagcttcagcgaggcccacagcgagttcctgaaggccgccagcaacctgagagacaactacagattcgcccacaccaacgtggagagcctggtgaacgagtacgacgacaacggcgagggcatcatcctgttcagacccagccacctgaccaacaagttcgaggacaagaccgtggcctacaccgagcagaagatgaccagcggcaagatcaagaagttcatccaggagaacatcttcggcatctgcccccacatgaccgaggacaacaaggacctgatccagggcaaggacctgctgatcgcctactacgacgtggactacgagaagaacgccaagggcagcaactactggagaaacagagtgatgatggtggccaagaagttcctggacgccggccacaagctgaacttcgccgtggccagcagaaagaccttcagccacgagctgagcgacttcggcctggagagcaccgccggcgagatccccgtggtggccatcagaaccgccaagggcgagaagttcgtgatgcaggaggagttcagcagagacggcaaggccctggagagattcctgcaggactacttcgacggcaacctgaagagatacctgaagagcgagcccatccccgagagcaacgacggccccgtgaaggtggtggtggccgagaacttcgacgagatcgtgaacaacgagaacaaggacgtgctgatcgagttctacgccccctggtgcggccactgcaagaacctggagcccaagtacaaggagctgggcgagaagctgagcaaggaccccaacatcgtgatcgccaagatggacgccaccgccaacgacgtgcccagcccctacgaggtgagaggcttccccaccatctacttcagccccgccaacaagaagctgaaccccaagaagtacgagggcggcagagagctgagcgacttcatcagctacctgcagagagaggccaccaacccccccgtgatccaggaggagaagcccaagaagaagaagaaggcccaggaggacctgtag

SEQ ID NO: 13302 - DNA, 228 bp, Artificial Sequence
  Description of Artificial Sequence: Synthetic coding sequence
atgggcgtgaagctggagatcttcagaatgatcatctacctgaccttccccgtggccatgttctgggtgagcaaccaggccgagtggttcgaggacgacgtgatccagagaaagagagagctgtggccccccgagaagctgcaggagctggaggagttcaaggagagactgagaaagagaaagagaagagaggagaagctgctgagagacgcccagcagaacagctag

SEQ ID NO: 13303 - DNA, 807 bp, Artificial Sequence; identical to SEQ ID NO: 13201
  Description of Artificial Sequence: Synthetic coding sequence

SEQ ID NO: 13304 - DNA, 351 bp, Artificial Sequence
  Description of Artificial Sequence: Synthetic coding sequence
atgctgctggagtgcggcatgcaggaggagggcctgttcagagtggcccccagcgccagcaagctgaagaagctgaaggccgccctggactgctgcgtggtggacgtgcaggagtacagcgccgacccccacgccatcgccggcgccctgaagagctacctgagagagctgcccgagcccctgatgaccttcgagctgtacgacgagtggatccaggccagcaacgtgcaggagcaggacaagaagctgcaggccctgtggaacgcctgcgagaagctgcccaaggccaaccacaacaacatcagatacctgatcaagttctaccccagctgccagaacatcaagatgtag

SEQ ID NO: 13305 - DNA, 906 bp, Artificial Sequence
  Description of Artificial Sequence: Synthetic coding sequence
atggtgagaaccaagacctggaccctgaagaagcacttcgtgggctaccccaccaacagcgacttcgagctgaagaccgccgagctgccccccctgaagaacggcgaggtgctgctggaggccctgttcctgaccgtggacccctacatgagagtggccgccaagagactgaaggagggcgacaccatgatgggccagcaggtggccaaggtggtggagagcaagaacgtggccctgcccaagggcaccatcgtgctggccagccccggctggaccacccacagcatcagcgacggcaaggacctggagaagctgctgaccgagtggcccgacaccatccccctgagcctggccctgggcaccgtgggcatgcccggcctgaccgcctacttcggcctgctggagatctgcggcgtgaagggcggcgagaccgtgatggtgaacgccgccgccggcgccgtgggcagcgtggtgggccagatcgccaagctgaagggctgcaaggtggtgggcgccgtgggcagcgacgagaaggtggcctacctgcagaagctgggcttcgacgtggtgttcaactacaagaccgtggagagcctggaggagaccctgaagaaggccagccccgacggctacgactgctacttcgacaacgtgggcggcgagttcagcaacaccgtgatcggccagatgaagaagttcggcagaatcgccatctgcggcgccatcagcacctacaacagaaccggccccctgccccccggccccccccccgagatcgtgatctaccaggagctgagaatggaggccttcgtggtgtacagatggcagggcgacgccagacagaaggccctgaaggacctgctgaagtgggtgctggagatcaagagagagaacgaggaggactag

SEQ ID NO: 13306 - DNA, 1068 bp, Artificial Sequence
  Description of Artificial Sequence: Synthetic coding sequence
atgctgggcagcggcttcaaggccgagagactgagagtgaacctgagactggtgatcaacagactgaagctgctggagaagaagaagaccgagctggcccagaaggccagaaaggagatcgccgactacctggccgccggcaaggacgagagagccagaatcagagtggagcacatcatcagagaggactacctggtggaggccatggagatcctggagctgtactgcgacctgctgctggccagattcggcctgatccagagcatgaaggagctggacagcggcctggccgagagcgtgagcaccctggccgagctgaagatcgtggccgaccagctgtgcgccaagtacagcaaggagtacggcaagctgtgcagaaccaaccagatcggcaccgtgaacgacagactgatgcacaagctgagcgtggaggccccccccaagatcctggtggagagatacctgatcgagatcgccaagaactacaacgtgccctacgagcccgacagcgtggtgatggccgaggccccccccggcgtggagaccgacctgatcgacgtgggcttcaccgacgacgtgaagaagggcggccccggcagaggcggcagcggcggcttcaccgcccccgtgggcggccccgacggcaccgtgcccatgcccatgcccatgcccatgcccatgcccagcgccaacacccccttcagctaccccctgcccaagggccccagcgacttcaacggcctgcccatgggcacctaccaggccttccccaacatccaccccccccagatccccgccaccccccccagctacgagagcgtggacgacatcaacgccgacaagaacatcagcagcgcccagatcgtgggccccggccccaagcccgaggccagcgccaagctgcccagcagacccgccgacaactacgacaacttcgtgctgcccgagctgcccagcgtgcccgacaccctgcccaccgccagcgccggcgccagcaccagcgccagcgaggacatcgacttcgacgacctgagcagaagattcgaggagctgaagaagaagacctag

SEQ ID NO: 13307 - DNA, 2175 bp, Artificial Sequence
  Description of Artificial Sequence: Synthetic coding sequence
atgcagatgaccatccaggccctgcaggacgagctgagaatccagagagacctgaaccagctgttccagcaggacagcagcagcagaaccggcgagccctgcgtggccgagctgaccgaggagaacttccagagactgcacgccgagcacgagagacaggccaaggagctgttcctgctgagaaagaccctggaggagatggagctgagaatcgagacccagaagcagaccctgaacgccagagacgagagcatcaagaagctgctggagatgctgcagagcaagggcctgagcgccaaggccaccgaggaggaccacgagagaaccagaagactggccgaggccgagatgcacgtgcaccacctggagagcctgctggagcagaaggagaaggagaacagcatgctgagagaggagatgcacagaagattcgagaacgcccccgacagcgccaagaccaaggccctgcagaccgtgatcgagatgaaggacagcaagatcagcagcatggagagaggcctgagagacctggaggaggagatccagatgctgaagagcaacggcgccctgagcaccgaggagagagaggaggagatgaagcagatggaggtgtacagaagccacagcaagttcatgaagaacaagatcggccaggtgaagcaggagctgagcagaaaggacaccgagctgctggccctgcagaccaagctggagaccctgaccaaccagttcagcgacagcaagcagcacatcgaggtgctgaaggagagcctgaccgccaaggagcagagagccgccatcctgcagaccgaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagcctgaccagcagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccaggacgaggaggagggcatctgggcctag

SEQ ID NO: 13308 - DNA, 408 bp, Artificial Sequence
  Description of Artificial Sequence: Synthetic coding sequence
atggccatcggcttcaacgtggagaccgtgacctacaagaacctgaagttccaggtgtgggacctgggcggccagaccagcatcagaccctactggagatgctactacagcaacaccgacgccgtgatctacgtggtggacagctgcgacagagacagaatcggcatcagcaagagcgagctggtggccatgctggaggaggaggagctgagaaaggccatcctggtggtgttcgccaacaagcaggacatggagcaggccatgaccagcagcgagatggccaacagcctgggcctgcccgccctgaaggacagaaagtggcagatcttcaagaccagcgccaccaagggcaccggcctggacgaggccatggagtggctggtggagaccctgaagagcagacagtag

SEQ ID NO: 13309 - DNA, 684 bp, Artificial Sequence
  Description of Artificial Sequence: Synthetic coding sequence
agaagacagatcctgaaggagctggccctgtgcctgagaagacaggagatgtacggccccagagccgccagcagaaacaaggagaccagcgccggccccgtggccgtgatgggcaaggactactacaagatcctgggcatccccagcggcgccaacgaggacgagatcaagaaggcctacagaaagatggccctgaagtaccaccccgacaagaacaaggagcccaacgccgaggagaagttcaaggagatcgccgaggcctacgacgtgctgagcgaccccaagaagagaggcctgtacgaccagtacggcgaggagggcctgaagaccggcggcggcaccagcggcggcagcagcggcagcttccactacaccttccacggcgacccccacgccaccttcgccagcttcttcggcggcagcaaccccttcgacatcttcttcgccagcagcagaagcaccagacccttcagcggcttcgaccccgacgacatggacgtggacgaggacgaggaccccttcggcgccttcggcagattcggcttcaacggcctgagcagaggccccagaagagcccccgagcccctgtaccccagaagaaaggtgcaggacccccccgtggtgcacgagctgagagtgagcctggaggagatctaccacggcagcaccaagagaatgaagtag

SEQ ID NO: 13310 - DNA, 252 bp, Artificial Sequence
  Description of Artificial Sequence: Synthetic coding sequence
atgagcatgctgaagcccagcggcctgaaggcccccaccaagatcctgaagcccggcagcaccgccctgaagacccccaccgccgtggtggcccccgtggagaagaccatcagcagcgagaaggccagcagcacccccagcagcgagacccaggaggagttcgtggacgacttcagagtgggcgagagagtgtgggtgaacggcaacaagcccggcttcatccagttcctgggcgagacccagttcgcctag

SEQ ID NO: 13311 - DNA, 642 bp, Artificial Sequence
  Description of Artificial Sequence: Synthetic coding sequence
atggacatgctgggcggccccggcatcgagagccagtgcagaaaggtggacatcatcgccgacgccgcctacagcatcttccagaagcccaagagcttcaccggcaacttcgtgatcgacgagaacatcctgaaggaggagggcatcgagaacttcgacgtgtacgccatcaagcccggccaccccctgcagcccgacttcttcctggacgagtaccccgaggccgtgagcaagaaggtggagagcaccggcgccgtgcccgagttcaaggaggagaagctgcagctgcagcccaagcccagaagcggcgccgtggaggagaccttcagaatcgtgaaggacagcctgagcgacgacgtggtgaaggccacccaggccatctacctgttcgagctgagcggcgaggacggcggcacctggttcctggacctgaagagcaagggcggcaacgtgggctacggcgagcccagcgaccaggccgacgtggtgatgagcatgaccaccgacgacttcgtgaagatgttcagcggcaagctgaagcccaccatggccttcatgagcggcaagctgaagatcaagggcaacatggccctggccatcaagctggagaagctgatgaaccagatgaacgccagactgtag

SEQ ID NO: 13312 - DNA, 1230 bp, Artificial Sequence
  Description of Artificial Sequence: Synthetic coding sequence
atgaacagaacctggcccagaagaatctggggcagcagccaggacgagcccgagttcgccagcagcgtgagaagaccccacctgaccagcgacgccgtggccctgctgagagacaacgtgacccccagagagaacgagctgtggaccagcctgggcgacagctggaccagacccggcctggagctgagccccgaggagggccccccctacagacccgagttcttcagcggctgggagccccccgtgaccgacccccagagcagagcctgggaggaccccgtggagaagcagctgcagcacgagagaagaagaagacaggtgacccaggccacccagcagggcagaggctgggaggtgagaggcagaggcagaagcgcctggcccagactgaccagactgagctacttcctgcagcagagcgccccccaggtggccgtgaacggccacagagacctggagcccgagagcgagccccagctggagagcgagaccgccggcaagtgggtgctgtgcaactacgacttccaggccagaaacagcagcgagctgagcgtgaagcagagagacgtgctggaggtgctggacgacagcagaaagtggtggaaggtgagagaccccgccggccaggagggctacgtgccctacaacatcctgaccccctaccccggccccagactgcaccacagccagagccccgccagaagcctgaacagcacccccccccccccccccgcccccgcccccgcccccccccccgccctggccagacccagatgggacagacccagatgggacagctgcgacagcctgaacggcctggaccccagcgagaaggagaagttcagccagatgctgatcgtgaacgaggagctgcaggccagactggcccagggcagaagcggccccagcagagccgtgcccggccccagagcccccgagccccagctgagccccggcagcgacgccagcgaggtgagagcctggctgcaggccaagggcttcagcagcggcaccgtggacgccctgggcgtgctgaccggcgcccagctgttcagcctgcagaaggaggagctgagagccgtgagccccgaggagggcgccagagtgtacagccaggtgaccgtgcagagaagcctgctggaggacaaggagaaggtgagcgagctggaggccgtgatggagaagcagaagaagaaggtggagggcgaggtggagatggaggtgatctag

SEQ ID NO: 13313 - DNA, 1425 bp, Artificial Sequence
  Description of Artificial Sequence: Synthetic coding sequence
atggccagcctgagcagagccctgagagtggccgccgcccaccccagacagagccccaccagaggcatgggcccctgcaacctgagcagcgccgccggccccaccgccgagaagagcgtgccctaccagagaaccctgaaggagggccagggcaccagcgtggtggcccagggccccagcagacccctgcccagcaccgccaacgtggtggtgatcggcggcggcagcctgggctgccagaccctgtaccacctggccaagctgggcatgagcggcgccgtgctgctggagagagagagactgaccagcggcaccacctggcacaccgccggcctgctgtggcagctgagacccagcgacgtggaggtggagctgctggcccacaccagaagagtggtgagcagagagctggaggaggagaccggcctgcacaccggctggatccagaacggcggcctgttcatcgccagcaacagacagagactggacgagtacaagagactgatgagcctgggcaaggcctacggcgtggagagccacgtgctgagccccgccgagaccaagaccctgtaccccctgatgaacgtggacgacctgtacggcaccctgtacgtgccccacgacggcaccatggaccccgccggcacctgcaccaccctggccagagccgccagcgccagaggcgcccaggtgatcgagaactgccccgtgaccggcatcagagtgtggaccgacgacttcggcgtgagaagagtggccggcgtggagacccagcacggcagcatccagaccccctgcgtggtgaactgcgccggcgtgtgggccagcgccgtgggcagaatggccggcgtgaaggtgcccctggtggccatgcaccacgcctacgtggtgaccgagagaatcgagggcatccagaacatgcccaacgtgagagaccacgacgccagcgtgtacctgagactgcagggcgacgccctgagcgtgggcggctacgaggccaaccccatcttctgggaggaggtgagcgacaagttcgccttcggcctgttcgacctggactgggaggtgttcacccagcacatcgagggcgccatcaacagagtgcccgtgctggagaagaccggcatcaagagcaccgtgtgcggccccgagagcttcacccccgaccacaagcccctgatgggcgaggcccccgagctgagaggcttcttcctgggctgcggcttcaacagcgccggcatgatgctgggcggcggctgcggccaggagctggcccactggatcatccacggcagacccgagaaggacatgcacggctacgacatcagaagattccaccacagcctgaccgaccaccccagatggatcagagagagaagccacgagagctaccaggagctgctgagaagactgccccccagatag

SEQ ID NO: 13314 - DNA, 1893 bp, Artificial Sequence
  Description of Artificial Sequence: Synthetic coding sequence
atgagcatcgagctgcagagcgtgagcaaccccgtgcacagaaaggacctggtgatcagactgaccgacgacaccgaccccttcttcctgtacaacctggtgatcagcgaggaggacttccagagcctgaagttccagcagggcctgctggtggacttcctggccttcccccagaagttcatcgacctgctgcagcagtgcacccaggagcacgccaaggagatccccagattcctgctgcagctggtgagccccgccgccatcctggacaacagccccgccttcctgaacgtggtggagaccaaccccttcaagcacctgacccacctgagcctgaagctgctgcccggcaacgacgtggagatcaagaagttcctggccggctgcctgaagtgcagcaaggaggagaagctgagcctgatgcagagcctggacgacgccaccaagcagctggacttcaccagaaagaccctggccgagaagaagcaggagctggacaagctgagaaacgagtgggccagccacaccgccgccctgaccaacaagcacagccaggagctgaccaacgagaaggagaaggccctgcaggcccaggtgcagtaccagcagcagcacgagcagcagaagaaggacctggagatcctgcaccagcagaacatccaccagctgcagaacagactgagcgagctggaggccgccaacaaggacctgaccgagagaaagtacaagggcgacagcaccatcagagagctgaaggccaagctgagcggcgtggaggaggagctgcagagaaccaagcaggaggtgctgagcctgagaagagagaacagcaccctggacgtggagtgccacgagaaggagaagcacgtgaaccagctgcagaccaaggtggccgtgctggagcaggagatcaaggacaaggaccagctggtgctgagaaccaaggaggccttcgacaccatccaggagcagaaggtggtgctggaggagaacggcgagaagaaccaggtgcagctgggcaagctggaggccaccatcaagagcctgagcgccgagctgctgaaggccaacgagatcatcaagaagctgcagggcgacctgaagaccctgatgggcaagctgaagctgaagaacaccgtgaccatccagcaggagaagctgctggccgagaaggaggagaagctgcagaaggagcagaaggagctgcaggacgtgggccagagcctgagaatcaaggagcaggaggtgtgcaagctgcaggagcagctggaggccaccgtgaagaagctggaggagagcaagcagctgctgaagaacaacgagaagctgatcacctggctgaacaaggagctgaacgagaaccagctggtgagaaagcaggacgtgctgggccccagcaccaccccccccgcccacagcagcagcaacaccatcagaagcggcatcagccccaacctgaacgtggtggacggcagactgacctaccccacctgcggcatcggctaccccgtgagcagcgccttcgccttccagaacaccttcccccacagcatcagcgccaagaacaccagccaccccggcagcggcaccaaggtgcagttcaacctgcagttcaccaagcccaacgccagcctgggcgacgtgcagagcggcgccaccatcagcatgccctgcagcaccgacaaggagaacggcgagaacgtgggcctggagagcaagtacctgaagaagagagaggacagcatccccctgagaggcctgagccagaacctgttcagcaacagcgaccaccagagagacggcaccctgggcgccctgcacaccagcagcaagcccaccgccctgcccagcgccagcagcgcctacttccccggccagctgcccaacagctag

SEQ ID NO: 13315 - DNA, 1170 bp, Artificial Sequence
  Description of Artificial Sequence: Synthetic coding sequence
atggacagagagaccctgatcgacgtggccagaaccagcctgagaaccaaggtgcacgccgagctggccgacgtgctgaccgaggccgtggtggacagcatcctggccatcaagaagcaggacgagcccatcgacctgttcatgatcgagatcatggagatgaagcacaagagcgagaccgacaccagcctgatcagaggcctggtgctggaccacggcgccagacaccccgacatgaagaagagagtggaggacgcctacatcctgacctgcaacgtgagcctggagtacgagaagaccgaggtgaacagcggcttcttctacaagagcgccgaggagagagagaagctggtgaaggccgagagaaagttcatcgaggacagagtgaagaagatcatcgagctgaagagaaaggtgtgcggcgacagcgacaagggcttcgtggtgatcaaccagaagggcatcgaccccttcagcctggacgccctgagcaaggagggcatcgtggccctgagaagagccaagagaagaaacatggagagactgaccctggcctgcggcggcgtggccctgaacagcttcgacgacctgagccccgactgcctgggccacgccggcctggtgtacgagtacaccctgggcgaggagaagttcaccttcatcgagaagtgcaacaaccccagaagcgtgaccctgctgatcaagggccccaacaagcacaccctgacccagatcaaggacgccgtgagagacggcctgagagccgtgaagaacgccatcgacgacggctgcgtggtgcccggcgccggcgccgtggaggtggccatggccgaggccctgatcaagcacaagcccagcgtgaagggcagagcccagctgggcgtgcaggccttcgccgacgccctgctgatcatccccaaggtgctggcccagaacagcggcttcgacctgcaggagaccctggtgaagatccaggccgagcacagcgagagcggccagctggtgggcgtggacctgaacaccggcgagcccatggtggccgccgaggtgggcgtgtgggacaactactgcgtgaagaagcagctgctgcacagctgcaccgtgatcgccaccaacatcctgctggtggacgagatcatgagagccggcatgagcagcctgaagggctag

SEQ ID NO: 13316 - DNA, 441 bp, Artificial Sequence
  Description of Artificial Sequence: Synthetic coding sequence
atgaccgtgaacgaggccaaggagaagctgaaggaggcccccgagggcaccttcctgatcagagacagcagccacagcgactacctgctgaccatcagcgtgaagaccagcgccggccccaccaacctgagaatcgagtaccaggacggcaagttcagactggacagcatcatctgcgtgaagagcaagctgaagcagttcgacagcgtggtgcacctgatcgactactacgtgcagatgtgcaaggacaagagaaccggccccgaggcccccagaaacggcaccgtgcacctgtacctgaccaagcccctgtacaccagcgcccccagcctgcagcacctgtgcagactgaccatcaacaagtgcaccggcgccatctggggcctgcccctgcccaccagactgaaggactacctggaggagtacaagttccaggtgtag

SEQ ID NO: 13317 - DNA, 1905 bp, Artificial Sequence
  Description of Artificial Sequence: Synthetic coding sequence
atgctggagtacgccctgaagcaggagagagccaagtaccacaagctgaagttcggcaccgacctgaaccagggcgagaagaaggccgacgtgagcgagcaggtgagcaacggccccgtggagagcgtgaccctggagaacagccccctggtgtggaaggagggcagacagctgctgagacagtacctggaggaggtgggctacaccgacaccatcctggacatgagaagcaagagagtgagaagcctgctgggcagaagcctggagctgaacggcgccgtggagcccagcgagggcgcccccagagccccccccggccccgccggcctgagcggcggcgagagcctgctggtgaagcagatcgaggagcagatcaagagaaacgccgccggcaaggacggcaaggagagactgggcggcagcgtgctgggccagatccccttcctgcagaactgcgaggacgaggacagcgacgaggacgacgagctggacagcgtgcagcacaagaagcagagagtgaagctgcccagcaaggccctggtgcccgagatggaggacgaggacgaggaggacgacagcgaggacgccatcaacgagttcgacttcctgggcagcggcgaggacggcgagggcgcccccgaccccagaagatgcaccgtggacggcagcccccacgagctggagagcagaagagtgaagctgcagggcatcctggccgacctgagagacgtggacggcctgccccccaaggtgaccggccccccccccggcaccccccagcccagaccccacgaggacgtgttcatcatggacaccatcggcggcggcgaggtgagcctgggcgacctggccgacctgaccgtgaccaacgacaacgacctgagctgcgacctgagcgacagcaaggacgccttcaagaagacctggaaccccaagttcaccctgagaagccactacgacggcatcagaagcctggccttccaccacagccagagcgccctgctgaccgccagcgaggacggcaccctgaagctgtggaacctgcagaaggccgtgaccgccaagaagaacgccgccctggacgtggagcccatccacgccttcagagcccacagaggccccgtgctggccgtggccatgggcagcaacagcgagtactgctacagcggcggcgccgacgcctgcatccacagctggaagatccccgacctgagcatggacccctacgacggctacgaccccagcgtgctgagccacgtgctggagggccacggcgacgccgtgtggggcctggccttcagccccaccagccagagactggccagctgcagcgccgacggcaccgtgagaatctgggaccccagcagcagcagccccgcctgcctgtgcaccttccccaccgccagcgagcacggcgtgcccaccagcgtggccttcaccagcaccgagcccgcccacatcgtggccagcttcagaagcggcgacaccgtgctgtacgacatggaggtgggcagcgccctgctgaccctggagagcagaggcagcagcggccccacccagatcaaccaggtggtgagccaccccaaccagcccctgaccatcaccgcccacgacgacagaggcatcagattcctggacaacagaaccggcaagcccgtgcacagcatggtggcccacctggacgccgtgacctgcctggccgtggaccccaacggcgccttcctgatgagcggcagccacgactgcagcctgagactgtggagcctggacaacaagacctgcgtgcaggagatcaccgcccacagaaagaagcacgaggaggccatccacgccgtggcctgccaccccagcaaggccctgatcgccagcgccggcgccgacgccctggccaaggtgttcgtgtag

SEQ ID NO: 13318 - DNA, 1368 bp, Artificial Sequence; identical to SEQ ID NO: 10195
  Description of Artificial Sequence: Synthetic coding sequence

SEQ ID NO: 13319 - DNA, 474 bp, Artificial Sequence
  Description of Artificial Sequence: Synthetic coding sequence
atgaagagcatgagccagctggccgtgctgagcagaagatggaagcccagcgagatgaagctggaccccttccaggaggtggtgctggagagcagcagcgtggacgagctgagagagaagctgagcgagatcagcggcatccccctggacgacatcgagttcgccaagggcagaggcaccttcccctgcgacatcagcgtgctggacatccaccaggacctggactggaaccccaaggtgagcaccctgaacgtgtggcccctgtacatctgcgacgacggcgccgtgatcttctacagagacaagaccgaggagctgatggagctgaccgacgagcagagaaacgagctgatgaagaaggagagcagcagactgcagaagaccggccacagagtgacctacagccccagaaaggagaaggccctgaagatctacctggacggcgcccccaacaaggacctgacccaggactag

SEQ ID NO: 13320 - DNA, 1083 bp, Artificial Sequence
  Description of Artificial Sequence: Synthetic coding sequence
atgaaggccaccgccatgaccagcgcctggctggcccagggcaccggcgagggcgtgaacgacgtgagaaagggcgcctgcgccagccacgtgagcaccatggccagcttcctgaagggcgcccacgtgaccatcaacgccagagccgaggaggacgtggagcccgagtgcatcatggagaaggtggccaaggccagcggcgccaactacagcttccacaaggagagcggcagattccaggacgtgggcccccaggcccccgtgggcagcgtgtaccagaagaccaacgccgtgagcgagatcaagagagtgggcaaggacagcttctgggccaaggccgagaaggaggaggagaacagaagactggaggagaagagaagagccgaggaggcccagagacagctggagcaggagagaagagagagagagctgagagaggccgccagaagagagcagagataccaggagcagggcggcgaggccagcccccagagaacctgggagcagcagcaggaggtggtgagcagaaacagaaacgagcaggagagcgccgtgcaccccagagagatcttcaagcagaaggagagagccatgagcaccaccagcatcagcagcccccagcccggcaagctgagaagccccttcctgcagaagcagctgacccagcccgagacccacttcggcagagagcccgccgccgccatcagcagacccagagccgacctgcccgccgaggagcccgcccccagcacccccccctgcctggtgcaggccgaggaggaggccgtgtacgaggagccccccgagcaggagaccttctacgagcagccccccctggtgcagcagcagggcgccggcagcgagcacatcgaccaccacatccagggccagggcctgagcggccagggcctgtgcgccagagccctgtacgactaccaggccgccgacgacaccgagatcagcttcgaccccgagaacctgatcaccggcatcgaggtgatcgacgagggctggtggagaggctacggccccgacggccacttcggcatgttccccgccaactacgtggagctgatcgagtag

SEQ ID NO: 13321 - DNA, 291 bp, Artificial Sequence
  Description of Artificial Sequence: Synthetic coding sequence
atgtgccacaccagctgcagcagcggctgccagcccgcctgctgcgcccccagcccctgccagcccgcctgctgcgtgcccgtgagctgccagagcagcgtgtgcgtgcccgtgagctgcagacccatcgtgtgcgccgcccccagctgccagagcagcctgtgcgtgcccgtgagctgcagacccgtggtgtacgccgcccccagctgccagagcagcggctgctgccagcccagctgcaccagcgtgctgtgcagacccatcagctacagcatcagcagctgctgctag

SEQ ID NO: 13322 - DNA, 27 bp, Artificial Sequence
  Description of Artificial Sequence: Synthetic coding sequence
atgcccctgagcagccccaacgcctag

SEQ ID NO: 13323 - DNA, 384 bp, Artificial Sequence
  Description of Artificial Sequence: Synthetic coding sequence
atgagcagcagcatgtggtacatcatgcagagcatccagagcaagtacagcctgagcgagagactgatcagaaccatcgccgccatcagaagcttcccccacgacaacgtggaggacctgatcagaggcggcgccgacgtgaactgcacccacggcaccctgaagcccctgcactgcgcctgcatggtgagcgacgccgactgcgtggagctgctgctggagaagggcgccgaggtgaacgccctggacggctacaacagaaccgccctgcactacgccgccgagaaggacgaggcctgcgtggaggtgctgctggagtacggcgccaaccccaacgccctggacggcaacagagacacccccctgcactgggccgccttctag

SEQ ID NO: 13324 - DNA, 318 bp, Artificial Sequence
  Description of Artificial Sequence: Synthetic coding sequence
cagtggaccgccagcaccgccaccatcaccaaggagaagcaggaccagcccaagaaggacatcagcaactaccaggtggagcaggcccaggtgctgctgaagagagagaaggagatcccccccaccgtgttccccaacagaagcccctggtgccagaacccctacgtgagcgcccacccctactgccccctgatcgagccccacaacaccagcaccgccggcggcagactggacagacagcccagaaccagaagcaccagacccaacagagccagcggcagcaagaagaagaagaccagcgagagccagaagcagtag

SEQ ID NO: 13325 - DNA, 1116 bp, Artificial Sequence
  Description of Artificial Sequence: Synthetic coding sequence
atggaggaggagggcctggccgacgaggaggtgagactggtgcagaagaaggacaccggccacatctacgccatgaagatcctgagaaagagcgacatgctggagaaggagcaggtggcccacatcagagccgagagagacatcctggtggaggccgacggcgcctgggtggtgaagatgttctacagcttccaggacaagagaaacctgtacctgatcatggagttcctgcccggcggcgacatgatgaccctgctgatgaagaaggacaccctgaccgaggaggagacccagttctacatcagcgagaccgtgctggccatcgacgccatccaccagctgggcttcatccacagagacatcaagcccgacaacctgctgctggacgccaagggccacgtgaagctgagcgacttcggcctgtgcaccggcctgaagaaggcccacagaaccgagttctacagaaacctgacccacaacccccccagcgacttcagcttccagaacatgaacagcaagagaaaggccgagacctggaagaagaacagaagacagctggcctacagcaccgtgggcacccccgactacatcgcccccgaggtgttcatgcagaccggctacaacaagctgtgcgactggtggagcctgggcgtgatcatgtacgagatgctgatcggctacccccccttctgcagcgagaccccccaggagacctacagaaaggtgatgaactggaaggagaccctggtgttcccccccgaggtgcccatcagcgagaaggccaaggacctgatcctgagattctgcatcgacagcgagaacagaatcggcaacagcggcgtggaggagatcaagggccaccccttcttcgagggcgtggactgggagcacatcagagagagacccgccgccatccccatcgagatcaagagcatcgacgacaccagcaacttcgacgacttccccgagagcgacatcctgcagcccgtgcccaacaccaccgagcccgactacaagagcaaggactgggtgttcctgaactacacctacaagagattcgagggcctgacccagagaggcagcatccccacctacatgaaggccggcaagctgtag

SEQ ID NO: 13326 - DNA, 564 bp, Artificial Sequence
  Description of Artificial Sequence: Synthetic coding sequence
atgaacaacaccctgagaaaggacggcaagaaggactgctgcttcgagatcagcgcccccgacaagagaatctaccagttcaccgccgccagccccaaggacgccgaggagtgggtgcagcagctgaagttcgtgctgcaggacatggagagcgacatcatccccgaggactacgacgagagaggcgagctgtacgacgacgtggaccaccccctgcccatcagcaaccccctgaccagcagccagcccatcgacgacgagatctacgaggagctgcccgaggaggaggaggacagcgcccccgtgaaggtggaggagcagagaaagatgagccaggacagcgtgcaccacaccagcggcgacaagagcaccgactacgccaacttctaccagggcctgtgggactgcaccggcgccttcagcgacgagctgagcttcaagagaggcgacgtgatctacatcctgagcaaggagtacaacagatacggctggtgggtgggcgagatgaagggcgccatcggcctggtgcccaaggcctacatcatggagatgtacgacatctag

SEQ ID NO: 13327 - DNA, 219 bp, Artificial Sequence
  Description of Artificial Sequence: Synthetic coding sequence
atggccctgagcctgggctggaaggcccacagaaaccactgcggcctgctgctgcaggccctgagaagcagcggcctgctgctgttcccctgcggccagtgcccctggagaggcgccggcagcttcctggaccccgagatcaaggccttcctggaggagaacaccgaggtgaccagcagcggcagcctgacccccgagatccagctgagactgctgtag

SEQ ID NO: 13328 - DNA, 2919 bp, Artificial Sequence
  Description of Artificial Sequence: Synthetic coding sequence
atggccgccgccgccgccgagcagcagcagttctacctgctgctgggcaacctgctgagccccgacaacgtggtgagaaagcaggccgaggagacctacgagaacatccccggccagagcaagatcaccttcctgctgcaggccatcagaaacaccaccgccgccgaggaggccagacagatggccgccgtgctgctgagaagactgctgagcagcgccttcgacgaggtgtaccccgccctgcccagcgacgtgcagaccgccatcaagaacctgctgcccggcttcctgcaggccgtgaacgacagctgctaccagaacgacgacagcgtgctgaagagcctggtggagatcgccgacaccgtgcccaagtacctgagaccccacctggaggccaccctgcagctgagcctgaagctgtgcggcgacaccagcctgaacaacatgcagagacagctggccctggaggtgatcgtgaccctgagcgagaccgccgccgccatgctgagaaagcacaccaacatcgtggcccagaccatcccccagatgctggccatgatggtggacctggaggaggacgaggactgggccaacgccgacgagctggaggacgacgacttcgacagcaacgccgtggccggcgagagcgccctggacagaatggcctgcggcctgggcggcaagctggtgctgcccatgatcaaggagcacatcatgcagatgctgcagaaccccgactggaagtacagacacgccggcctgatggccctgagcgccatcggcgagggctgccaccagcagatggagggcatcctgaacgagatcgtgaacttcgtgctgctgttcctgcaggacccccaccccagagtgagatacgccgcctgcaacgccgtgggccagatggccaccgacttcgcccccggcttccagaagaagttccacgagaaggtgatcgccgccctgctgcagaccatggaggaccagggcaaccagagagtgcaggcccacgccgccgccgccctgatcaacttcaccgaggactgccccaagagcctgctgatcccctacctggacaacctggtgaagcacctgcacagcatcatggtgctgaagctgcaggagctgatccagaagggcaccaagctggtgctggagcaggtggtgaccagcatcgccagcgtggccgacaccgccgaggagaagttcgtgccctactacgacctgttcatgcccagcctgaagcacatcgtggagaacgccgtgcagaaggagctgagactgctgagaggcaagaccatcgagtgcatcagcctgatcggcctggccgtgggcaaggagaagttcatgcaggacgccagcgacgtgatgcagctgctgctgaagacccagaccgacttcaacgacatggaggacgacgacccccagatcagctacatgatcagcgcctgggccagaatgtgcaagatcctgggcaaggagttccagcagtacctgcccgtggtgatgggccccctgatgaagaccgccagcatcaagcccgaggtggccctgctggacacccaggacatggagaacatgagcgacgacgacggctgggagttcgtgaacctgggcgaccagcagagcttcggcatcaagaccgccggcctggaggagaagagcaccgcctgccagatgctggtgtgctacgccaaggagctgaaggagggcttcgtggagtacaccgagcaggtggtgaagctgatggtgcccctgctgaagttctacttccacgacggcgtgagagtggccgccgccgagagcatgcccctgctgctggagtgcgccagagtgagaggccccgagtacctgacccagatgtggcacttcatgtgcgacgccctgatcaaggccatcggcaccgagcccgacagcgacgtgctgagcgagatcatgcacagcttcgccaagtgcatcgaggtgatgggcgacggctgcctgaacaacgagcacttcgaggagctgggcggcatcctgaaggccaagctggaggagcacttcaagaaccaggagctgagacaggtgaagagacaggacgaggactacgacgagcaggtggaggagagcctgcaggacgaggacgacaacgacgtgtacatcctgaccaaggtgagcgacatcctgcacagcatcttcagcagctacaaggagaaggtgctgccctggttcgagcagctgctgcccctgatcgtgaacctgatctgcccccacagaccctggcccgacagacagtggggcctgtgcatcttcgacgacgtgatcgagcactgcagccccgccagcttcaagtacgccgagtacttcctgagacccatgctgcagtacgtgtgcgacaacagccccgaggtgagacaggccgccgcctacggcctgggcgtgatggcccagtacggcggcgacaactacagacccttctgcaccgaggccctgcccctgctggtgagagtgatccagagcgccgacagcaagaccaaggagaacgtgaacgccaccgagaactgcatcagcgccgtgggcaagatcatgaagttcaagcccgactgcgtgaacgtggaggaggtgctgccccactggctgagctggctgcccctgcacgaggacaaggaggaggccgtgcagaccttcaactacctgtgcgacctgatcgagagcaaccaccccatcgtgctgggccccaacaacaccaacctgcccaagatcttcagcatcatcgccgagggcgagatgcacgaggccatcaagcacgaggacccctgcgccaagagactggccaacgtggtgagacaggtgcagaccagcggcggcctgtggaccgagtgcatcgcccagctgagccccgagcagcaggccgccatccaggagctgctgaacagcgcctag

SEQ ID NO: 13329 - DNA, 1428 bp, Artificial Sequence
  Description of Artificial Sequence: Synthetic coding sequence
atgcaggtgaccttcatctacgtgtgcctgaagggcctgatgctgcaggacctggtgagcgccaagctgatcagcgactacaccgtgaccgagatccccgacaccatcaacgacctgcagggcagcaccaaggtgctgcaggccgtgcagtggctggtgagccactgcccccacagcctggacctgtgctgccagaccctgatccagtacgtggaggacggcatcggccacgagttcagcggcagattcttccacgacagaagagagagaagactgggcggcctggccagccaggagcccggcgccatcatcgagctgttcaacagcgtgctgcagttcctggccagcgtggtgagcagcgagcagctgtgcgacctgagctggcccgtgaccgagttcgccgaggccggcggcagcagactgctgccccacctgcactggaacgcccccgagcacctggcctggctgaagcaggccgtgctgggcttccagctgccccagatggacctgccccccctgggcgccccctggctgcccgtgtgcagcatggtggtgcagtacgccagccagatccccagcagcagacagacccagcccgtgctgcagagccaggtggagaacctgctgcacagaacctactgcagatggaagagcaagagccccagccccgtgcacggcgccggccccagcgtgatggagatcccctgggacgacctgatcgccctgtgcatcaaccacaagctgagagactggaccccccccagactgcccgtgaccagcgaggccctgagcgaggacggccagatctgcgtgtacttcttcaagaacgacctgaagaagtacgacgtgcccctgagctgggagcaggccagactgcagacccagaaggagctgcagctgagagagggcagactggccatcaagcccttccaccccagcgccaacaacttccccatccccctgctgcacatgcacagaaactggaagagaagcaccgagtgcgcccaggagggcagaatccccagcaccgaggacctgatgagaggcgccagcgccgaggagctgctggcccagtgcctgagcagcagcctgctgctggagaaggaggagaacaagagattcgaggaccagctgcagcagtggctgagcgaggacagcggcgccttcaccgacctgaccagcctgcccctgtacctgccccagaccctggtgagcctgagccacaccatcgagcccgtgatgaagaccagcgtgaccaccagcccccagagcgacatgatgagagagcagctgcagctgagcgaggccaccggcacctgcctgggcgagagactgaagcacctggagagactgatcagaagcagcagagaggaggaggtggccagcgagctgcacctgagcgccctgctggacatggtggacatctag

SEQ ID NO: 13330 - DNA, 333 bp, Artificial Sequence
  Description of Artificial Sequence: Synthetic coding sequence
atgagcaccgccctgacccacaccaccgtggccatgagatgccccatgggcggcggcggcggccccacctacggccccccccagccctggggccaccccgacgtgcacatcatgcagcaccacgtgctgcccatccaggccagactgggcagcatcgccgagatcgacctgggcgtgcccccccccgtgatgaagaccttcaaggagttcctgctgagcctggacgacagcgtggacgagaccgaggccgtgaagagatacaacgactacaagctggacttcagaagacagcagatgcaggacttcttcctggcccacaaggacgaggagtag

SEQ ID NO: 13331 - DNA, 828 bp, Artificial Sequence; identical to SEQ ID NO: 12370
  Description of Artificial Sequence: Synthetic coding sequence

SEQ ID NO: 13332 - DNA, 876 bp, Artificial Sequence
  Description of Artificial Sequence: Synthetic coding sequence
atgatcggcgacggcgaggactacttcctgagcctgttcggcgacagcaagaagctgaccgcccacagcaactacacccagaagaccctgaagtacttcagcatgatcctggaggaggtgggccagttcaccagcagcagcctgggcgacgtggagatcgccgaggtgaacgtgaagggcctgttcgtgaagctgatcaacagcagcctggacaaggagatggccatcggcgaccacatcctgcagcagaacgtgaacggccagaccatcagcctgtacagattcctgcccaacatcgtgatgcaggccaacagcaccgtgaccgtgtgggccgccgccagcgaggccaagcaccagccccccagcgacttcctgtggaaggagcaggacaagttcagagccagccccgactgcatcaccatcctgtgcaagcccaacggccaggccatcgcctggtacacccccatccactggaagcaggcctgggagaagctggacgccgacgtggagttcaacagatgcagcgtggtgagccccaccttcagaaagagagtgttccagtggaccgccagcaccgccaccatcaccaaggagaagcaggaccagcccaagaaggacatcagcaactaccaggtggagcaggcccaggtgctgctgaagagagagaaggagatcccccccaccgtgttccccaacagaagcccctggtgccagaacccctacgtgagcgcccacccctactgccccctgatcgagccccacaacaccagcaccgccggcggcagactggacagacagcccagaaccagaagcaccagacccaacagagccagcggcagcaagaagaagaagaccagcgagagccagaagcagtag

SEQ ID NO: 13333 - DNA, 1185 bp, Artificial Sequence
  Description of Artificial Sequence: Synthetic coding sequence
atggtgcccagccaggccccctacctggtgcccgccttccccctgcccgccgccaccagccccggcagagagtacgccgcccccggcaccgcccccgagggcctgcacggcctgcccctgagcgagggcctgcagccctaccccgccttccccttcccctacctggacaccttcatgaccgtgttcctgcccgacccccccgtgtgccccctgctgagccccagcttcctgccctgccccttcctgggcgccaccgccagcagcgccatcagccccagcatgagcagcgccatgagccccaccctggaccccccccccagcgtgaccagccagagaagagaggaggagaagtgggaggcccagagcgagggccaccccttcatcaccagcagaagcagcagccccctgcagctgaacctgctgcaggaggagatgcccagacccagcgagagccccgaccagatgagaagaaacacctgcccccagaccgagtactgcgtgaccggcaacaacggcagcgagagcagccccgccaccaccggcgccctgagcaccggcagcccccccagagagaaccccagccaccccaccgccagcgccctgagcaccggcagcccccccatgaagaaccccagccaccccaccgccagcaccctgagcatgggcctgccccccagcagaacccccagccaccccaccgccaccgtgctgagcaccggcagcccccccagcgagagccccagcagaaccggcagcgccgccagcggcagcagcgacagcagcatctacctgaccagcagcgtgtacagcagcaagatcagccagaacggccagcagagccaggacgtgcagaagaaggagaccttccccaacgtggccgaggagcccatctggagaatgatcagacagacccccgagagaatcctgatgacctaccaggtgcccgagagagtgaaggaggtggtgctgaaggaggacctggagaagctggagagcatgagacagcagcagccccagttcagccacggccagaaggaggagctggccaaggtgtacaactggatccagagccagaccgtgacccaggagatcgacatccaggcctgcgtgacctgcgagaacgaggacagcgccgacggcgccgccaccagctgcggccaggtgctggtggaggacagctgctag

SEQ ID NO: 13334 - DNA, 2424 bp, Artificial Sequence
  Description of Artificial Sequence: Synthetic coding sequence
cagggcgccagcttcgccctggccgccgccgccgccctgctgttcggcagcgacatggaggacggccccagcaacaacgccagctgcttcagaagactgaccgagtgcttcctgagccccagcctgaccgacgagaaggtgaaggcctacctgagcctgcacccccaggtgctggacgagttcgtgagcgagagcgtgagcgccgagaccgtggagaagtggctgaagagaaagaacaacaagagcgaggacgagagcgcccccaaggaggtgagcagataccaggacaccaacatgcagggcgtggtgtacgagctgaacagctacatcgagcagagactggacaccggcggcgacaaccagctgctgctgtacgagctgagcagcatcatcaagatcgccaccaaggccgacggcttcgccctgtacttcctgggcgagtgcaacaacagcctgtgcatcttcaccccccccggcatcaaggagggcaagcccagactgatccccgccggccccatcacccagggcaccaccgtgagcgcctacgtggccaagagcagaaagaccctgctggtggaggacatcctgggcgacgagagattccccagaggcaccggcctggagagcggcaccagaatccagagcgtgctgtgcctgcccatcgtgaccgccatcggcgacctgatcggcatcctggagctgtacagacactggggcaaggaggccttctgcctgagccaccaggaggtggccaccgccaacctggcctgggccagcgtggccatccaccaggtgcaggtgtgcagaggcctggccaagcagaccgagctgaacgacttcctgctggacgtgagcaagacctacttcgacaacatcgtggccatcgacagcctgctggagcacatcatgatctacgccaagaacctggtgaacgccgacagatgcgccctgttccaggtggaccacaagaacaaggagctgtacagcgacctgttcgacatcggcgaggagaaggagggcaagcccgtgttcaagaagaccaaggagatcagattcagcatcgagaagggcatcgccggccaggtggccagaaccggcgaggtgctgaacatccccgacgcctacgccgaccccagattcaacagagaggtggacctgtacaccggctacaccaccagaaacatcctgtgcatgcccatcgtgagcagaggcagcgtgatcggcgtggtgcagatggtgaacaagatcagcggcagcgccttcagcaagaccgacgagaacaacttcaagatgttcgccgtgttctgcgccctggccctgcactgcgccaacatgtaccacagaatcagacacagcgagtgcatctacagagtgaccatggagaagctgagctaccacagcatctgcaccagcgaggagtggcagggcctgatgcagttcaccctgcccgtgagactgtgcaaggagatcgagctgttccacttcgacatcggccccttcgagaacatgtggcccggcatcttcgtgtacatggtgcacagaagctgcggcaccagctgcttcgagctggagaagctgtgcagattcatcatgagcgtgaagaagaactacagaagagtgccctaccacaactggaagcacgccgtgaccgtggcccactgcatgtacgccatcctgcagaacaaccacaccctgttcaccgacctggagagaaagggcctgctgatcgcctgcctgtgccacgacctggaccacagaggcttcagcaacagctacctgcagaagttcgaccaccccctggccgccctgtacagcaccagcaccatggagcagcaccacttcagccagaccgtgagcatcctgcagctggagggccacaacatcttcagcaccctgagcagcagcgagtacgagcaggtgctggagatcatcagaaaggccatcatcgccaccgacctggccctgtacttcggcaacagaaagcagctggaggagatgtaccagaccggcagcctgaacctgaacaaccagagccacagagacagagtgatcggcctgatgatgaccgcctgcgacctgtgcagcgtgaccaagctgtggcccgtgaccaagctgaccgccaacgacatctacgccgagttctgggccgagggcgacgagatgaagaagctgggcatccagcccatccccatgatggacagagacaagaaggacgaggtgccccagggccagctgggcttctacaacgccgtggccatcccctgctacaccaccctgacccagatcctgccccccaccgagcccctgctgaaggcctgcagagacaacctgagccagtgggagaaggtgatcagaggcgaggagaccgccacctggatcagcagccccagcgtggcccagaaggccgccgccagcgaggactag

SEQ ID NO: 13335 - DNA, 1677 bp, Artificial Sequence
  Description of Artificial Sequence: Synthetic coding sequence
atggccagctgccccgacagcgacaacagctgggtgctggccggcggcgagctgggcatcagcctgaacatgtgcctgctgggcgccctggtgctgctgggcctgggcgtgctgctgttcagcggcggcctgagcgagagcgagaccggccccatggaggaggtggagagacaggtgctgcccgaccccgaggtgctggaggccgtgggcgacagacaggacggcctgagagagcagctgcaggcccccgtgccccccgacagcgtgcccagcctgcagaacatgggcctgctgctggacaagctggccaaggagaaccaggacatcagactgctgcaggcccagctgcaggcccagaaggaggagctgcagagcctgatgcaccagcccaagggcctggaggaggagaacgcccagctgagaggcgccctgcagcagggcgaggccttccagagagccctggagagcgagctgcagcagctgagagccagactgcagggcctggaggccgactgcgtgagaggccccgacggcgtgtgcctgagcggcggcagaggcccccagggcgacaaggccatcagagagcagggccccagagagcaggagcccgagctgagcttcctgaagcagaaggagcagctggaggccgaggcccaggccctgagacaggagctggagagacagagaagactgctgggcagcgtgcagcaggacctggagagaagcctgcaggacgccagcagaggcgaccccgcccacgccggcctggccgagctgggccacagactggcccagaagctgcagggcctggagaactggggccaggaccccggcgtgagcgccaacgccagcaaggcctggcaccagaagagccacttccagaacagcagagagtggagcggcaaggagaagtggtgggacggccagagagacagaaaggccgagcactggaagcacaagaaggaggagagcggcagagagagaaagaagaactggggcggccaggaggacagagagcccgccggcagatggaaggagggcagacccagagtggaggagagcggcagcaagaaggagggcaagagacagggccccaaggagccccccagaaagagcggcagcttccacagcagcggcgagaagcagaagcagcccagatggagagagggcaccaaggacagccacgaccccctgcccagctgggccgagctgctgagacccaagtacagagccccccagggctgcagcggcgtggacgagtgcgccagacaggagggcctgaccttcttcggcaccgagctggcccccgtgagacagcaggagctggccagcctgctgagaacctacctggccagactgccctgggccggccagctgaccaaggagctgcccctgagccccgccttcttcggcgaggacggcatcttcagacacgacagactgagattcagagacttcgtggacgccctggaggacagcctggaggaggtggccgtgcagcagaccggcgacgacgacgaggtggacgacttcgaggacttcatcttcagccacttcttcggcgacaaggccctgaagaagagaagcggcaagaaggacaagcacagccagagccccagagccgccggccccagagagggccacagccacagccaccaccaccaccacagaggctag

SEQ ID NO: 13336 - DNA, 1881 bp, Artificial Sequence
  Description of Artificial Sequence: Synthetic coding sequence
atgggcaacgccgccggcagcgccgagcagcccgccggccccgccgcccccccccccaagcagcacagattcgagaagctgatggagtacttcagaaacgaggacagcaacatcgacttcatggtggcctgcatgcagttcatcaacatcgtggtgcacagcgtggagaacatgaacttcagagtgttcctgcagtacgagttcacccacctgggcctggacctgtacctggagagactgagactgaccgagagcgacaagctgcaggtgcagatccaggcctacctggacaacatcttcgacgtgggcgccctgctggaggacaccgagaccaagaacgccgtgctggagcacatggaggagctgcaggagcaggtggccctgctgaccgagagactgagagacgccgagaacgagagcatggccaagatcgccgagctggagaagcagctgagccaggccagaaaggagctggagaccctgagagagagattcagcgagagcaccgccatgggccccagcagaagaccccccgagcccgagaaggccccccccgccgcccccaccagacccagcgccctggagctgaaggtggaggagctggaggagaagggcctgatcagaatcctgagaggccccggcgacgccgtgagcatcgagatcctgcccgtggccgtggccacccccagcggcggcgacgcccccacccccggcgtgcccaccggcagccccagccccgacctggcccccgccgccgagcccgcccccggcgccgccccccccccccccccccccccccccggcggcccccccgacgccctgggcagaagagacagcgagctgggccccggcgtgaaggccaagaagcccatccagaccaagttcagaatgcccctgctgaactgggtggccctgaagcccagccagatcaccggcaccgtgttcaccgagctgaacgacgagaaggtgctgcaggagctggacatgagcgacttcgaggagcagttcaagaccaagagccagggccccagcctggacctgagcgccctgaagagcaaggccgcccagaaggcccccagcaaggccaccctgatcgaggccaacagagccaagaacctggccatcaccctgagaaagggcaacctgggcgccgagagaatctgccaggccatcgaggcctacgacctgcaggccctgggcctggacttcctggagctgctgatgagattcctgcccaccgagtacgagagaagcctgatcaccagattcgagagagagcagagacccatggaggagctgagcgaggaggacagattcatgctgtgcttcagcagaatccccagactgcccgagagaatgaccaccctgaccttcctgggcaacttccccgacaccgcccagctgctgatgccccagctgaacgccatcatcgccgccagcatgagcatcaagagcagcgacaagctgagacagatcctggagatcgtgctggccttcggcaactacatgaacagcagcaagagaggcgccgcctacggcttcagactgcagagcctggacgccctgctggagatgaagagcaccgacagaaagcagaccctgctgcactacctggtgaaggtgatcgccgagaagtacccccagctgaccggcttccacagcgacctgcacttcctggacaaggccggcagcgtgagcctggacagcgtgctggccgacgtgagaagcctgcagagaggcctggagctgacccagagagagttcgtgagacaggacgactgcatggtgctgaaggagttcctgagagccaacagccccaccatggacaagctgctggccgacagcaagaccgcccaggccgtgcccaccggcggcctgtag

SEQ ID NO: 13337 - DNA, 1500 bp, Artificial Sequence
  Description of Artificial Sequence: Synthetic coding sequence
atggacaagctgatcgtggacggcagaggcaaggccaccatcagcaacgacggcgccaccatcctgaagctgctggacgtggtgcaccccgccgccaagaccctggtggacatcgccaagagccaggacgccgaggtgggcgacggcaccaccagcgtgaccctgctggccgccgagttcctgaagcaggtgaagccctacgtggaggagggcctgcacccccagatcatcatcagagccttcagaaccgccacccagctggccgtgaacaagatcaaggagatcgccgtgaccgtgaagaaggccgacaaggtggagcagagaaagctgctggagaagtgcgccatgaccgccctgagcagcaagctgatcagccagcagaaggccttcttcgccaagatggtggtggacgccgtgatgatgctggacgacctgctgcagctgaagatgatcggcatcaagaaggtgcagggcggcgccctggaggacagccagctggtggccggcgtggccttcaagaagaccttcagctacgccggcttcgagatgcagcccaagaagtaccacaaccccaagatcgccctgctgaacgtggagctggagctgaaggccgagaaggacaacgccgagatcagagtgcacaccgtggaggactaccaggccatcgtggacgccgagtggaacatcctgtacgacaagctggagaagatccaccacagcggcgccaaggtggtgctgagcaagctgcccatcggcgacgtggccacccagtacttcgccgacagagacatgttctgcgccggcagagtgcccgaggaggacctgaagagaaccatgatggcctgcggcggcagcatccagaccagcgtgaacgccctgagcgccgacgtgctgggcagatgccaggtgttcgaggagacccagatcggcggcgagagatacaacttcttcaccggctgccccaaggccaagacctgcaccttcatcctgagaggcggcgccgagcagttcatggaggagaccgagagaagcctgcacgacgccatcatgatcgtgagaagagccatcaagaacgacagcgtggtggccggcggcggcgccatcgagatggagctgagcaagtacctgagagactacagcagaaccatccccggcaagcagcagctgctgatcggcgcctacgccaaggccctggagatcatccccagacagctgtgcgacaacgccggcttcgacgccaccaacatcctgaacaagctgagagccagacacgcccagggcggcacctggtacggcgtggacatcaacaacgaggacatcgccgacaacttcgaggccttcgtgtgggagcccgccatggtgagaatcaacgccctgaccgccgccagcgaggccgcctgcctgatcgtgagcgtggacgagaccatcaagaaccccagaagcaccgtggacgcccccaccgccgccggcagaggcagaggcagaggcagaccccactag

SEQ ID NO: 13338 - DNA, 78 bp, Artificial Sequence
  Description of Artificial Sequence: Synthetic coding sequence
atggcccacgagatgatcggcacccagatcgtgaccgagagactggtggccctgctggagagcggcaccgagaagtag

SEQ ID NO: 13339 - DNA, 633 bp, Artificial Sequence
  Description of Artificial Sequence: Synthetic coding sequence
atggagaagaccgagctgatccagaaggccgtggcctacaagaacgtggtgggcggcagaagaagcgcctggagagtgatcagcagcatcgagcagaagaccgacaccagcgacaagaagctgcagctgatcaaggactacagagagaaggtggagagcgagctgagaagcatctgcaccaccgtgctggagctgctggacaagtacctgatcgccaacgccaccaaccccgagagcaaggtgttctacctgaagatgaagggcgactacttcagatacctggccgaggtggcctgcggcgacgacagaaagcagaccatcgacaacagccagggcgcctaccaggaggccttcgacatcagcaagaaggagatgcagcccacccaccccatcagactgggcctggccctgaacttcagcgtgttctactacgagatcctgaacaaccccgagctggcctgcaccctggccaagaccgccttcgacgaggccatcgccgagctggacaccctgaacgaggacagctacaaggacagcaccctgatcatgcagctgctgagagacaacctgaccctgtggaccagcgacagcgccggcgaggagtgcgacgccgccgagggcgccgagaactag

SEQ ID NO: 13340 - DNA, 501 bp, Artificial Sequence
  Description of Artificial Sequence: Synthetic coding sequence
atggacctgatgcccttcatcaacaaggccggctgcgagtgcctgaacgagagcgacgagcacggcttcgacaactgcctgagaaaggacaccaccttcctggagagcgactgcgacgagcagctgctgatcaccgtggccttcaaccagcccgtgaagctgtacagcatgaagttccagggccccgacaacggccagggccccaagtacgtgaagatcttcatcaacctgcccagaagcatggacttcgaggaggccgagagaagcgagcccacccaggccctggagctgaccgaggacgacatcaaggaggacggcatcgtgcccctgagatacgtgaagttccagaacgtgaacagcgtgaccatcttcgtgcagagcaaccagggcgaggaggagaccaccagaatcagctacttcaccttcatcggcacccccgtgcaggccaccaacatgaacgacttcaagagagtggtgggcaagaagggcgagagccactag

SEQ ID NO: 13341 - DNA, 639 bp, Artificial Sequence
  Description of Artificial Sequence: Synthetic coding sequence
atggccgcccccgaggagagagacctgacccaggagcagaccgagaagctgctgcagttccaggacctgaccggcatcgagagcatggaccagtgcagacacaccctggagcagcacaactggaacatcgaggccgccgtgcaggacagactgaacgagcaggagggcgtgcccagcgtgttcaaccccccccccagcagacccctgcaggtgaacaccgccgaccacagaatctacagctacgtggtgagcagaccccagcccagaggcctgctgggctggggctactacctgatcatgctgcccttcagattcacctactacaccatcctggacatcttcagattcgccctgagattcatcagacccgaccccagaagcagagtgaccgaccccgtgggcgacatcgtgagcttcatgcacagcttcgaggagaagtacggcagagcccaccccgtgttctaccagggcacctacagccaggccctgaacgacgccaagagagagctgagattcctgctggtgtacctgcacggcgacgaccaccaggacagcgacgagttctgcagaaacaccctgtgcgcccccgaggtgatcagcctgatcaacaccagcagccacagcttcctgctgctgtag

SEQ ID NO: 13342 - DNA, 1371 bp, Artificial Sequence; identical to SEQ ID NO: 11746
  Description of Artificial Sequence: Synthetic coding sequence

SEQ ID NO: 13343 - DNA, 183 bp, Artificial Sequence
  Description of Artificial Sequence: Synthetic coding sequence
atggacgagcaggccctgctgggcctgaaccccaacgccgacagcgacttcagacagagagccctggcctacttcgagcagctgaagatcagccccgacgcctggcaggtgtgcgccgaggccctggcccagagaacctacagcgacgaccacgtgaagttcttctgcttccaggtgctgtag

SEQ ID NO: 13344 - DNA, 339 bp, Artificial Sequence
  Description of Artificial Sequence: Synthetic coding sequence
atgagcagcagcatgtggtacatcatgcagagcatccagagcaagtacagcctgagcgagagactgatcagaaccatcgccgccatcagaagcttcccccacgacaacgtggaggacctgatcagaggcggcgccgacgtgaactgcacccacggcaccctgaagcccctgcactgcgcctgcatggtgagcgacgccgactgcgtggagctgctgctggagaagggcgccgaggtgaacgccctggacggctacaacagaaccgccctgcactacgccgccgagaaggacgaggcctgcgtggaggtgctgctggagtacggcgccaaccccaactag

SEQ ID NO: 13345 - DNA, 1173 bp, Artificial Sequence; identical to SEQ ID NO: 12528
  Description of Artificial Sequence: Synthetic coding sequence

SEQ ID NO: 13346 - DNA, 1335 bp, Artificial Sequence; identical to SEQ ID NO: 9462
  Description of Artificial Sequence: Synthetic coding sequence

SEQ ID NO: 13347 - DNA, 495 bp, Artificial Sequence; identical to SEQ ID NO: 10722
  Description of Artificial Sequence: Synthetic coding sequence

SEQ ID NO: 13348 - DNA, 3252 bp, Artificial Sequence; identical to SEQ ID NO: 9558
  Description of Artificial Sequence: Synthetic coding sequence

SEQ ID NO: 13349 - DNA, 1503 bp, Artificial Sequence
  Description of Artificial Sequence: Synthetic coding sequence
atggccgccgtgaagaccctgaaccccaagggcaccatgaagatgctggtgagcggcgccggcgacatcaagctgaccaaggacggcaacgtgctgctgcacgagatgcagatccagcaccccaccgccagcctgatcgccaaggtggccaccgcccaggacgacatcaccggcgacggcaccaccagcaacgtgctgatcatcggcgagctgctgaagcaggccgacctgtacatcagcgagggcctgcaccccagaatcatcaccgagggcttcgaggccgccaaggagaaggccctgcagttcctggaggaggtgaaggtgagcagagagatggacagagagaccctgatcgacgtggccagaaccagcctgagaaccaaggtgcacgccgagctggccgacgtgctgaccgaggccgtggtggacagcatcctggccatcaagaagcaggacgagcccatcgacctgttcatgatcgagatcatggagatgaagcacaagagcgagaccgacaccagcctgatcagaggcctggtgctggaccacggcgccagacaccccgacatgaagaagagagtggaggacgcctacatcctgacctgcaacgtgagcctggagtacgagaagaccgaggtgaacagcggcttcttctacaagagcgccgaggagagagagaagctggtgaaggccgagagaaagttcatcgaggacagagtgaagaagatcatcgagctgaagagaaaggtgtgcggcgacagcgacaagggcttcgtggtgatcaaccagaagggcatcgaccccttcagcctggacgccctgagcaaggagggcatcgtggccctgagaagagccaagagaagaaacatggagagactgaccctggcctgcggcggcgtggccctgaacagcttcgacgacctgagccccgactgcctgggccacgccggcctggtgtacgagtacaccctgggcgaggagaagttcaccttcatcgagaagtgcaacaaccccagaagcgtgaccctgctgatcaagggccccaacaagcacaccctgacccagatcaaggacgccgtgagagacggcctgagagccgtgaagaacgccatcgacgacggctgcgtggtgcccggcgccggcgccgtggaggtggccatggccgaggccctgatcaagcacaagcccagcgtgaagggcagagcccagctgggcgtgcaggccttcgccgacgccctgctgatcatccccaaggtgctggcccagaacagcggcttcgacctgcaggagaccctggtgaagatccaggccgagcacagcgagagcggccagctggtgggcgtggacctgaacaccggcgagcccatggtggccgccgaggtgggcgtgtgggacaactactgcgtgaagaagcagctgctgcacagctgcaccgtgatcgccaccaacatcctgctggtggacgagatcatgagagccggcatgagcagcctgaagggctag

SEQ ID NO: 13350 - DNA, 1542 bp, Artificial Sequence
  Description of Artificial Sequence: Synthetic coding sequence
atgtgggacgtgtgcatggagagaggccacagagacctggagcagttcgagagagtgcacagatacatcagcgaccagctgttcaccaacttcaaggagagaaccgagagactggtgatcagccccctgaaccagctgctgagcatgttcaccggcccccacaagctggtgcagaagagattcgacaagctgctggacttctacaactgcaccgagagagccgagaagctgaaggacaagaagaccctggaggagctgcagagcgccagaaacaactacgaggccctgaacgcccagctgctggacgagctgcccaagttccaccagtacgcccagggcctgttcaccaactgcgtgcacggctacgccgaggcccactgcgacttcgtgcaccaggccctggagcagctgaagcccctgctgagcctgctgaaggtggccggcagagagggcaacctgatcgccatcttccacgaggagcacagcagagtgctgcagcagctgcaggtgttcaccttcttccccgagagcctgcccgccaccaagaagcccttcgagagaaagaccatcgacagacagagcgccagaaagcccctgctgggcctgcccagctacatgctgcagagcgaggagctgagagccagcctgctggccagatacccccccgagaagctgttccaggccgagagaaacttcaacgccgcccaggacctggacgtgagcctgctggagggcgacctggtgggcgtgatcaagaagaaggaccccatgggcagccagaacagatggctgatcgacaacggcgtgaccaagggcttcgtgtacagcagcttcctgaagccctacaaccccagaagaagccacagcgacgccagcgtgggcagccacagcagcaccgagagcgagcacggcagcagcagccccagattccccagacagaacagcggcagcaccctgaccttcaaccccagcagcatggccgtgagcttcaccagcggcagctgccagaagcagccccaggacgccagccccccccccaaggagtgcgaccagggcaccctgagcgccagcctgaaccccagcaacagcgagagcagccccagcagatgccccagcgaccccgacagcaccagccagcccagaagcggcgacagcgccgacgtggccagagacgtgaagcagcccaccgccacccccagaagctacagaaacttcagacaccccgagatcgtgggctacagcgtgcccggcagaaacggccagagccaggacctggtgaagggctgcgccagaaccgcccaggcccccgaggacagaagcaccgagcccgacggcagcgaggccgagggcaaccaggtgtacttcgccgtgtacaccttcaaggccagaaaccccaacgagctgagcgtgagcgccaaccagaagctgaagatcctggagttcaaggacgtgaccggcaacaccgagtggtggctggccgaggtgaacggcaagaagggctacgtgcccagcaactacatcagaaagaccgagtacacctag

SEQ ID NO: 13351 - DNA, 153 bp, Artificial Sequence; identical to SEQ ID NO: 11238
  Description of Artificial Sequence: Synthetic coding sequence

SEQ ID NO: 13352 - DNA, 4317 bp, Artificial Sequence
  Description of Artificial Sequence: Synthetic coding sequence
atgagcatgctgaagcccagcggcctgaaggcccccaccaagatcctgaagcccggcagcaccgccctgaagacccccaccgccgtggtggcccccgtggagaagaccatcagcagcgagaaggccagcagcacccccagcagcgagacccaggaggagttcgtggacgacttcagagtgggcgagagagtgtgggtgaacggcaacaagcccggcttcatccagttcctgggcgagacccagttcgcccccggccagtgggccggcatcgtgctggacgagcccatcggcaagaacgacggcagcgtggccggcgtgagatacttccagtgcgagcccctgaagggcatcttcaccagacccagcaagctgaccagaaaggtgcaggccgaggacgaggccaacggcctgcagaccacccccgccagcagagccaccagccccctgtgcaccagcaccgccagcatggtgagcagcagccccagcacccccagcaacatcccccagaagcccagccagcccgccgccaaggagcccagcgccaccccccccatcagcaacctgaccaagaccgccagcgagagcatcagcaacctgagcgaggccggcagcatcaagaagggcgagagagagctgaagatcggcgacagagtgctggtgggcggcaccaaggccggcgtggtgagattcctgggcgagaccgacttcgccaagggcgagtggtgcggcgtggagctggacgagcccctgggcaagaacgacggcgccgtggccggcaccagatacttccagtgccagcccaagtacggcctgttcgcccccgtgcacaaggtgaccaagatcggcttccccagcaccacccccgccaaggccaaggccaacgccgtgagaagagtgatggccaccaccagcgccagcctgaagagaagccccagcgccagcagcctgagcagcatgagcagcgtggccagcagcgtgagcagcagacccagcagaaccggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacgtgggcgagatcgagcaggagctggccctggccagagacggccacgaccagcacgtgctggagctggaggccaagatggaccagctgagaaccatggtggaggccgccgacagagagaaggtggagctgctgaaccagctggaggaggagaagagaaaggtggaggacctgcagttcagagtggaggaggagagcatcaccaagggcgacctggagcagaagagccagatcagcgaggaccccgagaacacccagaccaagctggagcacgccagaatcaaggagctggagcagagcctgctgttcgagaagaccaaggccgacaagctgcagagagagctggaggacaccagagtggccaccgtgagcgagaagagcagaatcatggagctggagaaggacctggccctgagagtgcaggaggtggccgagctgagaagaagactggagagcaacaagcccgccggcgacgtggacatgagcctgagcctgctgcaggagatcagcagcctgcaggagaagctggaggtgaccagaaccgaccaccagagagagatcaccagcctgaaggagcacttcggcgccagagaggagacccaccagaaggagatcaaggccctgtacaccgccaccgagaagctgagcaaggagaacgagagcctgaagagcaagctggagcacgccaacaaggagaacagcgacgtgatcgccctgtggaagagcaagctggagaccgccatcgccagccaccagcaggccatggaggagctgaaggtgagcttcagcaagggcctgggcaccgagaccgccgagttcgccgagctgaagacccagatcgagaagatgagactggactaccagcacgagatcgagaacctgcagaaccagcaggacagcgagagagccgcccacgccaaggagatggaggccctgagagccaagctgatgaaggtgatcaaggagaaggagaacagcctggaggccatcagaagcaagctggacaaggccgaggaccagcacctggtggagatggaggacaccctgaacaagctgcaggaggccgagatcaaggtgaaggagctggaggtgctgcaggccaagtgcaacgagcagaccaaggtgatcgacaacttcaccagccagctgaaggccaccgaggagaagctgctggacctggacgccctgagaaaggccagcagcgagggcaagagcgagatgaagaagctgagacagcagctggaggccgccgagaagcagatcaagcacctggagatcgagaagaacgccgagagcagcaaggccagcagcatcaccagagagctgcagggcagagagctgaagctgaccaacctgcaggagaacctgagcgaggtgagccaggtgaaggagaccctggagaaggagctgcagatcctgaaggagaagttcgccgaggccagcgaggaggccgtgagcgtgcagagaagcatgcaggagaccgtgaacaagctgcaccagaaggaggagcagttcaacatgctgagcagcgacctggagaagctgagagagaacctggccgacatggaggccaagttcagagagaaggacgagagagaggagcagctgatcaaggccaaggagaagctggagaacgacatcgccgagatcatgaagatgagcggcgacaacagcagccagctgaccaagatgaacgacgagctgagactgaaggagagagacgtggaggagctgcagctgaagctgaccaaggccaacgagaacgccagcttcctgcagaagagcatcgaggacatgaccgtgaaggccgagcagagccagcaggaggccgccaagaagcacgaggaggagaagaaggagctggagagaaagctgagcgacctggagaagaagatggagaccagccacaaccagtgccaggagctgaaggccagatacgagagagccaccagcgagaccaagaccaagcacgaggagatcctgcagaacctgcagaagaccctgctggacaccgaggacaagctgaagggcgccagagaggagaacagcggcctgctgcaggagctggaggagctgagaaagcaggccgacaaggccaaggccgcccagaccgccgaggacgccatgcagatcatggagcagatgaccaaggagaagaccgagaccctggccagcctggaggacaccaagcagaccaacgccaagctgcagaacgagctggacaccctgaaggagaacaacctgaagaacgtggaggagctgaacaagagcaaggagctgctgaccgtggagaaccagaagatggaggagttcagaaaggagatcgagaccctgaagcaggccgccgcccagaagagccagcagctgagcgccctgcaggaggagaacgtgaagctggccgaggagctgggcagaagcagagacgaggtgaccagccaccagaagctggaggaggagagaagcgtgctgaacaaccagctgctggagatgaagaagagagagagcaagttcatcaaggacgccgacgaggagaaggccagcctgcagaagagcatcagcatcaccagcgccctgctgaccgagaaggacgccgagctggagaagctgagaaacgaggtgaccgtgctgagaggcgagaacgccagcgccaagagcctgcacagcgtggtgcagaccctggagagcgacaaggtgaagctggagctgaaggtgaagaacctggagctgcagctgaaggagaacaagagacagctgagcagcagcagcggcaacaccgacacccaggccgacgaggacgagagagcccaggagagccagatcgacttcctgaacagcgtgatcgtggacctgcagagaaagaaccaggacctgaagatgaaggtggagatgatgagcgaggccgccctgaacggcaacggcgacgacctgaacaactacgacagcgacgaccaggagaagcagagcaagaagaagcccagactgttctgcgacatctgcgactgcttcgacctgcacgacaccgaggactgccccacccaggcccagatgagcgaggaccccccccacagcacccaccacggcagcagaggcgaggagagaccctactgcgagatctgcgagatgttcggccactgggccaccaactgcaacgacgacgagaccttctag

SEQ ID NO: 13353 - DNA, 636 bp, Artificial Sequence
  Description of Artificial Sequence: Synthetic coding sequence
atggccttcgccgacagccacctgtggaagctgctggacagacacgccaacaccatcagactgttcgtgctgctgcccgagcagagccccgtgagctacagcaagagaaccgcctaccagaaggccggcggcgacagcggcaacgtggacgacgactgcgagagagtgaagggccccgtgggcagcctgaagagcgtggaggccatcctggaggagagcaccgagaagctgaagagcctgagcctgcagcagcagcaggacggcgacaacggcgacagcagcaagagcaccgagaccagcgacttcgagaacatcgagagccccctgaacgagagagacagcagcgccagcgtggacaacagagagctggagcagcacatccagaccagcgaccccgagaacttccagagcgaggagagaagcgacagcgacgtgaacaacgacagaagcaccagcagcgtggacagcgacatcctgagcagcagccacagcagcgacaccctgtgcaacgccgacaacgcccagatccccctggccaacggcctggacagccacagcatcaccagcagcagaagaaccaaggccaacagagagaagagaaacatgggctacagcagaagaagactgtggaactag

SEQ ID NO: 13354 - DNA, 2136 bp, Artificial Sequence
  Description of Artificial Sequence: Synthetic coding sequence
atgctggccagcctgaaggtgaagaagcaggagctggccaacagcagcgacgccaccctgcccgacagacccctgagcccccccctgaccgccccccccaccatgaagagcagcgagttcttcgagatgctggagaagatgcagggcatcaagctggaggagcagaagcccggcccccagaagaacaaggacgactacatcccctaccccagcatcgacgaggtggtggagaagggcggcccctacccccaggtgatcctgccccagttcggcggctactggatcgaggaccccgagaacgtgggcacccccaccagcctgggcagcagcatctgcgaggaggaggaggaggacaacctgagccccaacaccttcggctacaagctggagtgcaagggcgaggccagagcctacagaagacacttcctgggcaaggaccacctgaacttctactgcaccggcagcagcctgggcaacctgatcctgagcgtgaagtgcgaggaggccgagggcatcgagtacctgagagtgatcctgagaagcaagctgaagaccgtgcacgagagaatccccctggccggcctgagcaagctgcccagcgtgccccagatcgccaaggccttctgcgacgacgccgtgggcctgagattcaaccccgtgctgtaccccaaggccagccagatgatcgtgagctacgacgagcacgaggtgaacaacaccttcaagttcggcgtgatctaccagaaggccagacagaccctggaggaggagctgttcggcaacaacgaggagagccccgccttcaaggagttcctggacctgctgggcgacaccatcaccctgcaggacttcaagggcttcagaggcggcctggacgtgacccacggccagaccggcgtggagagcgtgtacaccaccttcagagacagagagatcatgttccacgtgagcaccaagctgcccttcaccgacggcgacgcccagcagctgcagagaaagagacacatcggcaacgacatcgtggccatcatcttccaggaggagaacacccccttcgtgcccgacatgatcgccagcaacttcctgcacgcctacatcgtggtgcaggtggagacccccggcaccgagacccccagctacaaggtgagcgtgaccgccagagaggacgtgcccaccttcggcccccccctgcccagcccccccgtgttccagaagggccccgagttcagagagttcctgctgaccaagctgaccaacgccgagaacgcctgctgcaagagcgacaagttcgccaagctggaggacagaaccagagccgccctgctggacaacctgcacgacgagctgcacgcccacacccaggccatgctgggcctgggccccgaggaggacaagttcgagaacggcggccacggcggcttcctggagagcttcaagagagccatcagagtgagaagccacagcatggagaccatggtgggcggccagaagaagagccacagcggcggcatccccggcagcctgagcggcggcatcagccacaacagcatggaggtgaccaagaccaccttcagcccccccgtggtggccgccaccgtgaagaaccagagcagaagccccatcaagagaagaagcggcctgttccccagactgcacaccggcagcgagggccagggcgacagcagagccagatgcgacagcaccagcagcacccccaagacccccgacggcggccacagcagccaggagatcaagagcgagaccagcagcaaccccagcagccccgagatctgccccaacaaggagaagcccttcatgaagctgaaggagaacggcagagccatcagcagaagcagcagcagcaccagcagcgtgagcagcaccgccggcgagggcgaggccatggaggagggcgacagcggcggcagccagcccagcaccaccagccccttcaagcaggaggtgttcgtgtacagccccagccccagcagcgagagccccagcctgggcgccgccgccacccccatcatcatgagcagaagccccaccgacgccaagagcagaaacagccccagaagcaacctgaagttcagattcgacaagctgagccacgccagcagcggcgccggccactag

SEQ ID NO: 13355 - DNA, 1089 bp, Artificial Sequence
  Description of Artificial Sequence: Synthetic coding sequence
atggacggcctggacgacgtggagaacagcatgctgtactacaaccaggccgtgatcctgtaccacctgagacagtacaccgaggccatcagcgtgggcgagaagctgtaccagttcatcgagcccttcgaggagaagttcgcccaggccgtgtgcttcctgctggtggacctgtacatcctgacctaccaggccgagaaggccctgcacctgctggccgtgctggagaagatgatcagccagggcaacaacaacaagaacggcaagaacgagaccggcaacaacaacaacaaggacggcagcaaccacaaggccgagagcggcgccctgatcgaggccgccaagagcaagatccaccagtacaaggtgagagcctacatccagatgaagagcctgaaggcctgcaagagagagatcaagagcgtgatgaacaccgccggcaacagcgcccccagcctgttcctgaagagcaacttcgagtacctgagaggcaactacagaaaggccgtgaagctgctgaacagcagcaacatcgccgagcaccccggcttcatgaagaccggcgagtgcctgagatgcatgttctggaacaacctgggctgcatccacttcgccatgagcaagcacaacctgggcatcttctacttcaagaaggccctgcaggagaacgacaacgtgtgcgcccagctgagcgccggcagcaccgaccccggcaagaagttcagcggcagacccatgtgcaccctgctgaccaacaagagatacgagctgctgtacaactgcggcatccagctgctgcacatcggcagacccctggccgccttcgagtgcctgatcgaggccgtgcaggtgtaccacgccaaccccagactgtggctgagactggccgagtgctgcatcgccgccaacaagggcaccagcgagcaggagaccaagggcctgcccagcaagaagggcatcgtgcagagcatcgtgggccagggctaccacagaaagatcgtgctggccagccagagcatccagaacaccgtgtacaacgacggccagagcagcgccatccccgtggccaaggccggcaagtggggctag

SEQ ID NO: 13356 - DNA, 1821 bp, Artificial Sequence
  Description of Artificial Sequence: Synthetic coding sequence
atgtgcggcgccggcttcggccacttcgagtggctggccggcggcggcgccggccaggacgtgggcagaagctgcatcctggtgagcatcgccggcaagaacgtgatgctggactgcggcatgcacatgggcttcaacgacgacagaagattccccgacttcagctacatcacccagaacggcagactgaccgacttcctggactgcgtgatcatcagccacttccacctggaccactgcggcgccctgccctacttcagcgagatggtgggctacgacggccccatctacatgacccaccccacccaggccatctgccccatcctgctggaggactacagaaagatcgccgtggacaagaagggcgaggccaacttcttcaccagccagatgatcaaggactgcatgaagaaggtggtggccgtgcacctgcaccagaccgtgcaggtggacgacgagctggagatcaaggcctactacgccggccacgtgctgggcgccgccatgttccagatcaaggtgggcagcgagagcgtggtgtacaccggcgactacaacatgacccccgacagacacctgggcgccgcctggatcgacaagtgcagacccaacctgctgatcaccgagagcacctacgccaccaccatcagagacagcaagagatgcagagagagagacttcctgaagaaggtgcacgagaccgtggagagaggcggcaaggtgctgatccccgtgttcgccctgggcagagcccaggagctgtgcatcctgctggagaccttctgggagagaatgaacctgaaggtgcccatctacttcagcaccggcctgaccgagaaggccaaccactactacaagctgttcatcccctggaccaaccagaagatcagaaagaccttcgtgcagagaaacatgttcgagttcaagcacatcaaggccttcgacagagccttcgccgacaaccccggccccatggtggtgttcgccacccccggcatgctgcacgccggccagagcctgcagatcttcagaaagtgggccggcaacgagaagaacatggtgatcatgcccggctactgcgtgcagggcaccgtgggccacaagatcctgagcggccagagaaagctggagatggagggcagacaggtgctggaggtgaagatgcaggtggagtacatgagcttcagcgcccacgccgacgccaagggcatcatgcagctggtgggccaggccgagcccgagagcgtgctgctggtgcacggcgaggccaagaagatggagttcctgaagcagaagatcgagcaggagctgagagtgaactgctacatgcccgccaacggcgagaccgtgaccctgcccaccagccccagcatccccgtgggcatcagcctgggcctgctgaagagagagatggcccagggcctgctgcccgaggccaagaagcccagactgctgcacggcaccctgatcatgaaggacagcaacttcagactggtgagcagcgagcaggccctgaaggagctgggcctggccgagcaccagctgagattcacctgcagagtgcacctgcacgacaccagaaaggagcaggagaccgccctgagagtgtacagccacctgaagagcgtgctgaaggaccactgcgtgcagcacctgcccgacggcagcgtgaccgtggagagcgtgctgctgcaggccgccgcccccagcgaggaccccggcaccaaggtgctgctggtgagctggacctaccaggacgaggagctgggcagcttcctgaccagcctgctgaagaagggcctgccccaggcccccagctag

SEQ ID NO: 13357 - DNA, 399 bp, Artificial Sequence
  Description of Artificial Sequence: Synthetic coding sequence
atgaagaaggtgagactgaaggagctggagagcagactgcagcaggtggacggcttcgagaagcccaagctgctgctggagcagtaccccaccagaccccacatcgccgcctgcatgctgtacaccatccacaacacctacgacgacatcgagaacaaggtggtggccgacctgggctgcggctgcggcgtgctgagcatcggcaccgccatgctgggcgccggcctgtgcgtgggcttcgacatcgacgaggacgccctggagatcttcaacagaaacgccgaggagttcgagctgcagatcctgacctggttcaacgtgatgtgcgcctactacctgaccgagtgccccagccacagcatccagaactacgagagcagcctgtgggaccagaagtag

SEQ ID NO: 13358 - DNA, 1371 bp, Artificial Sequence
  Description of Artificial Sequence: Synthetic coding sequence
atgatggtgggcgacggcaccaccagcgtgaccctgctggccgccgagttcctgaagcaggtgaagccctacgtggaggagggcctgcacccccagatcatcatcagagccttcagaaccgccacccagctggccgtgaacaagatcaaggagatcgccgtgaccgtgaagaaggccgacaaggtggagcagagaaagctgctggagaagtgcgccatgaccgccctgagcagcaagctgatcagccagcagaaggccttcttcgccaagatggtggtggacgccgtgatgatgctggacgacctgctgcagctgaagatgatcggcatcaagaaggtgcagggcggcgccctggaggacagccagctggtggccggcgtggccttcaagaagaccttcagctacgccggcttcgagatgcagcccaagaagtaccacaaccccaagatcgccctgctgaacgtggagctggagctgaaggccgagaaggacaacgccgagatcagagtgcacaccgtggaggactaccaggccatcgtggacgccgagtggaacatcctgtacgacaagctggagaagatccaccacagcggcgccaaggtggtgctgagcaagctgcccatcggcgacgtggccacccagtacttcgccgacagagacatgttctgcgccggcagagtgcccgaggaggacctgaagagaaccatgatggcctgcggcggcagcatccagaccagcgtgaacgccctgagcgccgacgtgctgggcagatgccaggtgttcgaggagacccagatcggcggcgagagatacaacttcttcaccggctgccccaaggccaagacctgcaccttcatcctgagaggcggcgccgagcagttcatggaggagaccgagagaagcctgcacgacgccatcatgatcgtgagaagagccatcaagaacgacagcgtggtggccggcggcggcgccatcgagatggagctgagcaagtacctgagagactacagcagaaccatccccggcaagcagcagctgctgatcggcgcctacgccaaggccctggagatcatccccagacagctgtgcgacaacgccggcttcgacgccaccaacatcctgaacaagctgagagccagacacgcccagggcggcacctggtacggcgtggacatcaacaacgaggacatcgccgacaacttcgaggccttcgtgtgggagcccgccatggtgagaatcaacgccctgaccgccgccagcgaggccgcctgcctgatcgtgagcgtggacgagaccatcaagaaccccagaagcaccgtggacgcccccaccgccgccggcagaggcagaggcagaggcagaccccactag

SEQ ID NO: 13359 - DNA, 2520 bp, Artificial Sequence
  Description of Artificial Sequence: Synthetic coding sequence
atggacggcaaggccgacgtgaagagcctgatggccaagtacaacaccggcggcaaccccaccgaggacgtgagcgtgaacagcagacccttcagagtgaccggccccaacagcagcagcggcatccaggccagaaagaacctgttcaacaaccagggcaacgccagcccccccgccggccccagcaacgtgcccaagttcggcagccccaagccccccgtggccgtgaagcccagcagcgaggagaagcccgacaaggagcccaagccccccttcctgaagcccaccggcgccggccagagattcggcacccccgccagcctgaccaccagagaccccgaggccaaggtgggcttcctgaagcccgtgggccccaagcccatcaacctgcccaaggaggacagcaagcccaccttcccctggccccccggcaacaagcccagcctgcacagcgtgaaccaggaccacgacctgaagcccctgggccccaagagcggccccaccccccccaccagcgagaacgagcagaagcaggccttccccaagctgaccggcgtgaagggcaagttcatgagcgccagccaggacctggagcccaagcccctgttccccaagcccgccttcggccagaagccccccctgagcaccgagaacagccacgaggacgagagccccatgaagaacgtgagcagcagcaagggcagccccgcccccctgggcgtgagaagcaagagcggccccctgaagcccgccagagaggacagcgagaacaaggaccacgccggcgagatcagcagcctgcccttccccggcgtggtgctgaagcccgccgccagcagaggcggccccggcctgagcaagaacggcgaggagaagaaggaggacagaaagatcgacgccgccaagaacaccttccagagcaagatcaaccaggaggagctggccagcggcaccccccccgccagattccccaaggcccccagcaagctgaccgtgggcggcccctggggccagagccaggagaaggagaagggcgacaagaacagcgccacccccaagcagaagcccctgccccccctgttcaccctgggcccccccccccccaagcccaacagaccccccaacgtggacctgaccaagttccacaagaccagcagcggcaacagcaccagcaagggccagaccagctacagcaccaccagcctgcccccccccccccccagccaccccgccagccagccccccctgcccgccagccaccccagccagccccccgtgcccagcctgccccccagaaacatcaagccccccttcgacctgaagagccccgtgaacgaggacaaccaggacggcgtgacccacagcgacggcgccggcaacctggacgaggagcaggacagcgagggcgagacctacgaggacatcgaggccagcaaggagagagagaagaagagagagaaggaggagaagaagagactggagctggagaagaaggagcagaaggagaaggagaagaaggagcaggagatcaagaagaagttcaagctgaccggccccatccaggtgatccacctggccaaggcctgctgcgacgtgaagggcggcaagaacgagctgagcttcaagcagggcgagcagatcgagatcatcagaatcaccgacaaccccgagggcaagtggctgggcagaaccgccagaggcagctacggctacatcaagaccaccgccgtggagatcgactacgacagcctgaagctgaagaaggacagcctgggcgcccccagcagacccatcgaggacgaccaggaggtgtacgacgacgtggccgagcaggacgacatcagcagccacagccagagcggcagcggcggcatcttcccccccccccccgacgacgacatctacgacggcatcgaggaggaggacgccgacgacggcagcaccctgcaggtgcaggagaagagcaacacctggagctggggcatcctgaagatgctgaagggcaaggacgacagaaagaagagcatcagagagaagcccaaggtgagcgacagcgacaacaacgagggcagcagcttccccgccccccccaagcagctggacatgggcgacgaggtgtacgacgacgtggacaccagcgacttccccgtgagcagcgccgagatgagccagggcaccaacgtgggcaaggccaagaccgaggagaaggacctgaagaagctgaagaagcaggagaaggaggagaaggacttcagaaagaagttcaagtacgacggcgagatcagagtgctgtacagcaccaaggtgaccaccagcatcaccagcaagaagtggggcaccagagacctgcaggtgaagcccggcgagagcctggaggtgatccagaccaccgacgacaccaaggtgctgtgcagaaacgaggagggcaagtacggctacgtgctgagaagctacctggccgacaacgacggcgagatctacgacgacatcgccgacggctgcatctacgacaacgactag

SEQ ID NO: 13360 - DNA, 1017 bp, Artificial Sequence
  Description of Artificial Sequence: Synthetic coding sequence
atgggccacagatacatcgaggtgttcaagagccacagaaccgagatggactgggtgctgaagcacagcggccccaacagcgccgacagcgccaacgacggcttcgtgagactgagaggcctgcccttcggctgcaccaaggaggagatcgtgcagttcttcagcggcctggagatcgtgcccaacggcatcaccctgcccgtggaccccgagggcaagatcaccggcgaggccttcgtgcagttcgccagccaggagctggccgagaaggccctgggcaagcacaaggagagaatcggccacagatacatcgaggtgttcaagagcagccaggaggaggtgagaagctacagcgacccccccctgaagttcatgagcgtgcagagacccggcccctacgacagacccggcaccgccagaagatacatcggcatcgtgaagcaggccggcctggagagaatgagacccggcgcctacagcaccggctacggcggctacgaggagtacagcggcctgagcgacggctacggcttcaccaccgacctgttcggcagagacctgagctactgcctgagcggcatgtacgaccacagatacggcgacagcgagttcaccgtgcagagcaccaccggccactgcgtgcacatgagaggcctgccctacaaggccaccgagaacgacatctacaacttcttcagccccctgaaccccgtgagagtgcacatcgagatcggccccgacggcagagtgaccggcgaggccgacgtggagttcgccacccacgaggaggccgtggccgccatgagcaaggacagagccaacatgcagcacagatacatcgagctgttcctgaacagcaccaccggcgccagcaacggcgcctacagcagccaggtgatgcagggcatgggcgtgagcgccgcccaggccacctacagcggcctggagagccagagcgtgagcggctgctacggcgccggctacagcggccagaacagcatgggcggctacgactag

SEQ ID NO: 13361 - DNA, 1536 bp, Artificial Sequence
  Description of Artificial Sequence: Synthetic coding sequence
atggccagcgtggtggagtacaagggcctgagagccggctaccactgcggctactgcgacagcaaggagggcaaggccagctgcggcatgtgggcccacagcatgaccgtgcaggactaccaggacctgatcgacagaggctggagaagaagcggcaagtacgtgtacaagcccgtgatgaaccagacctgctgcccccagtacaccatcagatgcagacccctgcagttccagcccagcaagagccacaagaaggtgctgaagaagatgctgaagttcctggccaagggcgaggtgcccaagggcagctgcgaggacgagcccatggacagcaccatggacgacgccgtggccggcgacttcgccctgatcaacaagctggacatccagtgcgacctgaagaccctgagcgacgacatcaaggagagcctggagagcgagggcaagaacagcaagaaggaggagccccaggagctgctgcagagccaggacttcgtgggcgagaagctgggcagcggcgagcccagccacagcgtgaaggtgcacaccgtgcccaagcccggcaagggcgccgacctgagcaagcccccctgcagaaaggccaaggagatcagaaaggagagaaagagactgaagctgatgcagcagaaccccgccggcgagctggagggcttccaggcccagggccacccccccagcctgttcccccccaaggccaagagcaaccagcccaagagcctggaggacctgatcttcgagagcctgcccgagaacgccagccacaagctggaggtgagactggtgcccgtgagcttcgaggaccccgagttcaagagcagcttcagccagagcttcagcctgtacgtgaagtaccaggtggccatccaccaggacccccccgacgagtgcggcaagaccgagttcaccagattcctgtgcagcagccccctggaggccgagaccccccccaacggccccgactgcggctacggcagcttccaccagcagtactggctggacggcaagatcatcgccgtgggcgtgatcgacatcctgcccaactgcgtgagcagcgtgtacctgtactacgaccccgactacagcttcctgagcctgggcgtgtacagcgccctgagagagatcgccttcaccagacagctgcacgagaagaccagccagctgagctactactacatgggcttctacatccacagctgccccaagatgaagtacaagggccagtacagacccagcgacctgctgtgccccgagacctacgtgtgggtgcccatcgagcagtgcctgcccagcctggagaacagcaagtactgcagattcaaccaggaccccgaggccgtggacgaggacagaagcaccgagcccgacagactgcaggtgttccacaagagagccatcatgccctacggcgtgtacaagaagcagcagaaggaccccagcgaggaggccgccgtgctgcagtacgccagcctggtgggccagaagtgcagcgagagaatgctgctgttcagaaactag

SEQ ID NO: 13362 - DNA, 3963 bp, Artificial Sequence
  Description of Artificial Sequence: Synthetic coding sequence
atgcaggacgacagcatcgaggccagcaccagcatcagccagctgctgagagagagctacctggccgagaccagacacagaggcaacaacgagagaagcagagccgagcccagcagcaacccctgccacttcggcagccccagcggcgccgccgagggcggcggcggccaggacgacctgcccgacctgagcgccttcctgagccaggaggagctggacgagagcgtgaacctggccagactggccatcaactacgaccccctggagaaggccgacgagacccaggccagaaagagactgagccccgaccagatgaagcacagccccaacctgagcttcgagcccaacttctgccaggacaaccccagaagccccaccagcagcaaggagagcccccaggaggccaagagaccccagtactgcagcgagacccagagcaagaaggtgttcctgaacaaggccgccgacttcatcgaggagctgagcagcctgttcaagagccacagcagcaagagaatcagacccagagcctgcaagaaccacaagagcaagctggagagccagaacaaggtgatgcaggagaacagcagcagcttcagcgacctgagcgagagaagagagagaagcagcgtgcccatccccatccccgccgacaccagagacaacgaggtgaaccacgccctggagcagcaggaggccaagagaagagaggccgagcaggccgccagcgaggccgccggcggcgacaccacccccggcagcagccccagcagcctgtactacgaggagcccctgggccagccccccagattcacccagaagctgagaagcagagaggtgcccgagggcaccagagtgcagctggactgcatcgtggtgggcatcccccccccccaggtgagatggtactgcgagggcaaggagctggagaacagccccgacatccacatcgtgcaggccggcaacctgcacagcctgaccatcgccgaggccttcgaggaggacaccggcagatacagctgcttcgccagcaacatctacggcaccgacagcaccagcgccgagatctacatcgagggcgtgagcagcagcgacagcgagggcgaccccaacaaggaggagatgaacagaatccagaagcccaacgaggtgagcagcccccccaccaccagcgccgtgatcccccccgccgtgccccaggcccagcacctggtggcccagcccagagtggccaccatccagcagtgccagagccccaccaactacctgcagggcctggacggcaagcccatcatcgccgcccccgtgttcaccaagatgctgcagaacctgagcgccagcgagggccagctggtggtgttcgagtgcagagtgaagggcgcccccagccccaaggtggagtggtacagagagggcaccctgatcgaggacagccccgacttcagaatcctgcagaagagacccgtgtgcatggagcacatcgaggagatctgcaccctggtgatcgccgaggtgttcgccgaggacagcggctgcttcacctgcaccgccagcaacaagtacggcaccgtgagcagcatcgcccagctgcacgtgagaggcaacgaggacctgagcaacaacggcagcctgcacagcgccaacagcaccaccaacctggccgccatcgagccccagcccagccccccccacagcgagccccccagcgtggagcagccccccaagcccaagctggagggcgtgctggtgaaccacaacgagcccagaagcagcagcagaatcggcctgagagtgcacttcaacctgcccgaggacgacaagggcagcgaggccagcagcgaggccggcgtggtgaccaccagacagaccagacccgacagcttccaggagagattcaacggccaggccaccaagacccccgagcccagcagccccgtgaaggagcccccccccgtgctggccaagcccaagctggacagcacccagctgcagcagctgcacaaccaggtgctgctggagcagcaccagctgcagaaccccccccccagcagccccaaggagttccccttcagcatgaccgtgctgaacagcaacgccccccccgccgtgaccaccagcagcaagcaggtgaaggcccccagcagccagaccttcagcctggccagacccaagtacttcttccccagcaccaacaccaccgccgccaccgtggcccccagcagcagccccgtgttcaccctgagcagcaccccccagaccatccagagaaccgtgagcaaggagagcctgctggtgagccaccccagcgtgcagaccaagagccccggcggcctgagcatccagaacgagcccctgccccccggccccaccgagcccacccccccccccttcaccttcagcatccccagcggcaaccagttccagcccagatgcgtgagccccatccccgtgagccccaccagcagaatccagaaccccgtggccttcctgagcagcgtgctgcccagcctgcccgccatcccccccaccaacgccatgggcctgcccagaagcgcccccagcatgcccagccagggcctggccaagaagaacaccaagagcccccagcccgtgaacgacgacaacatcagagagaccaagaacgccgtgatcagagacctgggcaagaagatcaccttcagcgacgtgagacccaaccagcaggagtacaagatcagcagcttcgagcagagactgatgaacgagatcgagttcagactggagagaacccccgtggacgagagcgacgacgagatccagcacgacgagatccccaccggcaagtgcatcgcccccatcttcgacaagagactgaagcacttcagagtgaccgagggcagccccgtgaccttcacctgcaagatcgtgggcatccccgtgcccaaggtgtactggttcaaggacggcaagcagatcagcaagagaaacgagcactgcaagatgagaagagagggcgacggcacctgcagcctgcacatcgagagcaccaccagcgacgacgacggcaactacaccatcatggccgccaacccccagggcagaatcagctgcagcggccacctgatggtgcagagcctgcccatcagaagcagactgaccagcgccggccagagccacagaggcagaagcagagtgcaggagagagacaaggagcccctgcaggagagattcttcagaccccacttcctgcaggcccccggcgacatggtggcccacgagggcagactgtgcagactggactgcaaggtgagcggcctgcccccccccgagctgacctggctgctgaacggccagcccgtgctgcccgacgccagccacaagatgctggtgagagagaccggcgtgcacagcctgctgatcgaccccctgacccagagagacgccggcacctacaagtgcatcgccaccaacaagaccggccagaacagcttcagcctggagctgagcgtggtggccaaggaggtgaagaaggcccccgtgatcctggagaagctgcagaactgcggcgtgcccgagggccaccccgtgagactggagtgcagagtgatcggcatgcccccccccgtgttctactggaagaaggacaacgagaccatcccctgcaccagagagagaatcagcatgcaccaggacaccaccggctacgcctgcctgctgatccagcccgccaagaagagcgacgccggctggtacaccctgagcgccaagaacgaggccggcatcgtgagctgcaccgccagactggacatctacgcccagtggcaccaccagatccccccccccatgagcgtgagacccagcggcagcagatacggcagcctgaccagcaagggcctggacatcttcagcgccttcagcagcatggagagcaccatggtgtacagctgcagcagcagaagcgtggtggagagcgacgagctgtag

SEQ ID NO: 13363 - DNA, 2292 bp, Artificial Sequence
  Description of Artificial Sequence: Synthetic coding sequence
atgcaggacctgggcgacaagctgagaatgatcgtgatgggccacagaagagtgcacatcagcagacagctggaggtggagcccgaggagcccgaggccgagaacaagcacaagcccagaagaaagagcaagagaggcaagaaggaggccgaggacgagctgagcgccagacaccccgccgagctggccatggagcccacccccgagctgcccgccgaggtgctgatggtggaggtggagaacgtggtgcacgaggacttccaggtgaccgaggaggtgaaggccctgaccgccgagatcgtgaagaccatcagagacatcatcgccctgaaccccctgtacagagagagcgtgctgcagatgatgcaggccggccagagagtggtggacaaccccatctacctgagcgacatgggcgccgccctgaccggcgccgagagccacgagctgcaggacgtgctggaggagaccaacatccccaagagactgtacaaggccctgagcctgctgaagaaggagttcgagctgagcaagctgcagcagagactgggcagagaggtggaggagaagatcaagcagacccacagaaagtacctgctgcaggagcagctgaagatcatcaagaaggagctgggcctggagaaggacgacaaggacgccatcgaggagaagttcagagagagactgaaggagctggtggtgcccaagcacgtgatggacgtggtggacgaggagctgagcaagctgggcctgctggacaaccacagcagcgagttcaacgtgaccagaaactacctggactggctgaccagcatcccctggggcaagtacagcaacgagaacctggacctggccagagcccaggccgtgctggaggaggaccactacggcatggaggacgtgaagaagagaatcctggagttcatcgccgtgagccagctgagaggcagcacccagggcaagatcctgtgcttctacggcccccccggcgtgggcaagaccagcatcgccagaagcatcgccagagccctgaacagagagtacttcagattcagcgtgggcggcatgaccgacgtggccgagatcaagggccacagaagaacctacgtgggcgccatgcccggcaagatcatccagtgcctgaagaagaccaagaccgagaaccccctgatcctgatcgacgaggtggacaagatcggcagaggctaccagggcgaccccagcagcgccctgctggagctgctggaccccgagcagaacgccaacttcctggaccactacctggacgtgcccgtggacctgagcaaggtgctgttcatctgcaccgccaacgtgaccgacaccatccccgagcccctgagagacagaatggagatgatcaacgtgagcggctacgtggcccaggagaagctggccatcgccgagagatacctggtgccccaggccagagccctgtgcggcctggacgagagcaaggccaagctgagcagcgacgtgctgaccctgctgatcaagcagtactgcagagagagcggcgtgagaaacctgcagaagcaggtggagaaggtgctgagaaagagcgcctacaagatcgtgagcggcgaggccgagagcgtggaggtgacccccgagaacctgcaggacttcgtgggcaagcccgtgttcaccgtggagagaatgtacgacgtgaccccccccggcgtggtgatgggcctggcctggaccgccatgggcggcagcaccctgttcgtggagaccagcctgagaagaccccaggacaaggacgccaagggcgacaaggacggcagcctggaggtgaccggccagctgggcgaggtgatgaaggagagcgccagaatcgcctacaccttcgccagagccttcctgatgcagcacgcccccgccaacgactacctggtgaccagccacatccacctgcacgtgcccgagggcgccacccccaaggacggccccagcgccggctgcaccatcgtgaccgccctgctgagcctggccatgggcagacccgtgagacagaacctggccatgaccggcgaggtgagcctgaccggcaagatcctgcccgtgggcggcatcaaggagaagaccatcgccgccaagagagccggcgtgacctgcatcgtgctgcccgccgagaacaagaaggacttctacgacctggccgccttcatcaccgagggcctggaggtgcacttcgtggagcactacagagagatcttcgacatcgccttccccgacgagcaggccgaggccctggccgtggagagatag

SEQ ID NO: 13364 - DNA, 558 bp, Artificial Sequence
  Description of Artificial Sequence: Synthetic coding sequence
atgaacaacaaccagatcgtggccaaggacctgcaggacgagaagatcctgtaccccgagttcaacaagctgaaggagagaaacagagagctgaagaccctgctgagcatcggcggctggaacttcggcaccagcagattcaccaccatgctgagcaccttcgccaacagagagaagttcatcgccagcgtgatcagcctgctgagaacccacgacttcgacggcctggacctgttcttcctgtaccccggcctgagaggcagccccatgcacgacagatggaccttcctgttcctgatcgaggagctgctgttcgccttcagaaaggaggccctgctgaccatgagacccagactgctgctgagcgccgccgtgagcggcgtgccccacatcgtgcagaccagctacgacgtgagattcctgggcagattcgtgcccctgagcggcgagagaagaagcaccggcctgatcaccagcatgagcagaatgcccaccagaggcaagagcggcctggccatgaccatgcccagcgccagcgtgaccagacacggcctgtag

SEQ ID NO: 13365 - DNA, 1269 bp, Artificial Sequence
  Description of Artificial Sequence: Synthetic coding sequence
atgagcggcggcaccccctacatcggcagcaagatcagcctgatcagcaaggccgagatcagatacgagggcatcctgtacaccatcgacaccgagaacagcaccgtggccctggccaaggtgagaagcttcggcaccgaggacagacccaccgacagacccatcccccccagagacgaggtgttcgagtacatcatcttcagaggcagcgacatcaaggacctgaccgtgtgcgagccccccaagccccagtgcagcctgccccaggaccccgccatcgtgcagagcagcctgggcagcagcaccagcagcttccagagcatgggcagctacggccccttcggcagaatgcccacctacagccagttcagccccagcagcctggtgggccagcagttcggcgccgtgggcgtgggcagaagcagcccccagctggaccccctgagaaagagccccaccatggagcaggccgtgcagaccgccagcgcccacctgcccgcccccgccgccgtgggcagaagaagccccgtgagcaccagacccctgcccagcgccagccagaaggccggcgagaaccaggagcacagaagagccgaggtgcacaaggtgagcagacccgagaacgagcagctgagaaacgacaacaagagacaggtggcccccggcgcccccagcgcccccagaagaggcagaggcggccacagaggcggcagaggcagattcggcatcagaagagacggccccatgaagttcgagaaggacttcgacttcgagagcgccaacgcccagttcaacaaggaggagatcgacagagagttccacaacaagctgaagctgaaggaggacaagctggagaagcaggagaagcccgtgaacggcgaggacaagggcgacagcggcgtggacacccagaacagcgagggcaacgccgacgaggaggaccccctgggccccaactgctactacgacaagaccaagagcttcttcgacaacatcagctgcgacgacaacagagagagaagacccacctgggccgaggagagaagactgaacgccgagaccttcggcatccccctgagacccaacagaggcagaggcggctacagaggcagaggcggcctgggcttcagaggcggcagaggcagaggcggcggcagaggcggcaccttcaccgcccccagaggcttcagaggcggcttcagaggcggcagaggcggcagagagttcgccgacttcgagtacagaaagaccaccgccttcggcccctag

SEQ ID NO: 13366 - DNA, 1266 bp, Artificial Sequence; identical to SEQ ID NO: 10383
  Description of Artificial Sequence: Synthetic coding sequence

SEQ ID NO: 13367 - DNA, 756 bp, Artificial Sequence
  Description of Artificial Sequence: Synthetic coding sequence
atggacagcgagctgatgcacagcatcgtgggcagctaccacaagccccccgagagagtgttcgtgcccagcttcacccagaacgagcccagccagaactgccaccccgccaacctggaggtgaccagccccaagatcctgcacagccccaacagccaggccctgatcctggccctgaagaccctgcaggagaagatccacagactggagctggagagaacccaggccgaggacaacctgaacatcctgagcagagaggccgcccagtacaagaaggccctggagaacgagaccaacgagagaaacctggcccaccaggagctgatcaagcagaagaaggacatcagcatccagctgagcagcgcccagagcagatgcaccctgctggagaagcagctggagtacaccaagagaatggtgctgaacgtggagagagagaagaacatgatcctggagcagcaggcccagctgcagagagagaaggagcaggaccagatgaagctgtacgccaagctggagaagctggacgtgctggagaaggagtgcttcagactgaccaccacccagaagaccgccgaggacaagatcaagcacctggaggagaagctgaaggaggaggagcaccagagaaagctgttccaggacaaggccagcgagctgcagaccggcctggagatcagcaagatcatcatgagcagcgtgagcaacctgaagcacagcaaggagaagaagaagagcagcaaggtgtgcatctag

SEQ ID NO: 13368 - DNA, 1980 bp, Artificial Sequence
  Description of Artificial Sequence: Synthetic coding sequence
atggacagccagggcagagtgtgggcccaggagatgctgctgagagtgagccccgaccacgtgaccctgctggaccccgccagcaaggaggagctggagagctaccccctgggcgccatcgtgagatgcgacgccgtgatgccccccggcagaagcagaagcctgctgctgctggtgtgccaggagcccgagagagcccagcccgacgtgcacttcttccagggcctgagactgggcgccgagctgatcagagaggacatccagggcgccctgcacaactacagaagcggcagaggcgagagaagagccgccgccctgagagccacccaggaggagctgcagagagacagaagccccgccgccgagaccccccccctgcagagaagacccagcgtgagagccgtgatcagcaccgtggagagaggcgccggcagaggcagaccccaggccaagcccatccccgaggccgaggaggcccagagacccgagcccgtgggcaccagcagcaacgccgacagcgccagccccgacctgggccccagaggccccgacctggccgtgctgcaggccgagagagaggtggacatcctgaaccacgtgttcgacgacgtggagagcttcgtgagcagactgcagaagagcgccgaggccgccagagtgctggagcacagagagagaggcagaagaagcagaagaagagccgccggcgagggcctgctgaccctgagagccaagccccccagcgaggccgagtacaccgacgtgctgcagaagatcaagtacgccttcagcctgctggccagactgagaggcaacatcgccgaccccagcagccccgagctgctgcacttcctgttcggccccctgcagatgatcgtgaacaccagcggcggccccgagttcgccagcagcgtgagaagaccccacctgaccagcgacgccgtggccctgctgagagacaacgtgacccccagagagaacgagctgtggaccagcctgggcgacagctggaccagacccggcctggagctgagccccgaggagggccccccctacagacccgagttcttcagcggctgggagccccccgtgaccgacccccagagcagagcctgggaggaccccgtggagaagcagctgcagcacgagagaagaagaagacagcagagcgccccccaggtggccgtgaacggccacagagacctggagcccgagagcgagccccagctggagagcgagaccgccggcaagtgggtgctgtgcaactacgacttccaggccagaaacagcagcgagctgagcgtgaagcagagagacgtgctggaggtgctggacgacagcagaaagtggtggaaggtgagagaccccgccggccaggagggctacgtgccctacaacatcctgaccccctaccccggccccagactgcaccacagccagagccccgccagaagcctgaacagcacccccccccccccccccgcccccgcccccgcccccccccccgccctggccagacccagatgggacagacccagatgggacagctgcgacagcctgaacggcctggaccccagcgagaaggagaagttcagccagatgctgatcgtgaacgaggagctgcaggccagactggcccagggcagaagcggccccagcagagccgtgcccggccccagagcccccgagccccagctgagccccggcagcgacgccagcgaggtgagagcctggctgcaggccaagggcttcagcagcggcaccgtggacgccctgggcgtgctgaccggcgcccagctgttcagcctgcagaaggaggagctgagagccgtgagccccgaggagggcgccagagtgtacagccaggtgaccgtgcagagaagcctgctggaggacaaggagaaggtgagcgagctggaggccgtgatggagaagcagaagaagaaggtggagggcgaggtggagatggaggtgatctag

SEQ ID NO: 13369 - DNA, 3702 bp, Artificial Sequence
  Description of Artificial Sequence: Synthetic coding sequence
atgaacaccaagaagagaggcagccccgccagaacccacagcatgatgagcctgagcgtgagaccccagagaagactgctgagcgccagagtgaacagaagccagagcttcgccggcgtgctgggcagccacgagagaggccccagaagcttccccgtgttcagcccccccggcccccccagaaagccccccgccctgagcagagtgagcagaatgttcagcgtggcccaccccgccgccaaggtgccccagcccgagagactggacctggtgtacaccgccctgaagagaggcctgaccgcctacctggaggtgcaccagcaggagcaggagaagctgcagggccagatcagagagagcaagagaaacagcagactgggcttcctgtacgacctggacaagcaggtgaagagcatcgagagattcctgagaagactggagttccacgccagcaagatcgacgagctgtacgaggcctactgcgtgcagagaagactgagagacggcgcctacaacatggtgagagcctacaccaccggcagccccggcagcagagaggccagagacagcctggccgaggccaccagaggccacagagagtacaccgagagcatgtgcctgctggagagcgagctggaggcccagctgggcgagttccacctgagaatgaagggcctggccggcttcgccagactgtgcgtgggcgaccagtacgagatctgcatgaagtacggcagacagagatggaagctgagaggcagaatcgagggcagcggcaagcaggtgtgggacagcgaggagaccatcttcctgcccctgctgaccgagttcctgagcatcaaggtgaccgagctgaagggcctggccaaccacgtggtggtgggcagcgtgagctgcgagaccaaggacctgttcgccgccctgccccaggtggtggccgtggacatcaacgacctgggcaccatcaagctgagcctggaggtgacctggagccccttcgacaaggacgaccagcccagcgccgccagcagcgtgaacaaggccagcaccgtgaccaagagattcagcacctacagccagagcccccccgacacccccagcctgagagagcaggccttctacaacatgctgagaagacaggaggagctggagaacggcaccgcctggagcctgagcagcgagagcagcgacgacagcagcagcccccagctgagcggcaccgccagacacagccccgcccccagacccctggtgcagcagcccgagcccctgcccatccaggtggccttcagaagacccgagacccccagcagcggccccctggacgaggagggcgccgtggcccccgtgctggccaacggccacgccccctacagcagaaccctgagccacatcagcgaggccagcgtggacgccgccctggccgaggccagcgtggaggccgtgggccccgagagcctggcctggggccccagcccccccacccaccccgcccccacccacggcgagcaccccagccccgtgccccccgccctggaccccggccacagcgccaccagcagcaccctgggcaccaccggcagcgtgcccaccagcaccgaccccgcccccagcgcccacctggacagcgtgcacaagagcaccgacagcggccccagcgagctgcccggccccacccacaccaccaccggcagcacctacagcgccatcaccaccacccacagcgcccccagccccctgacccacaccaccaccggcagcacccacaagcccatcatcagcaccctgaccaccaccggccccaccctgaacatcatcggccccgtgcagaccaccaccagccccacccacaccatgcccagccccacccacaccaccgccagccccacccacaccagcaccagccccacccacacccccaccagccccacccacaagaccagcatgagcccccccaccaccaccagccccacccccagcggcatgggcctggtgcagaccgccaccagccccacccaccccaccaccagccccacccaccccaccaccagccccatcctgatcaacgtgagccccagcaccagcctggagctggccaccctgagcagccccagcaagcacagcgaccccaccctgcccggcaccgacagcctgccctgcagcccccccgtgagcaacagctacacccaggccgaccccatggcccccagaaccccccaccccagccccgcccacagcagcagaaagcccctgaccagccccgcccccgaccccagcgagagcaccgtgcagagcctgagccccacccccagcccccccacccccgccccccagcacagcgacctgtgcctggccatggccgtgcagacccccgtgcccaccgccgccggcggcagcggcgacagaagcctggaggaggccctgggcgccctgatggccgccctggacgactacagaggccagttccccgagctgcagggcctggagcaggaggtgaccagactggagagcctgctgatgcagagacagggcctgaccagaagcagagccagcagcctgagcatcaccgtggagcacgccctggagagcttcagcttcctgaacgaggacgaggacgaggacaacgacgtgcccggcgacagaccccccagcagccccgaggccggcgccgaggacagcatcgacagccccagcgccagacccctgagcaccggctgccccgccctggacgccgccctggtgagacacctgtaccactgcagcagactgctgctgaagctgggcaccttcggccccctgagatgccaggaggcctgggccctggagagactgctgagagaggccagagtgctggaggccgtgtgcgagttcagcagaagatgggagatccccgccagcagcgcccaggaggtggtgcagttcagcgccagcagacccggcttcctgaccttctgggaccagtgcaccgagagactgagctgcttcctgtgccccgtggagagagtgctgctgaccttctgcaaccagtacggcgccagactgagcctgagacagcccggcctggccgaggccgtgtgcgtgaagttcctggaggacgccctgggccagaagctgcccagaagaccccagcccggccccggcgagcagctgaccgtgttccagttctggagcttcgtggagaccctggacagccccaccatggaggcctacgtgaccgagaccgccgaggaggtgctgctggtgagaaacctgaacagcgacgaccaggccgtggtgctgaaggccctgagactggcccccgagggcagactgagaagagacggcctgagagccctgagcagcctgctggtgcacggcaacaacaaggtgatggccgccgtgagcacccagctgagaagcctgagcctgggccccaccttcagagagagagccctgctgtgcttcctggaccagctggaggacgaggacgtgcagaccagagtggccggctgcctggccctgggctgcatcaaggcccccgagggcatcgagcccctggtgtacctgtgccagaccgacaccgaggccgtgagagaggccgccagacagagcctgcagcagtgcggcgaggagggccagagcgcccacagaagactggaggagagcctggacgccctgcccagaatcttcggccccggcagcatggccagcaccgccttctag

SEQ ID NO: 13370 - DNA, 1428 bp, Artificial Sequence
  Description of Artificial Sequence: Synthetic coding sequence
atggaccagatggtgcagcaccccgccgccaagatgatcgtgatggccagccacatgcaggagcaggaggtgggcgacggcaccaacttcgtgctggtgttcgccggcgccctgctggagctggccgaggagctgctgagaatcggcctgagcgtgagcgaggtgatcgagggctacgagatcgcctgcagaaaggcccacgagatcctgcccaacctggtgtgctgcagcgccaagaacctgagagacatcgacgaggtgagcagcctgctgagaaccagcatcatgagcaagcagtacggcaacgaggtgttcctggccaagctgatcgcccaggcctgcgtgagcatcttccccgacagcggccacttcaacgtggacaacatcagagtgtgcaagatcctgggcagcggcatcagcagcagcagcgtgctgcacggcatggtgttcaagaaggagaccgagggcgacgtgaccagcgtgaaggacgccaagatcgccgtgtacagctgccccttcgacggcatgatcaccgagaccaagggcaccgtgctgatcaagaccgccgaggagctgatgaacttcagcaagggcgaggagaacctgatggacgcccaggtgaaggccatcgccgacaccggcgccaacgtggtggtgaccggcggcaaggtggccgacatggccctgcactacgccaacaagtacaacatcatgctggtgagactgaacagcaagtgggacctgagaagactgtgcaagaccgtgggcgccaccgccctgcccagactgaccccccccgtgctggaggagatgggccactgcgacagcgtgtacctgagcgaggtgggcgacacccaggtggtggtgttcaagcacgagaaggaggacggcgccatcagcaccatcgtgctgagaggcagcaccgacaacctgatggacgacatcgagagagccgtggacgacggcgtgaacaccttcaaggtgctgaccagagacaagagactggtgcccggcggcggcgccaccgagatcgagctggccaagcagatcaccagctacggcgagacctgccccggcctggagcagtacgccatcaagaagttcgccgaggccttcgaggccatccccagagccctggccgagaacagcggcgtgaaggccaacgaggtgatcagcaagctgtacgccgtgcaccaggagggcaacaagaacgtgggcctggacatcgaggccgaggtgcccgccgtgaaggacatgctggaggccggcatcctggacacctacctgggcaagtactgggccatcaagctggccaccaacgccgccgtgaccgtgctgagagtggaccagatcatcatggccaagcccgccggcggccccaagccccccagcggcaagaaggactgggacgacgaccagaacgactag

SEQ ID NO: 13371 - DNA, 1626 bp, Artificial Sequence
  Description of Artificial Sequence: Synthetic coding sequence
atgagagccctgctgcacaagcccgagatgatcaagcagatcctgcccgagcacagcgtgctgcagaacatcaacttcgtggaggccttccaggacgagctgctggtgaccgaggtgtacgacctgccccagagacccaacgacgtgcagctgttctacggcagcatgtgcaagatcatcctgagcgtgatcggcgagttcagagactgcatcagcagcagagagttcctgcagcccagcagcaaggccagcctggagagcaccagcgacctgggcgccagcggcaagcacggcggcaacgtgagcctggacgtgctgcccgtgaagggcccccagggcagccccctgctgagcagagccgccagaccccccctggaccagctggccagcgaggagccctggaccgtgctgcccgagcacctgatcctggtggcccccagcccctgcgacatggccaagaccggcagattccagatcgtgaacaacagcgtgagactgctgagattcgagctgtgctggcccgcccactgcctgaccgtgaccccccagcacggctgcgtggcccccgagagcaagctgcagatcctggtgagccccaacagcagcctgagcaccaagcagagcatgttcccctggagcggcctgatctacatccactgcgacgacggccagaagaagatcgtgaaggtgcagatcagagaggacctgacccaggtggagctgctgaccagactgaccagcaagcccttcggcatcctgagccccgtgagcgagcccagcgtgagccacctggtgaagcccatgaccaagccccccagcaccaaggtggagatcagaaacaagagcatcaccttccccaccaccgagcccggcgagaccagcgagagctgcctggagctggagaaccacggcaccaccgacgtgaagtggcacctgagcagcctggcccccccctacgtgaagggcgtggacgagagcggcgacgtgttcagagccacctacgccgccttcagatgcagccccatcagcggcctgctggagagccacggcatccagaaggtgagcatcaccttcctgcccagaggcagaggcgactacgcccagttctgggacgtggagtgccaccccctgaaggagccccacatgaagcacaccctgagattccagctgagcggccagagcatcgaggccgagaacgagcccgagaacgcctgcctgagcaccgacagcctgatcaagatcgaccacctggtgaagcccagaagacaggccgtgagcgaggccagcgccagaatccccgagcagctggacgtgaccgccagaggcgtgtacgcccccgaggacgtgtacagattcagacccaccagcgtgggcgagagcagaaccctgaaggtgaacctgagaaacaacagcttcatcacccacagcctgaagttcctgagccccagagagcccttctacgtgaagcacagcaagtacagcctgagagcccagcactacatcaacatgcccgtgcagttcaagcccaagagcgccggcaagttcgaggccctgctggtgatccagaccgacgagggcaagagcatcgccatcagactgatcggcgaggccctgggcaagaactag

SEQ ID NO: 13372 - DNA, 1737 bp, Artificial Sequence
  Description of Artificial Sequence: Synthetic coding sequence
atgagcagcaagggcagcagcaccgacggcagaaccgacctggccaacggcagcctgagcagcagccccgaggagatgagcggcgccgaggagggcagagagaccagcagcggcatcgaggtggaggccagcgacctgagcctgagcctgaccggcgacgacggcggccccaacagaaccagcatggaggacaccggccactacagcatcaacgacgagaacagagtgcacgacagaagcgaggaggaggaggaggaggaggaggaggaggaggaggagcagcccagaagaagagtgcagagaaagagagccaacagagaccaggacagcagcgacgacgagagagccctggaggactgggtgagcagcgagaccagcgccctgcccagacccagatggcaggccctgcccgccctgagagagagagagctgggcagcagcgccagattcgtgtacgaggcctgcggcgccagagtgttcgtgcagagattcagactgcagcacggcctggagggccacaccggctgcgtgaacaccctgcacttcaaccagagaggcacctggctggccagcggcagcgacgacctgaaggtggtggtgtgggactgggtgagaagacagcccgtgctggacttcgagagcggccacaagagcaacgtgttccaggccaagttcctgcccaacagcggcgacagcaccctggccatgtgcgccagagacggccaggtgagagtggccgagctgagcgccacccagtgctgcaagaacaccaagagagtggcccagcacaagggcgccagccacaagctggccctggagcccgacagcccctgcaccttcctgagcgccggcgaggacgccgtggtgttcaccatcgacctgagacaggacagacccgccagcaagctggtggtgaccaaggagaaggagaagaaggtgggcctgtacaccatctacgtgaaccccgccaacacccaccagttcgccgtgggcggcagagaccagttcgtgagaatctacgaccagagaaagatcgacgagaacgagaacaacggcgtgctgaagaagttctgcccccaccacctggtgaacagcgagagcaaggccaacatcacctgcctggtgtacagccacgacggcaccgagctgctggccagctacaacgacgaggacatctacctgttcaacagcagccacagcgacggcgcccagtacgtgaagagatacaagggccacagaaacaacgccaccgtgaagggcgtgaacttctacggccccaagagcgagttcgtggtgagcggcagcgactgcggccacatcttcctgtgggagaagagcagctgccagatcatccagttcatggagggcgacaagggcggcgtggtgaactgcctggagccccacccccacctgcccgtgctggccaccagcggcctggaccacgacgtgaagatctgggcccccaccgccgaggccagcaccgagctgaccggcctgaaggacgtgatcaagaagaacaagagagagagagacgaggacagcctgcaccagaccgacctgttcgacagccacatgctgtggttcctgatgcaccacctgagacagagaagacaccacagaagatggagagagcccggcgtgggcgccaccgacgccgacagcgacgagagccccagcagcagcgacaccagcgacgaggaggagggccccgacagagtgcagtgcatgcccagctag

SEQ ID NO: 13373 - DNA, 426 bp, Artificial Sequence
  Description of Artificial Sequence: Synthetic coding sequence
atgggcggcaagcccagacacagcctgtacttcatcggctaccaggacgacttcctgctgtacctggacccccactactgccagcccaccgtggacgtgagccaggccgacttccccctggagagcttccactgcaccagccccagaaagatggccttcgccaagatggaccccagctgcaccgtgggcttctacgccggcgacagaaaggagttcgagaccctgtgcagcgagctgaccagagtgctgagcagcagcagcgccaccgagagataccccatgttcaccctggccgagggccacgcccaggaccacagcctggacgacctgtgcagccagctggcccagcccaccctgagactgcccagaaccggcagactgctgagagccaagagacccagcagcgaggacttcgtgttcctgtag

SEQ ID NO: 13374 - DNA, 570 bp, Artificial Sequence
  Description of Artificial Sequence: Synthetic coding sequence
atggtgctgctgcacgtgaagagaggcgacgagagccagttcctgctgcaggcccccggcagcaccgagctggaggagctgaccgtgcaggtggccagagtgtacaacggcagactgaaggtgcagagactgtgcagcgcccccaacgagaagatgaagcaggtgctgaagaagaccatcgaggaggccaaggccatcatcagcaagaagcaggtggaggccggcgtgtgcgtgaccatggagatggtgaaggacgccctggaccagctgagaggcgccgtgatgatcgtgtaccccatgggcctgcccccctacgaccccatcagaatggagttcgagaacaaggaggacctgagcggcacccaggccggcctgaacgtgatcaaggaggccgaggcccagctgtggtgggccgccaaggagctgagaagaaccaagaagctgagcgactacgtgggcaagaacgagaagaccaagatcatcgccaagatccagcaggtgagcaccttctgcttcaacgtgagcgtggtgttcgtgatcagcctgcagaccgacaagaacgtgcagtag

SEQ ID NO: 13375 - DNA, 2031 bp, Artificial Sequence
  Description of Artificial Sequence: Synthetic coding sequence
atggccgccatccagcacggccacgaggccgtggtgagactgctgatggagtggggcgccgaccccaaccacgccgccagaaccgtgggctggagccccctgatgctggccgccctgaccggcagactgggcgtggcccagcagctggtggagaagggcgccaaccccgaccacctgagcgtgctggagaagaccgccttcgaggtggccctggactgcaagcacagagacctggtggactacctggaccccctgaccaccgtgagacccaagaccgacgaggagaagagaagacccgacatcttccacgccctgaagatgggcaacttccagctggtgaaggagatcgccgacgaggaccccagccacgtgaacctggtgaacggcgacggcgccacccccctgatgctggccgccgtgaccggccagctggccctggtgcagctgctggtggagagacacgccgacgtggacaagcaggacagcgtgcacggctggaccgccctgatgcaggccacctaccacggcaacaaggagatcgtgaagtacctgctgaaccagggcgccgacgtgaccctgagagccaagaacggctacaccgccttcgacctggtgatgctgctgaacgaccccgacaccgagctggtgagactgctggccagcgtgtgcatgcaggtgaacaaggacaagggcagacccagccaccagccccccctgccccacagcaaggtgagacagccctggagcatccccgtgctgcccgacgacaagggcggcctgaagagctggtggaacagaatgagcaacagattcagaaagctgaagctgatgcagaccctgcccagaggcctgagcagcaaccagcccctgcccttcagcgacgagcccgagcccgccctggacagcaccatgagagccgccccccaggacaagaccagcagaagcgccctgcccgacgccgcccccgtgaccaaggacaacggccccggcagcaccagaggcgagaaggaggacaccctgctgaccaccatgctgagaaacggcgcccccctgaccagactgcccagcgacaagctgaaggccgtgatcccccccttcctgccccccagcagcttcgagctgtggagcagcgacagaagcagaaccagacacaacggcaaggccgaccccatgaagaccgccctgccccagagagccagcagaggccaccccgtgggcggcggcggcaccgacaccacccccgtgagacccgtgaagttccccagcctgcccagaagccccgccagcagcgccaacagcggcaacttcaaccacagcccccacagcagcggcggcagcagcggcgtgggcgtgagcagacacggcggcgagctgctgaacagaagcggcggcagcatcgacaacgtgctgagccagatcgccgcccagagaaagaaggccgccggcctgctggagcagaagcccagccacagaagcagccccgtgggccccgcccccggcagcagccccagcgagctgcccgccagccccgccggcggcagcgcccccgtgggcaagaagctggagaccagcaagagaccccccagcggcaccagcaccaccagcaagagcaccagccccaccctgacccccagccccagccccaagggccacaccgccgagagcagcgtgagcagcagcagcagccacagacagagcaagagcagcggcggcagcagcagcggcaccatcaccgacgaggacgagctgaccggcatcctgaagaagctgagcctggagaagtaccagcccatcttcgaggagcaggaggtggacatggaggccttcctgaccctgaccgacggcgacctgaaggagctgggcatcaagaccgacggcagcagacagcagatcctggccgccatcagcgagctgaacgccggcaagggcagagagagacagatcctgcaggagaccatccacaacttccacagcagcttcgagagcagcgccagcaacaccagagcccccggcaacagcccctgcgcctag

SEQ ID NO: 13376 - DNA, 2319 bp, Artificial Sequence
  Description of Artificial Sequence: Synthetic coding sequence
atgagacaccagaagagaaacgtgtaccactgcaacaagtgcagactgcagttcctgttcgccaaggacaagatcgagcacaagctgcagcaccacaagaccttcagaaagcccaagcagctggagggcctgaagcccggcaccaaggtgaccatcagagccagcagaggccagcccagaaccgtgcccgtgagcagcaacgacaccccccccagcgccctgcaggaggccgcccccctgaccagcagcatggaccccctgcccgtgttcctgtacccccccgtgcagagaagcatccagaagagagccgtgagaaagatgagcgtgatgggcagacagacctgcctggagtgcagcttcgagatccccgacttccccaaccacttccccacctacgtgcactgcagcctgtgcagatacagcacctgctgcagcagagcctacgccaaccacatgatcaacaaccacgtgcccagaaagagccccaagtacctggccctgttcaagaacagcgtgagcggcatcaagctggcctgcaccagctgcaccttcgtgaccagcgtgggcgacgccatggccaagcacctggtgttcaaccccagccacagaagcagcagcatcctgcccagaggcctgacctggatcgcccacagcagacacggccagaccagagacagagtgcacgacagaaacgtgaagaacatgtaccccccccccagcttccccaccaacaaggccgccaccgtgaagagcgccggcgccacccccgccgagcccgaggagctgctgacccccctggcccccgccctgcccagccccgccagcaccgccacccccccccccacccccacccacccccaggccctggccctgccccccctggccaccgagggcgccgagtgcctgaacgtggacgaccaggacgagggcagccccgtgacccaggagcccgagctggccagcggcggcggcggcagcggcggcgtgggcaagaaggagcagctgagcgtgaagaagctgagagtggtgctgttcgccctgtgctgcaacaccgagcaggccgccgagcacttcagaaacccccagagaagaatcagaagatggctgagaagattccaggccagccagggcgagaacctggagggcaagtacctgagcttcgaggccgaggagaagctggccgagtgggtgctgacccagagagagcagcagctgcccgtgaacgaggagaccctgttccagaaggccaccaagatcggcagaagcctggagggcggcttcaagatcagctacgagtgggccgtgagattcatgctgagacaccacctgaccccccacgccagaagagccgtggcccacaccctgcccaaggacgtggccgagaacgccggcctgttcatcgacttcgtgcagagacagatccacaaccaggacctgcccctgagcatgatcgtggccatcgacgagatcagcctgttcctggacaccgaggtgctgagcagcgacgacagaaaggagaacgccctgcagaccgtgggcaccggcgagccctggtgcgacgtggtgctggccatcctggccgacggcaccgtgctgcccaccctggtgttctacagaggccagatggaccagcccgccaacatgcccgacagcatcctgctggaggccaaggagagcggctacagcgacgacgagatcatggagctgtggagcaccagagtgtggcagaagcacaccgcctgccagagaagcaagggcatgctggtgatggactgccacagaacccacctgagcgaggaggtgctggccatgctgagcgccagcagcaccctgcccgccgtggtgcccgccggctgcagcagcaagatccagcccctggacgtgtgcatcaagagaaccgtgaagaacttcctgcacaagaagtggaaggagcaggccagagagatggccgacaccgcctgcgacagcgacgtgctgctgcagctggtgctggtgtggctgggcgaggtgctgggcgtgatcggcgactgccccgagctggtgcagagaagcttcctggtggccagcgtgctgcccggccccgacggcaacatcaacagccccaccagaaacgccgacatgcaggaggagctgatcgccagcctggaggagcagctgaagctgagcggcgagcacagcgagagcagcacccccagacccagaagcagccccgaggagaccatcgagcccgagagcctgcaccagctgttcgagggcgagagcgagaccgagagcttctacggcttcgaggaggccgacctggacctgatggagatctag

SEQ ID NO: 13377 - DNA, 285 bp, Artificial Sequence
  Description of Artificial Sequence: Synthetic coding sequence
atggccatgaccgccggcaccaccaccaccttccccatgagcaaccacaccagagagagagtgaccgtggccaagctgaccctggagaacttctacagcaacctgatcctgcagcacgaggagagagagaccagacagaagaagctggaggtggccatggaggaggagggcctggccgacgaggagaagaagctgagaagaagccagcacgccagaaaggagaccgagttcctgagactgaagagaaccagactgggcctggacgacttcgagagcctgaagtag

SEQ ID NO: 13378 - DNA, 1047 bp, Artificial Sequence; identical to SEQ ID NO: 9854
  Description of Artificial Sequence: Synthetic coding sequence

SEQ ID NO: 13379 - DNA, 888 bp, Artificial Sequence; identical to SEQ ID NO: 9312
  Description of Artificial Sequence: Synthetic coding sequence

SEQ ID NO: 13380 - DNA, 258 bp, Artificial Sequence
  Description of Artificial Sequence: Synthetic coding sequence
atgccctacaacgaggccgagaacaagagaagctaccacctgtgcgacctgtgcgacagaatcatcatcggcgacagagagtgggccgcccacatcaagagcaagagccacctgaaccagctgaagaagagaagaagactggacagcgacgccgtgaacaccatcgagagccagagcgtgagccccgaccacaacaaggagcccaaggagaagggcagccccggccagaacgaccaggagctgaagtgcagcgtgtag

SEQ ID NO: 13381 - DNA, 396 bp, Artificial Sequence
  Description of Artificial Sequence: Synthetic coding sequence
atggccatgaccgccggcaccaccaccaccttccccatgagcaaccacaccagagagagagtgaccgtggccaagctgaccctggagaacttctacagcaacctgatcctgcagcacgaggagagagagaccagacagaagaagctggaggtggccatggaggaggagggcctggccgacgaggagaagaagctgagaagaagccagcacgccagaaaggagaccgagttcctgagactgaagagaaccagactgggcctggacgacttcgagagcctgaaggtgatcggcagaggcgccttcggcgaggtgagactggtgcagaagaaggacaccggccacatctacgccatgaagatcctgagaaagagcgacatgctggagaaggagcagtag

SEQ ID NO: 13382 - DNA, 21 bp, Artificial Sequence
  Description of Artificial Sequence: Synthetic coding sequence
atggcccacgagatgatctag

SEQ ID NO: 13383 - DNA, 2199 bp, Artificial Sequence
  Description of Artificial Sequence: Synthetic coding sequence
atgggcttcagagacgaggccgccggctacttccacaaggccgtgaagctgaaccccgacttcagcgacgccaaggagaacttctacagagtggccaactggctggtggagagatggcacttcatcatgctgaacgacaccaagagaaacaccatctacaacgccgccatccagaaggccgtgtgcctgggcagcaagagcgtgctggacatcggcgccggcaccggcatcctgagcatgttcgccaagaaggccggcgcccacagcgtgtacgcctgcgagctgagcaagaccatgtacgagctggcctgcgacgtggtggccgccaacaagatggaggccggcatcaagctgctgcacaccaagagcctggacatcgagatccccaagcacatccccgagagagtgagcctggtggtgaccgagaccgtggacgccggcctgttcggcgagggcatcgtggagagcctgatccacgcctgggagcacctgctgctgcagcccaagaccaagggcgagagcgccaactgcgagaagtacggcaaggtgatccccgccagcgccgtgatcttcggcatggccgtggagtgcgccgagatcagaagacaccacagagtgggcatcaaggacatcgccggcatccacctgcccaccaacgtgaagttccagagccccgcctacagcagcgtggacaccgaggagaccatcgagccctacaccaccgagaagatgagcagagtgcccggcggctacctggccctgaccgagtgcttcgagatcatgaccgtggacttcaacaacctgcaggagctgaagagcctggccaccaagaagcccgacaagatcggcatccccgtgatcaaggagggcatcctggacgccatcatggtgtggttcgtgctgcagctggacgacgagcacagcctgagcaccagccccagcgaggagacctgctgggagcaggccgtgtaccccgtgcaggacctggccgactactggatcaagcccggcgaccacgtgatgatggaggtgagctgccaggactgctacctgagaatccagagcatcagcgtgctgggcctggagtgcgagatggacgtggccaagagcttcacccagaacaaggacctgctgagcctgggcaacgaggccgagctgtgcagcgccctggccaacctgcagaccagcaagcccgacgccgtggagcagacctgcatcctggagagcaccgagatcgccctgctgaacaacatcccctaccacgagggcttcaagatggccatgagcaaggtgctgagcagcctgacccccgagaagctgtaccagaccatggacacccactgccagaacgagatgagcagcggcaccggccagagcaacaccgtgcagaacatcctggagcccttctacgtgctggacgtgagcgagggcttcagcgtgctgcccgtgatcgccggcaccctgggccaggtgaagccctacagcagcgtggagaaggaccagcacagaatcgccctggacctgatcagcgaggccaaccacttccccaaggagaccctggagttctggctgagacacgtggaggacgagagcgccatgctgcagagacccaagagcgacaagctgtggagcatcatcatcctggacgtgatcgagcccagcggcctgatccagcaggagatcatggagaaggccgccatcagcagatgcctgctgcagagcggcggcaagatcttcccccagtacgtgctgatgttcggcctgctggtggagagccagaccctgctggaggagaacgccgtgcagggcaccgagagaaccctgggcctgaacatcgcccccttcatcaaccagttccaggtgcccatcagagtgttcctggacctgagcagcctgccctgcatccccctgagcaagcccgtggagctgctgagactggacctgatgaccccctacctgaacaccagcaacagagaggtgaaggtgtacgtgtgcaagagcggcagactgaccgccatccccttctggtaccacatgtacctggacgaggagatcagactggacaccagcagcgaggccagccactggaagcaggccgccgtggtgctggacaaccccatccaggtggagatgggcgaggagctggtgctgagcatccagcaccacaagagcaacgtgagcatcaccgtgaagcagtag

SEQ ID NO: 13384 - DNA, 1554 bp, Artificial Sequence
  Description of Artificial Sequence: Synthetic coding sequence
atgtgcagcctggccagcggcgccaccggcggcagaggcgccgtggagaacgaggaggacctgcccgagctgagcgacagcggcgacgaggccgcctgggaggacgaggacgacgccgacctgccccacggcaagcagcagaccccctgcctgttctgcaacagactgttcaccagcgccgaggagaccttcagccactgcaagagcgagcaccagttcaacatcgacagcatggtgcacaagcacggcctggagttctacggctacatcaagctgatcaacttcatcagactgaagaaccccaccgtggagtacatgaacagcatctacaaccccgtgccctgggagaaggaggagtacctgaagcccgtgctggaggacgacctgctgctgcagttcgacgtggaggacctgtacgagcccgtgagcgtgcccttcagctaccccaacggcctgagcgagaacaccagcgtggtggagaagctgaagcacatggaggccagagccctgagcgccgaggccgccctggccagagccagagaggacctgcagaagatgaagcagttcgcccaggacttcgtgatgcacaccgacgtgagaacctgcagcagcagcaccagcgtgatcgccgacctgcaggaggacgaggacggcgtgtacttcagcagctacggccactacggcatccacgaggagatgctgaaggacaagatcagaaccgagagctacagagacttcatctaccagaacccccacatcttcaaggacaaggtggtgctggacgtgggctgcggcaccggcatcctgagcatgttcgccgccaaggccggcgccaagaaggtgctgggcgtggaccagagcgagatcctgtaccaggccatggacatcatcagactgaacaagctggaggacaccatcaccctgatcaagggcaagatcgaggaggtgcacctgcccgtggagaaggtggacgtgatcatcagcgagtggatgggctacttcctgctgttcgagagcatgctggacagcgtgctgtacgccaagaacaagtacctggccaagggcggcagcgtgtaccccgacatctgcaccatcagcctggtggccgtgagcgacgtgaacaagcacgccgacagaatcgccttctgggacgacgtgtacggcttcaagatgagctgcatgaagaaggccgtgatccccgaggccgtggtggaggtgctggaccccaagaccctgatcagcgagccctgcggcatcaagcacatcgactgccacaccaccagcatcagcgacctggagttcagcagcgacttcaccctgaagatcaccagaaccagcatgtgcaccgccatcgccggctacttcgacatctacttcgagaagaactgccacaacagagtggtgttcagcaccggcccccagagcaccaagacccactggaagcagaccgtgttcctgctggagaagcccttcagcgtgaaggccggcgaggccctgaagggcaaggtgaccgtgcacaagaacaagagagaggtgctgatcgtgggcatctag

SEQ ID NO: 13385 - DNA, 1560 bp, Artificial Sequence
  Description of Artificial Sequence: Synthetic coding sequence
atggagcaggagaagttcgacctgcagaagcagcacaccgagaacatccaggagctgctggaggacaccaacgtgagactgaacaagatggagagcgagtacatggcccagacccagagcaccaaccacatgatcaaggagctggaggccagagtgcagcagctgaccggcgaggccgagaacagcaacctgcagagacagaagctgatccaggagaaggccgagctggagagatgctaccagatcacctgcagcgagctgcaggaggtgaaggccagaagaaacaccctgcacaaggagaaggaccacctggtgaacgactacgagcagaacatgaagctgctgcagaccaagtacgacgccgacatcaacctgctgaagcaggagcacgccctgagcgccagcaaggccagcagcatgatcgaggagctggagcagaacgtgtgccagctgaagcagcagctgcaggagagcgagctgcagagaaagcagcagctgagagaccaggagaacaagttccagatggagaagagccacctgaagcacatctacgagaagaaggcccacgacctgcagagcgagctggacaagggcaaggaggacacccagaagaagatccacaagttcgaggaggccctgaaggagaaggaggagcagctgaccagagtgaccgaggtgcagagactgcaggcccagcaggccgacgccgccctggaggagttcaagagacaggtggagctgaacagcgagaaggtgtacgccgagatgaaggagcagatggagaaggtggaggccgacctgaccagaagcaagagcctgagagagaagcagagcaaggagttcctgtggcagctggaggacatcagacagagatacgagcagcagatcgtggagctgaagctggagcacgagcaggagaagacccacctgctgcagcagcacaacgccgagaaggacagcctggtgagagaccacgagagagagatcgagaacctggagaagcagctgagagccgccaacatggagcacgagaaccagatccaggagttcaagaagagagacgcccaggtgatcgccgacatggaggcccaggtgcacaagctgagagaggagctgatcaacgtgaacagccagagaaagcagcagctggtggagctgggcctgctgagagaggaggagaagcagagagccaccagagagcacgagatcgtggtgaacaagctgaaggccgagagcgagaagatgaagatcgagctgaagaagacccacgccgccgagaccgagatgaccctggagaaggtgctgcaggacgagctggagaacagaagcaaccaggtgagatgcgccgagaagaagctgcagcacaaggagctggagagccaggagcagatcacctacatcagacaggagtacgagaccaagctgaagggcctgatgcccgccagcctgagacaggagctggaggacaccatcagcagcctgaagagccaggtgaacttcctgcagaagagagccagcatcctgcaggaggagctgaccacctaccagggcagaagatag

SEQ ID NO: 13386 - DNA, 1743 bp, Artificial Sequence
  Description of Artificial Sequence: Synthetic coding sequence
atgaacaacatccacgtggagaacgagagcctggacaacttcctgaaggagaccaacaaggagaacctgctggacatcctgaccgagcccgagagaaagcccgaccccaagctgtacaccagaagcaagcccaagaccgacagctacaaccagaccaagaacagcctggtgcccaagcaggccctgggcaagagcagcgtgaacagcgccgtgctgaaggacagagtgaacaagcagttcgtgggcgagacccagagcagaaccttccccgtgaagagccagcagctgagcagaggcgccgacctggccagacccggcgtgaagcccagcagaaccgtgcccagccacttcatcagaaccctgagcaaggtgcagagcagcaagaagcccgtggtgaagaacatcaaggacatcaaggtgaacagaagccagtacgagagacccaacgagaccaagatcagaagctaccccgtgaccgagcagagagtgaagcacaccaagcccagaacctaccccagcctgctgcagggcgagtacaacaacagacaccccaacatcaagcaggaccagaagagcagccaggtgtgcatcccccagaccagctgcgtgctgcagaagagcaaggccatcagccagagacccaacctgaccgtgggcagattcaacagcgccatccccagcacccccagcatcagacccaacggcaccagcggcaacaagcacaacaacaacggcttccagcagaaggcccagaccctggacagcaagctgaagaaggccgtgccccagaaccacttcctgaacaagaccgcccccaagacccaggccgacgtgaccaccgtgaacggcacccagaccaaccccaacatcaagaagaaggccaccgccgaggacagaagaaagcagctggaggagtggcagaagagcaagggcaagacctacaagagaccccccatggagctgaagaccaagagaaaggtgatcaaggagatgaacatcagcttctggaagagcatcgagaaggaggaggaggagaagaaggcccagctggagctgagcagcaagatcaacaacaccctgaccgagtgcctgaacctgatcgagggcggcgtgcccagcaacgagatcctgaacatcctgagcagcatccccgaggccgagaagttcgccaagttctggatctgcaaggccaagctgctggccagcaagggcaccttcgacgtgatcggcctgtacgaggaggccatcaagaacggcgccacccccatccaggagctgagaaaggtggtgctgaacatcctgcaggacagcaacagaaccaccgagggcatcaccagcgacagcctggtggccgagaccagcatcaccagcgtggaggagctggccaagaagatggagagcgtgaagagctgcctgagccccaaggagagagagcaggtgaccgccacccccagaatcgccaaggccgagcagcacaactaccccggcatcaagctgcagatcggccccatccccagaatcaacggcatgcccgaggtgcaggacatgaagttcatcacccccgtgagaagaagcagcagaatcgagagagccgtgagcagataccccgagatgctgcaggagcacgacctggtggtggccagcctggacgagctgctggaggtggaggagaccaagtgcttcatcttcagaagaaacgaggccctgcccgtgaccctgggcttccagacccccgagagctag

SEQ ID NO: 13387 - DNA, 705 bp, Artificial Sequence
  Description of Artificial Sequence: Synthetic coding sequence
atgtacatggacctggtggacggcatcttcctgaaccagatcatgctgcagatcgaccccagacccaccaaccagagaatcaacaagcacgtgaacaacgacgtgaacctgagaatccagaacctgaccatcctggtgagaaacatcaagacctactaccaggaggtgctgcagcagctgatcgtgatgaacctgcccaacgtgctgatgatcggcagagaccccctgagcggcaagagcatggaggagatcaagaaggtgctgctgctggtgctgggctgcgccgtgcagtgcgagagaaaggaggagttcatcgagagaatcaagcagctggacatcgagacccaggccggcatcgtggcccacatccaggaggtgacccacaaccaggagaacgtgttcgacctgcagtggctggagctgcccgacgtggcccccgaggagctggaggccctgagcagaagcatggtgctgcacctgagaagactgatcgaccagagagacgagtgcaccgagctgatcgtggacctgacccaggagagagactacctgcaggcccagcacccccccagccccatcaagagcagcagcgccgacagcacccccagccccaccagcagcctgagcagcgaggacaagcagcacctggccgtggagctggccgacaccaaggccagactgagaagagtgagacaggagctgtag

SEQ ID NO: 13388 - DNA, 1161 bp, Artificial Sequence
  Description of Artificial Sequence: Synthetic coding sequence
atgaccgacatcagaaagatcagactgggcgagagactggtggaggtgttcagcgccgagaaggtgtacatggtgagactgagaaaccccctgggcagacaggagtggagcggcccctggagcgagatcagcgaggagtggcagcagctgaccgccagcgacagaaagaacctgggcctggtgatgagcgacgacggcgagttctggatgagcctggaggacttctgcagaaacttccacaagctgaacgtgtgcagaaacgtgaacaaccccatcttcggcagaaaggagctggagagcgtgctgggctgctggaccgtggacgacgaccccctgatgaacagaagcggcggctgctacaacaacagagacaccttcctgcagaacccccagtacatcttcaccgtgcccgaggacggccacaaggtgatcatgagcctgcagcagaaggacctgagaacctacagaagaatgggcagacccgacaactacatcatcggcttcgagctgttcaaggtggagatgaacagaaagttcagactgcaccacctgtacatccaggagagagccggcaccagcacctacatcgacaccagaaccgtgttcctgagcaagtacctgaagaagggcaactacgtgctggtgcccaccatgttccagcacggcagaaccagcgagttcctgctgagaatcttcagcgaggtgcccgtgcagctgagagagctgaccctggacatgcccaagatgagctgctggaacctggccagaggctaccccaaggtggtgacccagatcaccgtgcacagcgccgaggacctggagaagaagtacgccaacgagaccgtgaacccctacctggtgatcaagtgcggcaaggaggaggtgagaagccccgtgcagaagaacaccgtgcacgccatcttcgacacccaggccatcttctacagaagaaccaccgacatccccatcatcgtgcaggtgtggaacagcagaaagttctgcgaccagttcctgggccaggtgaccctggacgccgaccccagcgactgcagagacctgaagagcctgtacctgagaaagaagggcggccccaccgccaaggtgaagcagggccacatcagcttcaaggtgatcagcagcgacgacctgaccgagctgtag

SEQ ID NO: 13389 - DNA, 966 bp, Artificial Sequence
  Description of Artificial Sequence: Synthetic coding sequence
atgaccgagctgagcctgcagaaggagcagctgcagctgaagatcatcgagatcgaggacgaggccgagaagtggcagaaggagaaggacagaatcaagagcttcaccaccaacgagaaggccatcctggagcagaacttcagagacctggtgagagacctggagaagcagaaggaggaggtgagagccgccctggagcagagagagcaggacgccgtggaccaggtgaaggtgatcatggacgccctggacgagagagccaaggtgctgcacgaggacaagcagaccagagagcagctgcacagcatcagcgacagcgtgctgttcctgcaggagttcggcgccctgatgagcaactacagcctgcccccccccctgcccacctaccacgtgctgctggagggcgagggcctgggccagagcctgggcaacttcaaggacgacctgctgaacgtgtgcatgagacacgtggagaagatgtgcaaggccgacctgagcagaaacttcatcgagagaaaccacatggagaacggcggcgaccacagatacgtgaacaactacaccaacagcttcggcggcgagtggagcgcccccgacaccatgaagagatacagcatgtacctgacccccaagggcggcgtgagaaccagctaccagcccagcagccccggcagattcaccaaggagaccacccagaagaacttcaacaacctgtacggcaccaagggcaactacaccagcagagtgtgggagtacagcagcagcatccagaacagcgacaacgacctgcccgtggtgcagggcagcagcagcttcagcctgaagggctaccccagcctgatgagaagccagagccccaaggcccagccccagacctggaagagcggcaagcagaccatgctgagccactacagacccttctacgtgaacaagggcaacggcatcggcagcaacgaggccccctag

SEQ ID NO: 13390 - DNA, 687 bp, Artificial Sequence
  Description of Artificial Sequence: Synthetic coding sequence
atgtacagacagagattcctgtacagcctgtacagacacacccactgggtgagatgcgccaagttcagccccgacggcagactgatcgtgagctgcagcgaggacaagaccatcaagatctgggacaccaccaacaagcagtgcgtgaacaacttcagcgacagcgtgggcttcgccaacttcgtggacttcaaccccagcggcacctgcatcgccagcgccggcagcgaccagaccgtgaaggtgtgggacgtgagagtgaacaagctgctgcagcactaccaggtgcacagcggcggcgtgaactgcatcagcttccaccccagcggcaactacctgatcaccgccagcagcgacggcaccctgaagatcctggacctgctggagggcagactgatctacaccctgcagggccacaccggccccgtgttcaccgtgagcttcagcaagggcggcgagctgttcgccagcggcggcgccgacacccaggtgctgctgtggagaaccaacttcgacgagctgcactgcaagggcctgaccaagagaaacctgaagagactgcacttcgacagccccccccacctgctggacatctaccccagaaccccccacccccacgaggagaaggtggagaccgtggaggacttcttcctgcacctgctgagactgatccagagcctgagatag

SEQ ID NO: 13391 - DNA, 1686 bp, Artificial Sequence
  Description of Artificial Sequence: Synthetic coding sequence
atgagagccgtgagaagacacctgttcccccagcacagcgcccccggcagaggcgtggtgtgggagtggctgagcgacgacggcagctggaccgcctacgaggccagcgtgtgcgactacctggagcagcaggtggccagaggcaaccagctggtggacctggcccccctgggctacaactacaccgtgaactacaccacccacacccagaccaacaagaccagcagcttctgcagaagcgtgagaagacaggccggccccccctaccccgtgaccaccatcatcgccccccccggccacaccggcgtggcctgcagctgccaccagtgcctgagcggcagcagaaccggccccgtgagcggcagatacagacacagcatgaccaacctgcccgcctaccccgtgccccagcaccccccccacagaaccgccagcgtgttcggcacccaccaggccttcgccccctacaacaagcccagcctgagcggcgccagaagcgcccccagactgaacaccaccaacgcctggggcgccgccccccccagcctgggcagccagcccctgtacagaagcagcctgagccacctgggcccccagcacctgccccccggcagcagcaccagcggcgccgtgagcgccagcctgcccagcggccccagcagcagccccggcagcgtgcccgccaccgtgcccatgcagatgcccaagcccagcagagtgcagcaggccctggccggcatgaccagcgtgctgatgagcgccatcggcctgcccgtgtgcctgagcagagccccccagcccaccagcccccccgccagcagactggccagcaagagccacggcagcgtgaagagactgagaaagatgagcgtgaagggcgccacccccaagcccgagcccgagcccgagcaggtgatcaagaactacaccgaggagctgaaggtgccccccgacgaggactgcatcatctgcatggagaagctgagcaccgccagcggctacagcgacgtgaccgacagcaaggccatcggcagcctggccgtgggccacctgaccaagtgcagccacgccttccacctgctgtgcctgctggccatgtactgcaacggcaacaaggacggcagcctgcagtgccccagctgcaagaccatctacggcgagaagaccggcacccagccccagggcaagatggaggtgctgagattccagatgagcctgcccggccacgaggactgcggcaccatcctgatcgtgtacagcatcccccacggcatccagggccccgagcaccccaaccccggcaagcccttcaccgccagaggcttccccagacagtgctacctgcccgacaacgcccagggcagaaaggtgctggagctgctgaaggtggcctggaagagaagactgatcttcaccgtgggcaccagcagcaccaccggcgagaccgacaccgtggtgtggaacgagatccaccacaagaccgagatggacagaaacatcaccggccacggctaccccgaccccaactacctgcagaacgtgctggccgagctggccgcccagggcgtgaccgaggactgcctggagcagcagcacgccagactgtggtggccccccagatgccccatggccggctgggtggccagacaggaggtgcccagccccagaggctgggaggtgtgctag

SEQ ID NO: 13392 - DNA, 2565 bp, Artificial Sequence
  Description of Artificial Sequence: Synthetic coding sequence
atgaaggtggaggcctgcacctgggccggctacagcggcctgtacgaggccatcgagagctgggacttcaagaagatcgagaagctggaggagtacagactgctgctgaagagactgcagcccgagttcaagaccagaatcatccccaccgacatcatcagcgacctgagcgagtgcctgatcaaccaggagtgcgaggagatcctgcagatctgcagcaccaagggcatgatggccggcgccgagaagctggtggagtgcctgctgagaagcgacaaggagaactggcccaagaccctgaagctggccctggagaaggagagaaacaagttcagcgagctgtggatcgtggagaagggcatcaaggacgtggagaccgaggacctggaggacaagatggagaccagcgacatccagatcttctaccaggaggaccccgagtgccagaacctgagcgagaacagctgcccccccagcgaggtgagcgacaccaacctgtacagccccttcaagcccagaaactaccagctggagctggccctgcccgccatgaagggcaagaacaccatcatctgcgcccccaccggctgcggcaagaccttcgtgagcctgctgatctgcgagcaccacctgaagaagttcccccagggccagaagggcaaggtggtgttcttcgccaaccagatccccgtgtacgagcagcagaagagcgtgttcagcaagtacttcgagagacacggctacagagtgaccggcatcagcggcgccaccgccgagaacgtgcccgtggagcagatcgtggagaacaacgacatcatcatcctgaccccccagatcctggtgaacaacctgaagaagggcaccatccccagcctgagcatcttcaccctgatgatcttcgacgagtgccacaacaccagcaagcagcacccctacaacatgatcatgttcaactacctggaccagaagctgggcggcagcagcggccccctgccccaggtgatcggcctgaccgccagcgtgggcgtgggcgacgccaagaacaccgacgaggccctggactacatctgcaagctgtgcgccagcctggacgccagcgtgatcgccaccgtgaagcacaacctggaggagctggagcaggtggtgtacaagccccagaagttcttcagaaaggtggagagcagaatcagcgacaagttcaagtacatcatcgcccagctgatgagagacaccgagagcctggccaagagaatctgcaaggacctggagaacctgagccagatccagaacagagagttcggcacccagaagtacgagcagtggatcgtgaccgtgcagaaggcctgcatggtgttccagatgcccgacaaggacgaggagagcagaatctgcaaggccctgttcctgtacaccagccacctgagaaagtacaacgacgccctgatcatcagcgagcacgccagaatgaaggacgccctggactacctgaaggacttcttcagcaacgtgagagccgccggcttcgacgagatcgagcaggacctgacccagagattcgaggagaagctgcaggagctggagagcgtgagcagagaccccagcaacgagaaccccaagctggaggacctgtgcttcatcctgcaggaggagtaccacctgaaccccgagaccatcaccatcctgttcgtgaagaccagagccctggtggacgccctgaagaactggatcgagggcaaccccaagctgagcttcctgaagcccggcatcctgaccggcagaggcaagaccaaccagaacaccggcatgaccctgcccgcccagaagtgcatcctggacgccttcaaggccagcggcgaccacaacatcctgatcgccaccagcgtggccgacgagggcatcgacatcgcccagtgcaacctggtgatcctgtacgagtacgtgggcaacgtgatcaagatgatccagaccagaggcagaggcagagccagaggcagcaagtgcttcctgctgaccagcaacgccggcgtgatcgagaaggagcagatcaacatgtacaaggagaagatgatgaacgacagcatcctgagactgcagacctgggacgaggccgtgttcagagagaagatcctgcacatccagacccacgagaagttcatcagagacagccaggagaagcccaagcccgtgcccgacaaggagaacaagaagctgctgtgcagaaagtgcaaggccctggcctgctacaccgccgacgtgagagtgatcgaggagtgccactacaccgtgctgggcgacgccttcaaggagtgcttcgtgagcagaccccaccccaagcccaagcagttcagcagcttcgagaagagagccaagatcttctgcgccagacagaactgcagccacgactggggcatccacgtgaagtacaagaccttcgagatccccgtgatcaagatcgagagcttcgtggtggaggacatcgccaccggcgtgcagaccctgtacagcaagtggaaggacttccacttcgagaagatccccttcgaccccgccgagatgagcaagtag

SEQ ID NO: 13393 - DNA, 813 bp, Artificial Sequence
  Description of Artificial Sequence: Synthetic coding sequence
atgcagatcgagcacatcatcgagaacatcgtggccgtgaccaagggcctgagcgagaagctgcccgagaagtgggagagcgtgaagctgctgttcgtgaagaccgagaagagcgccgccctgcccatcttcagcagcttcgtgagcaactgggacgaggccaccaagagaagcctgctgaacaagaagaagaaggaggccagaagaaagagaagagagagaaacttcgagaagcagaaggagagaaagaagaagagacagcaggccagaaagaccgccagcgtgctgagcaaggacgacgtggcccccgagagcggcgacaccaccgtgaagaagcccgagagcaagaaggagcagacccccgagcacggcaagaagaagagaggcagaggcaaggcccaggtgaaggccaccaacgagagcgaggacgagatcccccagctggtgcccatcggcaagaagacccccgccaacgagaaggtggagatccagaagcacgccaccggcaagaagagccccgccaagagccccaaccccagcacccccagaggcaagaagagaaaggccctgcccgccagcgagacccccaaggccgccgagagcgagacccccggcaagagccccgagaagaagcccaagatcaaggaggaggccgtgaaggagaagagccccagcctgggcaagaaggacgccagacagacccccaagaagcccgaggccaagttcttcaccacccccagcaagagcgtgagaaaggccagccacacccccaagaagtggcccaagaagcccaaggtgccccagagcacctag

SEQ ID NO: 13394 - DNA, 1059 bp, Artificial Sequence
  Description of Artificial Sequence: Synthetic coding sequence
atgagcagcagaaagctgagcggccccaagggcagaagactgagcatccacgtggtgacctggaacgtggccagcgccgccccccccctggacctgagcgacctgctgcagctgaacaacagaaacctgaacctggacatctacgtgatcggcctgcaggagctgaacagcggcatcatcagcctgctgagcgacgccgccttcaacgacagctggagcagcttcctgatggacgtgctgagccccctgagcttcatcaaggtgagccacgtgagaatgcagggcatcctgctgctggtgttcgccaagtaccagcacctgccctacatccagatcctgagcaccaagagcacccccaccggcctgttcggctactggctgagcatcgccaagaagcacgaccccctgctgagagagttccaggagggcagactgctgttcccccccacctacaagttcgacagaaacagcaacgactacgacaccagcgagaagaagagaaagcccgcctggaccgacagaatcctgtggagactgaagagacagccctgcgccggccccgacacccccatcccccccgccagccacttcagcctgagcctgagaggctacagcagccacatgacctacggcatcagcgaccacaagcccgtgagcggcaccttcgacctggagctgaagcccctggtgagcgcccccctgatcgtgctgatgcccgaggacctgtggaccgtggagaacgacatgatggtgagctacagcagcaccagcgacttccccagcagcccctgggactggatcggcctgtacaaggtgggcctgagagacgtgaacgactacgtgagctacgcctgggtgggcgacagcaaggtgagctgcagcgacaacctgaaccaggtgtacatcgacatcagcaacatccccaccaccgaggacgagttcctgctgtgctactacagcaacagcctgagaagcgtggtgggcatcagcagacccttccagatcccccccggcagcctgagagaggaccccctgggcgaggcccagccccagatctag

SEQ ID NO: 13395 - DNA, 375 bp, Artificial Sequence
  Description of Artificial Sequence: Synthetic coding sequence
atgaccggcagctgctgcggcagcaccttcagcagcctgagctacggcggcggctgctgccagccctgctgctgcagagacccctgctgctgcagacccgtgacctgccagaccaccgtgtgcagacccgtgacctgcgtgcccagatgcaccagacccatctgcgagccctgcagaagacccgtgtgctgcgacccctgcagcctgcaggagggctgctgcagacccatcacctgctgccccagcagctgcaccgccgtggtgtgcagaccctgctgctgggccaccacctgctgccagccccccgtgagcgtgcagagcccctgcggccagcccaccccctgcagcaccacctgcagaaccagcagctgctag

SEQ ID NO: 13396 - DNA, 927 bp, Artificial Sequence; identical to SEQ ID NO: 10182
  Description of Artificial Sequence: Synthetic coding sequence

SEQ ID NO: 13397 - DNA, 2943 bp, Artificial Sequence
  Description of Artificial Sequence: Synthetic coding sequence
atgaccgagggcagacactgccaggtgcacctgctggacgacagaagactggagctgctggtgcagcccaagctgctggccagagagctgctggacctggtggccagccacttcaacctgaaggagaaggagtacttcggcatcaccttcatcgacgacaccggccagcagaactggctgcagctggaccacagagtgctggaccacgacctgcccaagaagcccggccccaccatcctgcacttcgccgtgagattctacatcgagagcatcagcttcctgaaggacaagaccaccgtggagctgttcttcctgaacgccaaggcctgcgtgcacaagggccagatcgaggtggagagcgagaccatcttcaagctggccgccttcatcctgcagagccccaaggtgagcctgacccacgacgagaacgccagaaaggacctgaagaccctgcccgccttccccaccaagaccctgcaggagcaccccagcctggcctactgcgaggacagagtgatcgagcactacctgaagatcaagggcctgaccagaggccaggccgtggtgcagtacatgaagatcgtggaggccctgcccacctacggcgtgcactactacgccgtgaaggacaagcagggcctgccctggtggctgggcatcagctacaagggcatcggccagtacgacatccaggacaaggtgaagcccagaaagctgttccagtggaagcagctggagaacctgtacttcagagagaagaagttcgccgtggaggtgcacgaccccagaagaatcagcgtgagcagaagaaccttcggccagagcggcctgttcgtgcagacctggtacgccaacagcagcctgatcaagagcatctgggtgatggccatcagccagcaccagttctacctggacagaaagcagagcaaggccaagatccccagcgccagaagcctggacgagatcgccatggacctgaccgagaccggcacccagagagccagcaagctggtgaccctggagaccaagagccagttcatcatggccagcaacggcagcctgatcagcagcggcagccaggacagcgaggtgagcgaggagcagaagagagagaagatcctggagctgaagaagaaggagaagctgctgcaggagaagctgctgaagaaggtggaggagctgaagaagatctgcctgagagaggccgagctgaccggcaagatgcccaaggagtaccccctgaacatcggcgagaagcccccccaggtgagaagaagagtgggcaccgccttcaagctggacgacaacctgctgcccagcgaggaggaccccgccctgcaggagctggagagcaacttcctgatccagcagaagctggtggaggccgccaagaagctggccaacgagcccgacctgtgcaagaccgtgaagaagaagagaaagcaggactacaccgacgccatgaagaagctgcaggagatcgagaacgccatcaacgagtacagaatcagatgcggcaagaagcccagccagaaggccaccgtgctgcccgaggacatcatccccagcgagagcagcagcctgagcgacaccaccacctacgacgaccccagcgacgccttcaccttccccggccagagaagcagcagcgtgccccacagccccagaatcctgccccccaagagcctgggcatcgagagaatccacttcagaaagagcagcatcaacgagcagttcgtggacaccagacagagcagagagatgctgagcacccacagcagcccctacaagaccctggagagaagaccccagggcggcagaagcatgcccaccacccccgtgctgaccagaaacgcctacagcagcagccacctggagcccgagagcagcagccagcactgcagacagagaagcggcagcctggagagccagagccacctgctgagcgagatggacagcgacaagcccttcttcagcctgagcaagagccagagaagcagcagcaccgagatcctggacgacggcagcagctacaccagccagagcagcaccgagtactactgcgtgacccccgtgaccggcccctactacaccacccagaccctggacaccagaaccagaggcagaagaagaagcaagaagcagaacgtgagcaccagcaacagcggcagcatgcccaacctggcccagaaggacagcctgagaaacggcgtgtacagcaagagccaggagccccccagcagcagctactacatcgccggctacaccccctacgccgagtgcgacttctactacagcggcggctacgtgtacgagaacgacaccgagggccagtacagcgtgaaccccagctacagaagcagcgcccactacggctacgagagacagagagactacagcagaagcttccacgaggacgaggtggacagagtgccccacaacccctacgccaccctgagactgcccagaaaggccgccgccaagagcgagcacatcaccaagaacatccacaaggccctggtggccgagcacctgagaggctggtaccagagagccagcggccagaaggaccagggccacagcccccagaccagcttcgacagcgacagaggcagccagagatgcctgggcttcgccggcctgcaggtgccctgcagccccagcagcagagccagcagctacagcagcgtgagcagcaccaacgccagcggcaactggagaacccagctgaccatcggcctgagcgactacgagacccccgcccacagcagctacaccagctgctacggcaacgtgtacaaccccctgcccagccccagcagacagtacaccgagatcagccagctggacggcaccgacggcaaccagctggaggacaacctggagagcagcgagcagagactgttctggcacgaggacagcaagcccggcaccctggtgtag

SEQ ID NO: 13398 - DNA, 2979 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccagcacatgcagatgaccatccaggccctgcaggacgagctgagaatccagagagacctgaaccagctgttccagcaggacagcagcagcagaaccggcgagccctgcgtggccgagctgaccgaggagaacttccagagactgcacgccgagcacgagagacaggccaaggagctgttcctgctgagaaagaccctggaggagatggagctgagaatcgagacccagaagcagaccctgaacgccagagacgagagcatcaagaagctgctggagatgctgcagagcaagggcctgagcgccaaggccaccgaggaggaccacgagagaaccagaagactggccgaggccgagatgcacgtgcaccacctggagagcctgctggagcagaaggagaaggagaacagcatgctgagagaggagatgcacagaagattcgagaacgcccccgacagcgccaagaccaaggccctgcagaccgtgatcgagatgaaggacagcaagatcagcagcatggagagaggcctgagagacctggaggaggagatccagatgctgaagagcaacggcgccctgagcaccgaggagagagaggaggagatgaagcagatggaggtgtacagaagccacagcaagttcatgaagaacaagatcggccaggtgaagcaggagctgagcagaaaggacaccgagctgctggccctgcagaccaagctggagaccctgaccaaccagttcagcgacagcaagcagcacatcgaggtgctgaaggagagcctgaccgccaaggagcagagagccgccatcctgcagaccgaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagcctgaccagcagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggacagcctgagaaagaaggacgacagaatcgaggagctggaggaggccctgagagagagcgtgcagatcaccgccgagagagagatggtgctggcccaggaggagagcgccagaaccaacgccgagaagcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccaggacgaggaggagggcatctgggcctag

SEQ ID NO: 13399 - DNA, 3138 bp, Artificial Sequence
  Description of Artificial Sequence: Synthetic coding sequence
atgctgaccgtgcaggtgaagaccagcagcgccatcgagctgcccgacagcctggccttcctgtggatcatccccatgtggtactgcgagggcaaggagctggagaacagccccgacatccacatcgtgcaggccggcaacctgcacagcctgaccatcgccgaggccttcgaggaggacaccggcagatacagctgcttcgccagcaacatctacggcaccgacagcaccagcgccgagatctacatcgagggcgtgagcagcagcgacagcgagggcgaccccaacaaggaggagatgaacagaatccagaagcccaacgaggtgagcagcccccccaccaccagcgccgtgatcccccccgccgtgccccaggcccagcacctggtggcccagcccagagtggccaccatccagcagtgccagagccccaccaactacctgcagggcctggacggcaagcccatcatcgccgcccccgtgttcaccaagatgctgcagaacctgagcgccagcgagggccagctggtggtgttcgagtgcagagtgaagggcgcccccagccccaaggtggagtggtacagagagggcaccctgatcgaggacagccccgacttcagaatcctgcagaagagacccgtgtgcatggagcacatcgaggagatctgcaccctggtgatcgccgaggtgttcgccgaggacagcggctgcttcacctgcaccgccagcaacaagtacggcaccgtgagcagcatcgcccagctgcacgtgagaggcaacgaggacctgagcaacaacggcagcctgcacagcgccaacagcaccaccaacctggccgccatcgagccccagcccagccccccccacagcgagccccccagcgtggagcagccccccaagcccaagctggagggcgtgctggtgaaccacaacgagcccagaagcagcagcagaatcggcctgagagtgcacttcaacctgcccgaggacgacaagggcagcgaggccagcagcgaggccggcgtggtgaccaccagacagaccagacccgacagcttccaggagagattcaacggccaggccaccaagacccccgagcccagcagccccgtgaaggagcccccccccgtgctggccaagcccaagctggacagcacccagctgcagcagctgcacaaccaggtgctgctggagcagcaccagctgcagaaccccccccccagcagccccaaggagttccccttcagcatgaccgtgctgaacagcaacgccccccccgccgtgaccaccagcagcaagcaggtgaaggcccccagcagccagaccttcagcctggccagacccaagtacttcttccccagcaccaacaccaccgccgccaccgtggcccccagcagcagccccgtgttcaccctgagcagcaccccccagaccatccagagaaccgtgagcaaggagagcctgctggtgagccaccccagcgtgcagaccaagagccccggcggcctgagcatccagaacgagcccctgccccccggccccaccgagcccacccccccccccttcaccttcagcatccccagcggcaaccagttccagcccagatgcgtgagccccatccccgtgagccccaccagcagaatccagaaccccgtggccttcctgagcagcgtgctgcccagcctgcccgccatcccccccaccaacgccatgggcctgcccagaagcgcccccagcatgcccagccagggcctggccaagaagaacaccaagagcccccagcccgtgaacgacgacaacatcagagagaccaagaacgccgtgatcagagacctgggcaagaagatcaccttcagcgacgtgagacccaaccagcaggagtacaagatcagcagcttcgagcagagactgatgaacgagatcgagttcagactggagagaacccccgtggacgagagcgacgacgagatccagcacgacgagatccccaccggcaagtgcatcgcccccatcttcgacaagagactgaagcacttcagagtgaccgagggcagccccgtgaccttcacctgcaagatcgtgggcatccccgtgcccaaggtgtactggttcaaggacggcaagcagatcagcaagagaaacgagcactgcaagatgagaagagagggcgacggcacctgcagcctgcacatcgagagcaccaccagcgacgacgacggcaactacaccatcatggccgccaacccccagggcagaatcagctgcagcggccacctgatggtgcagagcctgcccatcagaagcagactgaccagcgccggccagagccacagaggcagaagcagagtgcaggagagagacaaggagcccctgcaggagagattcttcagaccccacttcctgcaggcccccggcgacatggtggcccacgagggcagactgtgcagactggactgcaaggtgagcggcctgcccccccccgagctgacctggctgctgaacggccagcccgtgctgcccgacgccagccacaagatgctggtgagagagaccggcgtgcacagcctgctgatcgaccccctgacccagagagacgccggcacctacaagtgcatcgccaccaacaagaccggccagaacagcttcagcctggagctgagcgtggtggccaaggaggtgaagaaggcccccgtgatcctggagaagctgcagaactgcggcgtgcccgagggccaccccgtgagactggagtgcagagtgatcggcatgcccccccccgtgttctactggaagaaggacaacgagaccatcccctgcaccagagagagaatcagcatgcaccaggacaccaccggctacgcctgcctgctgatccagcccgccaagaagagcgacgccggctggtacaccctgagcgccaagaacgaggccggcatcgtgagctgcaccgccagactggacatctacgcccagtggcaccaccagatccccccccccatgagcgtgagacccagcggcagcagatacggcagcctgaccagcaagggcctggacatcttcagcgccttcagcagcatggagagcaccatggtgtacagctgcagcagcagaagcgtggtggagagcgacgagctgtag

SEQ ID NO: 13400 - DNA, 72 bp, Artificial Sequence
  Description of Artificial Sequence: Synthetic coding sequence
gtgagactggcctggggcttcgtgagcgccctgggcagcttccacaccgccgaccccgagggcgccgcctag

SEQ ID NO: 13401 - DNA, 1608 bp, Artificial Sequence
  Description of Artificial Sequence: Synthetic coding sequence
atggaggcccccaccgtggagaccccccccgaccccagcccccccagcgcccccgcccccgccctggtgcccctgagagcccccgacgtggccagactgagagaggagcaggagaaggtggtgaccaactgccaggagagaatccagcactggaagaaggtggacaacgactacaacgccctgagagagagactgagcaccctgcccgacaagctgagctacaacatcatggtgcccttcggccccttcgccttcatgcccggcaagctggtgcacaccaacgaggtgaccgtgctgctgggcgacaactggttcgccaagtgcagcgccaagcaggccgtgggcctggtggagcacagaaaggagcacgtgagaaagaccatcgacgacctgaagaaggtgatgaagaacttcgagagcagagtggagttcaccgaggacctgcagaagatgagcgacgccgccggcgacatcgtggacatcagagaggagatcaagtgcgacttcgagttcaaggccaagcacagaatcgcccacaagccccacagcaagcccaagaccagcgacatcttcgaggccgacatcgccaacgacgtgaagagcaaggacctgctggccgacaaggagctgtgggccagactggaggagctggagagacaggaggagctgctgggcgagctggacagcaagcccgacaccgtgatcgccaacggcgaggacaccaccagcagcgaggaggagaaggaggacagaaacaccaacgtgaacgccatgcaccaggtgaccgacagccacaccccctgccacaaggacgtggccagcagcgagcccttcagcggccaggtgaacagccagctgaactgcagcgtgaacggcagcagcagctaccacagcgacgacgacgacgacgacgacgacgacgacgacgacgacaacatcgacgacgacgacggcgacaacgaccacgaggccctgggcgtgggcgacaacagcatccccaccatctacttcagccacaccgtggagcccaagagagtgagaatcaacaccggcaagaacaccaccctgaagttcagcgagaagaaggaggaggccaagagaaagagaaagaacagcaccggcagcggccacagcgcccaggagctgcccaccatcagaacccccgccgacatctacagagccttcgtggacgtggtgaacggcgagtacgtgcccagaaagagcatcctgaagagcagaagcagagagaacagcgtgtgcagcgacaccagcgagagcagcgccgccgagttcgacgacagaagaggcgtgctgagaagcatcagctgcgaggaggccacctgcagcgacaccagcgagagcatcctggaggaggagccccaggagaaccagaagaagctgctgcccctgagcgtgacccccgaggccttcagcggcaccgtgatcgagaaggagttcgtgagccccagcctgacccccccccccgccatcgcccaccccgccctgcccaccatccccgagagaaaggaggtgctgctggaggccagcgaggagaccggcaagagagtgagcaagttcaaggccgccagactgcagcagaaggactag

SEQ ID NO: 13402 - DNA, 1731 bp, Artificial Sequence
  Description of Artificial Sequence: Synthetic coding sequence
atggagggcctgagaagaagaagaggcagagaggccggccccccccagcccatggtgcccctggccgtggagaaccaggccggcggcgagggcgccggcggcgagctgggcatcagcctgaacatgtgcctgctgggcgccctggtgctgctgggcctgggcgtgctgctgttcagcggcggcctgagcgagagcgagaccggccccatggaggaggtggagagacaggtgctgcccgaccccgaggtgctggaggccgtgggcgacagacaggacggcctgagagagcagctgcaggcccccgtgccccccgacagcgtgcccagcctgcagaacatgggcctgctgctggacaagctggccaaggagaaccaggacatcagactgctgcaggcccagctgcaggcccagaaggaggagctgcagagcctgatgcaccagcccaagggcctggaggaggagaacgcccagctgagaggcgccctgcagcagggcgaggccttccagagagccctggagagcgagctgcagcagctgagagccagactgcagggcctggaggccgactgcgtgagaggccccgacggcgtgtgcctgagcggcggcagaggcccccagggcgacaaggccatcagagagcagggccccagagagcaggagcccgagctgagcttcctgaagcagaaggagcagctggaggccgaggcccaggccctgagacaggagctggagagacagagaagactgctgggcagcgtgcagcaggacctggagagaagcctgcaggacgccagcagaggcgaccccgcccacgccggcctggccgagctgggccacagactggcccagaagctgcagggcctggagaactggggccaggaccccggcgtgagcgccaacgccagcaaggcctggcaccagaagagccacttccagaacagcagagagtggagcggcaaggagaagtggtgggacggccagagagacagaaaggccgagcactggaagcacaagaaggaggagagcggcagagagagaaagaagaactggggcggccaggaggacagagagcccgccggcagatggaaggagggcagacccagagtggaggagagcggcagcaagaaggagggcaagagacagggccccaaggagccccccagaaagagcggcagcttccacagcagcggcgagaagcagaagcagcccagatggagagagggcaccaaggacagccacgaccccctgcccagctgggccgagctgctgagacccaagtacagagccccccagggctgcagcggcgtggacgagtgcgccagacaggagggcctgaccttcttcggcaccgagctggcccccgtgagacagcaggagctggccagcctgctgagaacctacctggccagactgccctgggccggccagctgaccaaggagctgcccctgagccccgccttcttcggcgaggacggcatcttcagacacgacagactgagattcagagacttcgtggacgccctggaggacagcctggaggaggtggccgtgcagcagaccggcgacgacgacgaggtggacgacttcgaggacttcatcttcagccacttcttcggcgacaaggccctgaagaagagaagcggcaagaaggacaagcacagccagagccccagagccgccggccccagagagggccacagccacagccaccaccaccaccacagaggctag

SEQ ID NO: 13403 - DNA, 2244 bp, Artificial Sequence
  Description of Artificial Sequence: Synthetic coding sequence
atggccaagtacaacaccggcggcaaccccaccgaggacgtgagcgtgaacagcagacccttcagagtgaccggccccaacagcagcagcggcatccaggccagaaagaacctgttcaacaaccagggcaacgccagcccccccgccggccccagcaacgtgcccaagttcggcagccccaagccccccgtggccgtgaagcccagcagcgaggagaagcccgacaaggagcccaagccccccttcctgaagcccaccggcgccggccagagattcggcacccccgccagcctgaccaccagagaccccgaggccaaggtgggcttcctgaagcccgtgggccccaagcccatcaacctgcccaaggaggacagcaagcccaccttcccctggccccccggcaacaagcccagcctgcacagcgtgaaccaggaccacgacctgaagcccctgggccccaagagcggccccaccccccccaccagcgagaacgagcagaagcaggccttccccaagctgaccggcgtgaagggcaagttcatgagcgccagccaggacctggagcccaagcccctgttccccaagcccgccttcggccagaagccccccctgagcaccgagaacagccacgaggacgagagccccatgaagaacgtgagcagcagcaagggcagccccgcccccctgggcgtgagaagcaagagcggccccctgaagcccgccagagaggacagcgagaacaaggaccacgccggcgagatcagcagcctgcccttccccggcgtggtgctgaagcccgccgccagcagaggcggccccggcctgagcaagaacggcgaggagaagaaggaggacagaaagatcgacgccgccaagaacaccttccagagcaagatcaaccaggaggagctggccagcggcaccccccccgccagattccccaaggcccccagcaagctgaccgtgggcggcccctggggccagagccaggagaaggagaagggcgacaagaacagcgccacccccaagcagaagcccctgccccccctgttcaccctgggcccccccccccccaagcccaacagaccccccaacgtggacctgaccaagttccacaagaccagcagcggcaacagcaccagcaagggccagaccagctacagcaccaccagcctgcccccccccccccccagccaccccgccagccagccccccctgcccgccagccaccccagccagccccccgtgcccagcctgccccccagaaacatcaagccccccttcgacctgaagagccccgtgaacgaggacaaccaggacggcgtgacccacagcgacgtggtgatccccctggaccacgagcaggacagcgagggcgagacctacgaggacatcgaggccagcaaggagagagagaagaagagagagaaggaggagaagaagagactggagctggagaagaaggagcagaaggagaaggagaagaaggagcaggagatcaagaagaagttcaagctgaccggccccatccaggtgatccacctggccaaggcctgctgcgacgtgaagggcggcaagaacgagctgagcttcaagcagggcgagcagatcgagatcatcagaatcaccgacaaccccgagggcaagtggctgggcagaaccgccagaggcagctacggctacatcaagaccaccgccgtggagatcgactacgacagcctgaagctgaagaaggacagcctgggcgcccccagcagacccatcgaggacgaccaggaggtgtacgacgacgtggccgagcaggacgacatcagcagccacagccagagcggcagcggcggcatcttcccccccccccccgacgacgacatctacgacggcatcgaggaggaggacgccgacgacggcagcaccctgcaggtgcaggagaagagcaacacctggagctggggcatcctgaagatgctgaagggcaaggacgacagaaagaagagcatcagagagaagcccaaggtgagcgacagcgacaacaacgagggcagcagcttccccgccccccccaagcagctggacatgggcgacgaggtgtacgacgacgtggacaccagcgacttccccgtgagcagcgccgagatgagccagggcaccaacgtgggcaaggccaagaccgaggagaaggacctgaagaagctgaagaagcaggagaaggaggagaaggacttcagaaagaagttcaagaagtag

SEQ ID NO: 13404 - DNA, 1566 bp, Artificial Sequence; identical to SEQ ID NO: 12539
  Description of Artificial Sequence: Synthetic coding sequence

SEQ ID NO: 13405 - DNA, 1710 bp, Artificial Sequence
  Description of Artificial Sequence: Synthetic coding sequence
atgctgagagacatgaccggcctgccccacaacagaaagtgcttcgactgcgaccagagaggccccacctacgtgaacatgaccgtgggcagcttcgtgtgcaccagctgcagcggcagcctgagaggcctgaaccccccccacagagtgaagagcatcagcatgaccaccttcacccagcaggagatcgagttcctgcagaagcacggcaacgaggtgtgcaagcagatctggctgggcctgttcgacgacagaagcagcgccatccccgacttcagagacccccagaaggtgaaggagttcctgcaggagaagtacgagaagaagagatggtacgtgccccccgagcaggccaaggtggtggccagcgtgcacgccagcatcagcggcagcagcgccagcagcaccagcagcacccccgaggtgaagcccctgaagagcctgctgggcgacagcgcccccaccctgcacctgaacaagggcacccccagccagagccccgtggtgggcagaagccagggccagcagcaggagaagaagcagttcgacctgctgagcgacctgggcagcgacatcttcgccgcccccgccccccagagcaccgccaccgccaacttcgccaacttcgcccacttcaacagccacgccgcccagaacagcgccaacgccgacttcgccaacttcgacgccttcggccagagcagcggcagcagcaacttcggcggcttccccaccgccagccacagccccttccagccccagaccaccgccttcagaatgctgagcagcagctgcagcttcggcgagttcaccagcgccttccccctgcaggccacccacagcggcagcgccgccagcgtgaacgccaacttcgcccacttcgacaacttccccaagagcagcagcgccgacttcggcaccttcaacaccagccagagccaccagaccgccagcgccgtgagcaaggtgagcaccaacaaggccggcctgcagaccgccgacaagtacgccgccctggccaacctggacaacatcttcagcgccggccagggcggcgaccagggcagcggcttcggcaccaccggcaaggcccccgtgggcagcgtggtgagcgtgcccagccagagcagcgccagcagcgacaagtacgccgccctggccgagctggacagcgtgttcagcagcgccgccaccagcagcaacgcctacaccagcaccagcaacgccagcagcaacgtgttcggcaccgtgcccgtggtggccagcgcccagacccagcccgccagcagcagcgtgcccgcccccttcggcgccacccccagcaccaaccccttcgtggccgccgccggccccagcgtggccagcagcaccaaccccttccagaccaacgccagaggcgccaccgccgccaccttcggcaccgccagcatgagcatgcccaccggcttcggcacccccgccccctacagcctgcccaccagcttcagcggcagcttccagcagcccgccttccccgcccaggccgccttcccccagcagaccgccttcagccagcagcccaacggcttcgccgccttcggccagaccaagcccgtggtgacccccttcggccaggtggccgccgccggcgtgagcagcaaccccttcatgaccggcgcccccaccggccagttccccaccggcagcagcagcaccaaccccttcctgtag

SEQ ID NO: 13406 - DNA, 2007 bp, Artificial Sequence
  Description of Artificial Sequence: Synthetic coding sequence
atgagcaagctggccgccgcccacagaggcgccatcagagccctgcagatgttcgtgacccagttcaccgacagaggcgagcaccccctgcccgccagatgcaaggagctgggcagcctgatcagacagctgagcctgtgcagcgtgaagctggacgccgaccccagcgtgcccgacgtggtgatcgacatcctgcagcagatcgaggccctggagagcctgctggagaagaagctgagccccaagaaggtgaagaagtgcttcagcgagatcagaagcagattccccatcggcagccagaaggccctggagagatggcccagcaccagccccaagggcgagagaagacccctgaccgccaaggacaccttcccccaggagaccagcagacccagcgtggccaagcagctgctggccgacaagtaccagcccgacaccgagctgcccgagacccagagactgcagagcgagctggacgtgctggacgccgacatcgtgctggaggagggccccttcatcctggaccagagcgccagcttcaaggacgaggtgctggccgtggccaagaccaaggccggcaagaagaagcccgtgaccgagaacgtgcccttcagaaagaaggacaccctggcccccgccagacagcagggcctgagaaaggccgagagaggcagacagagccagccccacagcaagagcagagtgcagcagaccaccgtgagcagcagactgaagatgaacagacagcccgtgaaggacagaaaggccccctggatcccccccaaccccaccagcccccccgccagccccaagtgcgccgcctggctgaaggtgaagaccagccccagagacgccaccaaggagcccctgcagcaggaggacccccaggaggagagccacctgaccggcgccgtggagcacgaggccgccagactggcctggctggacgccgagaccagcaagagactgaaggagctggaggagctgaaggccaaggagatcgacagcatgcagaagcagagactggactggctggacgccgagaccagcagaagaaccaaggagctgaacgagctgaaggccgaggagatgtacagactgcagcagctgagcgtgagcgccacccacctggccgacaaggtggaggaggccgtgctggacagactgaagcccctgctggtgaaggcccagagagtgaacagcaccaccgaggccaacatccacctgaaggacggcagcagcgtgaacaccgccaaggcccagcccgcccaggaggtggccgccgtggacttcgagagcaacaacatcagacagctggacgacttcctggaggactgcgccagcgagctgtgggccgtgacccacgccaagatcctgggcagcgagaccctggccaccgtggaggacagcaaggacagccccgacctggagatcatgatgagaagaatggaggagatggagaagtaccaggagagcgtgagacagagatacaacaagatcgcctacgccgaccccagactgtggatgcaggaggagaacaacgaccagaagatcagcgccatcagcgagaagcccctgagcccccaccccatcagaatcaccaagaccgtggacagaaaggaccccgccgtgaacatcatgctggagagaccctgcaacggcaacagcctggacgagagcgtgggcaccgaggagggcagcgagaagagagaggcccccctgctgagcctggccgaggacagccagcagaaggagggcagagcccccctgttcgtgccccccggcatgcagcacagcatcggcgactactgcagcagattcgagcagtacctgagaatcatcagccacgaggccgtgggcagcttcaacccctggctgatcgccgagagcttcagcgaggagctggtggacgaggccctgggcgccgtggccgccgagctgcaggacatgtgcgaggactacgccgaggccgtgttcaccagcgagttcctggaggccgccacctag

SEQ ID NO: 13407 - DNA, 3612 bp, Artificial Sequence
  Description of Artificial Sequence: Synthetic coding sequence
atgcccgccagaatcggctactacgagatcgacagaaccatcggcaagggcaacttcgccgtggtgaagagagccacccacctggtgaccaaggccaaggtggccatcaagatcatcgacaagacccagctggacgaggagaacctgaagaagatcttcagagaggtgcagatcatgaagatgctgtgccacccccacatcatcagactgtaccaggtgatggagaccgagagaatgatctacctggtgaccgagtacgccagcggcggcgagatcttcgaccacctggtggcccacggcagaatggccgagaaggaggccagaagaaagttcaagcagatcgtgaccgccgtgtacttctgccactgcagaaacatcgtgcacagagacctgaaggccgagaacctgctgctggacgccaacctgaacatcaagatcgccgacttcggcttcagcaacctgttcacccccggccagctgctgaagacctggtgcggcagccccccctacgccgcccccgagctgttcgagggcaaggagtacgacggccccaaggtggacatctggagcctgggcgtggtgctgtacgtgctggtgtgcggcgccctgcccttcgacggcagcaccctgcagaacctgagagccagagtgctgagcggcaagttcagaatccccttcttcatgagcaccgagtgcgagcacctgatcagacacatgctggtgctggaccccaacaagagactgagcatggagcagatctgcaagcacaagtggatgaagctgggcgacgccgaccccaacttcgacagactgatcgccgagtgccagcagctgaaggaggagagacaggtggaccccctgaacgaggacgtgctgctggccatggaggacatgggcctggacaaggagcagaccctgcaggccgagcaggccggcaccgccatgaacatcagcgtgccccaggtgcagctgatcaaccccgagaaccagatcgtggagcccgacggcaccctgaacctggacagcgacgagggcgaggagcccagccccgaggccctggtgagatacctgagcatgagaagacacaccgtgggcgtggccgaccccagaaccgaggtgatggaggacctgcagaagctgctgcccggcttccccggcgtgaacccccaggcccccttcctgcaggtggcccccaacgtgaacttcatgcacaacctgctgcccatgcagaacctgcagcccaccggccagctggagtacaaggagcagagcctgctgcagccccccaccctgcagctgctgaacggcatgggccccctgggcagaagagccagcgacggcggcgccaacatccagctgcacgcccagcagctgctgaagagacccagaggccccagccccctggtgaccatgacccccgccgtgcccgccgtgacccccgtggacgaggagagcagcgacggcgagcccgaccaggaggccgtgcagagatacctggccaacagaagcaagagacacaccctggccatgaccaaccccaccgccgagatcccccccgacctgcagagacagctgggccagcagcccttcagaagcagagtgtggcccccccacctggtgcccgaccagcacagaagcacctacaaggacagcaacaccctgcacctgcccaccgagagattcagccccgtgagaagattcagcgacggcgccgccagcatccaggccttcaaggcccacctggagaagatgggcaacaacagcagcatcaagcagctgcagcaggagtgcgagcagctgcagaagatgtacggcggccagatcgacgagagaaccctggagaagacccagcagcagcacatgctgtaccagcaggagcagcaccaccagatcctgcagcagcagatccaggacagcatctgccccccccagcccagcccccccctgcaggccgcctgcgagaaccagcccgccctgctgacccaccagctgcagagactgagaatccagcccagcagccccccccccaaccaccccaacaaccacctgttcagacagcccagcaacagccccccccccatgagcagcgccatgatccagccccacggcgccgccagcagcagccagttccagggcctgcccagcagaagcgccatcttccagcagcagcccgagaactgcagcagcccccccaacgtggccctgacctgcctgggcatgcagcagcccgcccagagccagcaggtgaccatccaggtgcaggagcccgtggacatgctgagcaacatgcccggcaccgccgccggcagcagcggcagaggcatcagcatcagccccagcgccggccagatgcagatgcagcacagaaccaacctgatggccaccctgagctacggccacagacccctgagcaagcagctgagcgccgacagcgccgaggcccacagcgcccaccagcagcccccccactacaccaccagcgccctgcagcaggccctgctgagccccaccccccccgactacaccagacaccagcaggtgccccacatcctgcagggcctgctgagccccagacacagcctgaccggccacagcgacatcagactgccccccaccgagttcgcccagctgatcaagagacagcagcagcagagacagcagcagcagcagcagcagcagcagcaggagtaccaggagctgttcagacacatgaaccagggcgacgccggcagcctggcccccagcctgggcggccagagcatgaccgagagacaggccctgagctaccagaacgccgacagctaccaccaccacaccagcccccagcacctgctgcagatcagagcccaggagtgcgtgagccaggccagcagccccacccccccccacggctacgcccaccagcccgccctgatgcacagcgagagcatggaggaggactgcagctgcgagggcgccaaggacggcttccaggacagcaagagcagcagcaccctgaccaagggctgccacgacagccccctgctgctgagcaccggcggccccggcgaccccgagagcctgctgggcaccgtgagccacgcccaggagctgggcatccacccctacggccaccagcccaccgccgccttcagcaagaacaaggtgcccagcagagagcccgtgatcggcaactgcatggacagaagcagccccggccaggccgtggagctgcccgaccacaacggcctgggctaccccgccagacccagcgtgcacgagcaccacagacccagagccctgcagagacaccacaccatccagaacagcgacgacgcctacgtgcagctggacaacctgcccggcatgagcctggtggccggcaaggccctgagcagcgccagaatgagcgacgccgtgctgagccagagcagcctgatgggcagccagcagttccaggacggcgagaacgaggagtgcggcgccagcctgggcggccacgagcaccccgacctgagcgacggcagccagcacctgaacagcagctgctaccccagcacctgcatcaccgacatcctgctgagctacaagcaccccgaggtgagcttcagcatggagcaggccggcgtgtag

SEQ ID NO: 13408 - DNA, 2046 bp, Artificial Sequence
  Description of Artificial Sequence: Synthetic coding sequence
atgatcgagaagatgcagggcagcagaatggacgagcagagatgcagcttccccccccccctgaagaccgaggaggactacatcccctaccccagcgtgcacgaggtgctgggcagagagggccccttccccctgatcctgctgccccagttcggcggctactggatcgagggcaccaaccacgagatcaccagcatccccgagaccgagcccctgcagagccccaccaccaaggtgaagctggagtgcaaccccaccgccagaatctacagaaagcacttcctgggcaaggagcacttcaactactacagcctggacgccgccctgggccacctggtgttcagcctgaagtacgacgtgatcggcgaccaggagcacctgagactgctgctgagaaccaagtgcagaacctaccacgacgtgatccccatcagctgcctgaccgagttccccaacgtggtgcagatggccaagctggtgtgcgaggacgtgaacgtggacagattctaccccgtgctgtaccccaaggccagcagactgatcgtgaccttcgacgagcacgtgatcagcaacaacttcaagttcggcgtgatctaccagaagctgggccagaccagcgaggaggagctgttcagcaccaacgaggagagccccgccttcgtggagttcctggagttcctgggccagaaggtgaagctgcaggacttcaagggcttcagaggcggcctggacgtgacccacggccagaccggcaccgagagcgtgtactgcaacttcagaaacaaggagatcatgttccacgtgagcaccaagctgccctacaccgagggcgacgcccagcagctgcagagaaagagacacatcggcaacgacatcgtggccgtggtgttccaggacgagaacacccccttcgtgcccgacatgatcgccagcaacttcctgcacgcctacgtggtggtgcaggccgagggcggcggccccgacggccccctgtacaaggtgagcgtgaccgccagagacgacgtgcccttcttcggcccccccctgcccgaccccgccgtgttcagaaagggccccgagttccaggagttcctgctgaccaagctgatcaacgccgagtacgcctgctacaaggccgagaagttcgccaagctggaggagagaaccagagccgccctgctggagaccctgtacgaggagctgcacatccacagccagagcatgatgggcctgggcggcgacgaggacaagatggagaacggcagcggcggcggcggcttcttcgagagcttcaagagagtgatcagaagcagaagccagagcatggacgccatgggcctgagcaacaagaagcccaacaccgtgagcaccagccacagcggcagcttcgcccccaacaaccccgacctggccaaggccgccggcatcagcctgctgatccccggcaagagcgccagcagattcggcagaagaggcagcgccatcggcatcggcaccgtggaggagagcctgatcgtgcccggcaagagccccaccagaaagaagagcggccccttcggcagcagaagaagcagcgccatcggcatcgagaacatccaggaggtgcaggagaagagagagagcccccccgccggccagaagacccccgacagcggccacgtgagccaggagcccaagagcgagaacagcagcacccagagcagccccgagatgcccaccaccaagaacagagccgagaccgccgcccagagagccgaggccctgaaggacttcagcagaagcagcagcagcgccagcagcttcgccagcgtggtggaggagaccgagggcgtggacggcgaggacaccggcctggagagcgtgagcagcagcggcaccccccacaagagagacagcttcatctacagcacctggctggaggacagcgtgagcaccaccagcggcggcagcagccccgacgccggcaagctgggcgaccccgcctgccccgagatcaagatccagctggaggccagcgagcagcacatgccccagctgggctgctag

SEQ ID NO: 13409 - DNA, 675 bp, Artificial Sequence
  Description of Artificial Sequence: Synthetic coding sequence
atgagcgtgggctacgccaacggcatcagagtgatgagcatgacccacaccggcgagcccggcttcatgctgtacatccccatcgagtacgccctgcacgtgtacaacgaggtgatgagcgtgggccagaagtacggcatcagaaacgccggctactacgccctgagaagcctgagaatcgagaagttcttcgccttctggggccaggacatcaacaacctgaccacccccctggagtgcggcagagagagcagagtgaagctggagaagggcatggacttcatcggcagagacgccctgctgcagcagaagcagaacggcgtgtacaagagactgaccatgttcatcctggacgaccacgacagcgacctggacctgtggccctggtggggcgagcccatctacagaaacggccagtacgtgggcaagaccaccagcagcgcctacagctacagcctggagagacacgtgtgcctgggcttcgtgcacaacttcagcgaggacaccggcgaggagcaggtggtgaccgccgacttcatcaacagaggcgagtacgagatcgacatcgccggctacagattccaggccaaggccaagctgtaccccgtggccagcctgttcacccagaagagaagaaaggacgacatggagctgagcgacctgcacggcaagtag

SEQ ID NO: 13410 - DNA, 1590 bp, Artificial Sequence
  Description of Artificial Sequence: Synthetic coding sequence
atgcacttcagcggcctggaggaggccgtgtacagaaacatccaggcctgcaaggagctggcccagaccaccagaaccgcctacggccccaacggcatgaacaagatggtgatcaaccacctggagaagctgttcgtgaccaacgacgccgccaccatcctgagagagctggaggtgcagcaccccgccgccaagatgatcgtgatggccagccacatgcaggagcaggaggtgggcgacggcaccaacttcgtgctggtgttcgccggcgccctgctggagctggccgaggagctgctgagaatcggcctgagcgtgagcgaggtgatcgagggctacgagatcgcctgcagaaaggcccacgagatcctgcccaacctggtgtgctgcagcgccaagaacctgagagacatcgacgaggtgagcagcctgctgagaaccagcatcatgagcaagcagtacggcaacgaggtgttcctggccaagctgatcgcccaggcctgcgtgagcatcttccccgacagcggccacttcaacgtggacaacatcagagtgtgcaagatcctgggcagcggcatcagcagcagcagcgtgctgcacggcatggtgttcaagaaggagaccgagggcgacgtgaccagcgtgaaggacgccaagatcgccgtgtacagctgccccttcgacggcatgatcaccgagaccaagggcaccgtgctgatcaagaccgccgaggagctgatgaacttcagcaagggcgaggagaacctgatggacgcccaggtgaaggccatcgccgacaccggcgccaacgtggtggtgaccggcggcaaggtggccgacatggccctgcactacgccaacaagtacaacatcatgctggtgagactgaacagcaagtgggacctgagaagactgtgcaagaccgtgggcgccaccgccctgcccagactgaccccccccgtgctggaggagatgggccactgcgacagcgtgtacctgagcgaggtgggcgacacccaggtggtggtgttcaagcacgagaaggaggacggcgccatcagcaccatcgtgctgagaggcagcaccgacaacctgatggacgacatcgagagagccgtggacgacggcgtgaacaccttcaaggtgctgaccagagacaagagactggtgcccggcggcggcgccaccgagatcgagctggccaagcagatcaccagctacggcgagacctgccccggcctggagcagtacgccatcaagaagttcgccgaggccttcgaggccatccccagagccctggccgagaacagcggcgtgaaggccaacgaggtgatcagcaagctgtacgccgtgcaccaggagggcaacaagaacgtgggcctggacatcgaggccgaggtgcccgccgtgaaggacatgctggaggccggcatcctggacacctacctgggcaagtactgggccatcaagctggccaccaacgccgccgtgaccgtgctgagagtggaccagatcatcatggccaagcccgccggcggccccaagccccccagcggcaagaaggactgggacgacgaccagaacgactag

SEQ ID NO: 13411 - DNA, 2193 bp, Artificial Sequence; identical to SEQ ID NO: 9353
  Description of Artificial Sequence: Synthetic coding sequence

SEQ ID NO: 13412 - DNA, 2271 bp, Artificial Sequence
  Description of Artificial Sequence: Synthetic coding sequence
atggtggcccccgtgctggagaccagccacgtgttctgctgccccaacagagtgagaggcgtgctgaactggagcagcggccccagaggcctgctggccttcggcaccagctgcagcgtggtgctgtacgaccccctgaagagagtggtggtgaccaacctgaacggccacaccgccagagtgaactgcatccagtggatctgcaagcaggacggcagccccagcaccgagctggtgagcggcggcagcgacaaccaggtgatccactgggagatcgaggacaaccagctgctgaaggccgtgcacctgcagggccacgagggccccgtgtacgccgtgcacgccgtgtaccagagaagaaccagcgaccccgccctgtgcaccctgatcgtgagcgccgccgccgacagcgccgtgagactgtggagcaagaagggccccgaggtgcccatcctggcctgcggcaacgacgactgcagaatccacatcttcgcccagcagaacgaccagttccagaaggtgctgagcctgtgcggccacgaggactggatcagaggcgtggagtgggccgccttcggcagagacctgttcctggccagctgcagccaggactgcctgatcagaatctggaagctgtacatcaagagcaccagcctggagacccaggacgacgacaacatcagactgaaggagaacaccttcaccatcgagaacgagagcgtgaagatcgccttcgccgtgaccctggagaccgtgctggccggccacgagaactgggtgaacgccgtgcactggcagcccgtgttctacaaggacggcgtgctgcagcagcccgtgagactgctgagcgccagcatggacaagaccatgatcctgtgggcccccgacgaggagagcggcgtgtggctggagcagagagagtggacccccgagatcgtgatcagcggccacttcgacggcgtgcaggacctggtgtgggaccccgagggcgagttcatcatcaccgtgggcaccgaccagaccaccagactgttcgccccctggaagagaaaggaccagagccaggtgacctggcacgagatcgccagaccccagatccacggctacgacctgaagtgcctggccatgatcaacagattccagttcgtgagcggcgccgacgagaaggtgctgagagtgttcagcgcccccagaaacttcgtggagaacttctgcgccatcaccggccagagcctgaaccacgtgctgtgcaaccaggacagcgacctgcccgagggcgccaccgtgcccgccctgggcctgagcaacaaggccgtgttccagggcgacatcgccagccagcccagcgacgaggaggagctgctgaccagcaccggcttcgagtaccagcaggtggccttccagcccagcatcctgaccgagccccccaccgaggaccacctgctgcagaacaccctgtggcccgaggtgcagaagctgtacggccacggctacgagatcttctgcgtgacctgcaacagcagcaagaccctgctggccagcgcctgcaaggccgccaagaaggagcacgccgccatcatcctgtggaacaccaccagctggaagcaggtgcagaacctggtgttccacagcctgaccgtgacccagatggccttcagccccaacgagaagttcctgctggccgtgagcagagacagaacctggagcctgtggaagaagcaggacaccatcagccccgagttcgagcccgtgttcagcctgttcgccttcaccaacaagatcaccagcgtgcacagcagaatcatctggagctgcgactggagccccgacagcaagtacttcttcaccggcagcagagacaagaaggtggtggtgtggggcgagtgcgacagcaccgacgactgcatcgagcacaacatcggcccctgcagcagcgtgctggacgtgggcggcgccgtgaccgccgtgagcgtgtgccccgtgctgcaccccagccagagatacgtggtggccgtgggcctggagtgcggcaagatctgcctgtacacctggaagaagaccgaccaggtgcccgagatcaacgactggacccactgcgtggagaccagccagagccagagccacaccctggccatcagaaagctgtgctggaagaactgcagcggcaagaccgagcagaaggaggccgagggcgccgagtggctgcacttcgccagctgcggcgaggaccacaccgtgaagatccacagagtgaacaagtgcgccctgtag

SEQ ID NO: 13413 - DNA, 1272 bp, Artificial Sequence
  Description of Artificial Sequence: Synthetic coding sequence
atgaacagacagcccgtgaaggacagaaaggccccctggatcccccccaaccccaccagcccccccgccagccccaagtgcgccgcctggctgaaggtgaagaccagccccagagacgccaccaaggagcccctgcagcaggaggacccccaggaggagagccacctgaccggcgccgtggagcacgaggccgccagactggcctggctggacgccgagaccagcaagagactgaaggagctggaggagctgaaggccaaggagatcgacagcatgcagaagcagagactggactggctggacgccgagaccagcagaagaaccaaggagctgaacgagctgaaggccgaggagatgtacagactgcagcagctgagcgtgagcgccacccacctggccgacaaggtggaggaggccgtgctggacagactgaagcccctgctggtgaaggcccagagagtgaacagcaccaccgaggccaacatccacctgaaggacggcagcagcgtgaacaccgccaaggcccagcccgcccaggaggtggccgccgtggacttcgagagcaacaacatcagacagctggacgacttcctggaggactgcgccagcgagctgtgggccgtgacccacgccaagatcctgggcagcgagaccctggccaccgtggaggacagcaaggacagccccgacctggagatcatgatgagaagaatggaggagatggagaagtaccaggagagcgtgagacagagatacaacaagatcgcctacgccgaccccagactgtggatgcaggaggagaacaacgaccagaagatcagcgccatcagcgagaagcccctgagcccccaccccatcagaatcaccaagaccgtggacagaaaggaccccgccgtgaacatcatgctggagagaccctgcaacggcaacagcctggacgagagcgtgggcaccgaggagggcagcgagaagagagaggcccccctgctgagcctggccgaggacagccagcagaaggagggcagagcccccctgttcgtgccccccggcatgcagcacagcatcggcgactactgcagcagattcgagcagtacctgagaatcatcagccacgaggccgtgggcagcttcaacccctggctgatcgccgagagcttcagcgaggagctggtggacgaggccctgggcgccgtggccgccgagctgcaggacatgtgcgaggactacgccgaggccgtgttcaccagcgagttcctggaggccgccacctag

SEQ ID NO: 13414 - DNA, 777 bp, Artificial Sequence
  Description of Artificial Sequence: Synthetic coding sequence
atggccagactgcaggaggagcacggcgaccagctgctgagcatcagatgccagcaccaggagcaggtggaggacctgaccgccagccacgacgccgccctgctggagatggagaacaaccacaccgtggccatcaccatcctgcaggacgaccacgaccacaaggtgcaggagctgatgagcacccacgagctggagaagaaggagctggaggagaacttcgagaagctgagactgagcctgcaggaccaggtggacaccctgaccttccagagccagagcctgagagacagagccagaagattcgaggaggccctgagaaagaacaccgaggagcagctggagatcgccctggccccctaccagcacctggaggaggacatgaagagcctgaagcaggtgctggagatgaagaaccagcagatccacgagcaggagaagaagatcctggagctggagaagctggccgagaagaacatcatcctggaggagaagatccaggtgctgcagcagcagaacgaggacctgaaggccagaatcgaccagaacaccgtggtgaccagacagctgagcgaggagaacgccaacctgcaggagtacgtggagaaggagacccaggagaagaagagactgagcagaaccaacgaggagctgctgtggaagctgcagaccggcgaccccaccagccccatcaagctgagccccaccagccccgtgtacagaggcagcagcagcggccccagcagccccgccagagtgagcaccacccccagatag

SEQ ID NO: 13415 - DNA, 1053 bp, Artificial Sequence
  Description of Artificial Sequence: Synthetic coding sequence
atgtgccccaccaccacctggcccagaggcagaagatggagcagaaacctgagagacacccaggccgtgagacactacaagatctggagaagagccggcggcagactgcacctgaacgaggccgtgagcttcctgagcctgcccgagctggtgaactaccacagagcccagagcctgagccacggcctgagactggccgccccctgcagaaagcacgagcccgagcccctgccccactgggacgactgggagagacccagagaggagttcaccctgtgcagaaagctgggcagcggctacttcggcgaggtgttcgagggcctgtggaaggacagagtgcaggtggccatcaaggtgatcagcagagacaacctgctgcaccagcagatgctgcagagcgagatccaggccatgaagaagctgagacacaagcacatcctggccctgtacgccgtggtgagcgtgggcgaccccgtgtacatcatcaccgagctgatggccaagggcagcctgctggagctgctgagagacagcgacgagaaggtgctgcccgtgagcgagctgctggacatcgcctggcaggtggccgagggcatgtgctacctggagagccagaactacatccacagagacctggccgccagaaacatcctggtgggcgagaacaccctgtgcaaggtgggcgacttcggcctggccagactgatcaaggaggacgtgtacctgagccacgaccacaacatcccctacaagtggaccgcccccgaggccctgagcagaggccactacagcaccaagagcgacgtgtggagcttcggcatcctgctgcacgagatgttcagcagaggccaggtgccctaccccggcatgagcaaccacgaggccttcctgagagtggacgccggctacagaatgccctgccccctggagtgcccccccagcgtgcacaagctgatgctgacctgctggtgcagagaccccgagcagagaccctgcttcaaggccctgagagagagactgagcagcttcaccagctacgagaaccccacctag

SEQ ID NO: 13416 - DNA, 3480 bp, Artificial Sequence
  Description of Artificial Sequence: Synthetic coding sequence
atggtgagcagcagccccagcacccccagcaacatcccccagaagcccagccagcccgccgccaaggagcccagcgccaccccccccatcagcaacctgaccaagaccgccagcgagagcatcagcaacctgagcgaggccggcagcatcaagaagggcgagagagagctgaagatcggcgacagagtgctggtgggcggcaccaaggccggcgtggtgagattcctgggcgagaccgacttcgccaagggcgagtggtgcggcgtggagctggacgagcccctgggcaagaacgacggcgccgtggccggcaccagatacttccagtgccagcccaagtacggcctgttcgcccccgtgcacaaggtgaccaagatcggcttccccagcaccacccccgccaaggccaaggccaacgccgtgagaagagtgatggccaccaccagcgccagcctgaagagaagccccagcgccagcagcctgagcagcatgagcagcgtggccagcagcgtgagcagcagacccagcagaaccggcctgctgaccgagaccagcagcagatacgccagaaagatcagcggcaccaccgccctgcaggaggccctgaaggagaagcagcagcacatcgagcagctgctggccgagagagacctggagagagccgaggtggccaaggccaccagccacgtgggcgagatcgagcaggagctggccctggccagagacggccacgaccagcacgtgctggagctggaggccaagatggaccagctgagaaccatggtggaggccgccgacagagagaaggtggagctgctgaaccagctggaggaggagaagagaaaggtggaggacctgcagttcagagtggaggaggagagcatcaccaagggcgacctggagacccagaccaagctggagcacgccagaatcaaggagctggagcagagcctgctgttcgagaagaccaaggccgacaagctgcagagagagctggaggacaccagagtggccaccgtgagcgagaagagcagaatcatggagctggagaaggacctggccctgagagtgcaggaggtggccgagctgagaagaagactggagagcaacaagcccgccggcgacgtggacatgagcctgagcctgctgcaggagatcagcagcctgcaggagaagctggaggtgaccagaaccgaccaccagagagagatcaccagcctgaaggagcacttcggcgccagagaggagacccaccagaaggagatcaaggccctgtacaccgccaccgagaagctgagcaaggagaacgagagcctgaagagcaagctggagcacgccaacaaggagaacagcgacgtgatcgccctgtggaagagcaagctggagaccgccatcgccagccaccagcaggccatggaggagctgaaggtgagcttcagcaagggcctgggcaccgagaccgccgagttcgccgagctgaagacccagatcgagaagatgagactggactaccagcacgagatcgagaacctgcagaaccagcaggacagcgagagagccgcccacgccaaggagatggaggccctgagagccaagctgatgaaggtgatcaaggagaaggagaacagcctggaggccatcagaagcaagctggacaaggccgaggaccagcacctggtggagatggaggacaccctgaacaagctgcaggaggccgagatcaagaaggagaagttcgccgaggccagcgaggaggccgtgagcgtgcagagaagcatgcaggagaccgtgaacaagctgcaccagaaggaggagcagttcaacatgctgagcagcgacctggagaagctgagagagaacctggccgacatggaggccaagttcagagagaaggacgagagagaggagcagctgatcaaggccaaggagaagctggagaacgacatcgccgagatcatgaagatgagcggcgacaacagcagccagctgaccaagatgaacgacgagctgagactgaaggagagagacgtggaggagctgcagctgaagctgaccaaggccaacgagaacgccagcttcctgcagaagagcatcgaggacatgaccgtgaaggccgagcagagccagcaggaggccgccaagaagcacgaggaggagaagaaggagctggagagaaagctgagcgacctggagaagaagatggagaccagccacaaccagtgccaggagctgaaggccagatacgagagagccaccagcgagaccaagaccaagcacgaggagatcctgcagaacctgcagaagaccctgctggacaccgaggacaagctgaagggcgccagagaggagaacagcggcctgctgcaggagctggaggagctgagaaagcaggccgacaaggccaaggccgcccagaccgccgaggacgccatgcagatcatggagcagatgaccaaggagaagaccgagaccctggccagcctggaggacaccaagcagaccaacgccaagctgcagaacgagctggacaccctgaaggagaacaacctgaagaacgtggaggagctgaacaagagcaaggagctgctgaccgtggagaaccagaagatggaggagttcagaaaggagatcgagaccctgaagcaggccgccgcccagaagagccagcagctgagcgccctgcaggaggagaacgtgaagctggccgaggagctgggcagaagcagagacgaggtgaccagccaccagaagctggaggaggagagaagcgtgctgaacaaccagctgctggagatgaagaagagagagagcaagttcatcaaggacgccgacgaggagaaggccagcctgcagaagagcatcagcatcaccagcgccctgctgaccgagaaggacgccgagctggagaagctgagaaacgaggtgaccgtgctgagaggcgagaacgccagcgccaagagcctgcacagcgtggtgcagaccctggagagcgacaaggtgaagctggagctgaaggtgaagaacctggagctgcagctgaaggagaacaagagacagctgagcagcagcagcggcaacaccgacacccaggccgacgaggacgagagagcccaggagagccagaaccagatcgacttcctgaacagcgtgatcgtggacctgcagagaaagaaccaggacctgaagatgaaggtggagatgatgagcgaggccgccctgaacggcaacggcgacgacctgaacaactacgacagcgacgaccaggagaagcagagcaagaagaagcccagactgttctgcgacatctgcgactgcttcgacctgcacgacaccgaggactgccccacccaggcccagatgagcgaggaccccccccacagcacccaccacggcagcagaggcgaggagagaccctactgcgagatctgcgagatgttcggccactgggccaccaactgcaacgacgacgagaccttctag

SEQ ID NO: 13417 - DNA, 756 bp, Artificial Sequence
  Description of Artificial Sequence: Synthetic coding sequence
atgaccaccgagcagagaagaagcctgcaggccttccaggactacatcagaaagaccctggaccccacctacatcctgagctacatggccccctggttcagagaggaggaggtgcagtacatccaggccgagaagaacaacaagggccccatggaggccgccaccctgttcctgaagttcctgctggagctgcaggaggagggctggttcagaggcttcctggacgccctggaccacgccggctacagcggcctgtacgaggccatcgagagctgggacttcaagaagatcgagaagctggaggagtacagactgctgctgaagagactgcagcccgagttcaagaccagaatcatccccaccgacatcatcagcgacctgagcgagtgcctgatcaaccaggagtgcgaggagatcctgcagatctgcagcaccaagggcatgatggccggcgccgagaagctggtggagtgcctgctgagaagcgacaaggagaactggcccaagaccctgaagctggccctggagaaggagagaaacaagttcagcgagctgtggatcgtggagaagggcatcaaggacgtggagaccgaggacctggaggacaagatggagaccagcgacatccagatcttctaccaggaggaccccgagtgccagaacctgagcgagaacagctgcccccccagcgaggtgagcgacaccaacctgtacagccccttcaagcccatcaagaagaagaagaagaagaagtag

SEQ ID NO: 13418 - DNA, 3189 bp, Artificial Sequence; identical to SEQ ID NO: 12499
  Description of Artificial Sequence: Synthetic coding sequence

SEQ ID NO: 13419 - DNA, 363 bp, Artificial Sequence
  Description of Artificial Sequence: Synthetic coding sequence
atgtggagcatcgagaacatcgccttcggcagcggcggcggcctgctgcagaagctgaccagagacctgctgaactgcagcttcaagtgcagctacgtggtgaccaacggcctgggcatcaacgtgttcaaggaccccgtggccgaccccaacaagagaagcaagaagggcagactgagcctgcacagaacccccgccggcaacttcgtgaccctggaggagggcaagggcgacctggaggagtacggccaggacctgctgcacaccgtgttcaagaacggcaaggtgaccaagagctacagcttcgacgagatcagaaagaacgcccagctgaacatcgagctggaggccgcccaccactag

SEQ ID NO: 13420 - DNA, 936 bp, Artificial Sequence
  Description of Artificial Sequence: Synthetic coding sequence
atgtaccacctggacaaccaccccgagaagcagttcagcaccgacgtgctgaagcaggccatcgagctgagccccgacaaccagtacgtgaaggtgctgctgggcctgaagctgcagaagatgaacaaggaggccgagggcgagcagttcgtggaggaggccctggagaagagcccctgccagaccgacgtgctgagaagcgccgccaagttctacagaagaaagggcgacctggacaaggccatcgagctgttccagagagtgctggagagcacccccaacaacggctacctgtaccaccagatcggctgctgctacaaggccaaggtgagacagatgcagaacaccggcgagagcgaggccagcggcaacaaggagatgatcgaggccctgaagcagtacgccatggactacagcaacaaggccctggagaagggcctgaaccccctgaacgcctacagcgacctggccgagttcctggagaccgagtgctaccagacccccttcaacaaggaggtgcccgacgccgagaagcagcagagccaccagagatactgcaacctgcagaagtacaacggcaagagcgaggacaccgccgtgcagcacggcctggagggcctgagcatcagcaagaagagcaccgacaaggaggagatcaaggaccagccccagaacgtgagcgagaacctgctgccccagaacgcccccaactactggtacctgcagggcctgatccacaagcagaacggcgacctgctgcaggccgccaagtgctacgagaaggagctgggcagactgctgagagacgcccccagcggcatcggcagcatcttcctgagcgccagcgagctggaggacggcagcgaggagatgggccagggcgccgtgagcagcagccccagagagctgctgagcaacagcgagcagctgaactag

SEQ ID NO: 13421 - DNA, 3267 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccagcacatgcagatgaccatccaggccctgcaggacgagctgagaatccagagagacctgaaccagctgttccagcaggacagcagcagcagaaccggcgagccctgcgtggccgagctgaccgaggagaacttccagagactgcacgccgagcacgagagacaggccaaggagctgttcctgctgagaaagaccctggaggagatggagctgagaatcgagacccagaagcagaccctgaacgccagagacgagagcatcaagaagctgctggagatgctgcagagcaagggcctgagcgccaaggccaccgaggaggaccacgagagaaccagaagactggccgaggccgagatgcacgtgcaccacctggagagcctgctggagcagaaggagaaggagaacagcatgctgagagaggagatgcacagaagattcgagaacgcccccgacagcgccaagaccaaggccctgcagaccgtgatcgagatgaaggacagcaagatcagcagcatggagagaggcctgagagacctggaggaggagatccagatgctgaagagcaacggcgccctgagcaccgaggagagagaggaggagatgaagcagatggaggtgtacagaagccacagcaagttcatgaagaacaagatcggccaggtgaagcaggagctgagcagaaaggacaccgagctgctggccctgcagaccaagctggagaccctgaccaaccagttcagcgacagcaagcagcacatcgaggtgctgaaggagagcctgaccgccaaggagcagagagccgccatcctgcagaccgaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggacagcctgagaaagaaggacgacagaatcgaggagctggaggaggccctgagagagagcgtgcagatcaccgccgagagagagatggtgctggcccaggaggagagcgccagaaccaacgccgagaagcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccagatcatccagcccctgctggagctggaccagaacagaagcaagctgaagctgtacatcggccacctgaccaccctgtgccacgacagagaccccctgatcctgagaggcctgaccccccccgccagctacaacctggacgacgaccaggccgcctgggagaacgagctgcagaagatgaccagaggccagctgcaggacgagctggagaagggcgagagagacaacgccgagctgcaggagttcgccaacgccatcctgcagcagatcgccgaccactgccccgacatcctggagcaggtggtgaacgccctggaggagagcagctag

SEQ ID NO: 13422 - DNA, 1485 bp, Artificial Sequence
  Description of Artificial Sequence: Synthetic coding sequence
atgaagctggtgaacctgtacaagggcgccgtgctgtacctgctgagaggcagaaagaccttcctgatccccgtgctgttcaacaactacatcaccgccgccctgaagctgctggagaagctgtacaaggtgaacctgaaggtgaagcacgtggagtacgacaccttctacatccccgagatcagcaacctggtggacatccaggaggactacctgatgtggttcctgcaccaggccggcatgaaggccagacccagcatcatccaggacaccgtgaccctgtgcagctaccccttcatcttcgacgcccaggccaagaccaagatgctgcagaccgacgccgagctgcagatgcaggtggccgtgaacggcgccaacctgcagaacgtgttcatgctgctgaccctggagcccctgctggccagaagccccttcctggtgctgcacgtgagaagaaacaacctggtgggcgacgccctgagagagctgagcatccacagcgacatcgacctgaagaagcccctgaaggtgatcttcgacggcgaggaggccgtggacgccggcggcgtgaccaaggagttcttcctgctgctgctgaaggagctgctgaaccccatctacggcatgttcacctactaccaggacagcaacctgctgtggttcagcgacacctgcttcgtggagcacaactggttccacctgatcggcatcacctgcggcctggccatctacaacagcaccgtggtggacctgcacttccccctggccctgtacaagaagctgctgaacgtgaagcccggcctggaggacctgaaggagctgagccccaccgagggcagaagcctgcaggagctgctggactaccccggcgaggacgtggaggagaccttctgcctgaacttcaccatctgcagagagagctacggcgtgatcgagcagaagaagctgatccccggcggcgacaacgtgaccgtgtgcaaggacaacagacaggagttcgtggacgcctacgtgaactacgtgttccagatcagcgtgcacgagtggtacaccgccttcagcagcggcttcctgaaggtgtgcggcggcaaggtgctggagctgttccagcccagcgagctgagagccatgatggtgggcaacagcaactacaactgggaggagctggaggagaccgccatctacaagggcgactacagcgccacccaccccaccgtgaagctgttctgggagaccttccacgagttccccctggagaagaagaagaagttcctgctgttcctgaccggcagcgacagaatccccatctacggcatggccagcctgcagatcgtgatccagagcaccgccagcggcgaggagtacctgcccgtggcccacacctgctacaacctgctggacctgcccaagtacagcagcaaggagatcctgagcgccagactgacccaggccctggacaactacgagggcttcagcctggcctag

SEQ ID NO: 13423 - DNA, 2370 bp, Artificial Sequence
  Description of Artificial Sequence: Synthetic coding sequence
atgtgccccagcagccagagccccagaccccccctgctgagacccccctgcagctacagagaggtgcccagcagcgtgcagagccccgcccagcagcaggtgcccgccagacccggcgcccccagcgtgcaggtgcccagccccttcctgctgcagaaccagtacgagcccgtgcagccccactggttctactgcaaggaggtggagtacaagcagctgtggatgcccttcagcgtgttcgacagcctgaacctggaggagatctacaacagcgtgcagcccgaccccgagagcgtggtgctgggcaccgacggcggcagatacgacgtgtacctgtacgacagaatcagaaaggccgcctactgggaggaggagcccgccgaggtgagaagatgcacctggttctacaagggcgacaccgacagcagattcatcccctacaccgaggagttcagcgagaagctggaggccgagtacaagaaggccgtgaccaccaaccagtggcacagaagactggagttccccagcggcgagaccatcgtgatgcacaaccccaaggtgatcgtgcagttccagcccagcagcgtgcccgacgagtggggcaccacccaggacggccagaccagacccagagtggtgaagagaggcatcgacgacaacctggacgagatccccgacggcgagatgccccaggtggaccacctggtgttcgtggtgcacggcatcggccccgtgtgcgacctgagattcagaagcatcatcgagtgcgtggacgacttcagagtggtgagcctgaagctgctgagaacccacttcaagaagagcctggacgacggcaaggtgagcagagtggagttcctgcccgtgcactggcacagcagcctgggcggcgacgccaccggcgtggacagaaacatcaagaagatcaccctgcccagcatcggcagattcagacacttcaccaacgagaccctgctggacatcctgttctacaacagccccacctactgccagaccatcgtggagaaggtgggcatggagatcaaccacctgcacgccctgttcatgagcagaaaccccgacttcaagggcggcgtgagcgtggccggccacagcctgggcagcctgatcctgttcgacatcctgagcaaccagaaggacctgaacctgagcaagtgccccggccccctggccgtggccaacggcgtggtgaagcagctgcacttccaggagaagcagatgcccgaggagcccaagctgaccctggacgagagctacgacctggtggtggagaacaaggaggtgctgaccctgcaggagaccctggaggccctgagcctgagcgagtacttcagcaccttcgagaaggagaagatcgacatggagagcctgctgatgtgcaccgtggacgacctgaaggagatgggcatccccctgggccccagaaagaagatcgccaacttcgtggagcacaaggccgccaagctgaagaaggccgccagcgagaagaaggccgtggccgccaccagcaccaagggccaggagcagagcgcccagaagaccaaggacatggccagcctgcccagcgagagcaacgagcccaagagaaagctgcccgtgggcgcctgcgtgagcagcgtgtgcgtgaactacgagagcttcgaggtgggcgccggccaggtgagcgtggcctacaacagcctggacttcgagcccgagatcttcttcgccctgggcagccccatcgccatgttcctgaccatcagaggcgtggacagaatcgacgagaactacagcctgcccacctgcaagggcttcttcaacatctaccaccccctggaccccgtggcctacagactggagcccatgatcgtgcccgacctggacctgaaggccgtgctgatcccccaccacaagggcagaaagagactgcacctggagctgaaggagagcctgagcagaatgggcagcgacctgaagcagggcttcatcagcagcctgaagagcgcctggcagaccctgaacgagttcgccagagcccacaccagcagcacccagctgcaggaggagctggagaaggtggccaaccagatcaaggaggaggaggagaagcaggtggtggaggccgagaaggtggtggagagccccgacttcagcaaggacgaggactacctgggcaaggtgggcatgctgaacggcggcagaagaatcgactacgtgctgcaggagaagcccatcgagagcttcaacgagtacctgttcgccctgcagagccacctgtgctactgggagagcgaggacaccgccctgctgctgctgaaggagatctacagaaccatgaacatcagccccgagcagccccagcactag

SEQ ID NO: 13424 - DNA, 828 bp, Artificial Sequence; identical to SEQ ID NO: 12370
  Description of Artificial Sequence: Synthetic coding sequence

SEQ ID NO: 13425 - DNA, 240 bp, Artificial Sequence
  Description of Artificial Sequence: Synthetic coding sequence
atgaacggcaccctggaccaccccgaccagcccgacctggacgccatcaagatgttcgtgggccaggtgcccagaacctggagcgagaaggacctgagagagctgttcgagcagtacggcgccgtgtacgagatcaacgtgctgagagacagaagccagaaccccccccagagcaagggctgctgcttcgtgaccttctacaccagaaaggccgccctggaggcccagaacgccctgtag

SEQ ID NO: 13426 - DNA, 738 bp, Artificial Sequence
  Description of Artificial Sequence: Synthetic coding sequence
atggtgctgctgcacgtgaagagaggcgacgagagccagttcctgctgcaggcccccggcagcaccgagctggaggagctgaccgtgcaggtggccagagtgtacaacggcagactgaaggtgcagagactgtgcagcgagatggaggagctggccgagcacggcatcttcctgccccccaacatgcagggcctgaccgacgaccagatcgaggagctgaagctgaaggacgagtggggcgagaagtgcgtgcccagcggcggcgccgtgttcaagaaggacgacatcggcagaagaaacggccaggcccccaacgagaagatgaagcaggtgctgaagaagaccatcgaggaggccaaggccatcatcagcaagaagcaggtggaggccggcgtgtgcgtgaccatggagatggtgaaggacgccctggaccagctgagaggcgccgtgatgatcgtgtaccccatgggcctgcccccctacgaccccatcagaatggagttcgagaacaaggaggacctgagcggcacccaggccggcctgaacgtgatcaaggaggccgaggcccagctgtggtgggccgccaaggagctgagaagaaccaagaagctgagcgactacgtgggcaagaacgagaagaccaagatcatcgccaagatccagcaggtgagcaccttctgcttcaacgtgagcgtggtgttcgtgatcagcctgcagaccgacaagaacgtgcagtag

SEQ ID NO: 13427 - DNA, 396 bp, Artificial Sequence; identical to SEQ ID NO: 13381
  Description of Artificial Sequence: Synthetic coding sequence

SEQ ID NO: 13428 - DNA, 2517 bp, Artificial Sequence; identical to SEQ ID NO: 10075
  Description of Artificial Sequence: Synthetic coding sequence

SEQ ID NO: 13429 - DNA, 1215 bp, Artificial Sequence
  Description of Artificial Sequence: Synthetic coding sequence
atggacttcaacatgaagaagctggccagcgacgccggcatcttcttcaccagagccgtgcagttcaccgaggagaagttcggccaggccgagaagaccgagctggacgcccacttcgagaacctgctggccagagccgacagcaccaagaactggaccgagaagatcctgagacagaccgaggtgctgctgcagcccaaccccagcgccagagtggaggagttcctgtacgagaagctggacagaaaggtgcccagcagagtgaccaacggcgagctgctggcccagtacatggccgacgccgccagcgagctgggccccaccaccccctacggcaagaccctgatcaaggtggccgaggccgagaagcagctgggcgccgccgagagagacttcatccacaccgccagcatcagcttcctgacccccctgagaaacttcctggagggcgactggaagaccatcagcaaggagagaagactgctgcagaacagaagactggacctggacgcctgcaaggccagactgaagaaggccaaggccgccgaggccaaggccaccgccgagggccccaccgtgcccgacttccaggagaccagacccagaaactacatcctgagcgccagcgccagcgccctgtggaacgacgaggtggacaaggccgagcaggagctgagagtggcccagaccgagttcgacagacaggccgaggtgaccagactgctgctggagggcatcagcagcacccacgtgaaccacctgagatgcctgcacgagttcgtgaagagccagaccacctactacgcccagtgctacagacacatgctggacctgcagaagcagctgggcagcagccagggcgccatcttccccggcaccttcgtgggcaccaccgagcccgccagcccccccctgagcagcaccagccccaccaccgccgccgccaccatgcccgtggtgcccagcgtggccagcctggccccccccggcgaggccagcctgtgcctggaggaggtggccccccccgccagcggcaccagaaaggccagagtgctgtacgactacgaggccgccgacagcagcgagctggccctgctggccgacgagctgatcaccgtgtacagcctgcccggcatggaccccgactggctgatcggcgagagaggcaacaagaagggcaaggtgcccgtgacctacctggagctgctgagctag

SEQ ID NO: 13430 - DNA, 495 bp, Artificial Sequence
  Description of Artificial Sequence: Synthetic coding sequence
atgacctgctgccagaccagcttctgcggctaccccagcttcagcatcagcggcacctgcggcagcagctgctgccagcccagctgctgcgagaccagctgctgccagcccagaagctgccagaccagcttctgcggcttccccagcttcagcaccagcggcacctgcagcagcagctgctgccagcccagctgctgcgagaccagctgctgccagcccagctgctgccagatcagcagctgcggcaccggctgcggcatcggcggcggcatcagctacggccaggagggcagcagcggcgccgtgagcaccagaatcagatggtgcagacccgacagcagagtggagggcacctacctgcccccctgctgcgtggtgagctgcaccccccccagctgctgccagctgcaccacgcccaggccagctgctgcagacccagctactgcggccagagctgctgcagacccgtgtgctgctgcgagcccacctgctag

SEQ ID NO: 13431 - DNA, 846 bp, Artificial Sequence
  Description of Artificial Sequence: Synthetic coding sequence
atgctgaccaagctgcagatcaagcagatgatggaggccgccaccagacagatcgaggagagaaagaagcagctgagcttcatcagcccccccaccccccagcccaagacccccagcagcagccagcccgagagactgcccatcggcaacaccatccagcccagccaggccgccaccttcatgaacgacgccatcgagaaggccagaaaggccgccgagctgcaggccagaatccaggcccagctggccctgaagcccggcctgatcggcaacgccaacatggtgggcctggccaacctgcacgccatgggcatcgccccccccaaggtggagctgaaggaccagaccaagcccacccccctgatcctggacgagcagggcagaaccgtggacgccaccggcaaggagatcgagctgacccacagaatgcccaccctgaaggccaacatcagagccgtgaagagagagcagttcaagcagcagctgaaggagaagcccagcgaggacatggagagcaacaccttcttcgaccccagagtgagcatcgcccccagccagagacagagaagaaccttcaagttccacgacaagggcaagttcgagaagatcgcccagagactgagaaccaaggcccagctggagaagctgcaggccgagatcagccaggccgccagaaagaccggcatccacaccagcaccagactggccctgatcgcccccaagaaggagctgaaggagggcgacatccccgagatcgagtggtgggacagctacatcatccccaacggcttcgacctgggcaagagccaggagagaagactgttctggaaccacaagagctgctag

SEQ ID NO: 13432 - DNA, 693 bp, Artificial Sequence
  Description of Artificial Sequence: Synthetic coding sequence
atgagaggccacgagagcagcgtgttcagcatcagcgtgcacgccagcggcaagtacgccatcaccaccagcagcgacaccgcccagctgtgggacctggacaccttccagagaaagagaaagctgaacatcagacagagcgtgggcatccagaaggtgttcttcctgcccctgagcaacaccatcctgagctgcttcaaggacaacagcatcttcgcctgggagtgcgacaccctgttctgcaagtaccagctgcccgccccccccgagagcagcagcatcctgtacaaggtgttcgccgtgaccagagacggcagaatcctggccgccggcggcaagagcaaccacctgcacctgtggtgcctggaggccagacagctgttcagaatcatccagatgcccaccaaggtgagagccatcagacacctggagttcctgcccgacagcttcgacgccggcagcaaccaggtgctgggcgtgctgagccaggacggcatcatgagattcatcaacatgcagacctgcaagctgctgttcgagatcggcagcctggacgagggcatcagcagcagcgccatcagcccccacggcagatacatcgccagcatcatggagaacggcagcctgaacatctacagcgtgcaggccctgacccaggagatcaacaaggaggaggtgagagcccagaactag

SEQ ID NO: 13433 - DNA, 1212 bp, Artificial Sequence
  Description of Artificial Sequence: Synthetic coding sequence
atggacagcaccatggacgacgccgtggccggcgacttcgccctgatcaacaagctggacatccagtgcgacctgaagaccctgagcgacgacatcaaggagagcctggagagcgagggcaagaacagcaagaaggaggagccccaggagctgctgcagagccaggacttcgtgggcgagaagctgggcagcggcgagcccagccacagcgtgaaggtgcacaccgtgcccaagcccggcaagggcgccgacctgagcaagcccccctgcagaaaggccaaggagatcagaaaggagagaaagagactgaagctgatgcagcagaaccccgccggcgagctggagggcttccaggcccagggccacccccccagcctgttcccccccaaggccaagagcaaccagcccaagagcctggaggacctgatcttcgagagcctgcccgagaacgccagccacaagctggaggtgagagtggtgagaagcagcccccccagcagccagttcaaggccaccctgctggagagctaccaggtgtacaagagataccagatggtgatccacaagaacccccccgacacccccaccgagagccagttcaccagattcctgtgcagcagccccctggaggccgagaccccccccaacggccccgactgcggctacggcagcttccaccagcagtactggctggacggcaagatcatcgccgtgggcgtgatcgacatcctgcccaactgcgtgagcagcgtgtacctgtactacgaccccgactacagcttcctgagcctgggcgtgtacagcgccctgagagagatcgccttcaccagacagctgcacgagaagaccagccagctgagctactactacatgggcttctacatccacagctgccccaagatgaagtacaagggccagtacagacccagcgacctgctgtgccccgagacctacgtgtgggtgcccatcgagcagtgcctgcccagcctggagaacagcaagtactgcagattcaaccaggaccccgaggccgtggacgaggacagaagcaccgagcccgacagactgcaggtgttccacaagagagccatcatgccctacggcgtgtacaagaagcagcagaaggaccccagcgaggaggccgccgtgctgcagtacgccagcctggtgggccagaagtgcagcgagagaatgctgctgttcagaaactag

SEQ ID NO: 13434 - DNA, 909 bp, Artificial Sequence
  Description of Artificial Sequence: Synthetic coding sequence
atgcccctgtacgagggcctgggcagcggcggcgagaagaccgccgtggtgatcgacctgggcgaggccttcaccaagtgcggcttcgccggcgagaccggccccagatgcatcatccccagcgtgatcaagagagccggcatgcccaagcccgtgagagtggtgcagtacaacatcaacaccgaggagctgtacagctacctgaaggagttcatccacatcctgtacttcagacacctgctggtgaaccccagagacagaagagtggtgatcatcgagagcgtgctgtgccccagccacttcagagagaccctgaccagagtgctgttcaagtacttcgaggtgcccagcgtgctgctggcccccagccacctgatggccctgctgaccctgggcatcaacagcgccatggtgctggactgcggctacagagagagcctggtgctgcccatctacgagggcatccccgtgctgaactgctggggcgccctgcccctgggcggcaaggccctgcacaaggagctggagacccagctgctggagcagtgcaccgtggacaccagcgtggccaaggagcagagcctgcccagcgtgatgggcagcgtgcccgagggcgtgctggaggacatcaaggccagaacctgcttcgtgagcgacctgaagagaggcctgaagatccaggccgccaagttcaacatcgacggcaacaacgagagacccagccccccccccaacgtggactaccccctggacggcgagaagatcctgcacatcctgggcagcatcagagacagcgtggtggagatcctgttcgagcaggacaacgaggagcagagcgtggccaccctgatcctggacagcctgatccagtgctgcagctgctgccccggctggagcgccatggcctag

SEQ ID NO: 13435 - DNA, 378 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggcagccaggccagaccccacctgagcggcagaaagctgagcctgcaggagagaagccagggcggcctggccgccggcggcagcctggacatgaacggcagatgcatctgccccagctag

SEQ ID NO: 13436 - DNA, 1161 bp, Artificial Sequence
  Description of Artificial Sequence: Synthetic coding sequence
atggccgacagcctggagagcacccccctgcccagccccgaggacagactggccaagctgcaccccagcaaggagctgctggagtactaccagaagaagatggccgagtgcgaggccgagaacgaggacctgctgaagaagctggagctgtacaaggaggcctgcgagggccagcacaagctggagtgcgacctgcagcagagagaggaggagatcgccgagctgcagaaggccctgagcgacatgcaggtgtgcctgttccaggagagagagcacgtgctgagactgtacagcgagaacgacagactgagaatcagagagctggaggacaagaagaagatccagaacctgctggccctggtgggcaccgacgccggcgaggtgacctacttctgcaaggagcccccccacaaggtgaccatcctgcagaagaccatccaggccgtgggcgagtgcgagcagagcgagagcagcgccttcaaggccgaccccaagatcagcaagagaagacccagcagagagagaaaggagagcagcgagcactaccagagagacatccagaccctgatcctgcaggtggaggccctgcaggcccagctgggcgagcagaccaagctgagcagagagcagatcgagggcctgatcgaggacagaagaatccacctggaggagatccaggtgcagcaccagagaaaccagaacaagatcaaggagctgaccaagaacctgcaccacacccaggagctgctgtacgagagcaccaaggacttcctgcagctgagaagcgagaaccagaacaaggagaagagctggatgctggagaaggacaacctgatgagcaagatcaagcagtacagagtgcagtgcaagaagaaggaggacaagatcggcaaggtgctgcccgtgatgcacgagagccaccacgcccagagcgagtacatcaagagcctgaaggacaagctggtgcaggagaagaagctgagcaacatgtaccaggagcagtgcatcagcctggaggaggagctggccagaatcagagaggaggagggcatgagaagagagatcttcaaggacagaaccaacaagatgggcaagagactgcagatcatgaccaagagatacgaggccctggagagaagaagaatcctggaggtggagtag

SEQ ID NO: 13437 - DNA, 999 bp, Artificial Sequence; identical to SEQ ID NO: 13186
  Description of Artificial Sequence: Synthetic coding sequence

SEQ ID NO: 13438 - DNA, 1524 bp, Artificial Sequence
  Description of Artificial Sequence: Synthetic coding sequence
atggaggaggtggagagacaggtgctgcccgaccccgaggtgctggaggccgtgggcgacagacaggacggcctgagagagcagctgcaggcccccgtgccccccgacagcgtgcccagcctgcagaacatgggcctgctgctggacaagctggccaaggagaaccaggacatcagactgctgcaggcccagctgcaggcccagaaggaggagctgcagagcctgatgcaccagcccaagggcctggaggaggagaacgcccagctgagaggcgccctgcagcagggcgaggccttccagagagccctggagagcgagctgcagcagctgagagccagactgcagggcctggaggccgactgcgtgagaggccccgacggcgtgtgcctgagcggcggcagaggcccccagggcgacaaggccatcagagagcagggccccagagagcaggagcccgagctgagcttcctgaagcagaaggagcagctggaggccgaggcccaggccctgagacaggagctggagagacagagaagactgctgggcagcgtgcagcaggacctggagagaagcctgcaggacgccagcagaggcgaccccgcccacgccggcctggccgagctgggccacagactggcccagaagctgcagggcctggagaactggggccaggaccccggcgtgagcgccaacgccagcaaggcctggcaccagaagagccacttccagaacagcagagagtggagcggcaaggagaagtggtgggacggccagagagacagaaaggccgagcactggaagcacaagaaggaggagagcggcagagagagaaagaagaactggggcggccaggaggacagagagcccgccggcagatggaaggagggcagacccagagtggaggagagcggcagcaagaaggagggcaagagacagggccccaaggagccccccagaaagagcggcagcttccacagcagcggcgagaagcagaagcagcccagatggagagagggcaccaaggacagccacgaccccctgcccagctgggccgagctgctgagacccaagtacagagccccccagggctgcagcggcgtggacgagtgcgccagacaggagggcctgaccttcttcggcaccgagctggcccccgtgagacagcaggagctggccagcctgctgagaacctacctggccagactgccctgggccggccagctgaccaaggagctgcccctgagccccgccttcttcggcgaggacggcatcttcagacacgacagactgagattcagagacttcgtggacgccctggaggacagcctggaggaggtggccgtgcagcagaccggcgacgacgacgaggtggacgacttcgaggacttcatcttcagccacttcttcggcgacaaggccctgaagaagagaagcggcaagaaggacaagcacagccagagccccagagccgccggccccagagagggccacagccacagccaccaccaccaccacagaggctag

SEQ ID NO: 13439 - DNA, 2472 bp, Artificial Sequence
  Description of Artificial Sequence: Synthetic coding sequence
atgaccctgctgagcagccagagcagcagcctggtggcccccagcggcagcgtgagcgccgagaaccccgagcagagaatgctggagaagagagccaaggtgatcgaggagctgctgcagaccgagagagactacatcagagacctggagatgtgcatcgagagaatcatggtgcccatgcagcaggcccaggtgcccaacatcgacttcgagggcctgttcggcaacatgcagatggtgatcaaggtgagcaagcagctgctggccgccctggagatcagcgacgccgtgggccccgtgttcctgggccacagagacgagctggagggcacctacaagatctactgccagaaccacgacgaggccatcgccctgctggagatctacgagaaggacgagaagatccagaagcacctgcaggacagcctggccgacctgaagagcctgtacaacgagtggggctgcaccaactacatcaacctgggcagcttcctgatcaagcccgtgcagagagtgatgagataccccctgctgctgatggagctgctgaacagcacccccgagagccaccccgacaaggtgcccctgaccaacgccgtgctggccgtgaaggagatcaacgtgaacatcaacgagtacaagagaagaaaggacctggtgctgaagtacagaaagggcgacgaggacagcctgatggagaagatcagcaagctgaacatccacagcatcatcaagaagagcaacagagtgagcagccacctgaagcacctgaccggcttcgccccccagatcaaggacgaggtgttcgaggagaccgagaagaacttcagaatgcaggagagactgatcaagagcttcatcagagacctgagcctgtacctgcagcacatcagagagagcgcctgcgtgaaggtggtggccgccgtgagcatgtgggacgtgtgcatggagagaggccacagagacctggagcagttcgagagagtgcacagatacatcagcgaccagctgttcaccaacttcaaggagagaaccgagagactggtgatcagccccctgaaccagctgctgagcatgttcaccggcccccacaagctggtgcagaagagattcgacaagctgctggacttctacaactgcaccgagagagccgagaagctgaaggacaagaagaccctggaggagctgcagagcgccagaaacaactacgaggccctgaacgcccagctgctggacgagctgcccaagttccaccagtacgcccagggcctgttcaccaactgcgtgcacggctacgccgaggcccactgcgacttcgtgcaccaggccctggagcagctgaagcccctgctgagcctgctgaaggtggccggcagagagggcaacctgatcgccatcttccacgaggagcacagcagagtgctgcagcagctgcaggtgttcaccttcttccccgagagcctgcccgccaccaagaagcccttcgagagaaagaccatcgacagacagagcgccagaaagcccctgctgggcctgcccagctacatgctgcagagcgaggagctgagagccagcctgctggccagatacccccccgagaagctgttccaggccgagagaaacttcaacgccgcccaggacctggacgtgagcctgctggagggcgacctggtgggcgtgatcaagaagaaggaccccatgggcagccagaacagatggctgatcgacaacggcgtgaccaagggcttcgtgtacagcagcttcctgaagccctacaaccccagaagaagccacagcgacgccagcgtgggcagccacagcagcaccgagagcgagcacggcagcagcagccccagattccccagacagaacagcggcagcaccctgaccttcaaccccagcagcatggccgtgagcttcaccagcggcagctgccagaagcagccccaggacgccagccccccccccaaggagtgcgaccagggcaccctgagcgccagcctgaaccccagcaacagcgagagcagccccagcagatgccccagcgaccccgacagcaccagccagcccagaagcggcgacagcgccgacgtggccagagacgtgaagcagcccaccgccacccccagaagctacagaaacttcagacaccccgagatcgtgggctacagcgtgcccggcagaaacggccagagccaggacctggtgaagggctgcgccagaaccgcccaggcccccgaggacagaagcaccgagcccgacggcagcgaggccgagggcaaccaggtgtacttcgccgtgtacaccttcaaggccagaaaccccaacgagctgagcgtgagcgccaaccagaagctgaagatcctggagttcaaggacgtgaccggcaacaccgagtggtggctggccgaggtgaacggcaagaagggctacgtgcccagcaactacatcagaaagaccgagtacacctag

SEQ ID NO: 13440 - DNA, 492 bp, Artificial Sequence
  Description of Artificial Sequence: Synthetic coding sequence
tgagacaagttcagagccagccccgactgcatcaccatcctgtgcaagcccaacggccaggccatcgcctggtacacccccatccactggaagcaggcctgggagaagctggacgccgacgtggagttcaacagatgcagcgtggtgagccccaccttcagaaagagagtgttccagtggaccgccagcaccgccaccatcaccaaggagaagcaggaccagcccaagaaggacatcagcaactaccaggtggagcaggcccaggtgctgctgaagagagagaaggagatcccccccaccgtgttccccaacagaagcccctggtgccagaacccctacgtgagcgcccacccctactgccccctgatcgagccccacaacaccagcaccgccggcggcagactggacagacagcccagaaccagaagcaccagacccaacagagccagcggcagcaagaagaagaagaccagcgagagccagaagcagtag

SEQ ID NO: 13441 - DNA, 771 bp, Artificial Sequence; identical to SEQ ID NO: 10157
  Description of Artificial Sequence: Synthetic coding sequence

SEQ ID NO: 13442 - DNA, 2793 bp, Artificial Sequence
  Description of Artificial Sequence: Synthetic coding sequence
atgagcgagttcagaatccaccacgacgtgaacgagctgctgagcctgctgagagtgcacggcggcgacggcgccgaggtgtacatcgacctgctgcagaagaacagaaccccctacgtgaccaccaccgtgagcgcccacagcgccaaggtgaagatcgccgagttcagcagaacccccgaggacttcctgaagaagtacgacgagctgaagagcaagaacaccagaaacctggaccccctggtgtacctgctgagcaagctgaccgaggacaaggagaccctgcagtacctgcagcagaacgccaaggagagagccgagctggccgccgccgccgtgggcagcagcaccaccagcatcaacgtgcccgccgccgccagcaagatcagcatgcaggagctggaggagctgagaaagcagctgggcagcgtggccaccggcagcaccctgcagcagagcctggagctgaagagaaagatgctgagagacaagcagaacaagaagaacagcggccagcacctgcccatcttccccgcctgggtgtacgagagacccgccctgatcggcgacttcctgatcggcgccggcatcagcaccgacaccgccctgcccatcgtgctgctgagatggaacctggccctgagccccagactgaagtgcagcggcgtgatcagcgcccactgcaacctgcacctgcccggcaccctgcccctggccagccaggagagcgccgtggtggaggacctgctgtacgtgctggtgggcgtggacggcagatacgtgagcgcccagcccctggccggcagacagagcagaaccttcctggtggaccccaacctggacctgagcatcagagagctggtgcacagaatcctgcccgtggccgccagctacagcgccgtgaccagattcatcgaggagaagagcagcttcgagtacggccaggtgaaccacgccctggccgccgccatgagaaccctggtgaaggagcacctgatcctggtgagccagctggagcagctgcacagacagggcctgctgagcctgcagaagctgtggttctacatccagcccgccatgagaaccatggacatcctggccagcctggccaccagcgtggacaagggcgagtgcctgggcggcagcaccctgagcctgctgcacgacagaagcttcagctacaccggcgacagccaggcccaggagctgtgcctgtacctgaccaaggccgccagcgccccctacttcgaggtgctggagaagtggatctacagaggcatcatccacgacccctacagcgagttcatggtggaggagcacgagctgagaaaggagagaatccaggaggactacaacgacaagtactgggaccagagatacaccatcgtgcagcagcagatccccagcttcctgcagaagatggccgacaagatcctgagcaccggcaagtacctgaacgtggtgagagagtgcggccacgacgtgacctgccccgtggccaaggagatcatctacaccctgaaggagagagcctacgtggagcagatcgagaaggccttcaactacgccagcaaggtgctgctggacttcctgatggaggagaaggagctggtggcccacctgagaagcatcaagagatacttcctgatggaccagggcgacttcttcgtgcacttcatggacctggccgaggaggagctgagaaagcccgtggaggacatcaccccccccagactggaggccctgctggagctggccctgagaatgagcaccgccaacaccgaccccttcaaggacgacctgaagatcgacctgatgccccacgacctgatcacccagctgctgagagtgctggccatcgagaccaagcaggagaaggccatggcccacgccgaccccaccgagctggccctgagcggcctggaggccttcagcttcgactacatcgtgaagtggcccctgagcctgatcatcaacagaaaggccctgaccagataccagatgctgttcagacacatgttctactgcaagcacgtggagagacagctgtgcagcgtgtggatcagcaacaagaccgccaagcagcacagcctgcacagcgcccagtggttcgccggcgccttcaccctgagacagagaatgctgaacttcgtgcagaacatccagtactacatgatgttcgaggtgatggagcccacctggcacatcctggagaagaacctgaagagcgccagcaacatcgacgacgtgctgggccaccacaccggcttcctggacacctgcctgaaggactgcatgctgaccaaccccgagctgctgaaggtgttcagcaagctgatgagcgtgtgcgtgatgttcaccaactgcatgcagaagttcacccagagcatgaagctggacggcgagctgggcggccagaccctggagcacagcaccgtgctgggcctgcccgccggcgccgaggagagagccagaaaggagctggccagaaagcacctggccgagcacgccgacaccgtgcagctggtgagcggcttcgaggccaccatcaacaagttcgacaagaacttcagcgcccacctgctggacctgctggccagactgagcatctacagcaccagcgactgcgagcacggcatggccagcgtgatcagcagactggacttcaacggcttctacaccgagagactggagagactgagcgccgagagaagccagaaggccaccccccaggtgcccgtgctgagaggcccccccgcccccgcccccagagtggccgtgaccgcccagtag

SEQ ID NO: 13443 - DNA, 129 bp, Artificial Sequence
  Description of Artificial Sequence: Synthetic coding sequence
atgtgcctgctgcccatcagagtgaaggaggccgaggaggtgtgcagacagaagaagggcaagagcctgtacaagatcaagcccagacacgacagcggcatcaaggccaagatcagcatgaagacctag

SEQ ID NO: 13444 - DNA, 456 bp, Artificial Sequence
  Description of Artificial Sequence: Synthetic coding sequence
atggactgcagagagatggacctgtacgaggactaccagagccccttcgacttcgacgccggcgtgaacaagagctacctgtacctgagccccagcggcaacagcagcccccccggcagccccaccctgcagaagttcggcctgctgagaaccgaccccgtgcccgaggagggcgaggacgtggccgccaccatcagcgccaccgagaccctgagcgaggaggagcaggaggagctgagaagagagctggccaaggtggaggaggagatccagaccctgagccaggtgctggccgccaaggagaagcacctggccgagatcaagagaaagctgggcatcaacagcctgcaggagctgaagcagaacatcgccaagggctggcaggacgtgaccgccaccagcgccagaagcaagctgctggccgccgagaccgagctgctgtgcctgctgtactag

SEQ ID NO: 13445 - DNA, 627 bp, Artificial Sequence; identical to SEQ ID NO: 9606
  Description of Artificial Sequence: Synthetic coding sequence

SEQ ID NO: 13446 - DNA, 1575 bp, Artificial Sequence
  Description of Artificial Sequence: Synthetic coding sequence
atgaagagaagcagcgtgagcagcggcggcgccggcagactgagcatgcaggagctgagaagccaggacgtgaacaagcagggcctgtacaccccccagaccaaggagaagcccaccttcggcaagctgagcatcaacaagcccaccagcgagagaaaggtgagcctgttcggcaagagaaccagcggccacggcagcagaaacagccagctgggcatcttcagcagcagcgagaagatcaaggaccccagacccctgaacgacaaggccttcatccagcagtgcatcagacagctgtgcgagttcctgaccgagaacggctacgcccacaacgtgagcatgaagagcctgcaggcccccagcgtgaaggacttcctgaagatcttcaccttcctgtacggcttcctgtgccccagctacgagctgcccgacaccaagttcgaggaggaggtgcccagaatcttcaaggacctgggctaccccttcgccctgagcaagagcagcatgtacaccgtgggcgccccccacacctggccccacatcgtggccgccctggtgtggctgatcgactgcatcaagatccacaccgccatgaaggagagcagccccctgttcgacgacggccagccctggggcgaggagaccgaggacggcatcatgcacaacaagctgttcctggactacaccatcaagtgctacgagagcttcatgagcggcgccgacagcttcgacgagatgaacgccgagctgcagagcaagctgaaggacctgttcaacgtggacgccttcaagctggagagcctggaggccaagaacagagccctgaacgagcagatcgccagactggagcaggagagagagaaggagcccaacagactggagagcctgagaaagctgaaggccagcctgcagggcgacgtgcagaagtaccaggcctacatgagcaacctggagagccacagcgccatcctggaccagaagctgaacggcctgaacgaggagatcgccagagtggagctggagtgcgagaccatcaagcaggagaacaccagactgcagaacatcatcgacaaccagaagtacagcgtggccgacatcgagagaatcaaccacgagagaaacgagctgcagcagaccatcaacaagctgaccaaggacctggaggccgagcagcagaagctgtggaacgaggagctgaagtacgccagaggcaaggaggccatcgagacccagctggccgagtaccacaagctggccagaaagctgaagctgatccccaagggcgccgagaacagcaagggctacgacttcgagatcaagttcaaccccgaggccggcgccaactgcctggtgaagtacagagcccaggtgtacgtgcccctgaaggagctgctgaacgagaccgaggaggagatcaacaaggccctgaacaagaagatgggcctggaggacaccctggagcagctgaacgccatgatcaccgagagcaagagaagcgtgagaaccctgaaggaggaggtgcagaagctggacgacctgtaccagcagaagatcaagaaggagagaaagaagtag

SEQ ID NO: 13447 - DNA, 1248 bp, Artificial Sequence; identical to SEQ ID NO: 10184
  Description of Artificial Sequence: Synthetic coding sequence

SEQ ID NO: 13448 - DNA, 1512 bp, Artificial Sequence
  Description of Artificial Sequence: Synthetic coding sequence
atggccagcaaccacaagagcagcgccgccagacccgtgagcagaggcggcgtgggcctgaccggcagaccccccagcggcatcagacccctgagcggcaacatcagagtggccaccgccatgccccccggcaccgccagacccggcagcagaggctgccccatcggcaccggcggcgtgctgagcagccagatcaaggtggcccacagacccgtgacccagcagggcctgaccggcatgaagaccggcaccaagggcccccagagacagatcctggacaagagctactacctgggcctgctgagaagcaagatcagcgagctgaccaccgaggtgaacaagctgcagaagggcatcgagatgtacaaccaggagaacagcgtgtacctgagctacgagaagagagccgagaccctggccgtggagatcaaggagctgcagggccagctggccgactacaacatgctggtggacaagctgaacaccaacaccgagatggaggaggtgatgaacgactacaacatgctgaaggcccagaacgacagagagacccagagcctggacgtgatcttcaccgagagacaggccaaggagaagcagatcagaagcgtggaggaggagatcgagcaggagaagcaggccaccgacgacatcatcaagaacatgagcttcgagaaccaggtgaagtacctggagatgaagaccaccaacgagaagctgctgcaggagctggacaccctgcagcagcagctggacagccagaacatgaagaaggagagcctggaggccgagatcgcccacagccaggtgaagcaggaggccgtgctgctgcacgagaagctgtacgagctggagagccacagagaccagatgatcgccgaggacaagagcatcggcagccccatggaggagagagagaagctgctgaagcagatcaaggacgacaaccaggagatcgccagcatggagagacagctgaccgacaccaaggagaagatcaaccagttcatcgaggagatcagacagctggacatggacctggaggagcaccagggcgagatgaaccagaagtacaaggagctgaagaagagagaggagcacatggacaccttcatcgagaccttcgaggagaccaagaaccaggagctgaagagaaaggcccagatcgaggccaacatcgtggccctgctggagcactgcagcagaaacatcaacagaatcgagcagatcagcagcatcaccaaccaggagctgaagatgatgcaggacgacctgaacttcaagagcaccgaggtgcagaagagccagagcaccgcccagaacctgaccagcgacatccagagactgcagctggacctgcagaagatggagctgctggagagcaagatgaccgaggagcagcacagcctgaagagcaagatcaagcagatgaccaccgacctggagatctacaacgacctgcccgccctgaagagcagcggcgagaagaagaagaagaagaagaagaagtag

SEQ ID NO: 13449 - DNA, 1461 bp, Artificial Sequence; identical to SEQ ID NO: 9652
  Description of Artificial Sequence: Synthetic coding sequence

SEQ ID NO: 13450 - DNA, 1011 bp, Artificial Sequence
  Description of Artificial Sequence: Synthetic coding sequence
atgtgcaccatgcacaaggacgagaaggccaagagagaggtgagcagctggaccgtggagggcgacatcaacaccgacccctgggccggctacagatacaccggcaagctgagaccccactaccccctgatgcccaccagacccgtgcccagctacatccagagacccgactacgccgaccaccccctgggcatgagcgagagcgagcaggccctgaagggcaccagccagatcaagctgctgagcagcgaggacatcgagggcatgagactggtgtgcagactggccagagaggtgctggacgtggccgccggcatgatcaagcccggcgtgaccaccgaggagatcgaccacgccgtgcacctggcctgcatcgccagaaactgctaccccagccccctgaactactacaacttccccaagagctgctgcaccagcgtgaacgaggtgatctgccacggcatccccgacagaagacccctgcaggagggcgacatcgtgaacgtggacatcaccctgtacagaaacggctaccacggcgacctgaacgagaccttcttcgtgggcgaggtggacgacggcgccagaaagctggtgcagaccacctacgagtgcctgatgcaggccatcgacgccgtgaagcccggcgtgagatacagagagctgggcaacatcatccagaagcacgcccaggccaacggcttcagcgtggtgagaagctactgcggccacggcatccacaagctgttccacaccgcccccaacgtgccccactacgccaagaacaaggccgtgggcgtgatgaagagcggccacgtgttcaccatcgagcccatgatctgcgagggcggctggcaggacgagacctggcccgacggctggaccgccgtgaccagagacggcaagagaagcgcccagttcgagcacaccctgctggtgaccgacaccggctgcgagatcctgaccagaagactggacagcgccagaccccacttcatgagccagttctag

SEQ ID NO: 13451 - DNA, 3102 bp, Artificial Sequence
  Description of Artificial Sequence: Synthetic coding sequence
atggccggcatgatcgacagattcagccccgccaacaccggcatcagaagctgggacgtggaccccggcgtgtgcaacctggacgagcagctgaaggtgttcgtgagcagacacagcgccaccttcagcagcatcgtgaagggccagagaagcctgcaccacagaggcgacaacctggagaccctggtgctgctgaaccccagcgacaagagcctgtacgacgagctgagaaacctgctgctggaccccgccagccacaagctgctggtgctggccggcccctgcctggaggagaccggcgagctgctgctgcagaccggcggcttcagcccccaccacttcctgcaggtgctgaaggacagagagatcagagacatcctggccaccacccccccccccgtgcagccccccatcctgaccatcacctgccccaccttcggcgactgggcccagctggcccccgccgtgcccggcctgcagggcgccctgagactgcagctgagactgaacccccccgcccagctgcccaacagcgagggcctgtgcgagttcctggagtacgtggccgagagcctggagccccccagccccttcgagctgctggagccccccaccagcggcggcttcctgagactgggcagaccctgctgctacatcttccccggcggcctgggcgacgccgccttcttcgccgtgaacggcttcaccgtgctggtgaacggcggcagcaaccccaagagcagcttctggaagctggtgagacacctggacagagtggacgccgtgctggtgacccaccccggcgccgacagcctgcccggcctgaacagcctgctgagaagaaagctggccgagagaagcgaggtggccgccggcggcggcagctgggacgacagactgagaagactgatcagccccaacctgggcgtggtgttcttcaacgcctgcgaggccgccagcagactggccagaggcgaggacgaggccgagctggccctgagcctgctggcccagctgggcatcacccccctgcccctgagcagaggccccgtgcccgccaagcccaccgtgctgttcgagaagatgggcgtgggcagactggacatgtacgtgctgcacccccccagcgccggcgccgagagaaccctggccagcgtgtgcgccctgctggtgtggcaccccgccggccccggcgagaaggtggtgagagtgctgttccccggctgcaccccccccgcctgcctgctggacggcctggtgagactgcagcacctgagattcctgagagagcccgtggtgaccccccaggacctggagggccccggcagagccgagagcaaggagagcgtgggcagcagagacagcagcaagagagagggcctgctggccacccaccccagacccggccaggagagacccggcgtggccagaaaggagcccgccagagccgaggcccccagaaagaccgagaaggaggccaagacccccagagagctgaagaaggaccccaagcccagcgtgagcagaacccagcccagagaggtgagaagagccgccagcagcgtgcccaacctgaagaagaccaacgcccaggccgcccccaagcccagaaaggcccccagcaccagccacagcggcttcccccccgtggccaacggccccagaagcccccccagcctgagatgcggcgaggccagcccccccagcgccgcctgcggcagccccgccagccagctggtggccacccccagcctggagctgggccccatccccgccggcgaggagaaggccctggagctgcccctggccgccagcagcatccccagacccagaacccccagccccgagagccacagaagccccgccgagggcagcgagagactgagcctgagccccctgagaggcggcgaggccggccccgacgccagccccaccgtgaccacccccaccgtgaccacccccagcctgcccgccgaggtgggcagcccccacagcaccgaggtggacgagagcctgagcgtgagcttcgagcaggtgctgccccccagcgcccccaccagcgaggccggcctgagcctgcccctgagaggccccagagccagaagaagcgccagcccccacgacgtggacctgtgcctggtgagcccctgcgagttcgagcacagaaaggccgtgcccatggcccccgcccccgccagccccggcagcagcaacgacagcagcgccagaagccaggagagagccggcggcctgggcgccgaggagaccccccccaccagcgtgagcgagagcctgcccaccctgagcgacagcgaccccgtgcccctggcccccggcgccgccgacagcgacgaggacaccgagggcttcggcgtgcccagacacgaccccctgcccgaccccctgaaggtgcccccccccctgcccgaccccagcagcatctgcatggtggaccccgagatgctgccccccaagaccgccagacagaccgagaacgtgagcagaaccagaaagcccctggccagacccaacagcagagccgccgcccccaaggccacccccgtggccgccgccaagaccaagggcctggccggcggcgacagagccagcagacccctgagcgccagaagcgagcccagcgagaagggcggcagagcccccctgagcagaaagagcagcacccccaagaccgccaccagaggccccagcggcagcgccagcagcagacccggcgtgagcgccaccccccccaagagccccgtgtacctggacctggcctacctgcccagcggcagcagcgcccacctggtggacgaggagttcttccagagagtgagagccctgtgctacgtgatcagcggccaggaccagagaaaggaggagggcatgagagccgtgctggacgccctgctggccagcaagcagcactgggacagagacctgcaggtgaccctgatccccaccttcgacagcgtggccatgcacacctggtacgccgagacccacgccagacaccaggccctgggcatcaccgtgctgggcagcaacagcatggtgagcatgcaggacgacgccttccccgcctgcaaggtggagttctag

SEQ ID NO: 13452 - DNA, 2223 bp, Artificial Sequence
  Description of Artificial Sequence: Synthetic coding sequence
atgagagacctggagggctacagagagaccagataccagctgctgcagctgagacccgcccagagagccagctggatcggctacgccatcgcctaccacctgctggaggactacgagatggccgccaagatcctggaggagttcagaaagacccagcagaccagccccgacaaggtggactacgagtacagcgagctgctgctgtaccagaaccaggtgctgagagaggccggcctgtacagagaggccctggagcacctgtgcacctacgagaagcagatctgcgacaagctggccgtggaggagaccaagggcgagctgctgctgcagctgtgcagactggaggacgccgccgacgtgtacagaggcctgcaggagagaaaccccgagaactgggcctactacaagggcctggagaaggccctgaagcccgccaacatgctggagagactgaagatctacgaggaggcctggaccaagtaccccagaggcctggtgcccagaagactgcccctgaacttcctgagcggcgagaagttcaaggagtgcctggacaagttcctgagaatgaacttcagcaagggctgcccccccgtgttcaacaccctgagaagcctgtacaaggacaaggagaaggtggccatcatcgaggagctggtggtgggctacgagaccagcctgaagagctgcagactgttcaaccccaacgacgacggcaaggaggagccccccaccaccctgctgtgggtgcagtactacctggcccagcactacgacaagatcggccagcccagcatcgccctggagtacatcaacaccgccatcgagagcacccccaccctgatcgagctgttcctggtgaaggccaagatctacaagcacgccggcaacatcaaggaggccgccagatggatggacgaggcccaggccctggacaccgccgacagattcatcaacagcaagtgcgccaagtacatgctgaaggccaacctgatcaaggaggccgaggagatgtgcagcaagttcaccagagagggcaccagcgccgtggagaacctgaacgagatgcagtgcatgtggttccagaccgagtgcgcccaggcctacaaggccatgaacaagttcggcgaggccctgaagaagtgccacgagatcgagagacacttcatcgagatcaccgacgaccagttcgacttccacacctactgcatgagaaagatcaccctgagaagctacgtggacctgctgaagctggaggacgtgctgagacagcaccccttctacttcaaggccgccagaatcgccatcgagatctacctgaagctgcacgacaaccccctgaccgacgagaacaaggagcacgaggccgacaccgccaacatgagcgacaaggagctgaagaagctgagaaacaagcagagaagagcccagaagaaggcccagatcgaggaggagaagaagaacgccgagaaggagaagcagcagagaaaccagaagaagaagaaggacgacgacgacgaggagatcggcggccccaaggaggagctgatccccgagaagctggccaaggtggagacccccctggaggaggccatcaagttcctgacccccctgaagaacctggtgaagaacaagatcgagacccacctgttcgccttcgagatctacttcagaaaggagaagttcctgctgatgctgcagagcgtgaagagagccttcgccatcgacagcagccacccctggctgcacgagtgcatgatcagactgttcaacaccgccgtgtgcgagagcaaggacctgagcgacaccgtgagaaccgtgctgaagcaggagatgaacagactgttcggcgccaccaaccccaagaacttcaacgagaccttcctgaagagaaacagcgacagcctgccccacagactgagcgccgccaagatggtgtactacctggaccccagcagccagaagagagccatcgagctggccaccaccctggacgagagcctgaccaacagaaacctgcagacctgcatggaggtgctggaggccctgtacgacggcagcctgggcgactgcaaggaggccgccgagatctacagagccaactgccacaagctgttcccctacgccctggccttcatgccccccggctacgaggaggacatgaagatcaccgtgaacggcgacagcagcgccgaggccgaggagctggccaacgagatctag

SEQ ID NO: 13453 - DNA, 183 bp, Artificial Sequence
  Description of Artificial Sequence: Synthetic coding sequence
atgagctgcaccatcgagaaggccctggccgacgccaaggccctggtggagagactgagagaccacgacgacgccgccgagagcctgatcgagcagaccaccgccctgaacaagagagtggaggccatgaagcagtaccaggaggagatccaggagctgaacgaggtggccagacacagatag

SEQ ID NO: 13454 - DNA, 1419 bp, Artificial Sequence
  Description of Artificial Sequence: Synthetic coding sequence
atgggcaaggagcaggagctgctggaggccgccagaaccggccacctgcccgccgtggagaagctgctgagcggcaagagactgagcagcggcttcggcggcggcggcggcggcggcagcggcggcggcggcggcggcagcggcggcggcggcggcggcctgggcagcagcagccaccccctgagcagcctgctgagcatgtggagaggccccaacgtgaactgcgtggacagcaccggctacacccccctgcaccacgccgccctgaacggccacaaggacgtggtggaggtgctgctgagaaacgacgccctgaccaacgtggccgacagcaagggctgctaccccctgcacctggccgcctggaagggcgacgcccagatcgtgagactgctgatccaccagggccccagccacaccagagtgaacgagcagaacaacgacaacgagaccgccctgcactgcgccgcccagtacggccacaccgaggtggtgaaggtgctgctggaggagctgaccgaccccaccatgagaaacaacaagttcgagacccccctggacctggccgccctgtacggcagactggaggtggtgaagatgctgctgaacgcccaccccaacctgctgagctgcaacaccaagaagcacacccccctgcacctggccgccagaaacggccacaaggccgtggtgcaggtgctgctggacgccggcatggacagcaactaccagaccgagatgggcagcgccctgcacgaggccgccctgttcggcaagaccgacgtggtgcagatcctgctggccgccggcaccgacgtgaacatcaaggacaaccacggcctgaccgccctggacaccgtgagagagctgcccagccagaagagccagcagatcgccgccctgatcgaggaccacatgaccggcaagagaagcaccaaggaggtggacaagaccccccccccccagccccccctgatcagcagcatggacagcatcagccagaagagccagggcgacgtggagaaggccgtgaccgagctgatcatcgacttcgacgccaacgccgaggaggagggcccctacgaggccctgtacaacgccatcagctgccacagcctggacagcatggccagcggcagaagcagcgaccaggacagcaccaacaaggaggccgaggccgccggcgtgaagcccgccggcgtgagacccagagagagaccccccccccccgccaagcccccccccgacgaggaggaggaggaccacatcgacaagaagtacttccccctgaccgccagcgaggtgctgagcatgagacccagaatccacggcagcgccgccagagaggaggacgagcacccctacgagctgctgctgaccgccgagaccaagaagaagaagaagaagaagaagaagtag

SEQ ID NO: 13455 - DNA, 1392 bp, Artificial Sequence
  Description of Artificial Sequence: Synthetic coding sequence
atgagcggcggcaccccctacatcggcagcaagatcagcctgatcagcaaggccgagatcagatacgagggcatcctgtacaccatcgacaccgagaacagcaccgtggccctggccaaggtgagaagcttcggcaccgaggacagacccaccgacagacccatcccccccagagacgaggtgttcgagtacatcatcttcagaggcagcgacatcaaggacctgaccgtgtgcgagccccccaagccccagtgcagcctgccccaggaccccgccatcgtgcagagcagcctgggcagcagcaccagcagcttccagagcatgggcagctacggccccttcggcagaatgcccacctacagccagttcagccccagcagcctggtgggccagcagttcggcgccgtgggcgtggccggcagcagcctgaccagcttcggcaccgagaccagcaacagcggcaccctgccccagagcagcgccgtgggcagcgccttcacccaggacaccagaagcctgaagacccagctgagccagggcagaagcagcccccagctggaccccctgagaaagagccccaccatggagcaggccgtgcagaccgccagcgcccacctgcccgcccccgccgccgtgggcagaagaagccccgtgagcaccagacccctgcccagcgccagccagaaggccggcgagaaccaggagcacagaagagccgaggtgcacaaggtgagcagacccgagaacgagcagctgagaaacgacaacaagagacaggtggcccccggcgcccccagcgcccccagaagaggcagaggcggccacagaggcggcagaggcagattcggcatcagaagagacggccccatgaagttcgagaaggacttcgacttcgagagcgccaacgcccagttcaacaaggaggagatcgacagagagttccacaacaagctgaagctgaaggaggacaagctggagaagcaggagaagcccgtgaacggcgaggacaagggcgacagcggcgtggacacccagaacagcgagggcaacgccgacgaggaggaccccctgggccccaactgctactacgacaagaccaagagcttcttcgacaacatcagctgcgacgacaacagagagagaagacccacctgggccgaggagagaagactgaacgccgagaccttcggcatccccctgagacccaacagaggcagaggcggctacagaggcagaggcggcctgggcttcagaggcggcagaggcagaggcggcggcagaggcggcaccttcaccgcccccagaggcttcagaggcggcttcagaggcggcagaggcggcagagagttcgccgacttcgagtacagaaaggacaacaaggtggccgcctag

SEQ ID NO: 13456 - DNA, 1287 bp, Artificial Sequence
  Description of Artificial Sequence: Synthetic coding sequence
atgggcggcggcgtgggcgccagcagcagcggcggcggccccggcggcagcggcggcggcggcagcggcggccccggcgccggcaccagcttccccccccccggcgtgaagctgggcagagacagcggcaaggtgaccaccgtggtggccaccctgggccagggccccgagagaagccaggaggtggcctacaccgacatcaaggtgatcggcaacggcagcttcggcgtggtgtaccaggccagactggccgagaccagagagctggtggccatcaagaaggtgctgcaggacaagagattcaagaacagagagctgcagatcatgagaaagctggaccactgcaacatcgtgagactgagatacttcttctacagcagcggcgagaagaaggacgagctgtacctgaacctggtgctggagtacgtgcccgagaccgtgtacagagtggccagacacttcaccaaggccaagctgaccatccccatcctgtacgtgaaggtgtacatgtaccagctgttcagaagcctggcctacatccacagccagggcgtgtgccacagagacatcaagccccagaacctgctggtggaccccgacaccgccgtgctgaagctgtgcgacttcggcagcgccaagcagctggtgagaggcgagcccaacgtgagctacatctgcagcagatactacagagcccccgagctgatcttcggcgccaccgactacaccagcagcatcgacgtgtggagcgccggctgcgtgctggccgagctgctgctgggccagcccatcttccccggcgacagcggcgtggaccagctggtggagatcatcaaggtgctgggcacccccaccagagagcagatcagagagatgaaccccaactacaccgagttcaagttcccccagatcaaggcccacccctggaccaaggtgttcaagagcagaaccccccccgaggccatcgccctgtgcagcagcctgctggagtacacccccagcagcagactgagccccctggaggcctgcgcccacagcttcttcgacgagctgagatgcctgggcacccagctgcccaacaacagacccctgccccccctgttcaacttcagcgccggcgagctgagcatccagcccagcctgaacgccatcctgatccccccccacctgagaagccccgccggcaccaccaccctgacccccagcagccaggccctgaccgagacccccaccagcagcgactggcagagcaccgacgccacccccaccctgaccaacagcagctag

SEQ ID NO: 13457 - DNA, 657 bp, Artificial Sequence
  Description of Artificial Sequence: Synthetic coding sequence
atggacgccgagcaccccgagctgagaagctacgcccagagccagggctggtggaccggcgagggcgagttcaacttcagcgaggtgttcagccccgtggaggaccacctggactgcggcgccggcaaggacagcctggagaagcaggaggagagcatcaccgtgcagaccatgatgaacaccctgagagacaaggccagcggcgtgtgcatcgacagcgagttcttcctgaccaccgccagcggcgtgagcgtgctgccccagaacagaagcagcccctgcatccactacttcaccggcacccccgaccccagcagaagcatcttcaagcccttcatcttcgtggacgacgtgaagctggtgcccaagacccagagcccctgcttcggcgacgacgaccccgccaagaaggagcccagattccaggagaagcccgacagaagacacgagctgtacaaggcccacgagtgggccagagccatcatcgagagcgaccaggagcagggcagaaagctgagaagcaccatgctggagctggagaagcagggcctggaggccatggaggagatcctgaccagcagcgagcccctggaccccgccgaggtgggcgacctgttctacgactgcgtggacaccgagatcaagttcttcaagtag

SEQ ID NO: 13458 - DNA, 573 bp, Artificial Sequence
  Description of Artificial Sequence: Synthetic coding sequence
atggccctgctggccgagcacctgctgaagcccctgcccgccgacaagcagatcgagaccggccccttcctggaggccgtgagccacctgccccccttcttcgactgcctgggcagccccgtgttcacccccatcaaggccgacatcagcggcaacatcaccaagatcaaggccgtgtacgacaccaaccccgccaagttcagaaccctgcagaacatcctggaggtggagaaggagatcggcctgagattcatccaggtgttcctgcagagcatctgcgacggcgagagagacgagaaccaccccaacctgatcagagtgaacgccaccaaggcctacgagatggccctgaagaagtaccacggctggatcgtgcagaagatcttccaggccgccctgtacgccgccccctacaagagcgacttcctgaaggccctgagcaagggccagaacgtgaccgaggaggagtgcctggagaagatcagactgttcctggtgaactacaccgccaccatcgacgtgatctacgagatgtacacccagatgaacgccgagctgaactacaaggtgtag

SEQ ID NO: 13459 - DNA, 762 bp, Artificial Sequence
  Description of Artificial Sequence: Synthetic coding sequence
atgagcatctgcagcagcctggccagaaagttccccaagctgaccatcatcggcgaggaggacctgcccagcgaggaggtggaccaggagctgatcgaggacagccagtgggaggagatcctgaagcagccctgccccagccagtacagcgccatcaaggaggaggacctggtggtgtgggtggaccccctggacggcaccaaggagtacaccgagggcctgctggacaacgtgaccgtgctgatcggcatcgcctacgagggcaaggccatcgccggcgtgatcaaccagccctactacaactacgaggccggccccgacgccgtgctgggcagaaccatctggggcgtgctgggcctgggcgccttcggcttccagctgaaggaggtgcccgccggcaagcacatcatcaccaccaccagaagccacagcaacaagctggtgaccgactgcgtggccgccatgaaccccgacgccgtgctgagagtgggcggcgccggcaacaagatcatccagctgatcgagggcaaggccagcgcctacgtgttcgccagccccggctgcaagaagtgggacacctgcgcccccgaggtgatcctgcacgccgtgggcggcaagctgaccgacatccacggcaacgtgctgcagtaccacaaggacgtgaagcacatgaacagcgccggcgtgctggccaccctgagaaactacgactactacgccagcagagtgcccgagagcatcaagaacgccctggtgccctag

SEQ ID NO: 13460 - DNA, 1590 bp, Artificial Sequence
  Description of Artificial Sequence: Synthetic coding sequence
atgggcgcctacctgagccagcccaacaccgtgaagtgcagcggcgacggcgtgggcgtgagcatggaggacgcccacaactgcatccccgagctggacagcgagaccgccatgttcagcgtgtacgacggccacggcggcgaggaggtggccctgtactgcgccaagtacctgcccgacatcatcaaggaccagaaggcctacaaggagggcaagctgcagaaggccctggaggacgccttcctggccatcgacgccaagctgaccaccgaggaggtgatcaaggagctggcccagatcgccggcagacccaccgaggacgaggacgagaaggagaaggtggccgacgaggacgacgtggacaacgaggaggccgccctgctgcacgaggaggccaccatgaccatcgaggagctgctgaccagatacggccagaactgccacaagggccccccccacagcaagagcggcggcggcaccggcgaggagcccggcagccagggcctgaacggcgaggccggccccgaggacagcaccagagagacccccagccaggagaacggccccaccgccaaggcctacaccggcttcagcagcaacagcgagagaggcaccgaggccggccaggtgggcgagcccggcatccccaccggcgaggccggccccagctgcagcagcgccagcgacaagctgcccagagtggccaagagcaagttcttcgaggacagcgaggacgagagcgacgaggccgaggaggaggaggaggacagcgaggagtgcagcgaggaggaggacggctacagcagcgaggaggccgagaacgaggaggacgaggacgacaccgaggaggccgaggaggacgacgaggaggaggaggaggagatgatggtgcccggcatggagggcaaggaggagcccggcagcgacagcggcaccaccgccgtggtggccctgatcagaggcaagcagctgatcgtggccaacgccggcgacagcagatgcgtggtgagcgaggccggcaaggccctggacatgagctacgaccacaagcccgaggacgaggtggagctggccagaatcaagaacgccggcggcaaggtgaccatggacggcagagtgaacggcggcctgaacctgagcagagccatcggcgaccacttctacaagagaaacaagaacctgccccccgaggagcagatgatcagcgccctgcccgacatcaaggtgctgaccctgaccgacgaccacgagttcatggtgatcgcctgcgacggcatctggaacgtgatgagcagccaggaggtggtggacttcatccagagcaagatcagccagagagacgagaacggcgagctgagactgctgagcagcatcgtggaggagctgctggaccagtgcctggcccccgacaccagcggcgacggcaccggctgcgacaacatgacctgcatcatcatctgcttcaagcccagaaacaccgccgagctgcagcccgagagcggcaagagaaagctggaggaggtgctgagcaccgagggcgccgaggagaacggcaacagcgacaagaagaagaaggccaagagagactag

SEQ ID NO: 13461 - DNA, 1293 bp, Artificial Sequence
  Description of Artificial Sequence: Synthetic coding sequence
atgaccttcgagctgtacgacgagtggatccaggccagcaacgtgcaggagcaggacaagaagctgcaggccctgtggaacgcctgcgagaagctgcccaaggccaaccacaacaacatcagatacctgatcaagttcctgagcaagctgagcgagtaccaggacgtgaacaagatgacccccagcaacatggccatcgtgctgggccccaacctgctgtggccccaggccgagggcaacatcaccgagatgatgaccaccgtgagcctgcagatcgtgggcatcatcgagcccatcatccagcacgccgactggttcttccccggcgagatcgagttcaacatcaccggcaactacggcagccccgtgcacgtgaaccacaacgccaactacagcagcatgcccagccccgacatggaccccgccgacagaagacagcccgagcaggccagaagacccctgagcgtggccaccgacaacatgatgctggagttctacaagaaggacggcatgggcgtgagagtgatggacaccaactgggtggccagaagaggcagcagcgccggcagaaaggtgagctgcgccccccccagcatgcagccccccgccccccccgccgagctggccgcccccctgcccagccccctgcccgagcagcccctggacagccccgccgcccccgccctgagccccagcggcctgggcctgcagcccggccccgagagaaccagcaccaccaagagcaaggagctgagccccggcagcgcccagaagggcagccccggcagcagccagggcaccgcctgcgccggcacccagcccggcgcccagcccggcgcccagcccggcgccagccccagccccagccagccccccgccgaccagagcccccacaccctgagaaaggtgagcaagaagctggcccccatcccccccaaggtgcccttcggccagcccggcgccatggccgaccagagcgccggccagcccagccccgtgagcctgagccccaccccccccagcacccccagcccctacggcctgagctacccccagggctacagcctggccagcggccagctgagccccgccgccgccccccccctggccagccccagcgtgttcaccagcaccctgagcaagagcagacccacccccaagcccagacagagacccaccctgccccccccccagccccccaccgtgaacctgagcgccagcagcccccagagcaccgaggcccccatgctggacggcatgagccccggcgagagcatgagcaccgccgtgtag

SEQ ID NO: 13462 - DNA, 846 bp, Artificial Sequence
  Description of Artificial Sequence: Synthetic coding sequence
atgcccggccccagaagactgagaagccccggcggcagcggctgcagcagcagaggcagcggccccagactgagcaccagaagatggagaccctgctgctactgcggcggcagcggcgtgtggctgctgagaaccccccccagccccagcgcctggcccgccagaagatgccccagacacagattcgagttctgcgagcccgccttcgtggtgggcaactgcctgcagatcgccagcgacagccaccagtacgacagaatctactgcggcgccggcgtgcagaaggaccacgagaactacatgaagatcctgctgaaggtgggcggcatcctggtgatgcccatcgaggaccagctgacccagatcatgagaaccggccagaacacctgggagagcaagaacatcctggccgtgagcttcgcccccctggtgcagcccagcaagaacgacaacggcaagcccgacagcgtgggcctgcccccctgcgccgtgagaaacctgcaggacctggccagaatctacatcagaagaaccctgagaaacttcatcaacgacgagatgcaggccaagggcatcccccagagagccccccccaagagaaagagaaagagagtgaagcagagaatcaacacctacgtgttcgtgggcaaccagctgatcccccagcccctggacagcgaggaggacgagaagatggaggaggacaacaaggaggaggaggagaaggaccacaacgaggccatgaagcccgaggagcccccccagaacctgctgagagagaagatcatgaagctgcccctgcccgagagcctgaaggcctacctgacctacttcagagacaagtag

SEQ ID NO: 13463 - DNA, 1251 bp, Artificial Sequence
  Description of Artificial Sequence: Synthetic coding sequence
atgagccccgccatgctgagcgtgctggtgaagatgatgctggcccaggcccaggagagcgtgttcgagaagatcagcctgcccggcatcagaaacgagttcttcatgctggtgaaggtggcccaggaggccgccaaggtgggcgaggtgtaccagcagctgcacgccgccatgagccaggcccccgtgaaggagaacatcccctacagctgggccagcctggcctgcgtgaaggcccaccactacgccgccctggcccactacttcaccgccatcctgctgatcgaccaccaggtgaagcccggcaccgacctggaccaccaggagaagtgcctgagccagctgtacgaccacatgcccgagggcctgacccccctggccaccctgaagaacgaccagcagagaagacagctgggcaagagccacctgagaagagccatggcccaccacgaggagagcgtgagagaggccagcctgtgcaagaagctgagaagcatcgaggtgctgcagaaggtgctgtgcgccgcccaggagagaagcagactgacctacgcccagcaccaggaggaggacgacctgctgaacctgatcgacgcccccagcgtggtggccaagaccgagcaggaggtggacatcatcctgccccagttcagcaagctgaccgtgaccgacttcttccagaagctgggccccctgagcgtgttcagcgccaacaagagatggaccccccccagaagcatcagattcaccgccgaggagggcgacctgggcttcaccctgagaggcaacgcccccgtgcaggtgcacttcctggacccctactgcagcgccagcgtggccggcgccagagagggcgactacatcgtgagcatccagctggtggactgcaagtggctgaccctgagcgaggtgatgaagctgctgaagagcttcggcgaggacgagatcgagatgaaggtggtgagcctgctggacagcaccagcagcatgcacaacaagagcgccacctacagcgtgggcatgcagaagacctacagcatgatctgcctggccatcgacgacgacgacaagaccgacaagaccaagaagatcagcaagaagctgagcttcctgagctggggcaccaacaagaacagacagaagagcgccagcaccctgtgcctgcccagcgtgggcgccgccagaccccaggtgaagaagaagctgcccagccccttcagcctgctgaacagcgacagcagctggtactag

SEQ ID NO: 13464 - DNA, 6201 bp, Artificial Sequence
  Description of Artificial Sequence: Synthetic coding sequence
atgtgcagcacccccggcatgcccgcccccggcgccagcctggccctgagagtgagcttcgtggacgtgcaccccgacgtgatccccgtgcagctgtggggcctggtgggcgagagaagaggcgagtacctgagactgagcagagagatccaggaggccgccgccaccagaggccagtgggccctgggcagcgccagcgccagccccggcgagctgtgcctggtgcaggtgggcctgctgtggcacagatgcagagtggtgagcagacaggcccaggagagcagagtgttcctgctggacgagggcagaaccatcaccgccggcgccggcagcctggcccccggcagaagagagttcttcaacctgcccagcgaggtgctgggctgcgtgctggccggcctggtgcccgccggctgcggcgccggcagcggcgagcccccccagcactggcccgccgacgccgtggacttcctgagcaacctgcagggcaaggaggtgcacggctgcgtgctggacgtgctgctgctgcacagactggtgctgctggaggtgcccgacgtgttccagcagatgagagagctgggcctggccagaagagtgcccgacagcctgttcagaagcctgctggagagatacctgaccgccgccaccgccagcgtgggcagcggcgtgcccgtgctgagcagagtgcccctgaagcagaagcagcccggcctggactacttctacccccagctgcagctgggcgtgaccgaggccgtggtgatcacccaggtgtgccacccccacagaatccactgccagctgagaagcgtgagccaggagatccacagactgagcgagagcatggcccaggtgtacagaggcagcaccggcaccggcgacgagaacagcaccagcgccacctgggaggagagagaggagagccccgacaagcccggcagcccctgcgccagctgcggcctggacggccactggtacagagccctgctgctggagaccttcagaccccagagatgcgcccaggtgctgcacgtggactacggcagaaaggagctggtgagctgcagcagcctgagatacctgctgcccgagtacttcagaatgcccgtggtgacctacccctgcgccctgtacggcctgtgggacggcggcagaggctggagcagaagccaggtgggcgacctgaagaccctgatcctgggcaaggccgtgaacgccaagatcgagttctactgcagcttcgagcacgtgtactacgtgagcctgtacggcgaggacggcatcaacctgaacagagtgttcggcgtgcagagctgctgcctggccgacagagtgctgcagagccaggccaccgaggaggaggagcccgagaccagccagagccagagccccgccgaggaggtggacgaggagatcagcctgcccgccctgagaagcatcagactgaagatgaacgccttctacgacgcccaggtggagttcgtgaagaaccccagcgagttctggatcagactgagaaagcacaacgtgaccttcagcaagctgatgagaagaatgtgcggcttctacagcagcgccagcaagctggacggcgtggtgctgaagcccgagcccgacgacctgtgctgcgtgaagtggaaggagaacggctactacagagccatcgtgaccaagctggacgacaagagcgtggacgtgttcctggtggacagaggcaacagcgagaacgtggactggtacgacgtgagaatgctgctgccccagttcagacagctgcccatcctggccgtgaagtgcaccctggccgacatctggcccctgggcaagacctggagccaggaggccgtgagcttcttcaagaagaccgtgctgcacaaggagctggtgatccacatcctggacaagcaggaccaccagtacgtgatcgagatcctggacgagagcagaaccggcgaggagaacatcagcaaggtgatcgcccaggccggctacgccaagtaccaggagttcgagaccaaggagaacatcctggtgaacgcccacagccccggccacgtgagcaaccacttcaccaccgagagcaacaagatccccttcgccaagaccggcgagggcgagcagaaggccaagagagagaacaagaccaccagcgtgagcaaggccctgagcgacaccaccgtggtgaccaacggcagcaccgagctggtggtgcaggagaaggtgaagagagccagcgtgtacttccccctgatgcagaactgcctggagatcaagcccggcagcagcagcaagggcgagctggaggtgggcagcaccgtggaggtgagagtgagctacgtggagaaccccggctacttctggtgccagctgaccagaaacatccagggcctgaagaccctgatgagcgacatccagtactactgcaagaacaccgccgccccccaccagagaaacaccctggcctgcctggccaagagaaccgtgaacagacagtggagcagagccctgatcagcggcatccagagcgtggagcacgtgaacgtgaccttcgtggactacggcgacagagagatggtgagcgtgaagaacatctacagcatcagcgaggagttcctgaaggtgaaggcccaggccttcagatgcagcctgtacaacctgatccagcccgtgggccagaaccccttcgtgtgggacgtgaaggccatccaggccttcaacgagttcatcgacaacgcctggcagaagaacctggagctgaagtgcaccatcttcgccctggccagcatcaacgaggagctgttcaacatcgtggacctgctgacccccttccagagcgcctgccacttcctggtggagaagagactggccagacccgtgaagctgcagaagcccctggagagcagcgtgcagctgcacagctacttctacagcacccacgacatgaagatcggcagcgaggagctggtgtacatcacccacatcgacgacccctggaccttctactgccagctggccagaaacgccaacatcctggagcagctgagctgcagcatcacccagctgagcaaggtgctgctgaacctgaagaccagccccctgaaccccggcaccctgtgcctggccaagtacaccgacggcaactggtacagaggcatcgtgatcgagaaggagcccaagaaggtgttcttcgtggacttcggcaacatctacgtggtgaccagcgacgacctgctgcccatccccagcgacgcctacgacgtgctgctgctgcccatgcaggccgtgagatgcagcctgagcgacatccccgaccacatccccgaggaggtggtggtgtggttccaggagaccatcctggacaagagcctgaaggccctggtggtggccaaggaccccgacggcaccctgatcatcgagctgtacggcgacaacatccagatcagcgccagcatcaacaagaagctgggcctgctgagctacaaggacagaatcagaaagaaggagagcgaggtgctgtgcagcaccaccgagaccctggaggagaagaacgagaacatgaagctgccctgcaccgagtacctgagcaagagcgtgggctacaagctgcccaacaaggagatcctggaggagagctacaagccccagatcaacagcagctacaaggagctgaagctgctgcagagcctgaccaagaccaacctggtgacccagtaccaggacagcgtgggcaacaagaacagccaggtgttccccctgaccaccgagaagaaggaggagatcagcgccgagacccccctgaagaccgccagagtggaggccaccctgagcgagagaaagatcggcgacagctgcgacaaggacctgcccctgaagttctgcgagttcccccagaagaccatcatgcccggcttcaagaccaccgtgtacgtgagccacatcaacgacctgagcgacttctacgtgcagctgatcgaggacgaggccgagatcagccacctgagcgagagactgaacagcgtgaagaccagacccgagtactacgtgggcccccccctgcagagaggcgacatgatctgcgccgtgttccccgaggacaacctgtggtacagagccgtgatcaaggagcagcagcccaacgacctgctgagcgtgcagttcatcgactacggcaacgtgagcgtggtgcacaccaacaagatcggcagactggacctggtgaacgccatcctgcccggcctgtgcatccactgcagcctgcagggcttcgaggtgcccgacaacaagaacagcaagaagatgatgcactacttcagccagagaaccagcgaggccgccatcagatgcgagttcgtgaagttccaggacagatgggaggtgatcctggccgacgagcacggcatcatcgccgacgacatgatcagcagatacgccctgagcgagaagagccaggtggagctgagcacccaggtgatcaagagcgccagcagcaagagcgtgaacaagagcgacatcgacaccagcgtgttcctgaactggtacaaccccgagaagaagatgatcagagcctacgccaccgtgatcgacggccccgagtacttctggtgccagttcgccgacaccgagaagctgcagtgcctggaggtggaggtgcagaccgccggcgagcaggtggccgacagaagaaactgcatcccctgcccctacatcggcgacccctgcatcgtgagatacagagaggacggccactactacagagccctgatcaccaacatctgcgaggactacctggtgagcgtgagactggtggacttcggcaacatcgaggactgcgtggaccccaaggccctgtgggccatccccagcgagctgctgagcgtgcccatgcaggccttcccctgctgcctgagcggcttcaacatcagcgagggcctgtgcagccaggagggcaacgactacttctacgagatcatcaccgaggacgtgctggagatcaccatcctggagatcagaagagacgtgtgcgacatccccctggccatcgtggacctgaagagcaagggcaagagcatcaacgagaagatggagaagtacagcaagaccggcatcaagagcgccctgccctacgagaacatcgacagcgagatcaagcagaccctgggcagctacaacctggacgtgggcctgaagaagctgagcaacaaggccgtgcagaacaagatctacatggagcagcagaccgacgagctggccgagatcaccgagaaggacgtgaacatcatcggcaccaagcccagcaacttcagagaccccaagaccgacaacatctgcgagggcttcgagaacccctgcaaggacaagatcgacaccgaggagctggagggcgagctggagtgccacctggtggacaaggccgagttcgacgacaagtacctgatcaccggcttcaacaccctgctgccccacgccaacgagaccaaggagatcctggagctgaacagcctggaggtgcccctgagccccgacgacgagagcaaggagttcctggagctggagagcatcgagctgcagaacagcctggtggtggacgaggagaagggcgagctgagccccgtgccccccaacgtgcccctgagccaggagtgcgtgaccaagggcgccatggagctgttcaccctgcagctgcccctgagctgcgaggccgagaagcagcccgagctggagctgcccaccgcccagctgcccctggacgacaagatggaccccctgagcctgggcgtgagccagaaggcccaggagagcatgtgcaccgaggacatgagaaagagcagctgcgtggagagcttcgacgaccagagaagaatgagcctgcacctgcacggcgccgactgcgaccccaagacccagaacgagatgaacatctgcgaggaggagttcgtggagtacaagaacagagacgccatcagcgccctgatgcccctgttcagcgaggaggagagcagcgacggcagcaagcacaacaacggcctgcccgaccacatcagcgcccagctgcagaacacctacaccctgaaggccttcaccgtgggcagcaagtgcgtggtgtggagcagcctgagaaacacctggagcaagtgcgagatcctggagaccgccgaggagggcaccagaaagagaggcctggaggtgatggagatctag

SEQ ID NO: 13465 - DNA, 264 bp, Artificial Sequence
  Description of Artificial Sequence: Synthetic coding sequence
atgagcagctgcgtgagcagccagcccagcagcaacagagccgccccccaggacgagctgggcggcagaggcagcagcagcagcgagagccagaagccctgcgaggccctgagaggcctgagcagcctgagcatccacctgggcatggagagcttcatcgtggtgaccgagtgcgagcccggctgcgccgtggacctgggcctggccagagacagacccctggaggccgacggccaggaggtgcccctggacaccagcggctag

SEQ ID NO: 13466 - DNA, 2469 bp, Artificial Sequence
  Description of Artificial Sequence: Synthetic coding sequence
atggccgccgagggcgaccccgagtggggccccaccccccccagcaccagcgccaccaccgccgccagaagagccgtgaacaaggtggtgtacgacgaccacgagagcgaggaggaggaggaggaggaggacatggtgagcgaggaggaggaggaggaggacggcgacgccgaggagacccaggacagcgaggacgacgaggaggacgagatggaggaggacgacgacgacagcgactaccccgaggagatggaggacgacgacgacgacgccagctactgcaccgagagcagcttcagaagccacagcacctacagcagcacccccggcagaagaaagcccagagtgcacagacccagaagccccatcctggaggagaaggacatcccccccctggagttccccaagagcagcgaggacctgatggtgcccaacgagcacatcatgaacgtgatcgccatctacgaggtgctgagaaacttcggcaccgtgctgagactgagccccttcagattcgaggacttctgcgccgccctggtgagccaggagcagtgcaccctgatggccgagatgcacgtggtgctgctgaaggccgtgctgagagaggaggacaccagcaacaccaccttcggccccgccgacctgaaggacagcgtgaacagcaccctgtacttcatcgacggcatgacctggcccgaggtgctgagagtgtactgcgagagcgacaaggagtaccaccacgtgctgccctaccaggaggccgaggactacccctacggccccgtggagaacaagatcaaggtgctgcagttcctggtggaccagttcctgaccaccaacatcgccagagaggagctgatgagcgagggcgtgatccagtacgacgaccactgcagagtgtgccacaagctgggcgacctgctgtgctgcgagacctgcagcgccgtgtaccacctggagtgcgtgaagccccccctggaggaggtgcccgaggacgagtggcagtgcgaggtgtgcgtggcccacaaggtgcccggcgtgaccgactgcgtggccgagatccagaagaacaagccctacatcagacacgagcccatcggctacgacagaagcagaagaaagtactggttcctgaacagaagactgatcatcgaggaggacaccgagaacgagaacgagaagaagatctggtactacagcaccaaggtgcagctggccgagctgatcgactgcctggacaaggactactgggaggccgagctgtgcaagatcctggaggagatgagagaggagatccacagacacatggacatcaccgaggacctgaccaacaaggccagaggcagcaacaagagcttcctggccgccgccaacgaggagatcctggagagcatcagagccaagaagggcgacatcgacaacgtgaagagccccgaggagaccgagaaggacaagaacgagaccgagaacgacagcaaggacgccgagaagaacagagaggagttcgaggaccagagcctggagaaggacagcgacgacaagacccccgacgacgaccccgagcagggcaagagcgaggagcccaccgaggtgggcgacaagggcaacagcgtgagcgccaacctgggcgacaacaccaccaacgccaccagcgaggagaccagccccagcgagggcagaagccccgtgggctgcctgagcgagacccccgacagcagcaacatggccgagaagaaggtggccagcgagctgccccaggacgtgcccgaggagcccaacaagacctgcgagagcagcaacaccagcgccaccaccaccagcatccagcccaacctggagaacagcaacagcagcagcgagctgaacagcagccagagcgagagcgccaaggccgccgacgaccccgagaacggcgagagagagagccacacccccgtgagcatccaggaggagatcgtgggcgacttcaagagcgagaagagcaacggcgagctgagcgagagccccggcgccggcaagggcgccagcggcagcaccagaatcatcaccagactgagaaaccccgacagcaagctgagccagctgaagagccagcaggtggccgccgccgcccacgaggccaacaagctgttcaaggagggcaaggaggtgctggtggtgaacagccagggcgagatcagcagactgagcaccaagaaggaggtgatcatgaagggcaacatcaacaactacttcaagctgggccaggagggcaagtacagagtgtaccacaaccagtacagcaccaacagcttcgccctgaacaagcaccagcacagagaggaccacgacaagagaagacacctggcccacaagttctgcctgacccccgccggcgagttcaagtggaacggcagcgtgcacggcagcaaggtgctgaccatcagcaccctgagactgaccatcacccagtacggcgagaacctgtag

SEQ ID NO: 13467 - DNA, 552 bp, Artificial Sequence
  Description of Artificial Sequence: Synthetic coding sequence
atgctgcagcagacctggaccagcagatgcctgatgaagttctacgccgtggtggccaccagccccgccagctgggagagccacaagatcgccgagagaatcgagcagagaatcctgaacagcaaccccgtgatggaggccttcggcaacgcctgcaccctgagaaacaacaacagcagcagattcggcaagttcatccagctgcagctgaacagagcccagcagatgaccggcgccgccgtgcagacctacctgctggagaagaccagagtggcctgccaggccagcagcgagagaaacttccacatcttctaccagatctgcaagggcgccagcgaggacgagagactgcagtggcacctgcccgagggcgccgccttcagctggctgcccaaccccgagagaagcctggaggaggactgcttcgaggtgaccagagaggccatgctgcacctgggcatcgacacccccacccagaacaacatcttcaaggtgagaagaaaggccacccccctgaagttcggcagagacgacggccagcccttcgcctag

SEQ ID NO: 13468 - DNA, 744 bp, Artificial Sequence; identical to SEQ ID NO: 10972
  Description of Artificial Sequence: Synthetic coding sequence

SEQ ID NO: 13469 - DNA, 981 bp, Artificial Sequence
  Description of Artificial Sequence: Synthetic coding sequence
atgctgggcggcgtgggcgaggagaacgagaagctgtggagcttcaccaagaaggccagccacatccagctggacagcctgcccgaggtgcccctgctggtggacgtgccctgcctgagcgcccagctggacgacagcatcctgaacatcgtgaaggaccacatcttcaagcacggcaccgtggccagcagaccccccgtgcagatcgaggagctgatcgagaagcccggcggcatcatcgtgagatggtgcaaggtggacgacgacttcaccgcccaggactacagactgcagttcagaaagtgcaccagcaaccacttcgaggacgtgtacgtgggcagcgagaccgagttcatcgtgctgcacatcgaccccaacgtggactaccagttcagagtgtgcgccagaggcgacggcagacaggagtggagcccctggagcgtgccccagatcggccacagcaccctggtgccccacgagtggaccgccggcttcgagggctacagcctgagcagcagaagaaacatcgccctgagaaacgacagcgagagcagcggcgtgctgtacagcagagcccccacctacttctgcggccagaccctgaccttcagagtggagaccgtgggccagcccgacagaagagacagcatcggcgtgtgcgccgagaagcaggacggctacgacagcctgcagagagaccaggccgtgtgcatcagcaccaacggcgccgtgttcgtgaacggcaaggagatgaccaaccagctgcccgccgtgaccagcggcagcaccgtgaccttcgacatcgaggccgtgaccctgggcaccaccagcaacaacgagggcggccacttcaagctgagagtgaccatcagcagcaacaacagagaggtggtgttcgactggctgctggaccagagctgcggcagcctgtacttcggctgcagcttcttctaccccggctggaaggtgctggtgttctag

SEQ ID NO: 13470 - DNA, 2436 bp, Artificial Sequence
  Description of Artificial Sequence: Synthetic coding sequence
atggtgagcgaggaggaggaggaggaggacggcgacgccgaggagacccaggacagcgaggacgacgaggaggacgagatggaggaggacgacgacgacagcgactaccccgaggagatggaggacgacgacgacgacgccagctactgcaccgagagcagcttcagaagccacagcacctacagcagcacccccggcagaagaaagcccagagtgcacagacccagaagccccatcctggaggagaaggacatcccccccctggagttccccaagagcagcgaggacctgatggtgcccaacgagcacatcatgaacgtgatcgccatctacgaggtgctgagaaacttcggcaccgtgctgagactgagccccttcagattcgaggacttctgcgccgccctggtgagccaggagcagtgcaccctgatggccgagatgcacgtggtgctgctgaaggccgtgctgagagaggaggacaccagcaacaccaccttcggccccgccgacctgaaggacagcgtgaacagcaccctgtacttcatcgacggcatgacctggcccgaggtgctgagagtgtactgcgagagcgacaaggagtaccaccacgtgctgccctaccaggaggccgaggactacccctacggccccgtggagaacaagatcaaggtgctgcagttcctggtggaccagttcctgaccaccaacatcgccagagaggagctgatgagcgagggcgtgatccagtacgacgaccactgcagagtgtgccacaagctgggcgacctgctgtgctgcgagacctgcagcgccgtgtaccacctggagtgcgtgaagccccccctggaggaggtgcccgaggacgagtggcagtgcgaggtgtgcgtggcccacaaggtgcccggcgtgaccgactgcgtggccgagatccagaagaacaagccctacatcagacacgagcccatcggctacgacagaagcagaagaaagtactggttcctgaacagaagactgatcatcgaggaggacaccgagaacgagaacgagaagaagatctggtactacagcaccaaggtgcagctggccgagctgatcgactgcctggacaaggactactgggaggccgagctgtgcaagatcctggaggagatgagagaggagatccacagacacatggacatcaccgaggacctgaccaacaaggccagaggcagcaacaagagcttcctggccgccgccaacgaggagatcctggagagcatcagagccaagaagggcgacatcgacaacgtgaagagccccgaggagaccgagaaggacaagaacgagaccgagaacgacagcaaggacgccgagaagaacagagaggagttcgaggaccagagcctggagaaggacagcgacgacaagacccccgacgacgaccccgagcagggcaagagcgaggagcccaccgaggtgggcgacaagggcaacagcgtgagcgccaacctgggcgacaacaccaccaacgccaccagcgaggagaccagccccagcgagggcagaagccccgtgggctgcctgagcgagacccccgacagcagcaacatggccgagaagaaggtggccagcgagctgccccaggacgtgcccgtgggcgacttcaagagcgagaagagcaacggcgagctgagcgagagccccggcgccggcaagggcgccagcggcagcaccagaatcatcaccagactgagaaaccccgacagcaagctgagccagctgaagagccagcaggtggccgccgccgcccacgaggccaacaagctgttcaaggagggcaaggaggtgctggtggtgaacagccagggcgagatcagcagactgagcaccaagaaggaggtgatcatgaagggcaacatcaacaactacttcaagctgggccaggagggcaagtacagagtgtaccacaaccagtacagcaccaacagcttcgccctgaacaagcaccagcacagagaggaccacgacaagagaagacacctggcccacaagttctgcctgacccccgccggcgagttcaagtggaacggcagcgtgcacggcagcaaggtgctgaccatcagcaccctgagactgaccatcacccagctggagaacaacatccccagcagcttcctgcaccccaactgggccagccacagagccaactggatcaaggccgtgcagatgtgcagcaagcccagagagttcgccctggccctggccatcctggagtgcgccgtgaagcccgtggtgatgctgcccatctggagagagagcctgggccacaccagactgcacagaatgaccagcatcgagagagaggagaaggagaaggtgaagaagagagaggagaccggcagaagaagaaacgacgccgccagcgacatgggcaagatccacatcagcagctag

SEQ ID NO: 13471 - DNA, 1752 bp, Artificial Sequence
  Description of Artificial Sequence: Synthetic coding sequence
atggcccccgagctgacccccgaggaggagcaggccaccaagcagttcctggaggagatcaacaagtggaccgtgcagtacaacgtgagccccctgagctggaacgtggccgtgaagttcctgatggccagaaagttcgacgtgctgagagccatcgagctgttccacagctacagagagaccagaagaaaggagggcatcgtgaagctgaagccccacgaggagcccctgagaagcgagatcctgagcggcaagttcaccatcctgaacgtgagagaccccaccggcgccagcatcgccctgttcaccgccagactgcaccacccccacaagagcgtgcagcacgtggtgctgcaggccctgttctacctgctggacagagccgtggacagcttcgagacccagagaaacggcctggtgttcatctacgacatgtgcggcagcaactacgccaacttcgagctggacctgggcaagaaggtgctgaacctgctgaagggcgccttccccgccagactgaagaaggtgctgatcgtgggcgcccccatctggttcagagtgccctacagcatcatcagcctgctgctgaaggacaaggtgagagagagaatccagatcctgaagaccagcgaggtgacccagcacctgcccagagagtgcctgcccgagaacctgggcggctacgtgaagatcgacctggccacctggaacttccagttcctgccccaggtgaacggccaccccgaccccttcgacgagatcatcctgttcagcctgccccccgccctggactgggacagcgtgcacgtgcccggcccccacgccatgaccatccaggagctggtggactacgtgaacgccagacagaagcagggcatctacgaggagtacgaggacatcagaagagagaaccccgtgggcaccttccactgcagcatgagccccggcaacctggagaagaacagatacggcgacgtgccctgcctggaccagaccagagtgaagctgaccaagagaagcggccacacccagaccgactacatcaacgccagcttcatggacggctacaagcagaagaacgcctacatcggcacccagggccccctggagaacacctacagagacttctggctgatggtgtgggagcagaaggtgctggtgatcgtgatgaccaccagattcgaggagggcggcagaagaaagtgcggccagtactggcccctggagaaggacagcagaatcagattcggcttcctgaccgtgaccaacctgggcgtggagaacatgaaccactacaagaagaccaccctggagatccacaacaccgaggagagacagaagagacaggtgacccacttccagttcctgagctggcccgactacggcgtgcccagcagcgccgccagcctgatcgacttcctgagagtggtgagaaaccagcagagcctggccgtgagcaacatgggcgccagaagcaagggccagtgccccgagccccccatcgtggtgcactgcagcgccggcatcggcagaaccggcaccttctgcagcctggacatctgcctggcccagctggaggagctgggcaccctgaacgtgttccagaccgtgagcagaatgagaacccagagagccttcagcatccagacccccgagcagtactacttctgctacaaggccatcctggagttcgccgagaaggagggcatggtgagcagcggccagaacctgctggccgtggagagccagtag

SEQ ID NO: 13472 - DNA, 396 bp, Artificial Sequence; identical to SEQ ID NO: 13381
  Description of Artificial Sequence: Synthetic coding sequence

SEQ ID NO: 13473 - DNA, 435 bp, Artificial Sequence
  Description of Artificial Sequence: Synthetic coding sequence
atggccagcgtggccgccgccagagccgtgcccgtgggcagcggcctgagaggcctgcagagaaccctgcccctggtggtgatcctgggcgccaccggcaccggcaagagcaccctggccctgcagctgggccagagactgggcggcgagatcgtgagcgccgacagcatgcaggtgtacgagggcctggacatcatcaccaacaaggtgagcgcccaggagcagagaatctgcagacaccacatgatcagcttcgtggaccccctggtgaccaactacaccgtggtggacttcagaaacagagccaccgccctgatcgaggacatcttcgccagagacaagatccccatcgtggtgggcggcaccaactactacatcgagagcctgctgtggaaggtgctggtgaacaccaaggtgagcctggtgcacagctag

SEQ ID NO: 13474 - DNA, 1386 bp, Artificial Sequence
  Description of Artificial Sequence: Synthetic coding sequence
atggccgccagcagcctggagcagaagctgagcagactggaggccaagctgaagcaggagaacagagaggccagaagaagaatcgacctgaacctggacatcagcccccagagacccagacccaccctgcagctgcccctggccaacgacggcggcagcagaagccccagcagcgagagcagcccccagcaccccaccccccccgccagacccagacacatgctgggcctgcccagcaccctgttcacccccagaagcatggagagcatcgagatcgaccagaagctgcaggagatcatgaagcagaccggctacctgaccatcggcggccaggtgccccccagcctgtggagaggcgagggcggcggccccgccagactggaccccagctgggagagacagtggggcgccggcggcggcggcagacccggcaccctgcagcccagcctgagcagccagagataccaggccgagatcaacgacctggagaacctgggcgagatgggcagcggcacctgcggccaggtgtggaagatgagattcagaaagaccggccacgtgatcgccgtgaagcagatgagaagaagcggcaacaaggaggagaacaagagaatcctgatggacctggacgtggtgctgaagagccacgactgcccctacatcgtgcagtgcttcggcaccttcatcaccaacaccgacgtgttcatcgccatggagctgatgggcacctgcgccgagaagctgaagaagagaatgcagggccccatccccgagagaatcctgggcaagatgaccgtggccatcgtgaaggccctgtactacctgaaggagaagcacggcgtgatccacagagacgtgaagcccagcaacatcctgctggacgagagaggccagatcaagctgtgcgacttcggcatcagcggcagactggtggacagcaaggccaagaccagaagcgccggctgcgccgcctacatggcccccgagagaatcgacccccccgaccccaccaagcccgactacgacatcagagccgacgtgtggagcctgggcatcagcctggtggagctggccaccggccagttcccctacaagaactgcaagaccgacttcgaggtgctgaccaaggtgctgcaggaggagccccccctgctgcccggccacatgggcttcagcggcgacttccagagcttcgtgaaggactgcctgaccaaggaccacagaaagagacccaagtacaacaagctgctggagcacagcttcatcaagagatacgagaccctggaggtggacgtggccagctggttcaaggacgtgatggccaagaccgagagccccagaaccagcggcgtgctgagccagccccacctgcccttcttcagatag

SEQ ID NO: 13475 - DNA, 1611 bp, Artificial Sequence
  Description of Artificial Sequence: Synthetic coding sequence
atggagaccagcgacatccagatcttctaccaggaggaccccgagtgccagaacctgagcgagaacagctgcccccccagcgaggtgagcgacaccaacctgtacagccccttcaagcccagaaactaccagctggagctggccctgcccgccatgaagggcaagaacaccatcatctgcgcccccaccggctgcggcaagaccttcgtgagcctgctgatctgcgagcaccacctgaagaagttcccccagggccagaagggcaaggtggtgttcttcgccaaccagatccccgtgtacgagcagcagaagagcgtgttcagcaagtacttcgagagacacggctacagagtgaccggcatcagcggcgccaccgccgagaacgtgcccgtggagcagatcgtggagaacaacgacatcatcatcctgaccccccagatcctggtgaacaacctgaagaagggcaccatccccagcctgagcatcttcaccctgatgatcttcgacgagtgccacaacaccagcaagcagcacccctacaacatgatcatgttcaactacctggaccagaagctgggcggcagcagcggccccctgccccaggtgatcggcctgaccgccagcgtgggcgtgggcgacgccaagaacaccgacgaggccctggactacatctgcaagctgtgcgccagcctggacgccagcgtgatcgccaccgtgaagcacaacctggaggagctggagcaggtggtgtacaagccccagaagttcttcagaaaggtggagagcagaatcagcgacaagttcaagtacatcatcgcccagctgatgagagacaccgagagcctggccaagagaatctgcaaggacctggagaacctgagccagatccagaacagagagttcggcacccagaagtacgagcagtggatcgtgaccgtgcagaaggcctgcatggtgttccagatgcccgacaaggacgaggagagcagaatctgcaaggccctgttcctgtacaccagccacctgagaaagtacaacgacgccctgatcatcagcgagcacgccagaatgaaggacgccctggactacctgaaggacttcttcagcaacgtgagagccgccggcttcgacgagatcgagcaggacctgacccagagattcgaggagaagctgcaggagctggagagcgtgagcagagaccccagcaacgagaaccccaagctggaggacctgtgcttcatcctgcaggaggagtaccacctgaaccccgagaccatcaccatcctgttcgtgaagaccagagccctggtggacgccctgaagaactggatcgagggcaaccccaagctgagcttcctgaagcccggcatcctgaccggcagaggcaagaccaaccagaacaccggcatgaccctgcccgcccagaagtgcatcctggacgccttcaaggccagcggcgaccacaacatcctgatcgccaccagcgtggccgacgagggcatcgacatcgcccagtgcaacctggtgatcctgtacgagtacgtgggcaacgtgatcaagatgatccagaccagagaggaggagcaggaggtggccagcgccagcttctag

SEQ ID NO: 13476 - DNA, 2883 bp, Artificial Sequence; identical to SEQ ID NO: 9420
  Description of Artificial Sequence: Synthetic coding sequence

SEQ ID NO: 13477 - DNA, 666 bp, Artificial Sequence
  Description of Artificial Sequence: Synthetic coding sequence
atgctggccgccggcctgctggaggagctgagagacttccacagaagatacaaccagaagaacgtgagcgagaacagccaggactaccagcacggcatcttccagagcatcggcttcaaggagttccacgagtacctgatcaccgagggcaagtgcaccctggagaccagcaaccagctgctgaagaagggcatcgaggccctgaagcaggtgaccaagagatacgccagaaagcagaacagatgggtgaagaacagattcctgagcagacccggccccatcgtgccccccgtgtacggcctggaggtgagcgacgtgagcaagtgggaggagagcgtgctggagcccgccctggagatcgtgcagagcttcatccagggccacaagcccaccgccacccccatcaagatgccctacaacgaggccgagaacaagagaagctaccacctgtgcgacctgtgcgacagaatcatcatcggcgacagagagtgggccgcccacatcaagagcaagagccacctgaaccagctgaagaagagaagaagactggacagcgacgccgtgaacaccatcgagagccagagcgtgagccccgaccacaacaaggagcccaaggagaagggcagccccggccagaacgaccaggagctgaagtgcagcgtgtag

SEQ ID NO: 13478 - DNA, 2649 bp, Artificial Sequence
  Description of Artificial Sequence: Synthetic coding sequence
atgcccagagtgaagcccaagctggagaagcagctgcagaaggacaaggagaaggtggaggagttcaagagcatccccgccaagagcaacaacatcatcaacgagaccaccaccagaaacaacgccctggagaaggagaaggagaaggaggagaagaagctgaaggaggtgatggacagcctgaagcaggagacccagggcctgcagaaggagaaggagagcagagagaaggagctgatgggcttcagcaagagcgtgaacgaggccagaagcaagatggacgtggcccagagcgagctggacatctacctgagcagacacaacaccgccgtgagccagctgaccaaggccaaggaggccctgatcgccgccagcgagaccctgaaggagagaaaggccgccatcagagacatcgagggcaagctgccccagaccgagcaggagctgaaggagaaggagaaggagctgcagaagctgacccaggaggagaccaacttcaagagcctggtgcacgacctgttccagaaggtggaggaggccaagagcagcctggccatgaacagaagcagaggcaaggtgctggacgccatcatccaggagaagaagagcggcagaatccccggcatctacggcagactgggcgacctgggcgccatcgacgagaagtacgacgtggccatcagcagctgctgccacgccctggactacatcgtggtggacagcatcgacatcgcccaggagtgcgtgaacttcctgaagagacagaacatcggcgtggccaccttcatcggcctggacaagatggccgtgtgggccaagaagatgaccgagatccagacccccgagaacacccccagactgttcgacctggtgaaggtgaaggacgagaagatcagacaggccttctacttcgccctgagagacaccctggtggccgacaacctggaccaggccaccagagtggcctaccagaaggacagaagatggagagtggtgaccctgcagggccagatcatcgagcagagcggcaccatgaccggcggcggcagcaaggtgatgaagggcagaatgggcagcagcctggtgatcgagatcagcgaggaggaggtgaacaagatggagagccagctgcagaacgacagcaagaaggccatgcagatccaggagcagaaggtgcagctggaggagagagtggtgaagctgagacacagcgagagagagatgagaaacaccctggagaagttcaccgccagcatccagagactgatcgagcaggaggagtacctgaacgtgcaggtgaaggagctggaggccaacgtgctggccaccgcccccgacaagaagaagcagaagctgctggaggagaacgtgagcgccttcaagaccgagtacgacgccgtggccgagaaggccggcaaggtggaggccgaggtgaagagactgcacaacaccatcgtggagatcaacaaccacaagctgaaggcccagcaggacaagctggacaagatcaacaagcagctggacgagtgcgccagcgccatcaccaaggcccaggtggccatcaagaccgccgacagaaacctgcagaaggcccaggacagcgtgctgagaaccgagaaggagatcaaggacaccgagaaggaggtggacgacctgaccgccgagctgaagagcctggaggacaaggccgccgaggtggtgaagaacaccaacgccgccgaggagagcctgcccgagatccagaaggagcacagaaacctgctgcaggagctgaaggtgatccaggagaacgagcacgccctgcagaaggacgccctgagcatcaagctgaagctggagcagatcgacggccacatcgccgagcacaacagcaagatcaagtactggcacaaggagatcagcaagatcagcctgcaccccatcgaggacaaccccatcgaggagatcagcgtgctgagccccgaggacctggaggccatcaagaaccccgacagcatcaccaaccagatcgccctgctggaggccagatgccacgagatgaagcccaacctgggcgccatcgccgagtacaagaagaaggaggagctgtacctgcagagagtggccgagctggacaagatcacctacgagagagacagcttcagacaggcctacgaggacctgagaaagcagagactgaacgagttcatggccggcttctacatcatcaccaacaagctgaaggagaactaccagatgctgaccctgggcggcgacgccgagctggagctggtggacagcctggaccccttcagcgagggcatcatgttcagcgtgagaccccccaagaagagctggaagaagatcttcaacctgagcggcggcgagaagaccctgagcagcctggccctggtgttcgccctgcaccactacaagcccacccccctgtacttcatggacgagatcgacgccgccctggacttcaagaacgtgagcatcgtggccttctacatctacgagcagaccaagaacgcccagttcatcatcatcagcctgagaaacaacatgttcgagatcagcgacagactgatcggcatctacaagacctacaacatcaccaagagcgtggccgtgaaccccaaggagatcgccagcaagggcctgtgctag

SEQ ID NO: 13479 - DNA, 1038 bp, Artificial Sequence
  Description of Artificial Sequence: Synthetic coding sequence
atgttcctgaccagacccaaggtgtgcgtggacctgaacagaagagtgaccctgtacggcgtgttcaccatccacttcagccccaacgtgcccagcagatgcctgctgctggagctgctggacgtgagcgtgagcgagctgctgctgtacagcagccaccagggctgcagcatgtggatgatccagcactgcgccagagacgtgctggaggccctggccttcctgcaccacgagggctacgtgcacgccgacctgaagcccagaaacatcctgtggagcgccgagaacgagtgcttcaagctgatcgacttcggcctgagcttcaaggagggcaaccaggacgtgaagtacatccagaccgacggctacagagcccccgaggccgagctgcagaactgcctggcccaggccggcctgcagagcgacaccgagtgcaccagcgccgtggacctgtggagcctgggcatcatcctgctggagatgttcagcggcatgaagctgaagcacaccgtgagaagccaggagtggaaggccaacagcagcgccatcatcgaccacatcttcgccagcaaggccgtggtgaacgccgccatccccgcctaccacctgagagacctgatcaagagcatgctgcacgacgaccccagcagaagaatccccgccgagatggccctgtgcagccccttcttcagcatccccttcgccccccacatcgaggacctggtgatgctgcccacccccgtgctgagactgctgaacgtgctggacgacgactacctggagaacgaggaggagtacgaggacgtggtggaggacgtgaaggaggagtgccagaagtacggccccgtggtgagcctgctggtgcccaaggagaaccccggcagaggccaggtgttcgtggagtacgccaacgccggcgacagcaaggccgcccagaagctgctgaccggcagaatgttcgacggcaagttcgtggtggccaccttctaccccctgagcgcctacaagagaggctacctgtaccagaccctgctgtag

SEQ ID NO: 13480 - DNA, 954 bp, Artificial Sequence
  Description of Artificial Sequence: Synthetic coding sequence
atgtggctggccagagagggcatcgtggcccccctgcccggcgagtggaagccctgccaggacatcaccggcgacatctactacttcaacttcgccaacggccagagcatgtgggaccacccctgcgacgagcactacagaagcctggtgatccaggagagagccaagctgagcaccagcggcgccatcaagaagaagaagaagaagaaggagaagaaggacaagaaggacagagacccccccaagagcagcctggagacccagcccgaggagggcctgctgccccccagcagcttcctgtgcagcctgagcccccccagcgcccccggcctggccgacctggacctggaccaggagatgcaggccatcagcgagggcagctacaacaagggcaagagccccggcatgctgggcgacaccccctggagattcatgggcgccctgcccagaaagctgcagcccctgagcaagggccagcccagccagatccaccaggtgttcgccgacatggagaagatcctgggcagagcccccgcccagtgcagaagagagctgggcgaccagcagggcctggagaagctgcagaaggccaccgagaagatctacctgggcttcagcgaccccgagaccgaggagctggagatgagaagcagacagcagaagctgggcacccccgccccccagaacaccggcctgctgcagaacatgcaggacgtggtggagagcagaaaccaggccagcgtgcacagcaagctgagcgaggccatcaagggcctgcccctgaagggcgagcagcacagccacagcctggccaagctgagccccaccggccccggcggcgacaagggccagagccccatccccatgtggatctgctgcagactgagagccagcaactgcagaaacaccagcgccgcctggagactgaagctgaagagaagcagcacctgctag

SEQ ID NO: 13481 - DNA, 162 bp, Artificial Sequence
  Description of Artificial Sequence: Synthetic coding sequence
atgggcaacagcgacagccagtacaccctgcagggcagcaagaaccacagcaacaccatcaccggcgccaagcagatcccctgcagcctgaagatcagaggcatccacgccaaggaggagaagagcctgcacggctggggccacggcagcaacggcgcctag

SEQ ID NO: 13482 - DNA, 1203 bp, Artificial Sequence
  Description of Artificial Sequence: Synthetic coding sequence
gcctggctgcagagcgccggcgagctgcccagcgacggcggctgcagcagactgagatggcaggcccacctggagttcacccacaaccacgacgtgggcgacctgacctgggacaagatcgccgtgagcctgcccagaagcgagaagctgagaagcctggtgctggccggcatcccccacggcatgagaccccagctgtggatgagactgagcggcgccctgcagaagaagagaaacagcgagctgagctacagagagatcgtgaagaacagcagcaacgacgagaccatcgccgccaagcagatcgagaaggacctgctgagaaccatgcccagcaacgcctgcttcgccagcatgggcagcatcggcgtgcccagactgagaagagtgctgagagccctggcctggctgtaccccgagatcggctactgccagggcaccggcatggtggccgcctgcctgctgctgttcctggaggaggaggacgccttctggatgatgagcgccatcatcgaggacctgctgcccgccagctacttcagcaccaccctgctgggcgtgcagaccgaccagagagtgctgagacacctgatcgtgcagtacctgcccagactggacaagctgctgcaggagcacgacatcgagctgagcctgatcaccctgcactggttcctgaccgccttcgccagcgtggtggacatcaagctgctgctgagaatctgggacctgttcttctacgagggcagcagagtgctgttccagctgaccctgggcatgctgcacctgaaggaggaggagctgatccagagcgagaacagcgccagcatcttcaacaccctgagcgacatccccagccagatggaggacgccgagctgctgctgggcgtggccatgagactggccggcagcctgaccgacgtggccgtggagacccagagaagaaagcacctggcctacctgatcgccgaccagggccagctgctgggcgccggcaccctgaccaacctgagccaggtggcccaggacggcggcccccacctggacccccagcacaccggcagaagaggccacctggaggtgcagagcgccggcgccgccgagaacaagcccgccctgcccgccctgccccccagcctggcccagagcgaccacagctgcggcgtgatccaggccagcagcggcttcgtgcacctgagattctag

SEQ ID NO: 13483 - DNA, 294 bp, Artificial Sequence
  Description of Artificial Sequence: Synthetic coding sequence
atgctgagaggcaccaaggagatggacaacatgagccccagactgagagccttcctgagcgagcccatcggcgagaaggacgtgtgctgggtggacggcatcagccacgagctggccatcaacctggtgaccaagggcatcaacaaggcctacatcctgctgggccagttcctgctgatgcacaagaacgaggccgagttccagagatggctgatctgctgcttcggcgccaccgagtgcgaggcccagcagaccagccactgcctgaaggagtggtgcgcctgcttcctgtag

SEQ ID NO: 13484 - DNA, 1011 bp, Artificial Sequence
  Description of Artificial Sequence: Synthetic coding sequence
atggagtacctgggcggcggcagcgccctggacctgctgaagcccggccccctggaggagacctacatcgccaccatcctgagagagatcctgaagggcctggactacctgcacagcgagagaaagatccacagagacatcaaggccgccaacgtgctgctgagcgagcagggcgacgtgaagctggccgacttcggcgtggccggccagctgaccgacacccagatcaagagaaacaccttcgtgggcacccccttctggatggcccccgaggtgatcaagcagagcgcctacgacttcaaggccgacatctggagcctgggcatcaccgccatcgagctggccaagggcgagccccccaacagcgacctgcaccccatgagagtgctgttcctgatccccaagaacagcccccccaccctggagggccagcacagcaagcccttcaaggagttcgtggaggcctgcctgaacaaggaccccagattcagacccaccgccaaggagctgctgaagcacaagttcatcaccagatacaccaagaagaccagcttcctgaccgagctgatcgacagatacaagagatggaagagcgagggccacggcgaggagagcagcagcgaggacagcgacatcgacggcgaggccgaggacggcgagcagggccccatctggaccttcccccccaccatcagacccagcccccacagcaagctgcacaagggcaccgccctgcacagcagccagaagcccgccgagcccgtgaagagacagcccagaagccagtgcctgagcaccctggtgagacccgtgttcggcgaggtgttcagccagctgaaggagaagcacaagcagagcggcggcagcgtgggcgccctggaggagctggagaacgccttcagcctggccgaggagagctgccccggcatcagcgacaagctgatggtgcacctggtggagagagtgcagagattcagccacaacagaaaccacctgaccagcaccagatag

SEQ ID NO: 13485 - DNA, 1455 bp, Artificial Sequence
  Description of Artificial Sequence: Synthetic coding sequence
atggtgcacgagaccagctacagcgcccagttcaagggcgaggccagcaagcccaccaccgccgacaacaaggtgatcgacagaagaagaatcagaagcctgtacagcgagcccttcaaggagccccccaaggtggagaagcccagcgtgcagagcagcaagcccaagaagaccagcgccagccacaagcccaccagaaaggccaaggacaagcaggccgtgagcggccaggccgccaagaagaagagcgccgagggccccagcaccaccaagcccgacgacaaggagcagagcaaggagatgaacaacaagctggccgaggccaaggagagcctggcccagcccgtgagcgacagcagcaagacccagggccccgtggccaccgagcccgacaaggaccagggcagcgtggtgcccggcctgctgaagggccagggccccatggtgcaggagcccctgaagaagcagggcagcgtggtgcccggcccccccaaggacctgggccccatgatccccctgcccgtgaaggaccaggaccacaccgtgcccgagcccctgaagaacgagagccccgtgatcagcgcccccgtgaaggaccagggccccagcgtgcccgtgccccccaagaaccagagccccatggtgcccgccaaggtgaaggaccagggcagcgtggtgcccgagagcctgaaggaccagggccccagaatccccgagcccgtgaagaaccaggcccccatggtgcccgcccccgtgaaggacgagggccccatggtgagcgccagcgtgaaggaccagggccccatggtgagcgcccccgtgaaggaccagggccccatcgtgcccgcccccgtgaagggcgagggccccatcgtgcccgcccccgtgaaggacgagggccccatggtgagcgcccccatcaaggaccaggaccccatggtgcccgagcaccccaaggacgagagcgccatggccaccgcccccatcaagaaccagggcagcatggtgagcgagcccgtgaagaaccagggcctggtggtgagcggccccgtgaaggaccaggacgtggtggtgcccgagcacgccaaggtgcacgacagcgccgtggtggcccccgtgaagaaccagggccccgtggtgcccgagagcgtgaagaaccaggaccccatcctgcccgtgctggtgaaggaccagggccccaccgtgctgcagccccccaagaaccagggcagaatcgtgcccgagcccctgaagaaccaggtgcccatcgtgcccgtgcccctgaaggaccaggaccccctggtgcccgtgcccgccaaggaccagggccccgccgtgcccgagcccctgaagacccagggccccagagacccccagctgcccaccgtgagccccctgcccagagtgatgatccccaccgccccccacaccgagtacatcgagagcagcccctag

SEQ ID NO: 13486 - DNA, 2103 bp, Artificial Sequence
  Description of Artificial Sequence: Synthetic coding sequence
atggccctgggcgaggagaaggccgaggccgaggccagcgaggacaccaaggcccagagctacggcagaggcagctgcagagagcagccccccagactggaggccgagggcggcctgatcagccccgtgtggggcgccgagggcatccccgcccccacctgctggatcggcaccgaccccggcggccccagcagagcccaccagccccaggccagcgacgccaacagagagcccgtggccgagagaagcgagcccgccctgagcggcctgccccccgccaccatgggcagcggcgacctgctgctgagcggcgagagccaggtggagaagaccaagctgagcagcagcgaggagttcccccagaccctgagcctgcccagaaccaccaccatctgcagcggccacgacgccgacaccgaggacgaccccagcctggccgacctgccccaggccctggacctgagccagcagccccacagcagcggcctgagctgcctgagccagtggaagagcgtgctgagccccggcagcgccgcccagcccagcagctgcagcatcagcgccagcagcaccggcagcagcctgcagggccaccaggagagagccgagcccagaggcggcagcctggccaaggtgagcagcagcctggagcccgtggtgccccaggagcccagcagcgtggtgggcctgggccccagaccccagtggagcccccagcccgtgttcagcggcggcgacgccagcggcctgggcagaagaagactgagcttccaggccgagtactgggcctgcgtgctgcccgacagcctgccccccagccccgacagacacagccccctgtggaaccccaacaaggagtacgaggacctgctggactacacctaccccctgagacccggcccccagctgcccaagcacctggacagcagagtgcccgccgaccccgtgctgcaggacagcggcgtggacctggacagcttcagcgtgagccccgccagcaccctgaagagccccaccaacgtgagccccaactgcccccccgccgaggccaccgccctgcccttcagcggccccagagagcccagcctgaagcagtggcccagcagagtgccccagaagcagggcggcatgggcctggccagctggagccagctggccagcacccccagagcccccggcagcagagacgccagatgggagagaagagagcccgccctgagaggcgccaaggacagactgaccatcggcaagcacctggacatgggcagcccccagctgagaaccagagacagaggctggcccagccccagacccgagagagagaagagaaccagccagagcgccagaagacccacctgcaccgagagcagatggaagagcgaggaggaggtggagagcgacgacgagtacctggccctgcccgccagactgacccaggtgagcagcctggtgagctacctgggcagcatcagcaccctggtgaccctgcccaccggcgacatcaagggccagagccccctggaggtgagcgacagcgacggccccgccagcttccccagcagcagcagccagagccagctgccccccggcgccgccctgcagggcagcggcgaccccgagggccagaacccctgcttcctgagaagcttcgtgagagcccacgacagcgccggcgagggcagcctgggcagcagccaggccctgggcgtgagcagcggcctgctgaagaccagacccagcctgcccgccagactggacagatggcccttcagcgaccccgacgtggagggccagctgcccagaaagggcggcgagcagggcaaggagagcctggtgcagtgcgtgaagaccttctgctgccagctggaggagctgatctgctggctgtacaacgtggccgacgtgaccgaccacggcaccgccgccagaagcaacctgaccagcctgaagagcagcctgcagctgtacagagtgatctgcggccccggcagcggcctgttcccccacaagagcgtggccaagctgctggactacaaggtgaagagccagatcaccaacgtgtggtacgtgatcgcccagctgaccatcatccccgagatctag

SEQ ID NO: 13487 - DNA, 1626 bp, Artificial Sequence
  Description of Artificial Sequence: Synthetic coding sequence
atgaagagctacgtgagcgagaccatggccagccccggcaaggacaactacagaatgaagagctacaagaacaacgccctgaaccccgaggagatgagaagaagaagagaggaggagggcatccagctgagaaagcagaagagagagcagcagctgttcaagagaagaaacgtggagctgatcaacgaggaggccgccatgttcgacagcctgctgatggacagctacgtgagcagcaccaccggcgagagcgtgatcaccagagagatggtggagatgctgttcagcgacgacagcgacctgcagctggccaccacccagaagttcagaaagctgctgagcaaggagcccagcccccccatcgacgaggtgatcaacacccccagagtggtggacagattcgtggagttcctgaagagaaacgagaactgcaccctgcagttcgaggccgcctgggccctgaccaacatcgccagcggcaccagccagcagaccaagatcgtgatcgaggccggcgccgtgcccatcttcatcgagctgctgaacagcgacttcgaggacgtgcaggagcaggccgtgtgggccctgggcaacatcgccggcgacagcagcgtgtgcagagactacgtgctgaactgcagcatcctgaaccccctgctgaccctgctgaccaagagcaccagactgaccatgaccagaaacgccgtgtgggccctgagcaacctgtgcagaggcaagaaccccccccccgagttcgccaaggtgagcccctgcctgcccgtgctgagcagactgctgttcagcagcgacagcgacctgctggccgacgcctgctgggccctgagctacctgagcgacggccccaacgagaagatccaggccgtgatcgacagcggcgtgtgcagaagactggtggagctgctgatgcacaacgactacaaggtggccagccccgccctgagagccgtgggcaacatcgtgaccggcgacgacatccagacccaggtgatcctgaactgcagcgccctgccctgcctgctgcacctgctgagcagccccaaggagagcatcagaaaggaggcctgctggaccatcagcaacatcaccgccggcaacagagcccagatccaggccgtgatcgacgccaacatcttccccgtgctgatcgagatcctgcagaaggccgagttcagaaccagaaaggaggccgcctgggccatcaccaacgccaccagcggcggcacccccgagcagatcagatacctggtgagcctgggctgcatcaagcccctgtgcgacctgctgaccgtgatggacagcaagatcgtgcaggtggccctgaacggcctggagaacatcctgagactgggcgagcaggagggcaagagaagcggcagcggcgtgaacccctactgcggcctgatcgaggaggcctacggcctggacaagatcgagttcctgcagagccacgagaaccaggagatctaccagaaggccttcgacctgatcgagcactacttcggcgtggaggacgacgacagcagcctggccccccaggtggacgagacccagcagcagttcatcttccagcagcccgaggcccccatggagggcttccagctgtag

SEQ ID NO: 13488 - DNA, 1716 bp, Artificial Sequence
  Description of Artificial Sequence: Synthetic coding sequence
atgctggactgcggcatgcacatgggcttcaacgacgacagaagattccccgacttcagctacatcacccagaacggcagactgaccgacttcctggactgcgtgatcatcagccacttccacctggaccactgcggcgccctgccctacttcagcgagatggtgggctacgacggccccatctacatgacccaccccacccaggccatctgccccatcctgctggaggactacagaaagatcgccgtggacaagaagggcgaggccaacttcttcaccagccagatgatcaaggactgcatgaagaaggtggtggccgtgcacctgcaccagaccgtgcaggtggacgacgagctggagatcaaggcctactacgccggccacgtgctgggcgccgccatgttccagatcaaggtgggcagcgagagcgtggtgtacaccggcgactacaacatgacccccgacagacacctgggcgccgcctggatcgacaagtgcagacccaacctgctgatcaccgagagcacctacgccaccaccatcagagacagcaagagatgcagagagagagacttcctgaagaaggtgcacgagaccgtggagagaggcggcaaggtgctgatccccgtgttcgccctgggcagagcccaggagctgtgcatcctgctggagaccttctgggagagaatgaacctgaaggtgcccatctacttcagcaccggcctgaccgagaaggccaaccactactacaagctgttcatcccctggaccaaccagaagatcagaaagaccttcgtgcagagaaacatgttcgagttcaagcacatcaaggccttcgacagagccttcgccgacaaccccggccccatggtggtgttcgccacccccggcatgctgcacgccggccagagcctgcagatcttcagaaagtgggccggcaacgagaagaacatggtgatcatgcccggctactgcgtgcagggcaccgtgggccacaagatcctgagcggccagagaaagctggagatggagggcagacaggtgctggaggtgaagatgcaggtggagtacatgagcttcagcgcccacgccgacgccaagggcatcatgcagctggtgggccaggccgagcccgagagcgtgctgctggtgcacggcgaggccaagaagatggagttcctgaagcagaagatcgagcaggagctgagagtgaactgctacatgcccgccaacggcgagaccgtgaccctgcccaccagccccagcatccccgtgggcatcagcctgggcctgctgaagagagagatggcccagggcctgctgcccgaggccaagaagcccagactgctgcacggcaccctgatcatgaaggacagcaacttcagactggtgagcagcgagcaggccctgaaggagctgggcctggccgagcaccagctgagattcacctgcagagtgcacctgcacgacaccagaaaggagcaggagaccgccctgagagtgtacagccacctgaagagcgtgctgaaggaccactgcgtgcagcacctgcccgacggcagcgtgaccgtggagagcgtgctgctgcaggccgccgcccccagcgaggaccccggcaccaaggtgctgctggtgagctggacctaccaggacgaggagctgggcagcttcctgaccagcctgctgaagaagggcctgccccaggcccccagctag

SEQ ID NO: 13489 - DNA, 2232 bp, Artificial Sequence
  Description of Artificial Sequence: Synthetic coding sequence
atggaggccgccgccgtgaccgtgaccagaagcgccaccagaagaagaagaagacagctgcagggcctggccgcccccgaggccggcacccaggaggagcaggaggaccaggagcccagacccagaagaagaagacccggcagaagcatcaaggacgaggaggaggagaccgtgttcagagaggtggtgagcttcagccccgaccccctgcccgtgagatactacgacaaggacaccaccaagcccatcagcttctacctgagcagcctggaggagctgctggcctggaagcccagactggaggacggcttcaacgtggccctggagcccctggcctgcagacagccccccctgagcagccagagacccagaaccctgctgtgccacgacatgatgggcggctacctggacgacagattcatccagggcagcgtggtgcagaccccctacgccttctaccactggcagtgcatcgacgtgttcgtgtacttcagccaccacaccgtgaccatcccccccgtgggctggaccaacaccgcccacagacacggcgtgtgcgtgctgggcaccttcatcaccgagtggaacgagggcggcagactgtgcgaggccttcctggccggcgacgagagaagctaccaggccgtggccgacagactggtgcagatcacccagttcttcagattcgacggctggctgatcaacatcgagaacagcctgagcctggccgccgtgggcaacatgccccccttcctgagatacctgaccacccagctgcacagacaggtgcccggcggcctggtgctgtggtacgacagcgtggtgcagagcggccagctgaagtggcaggacgagctgaaccagcacaacagagtgttcttcgacagctgcgacggcttcttcaccaactacaactggagagaggagcacctggagagaatgctgggccaggccggcgagagaagagccgacgtgtacgtgggcgtggacgtgttcgccagaggcaacgtggtgggcggcagattcgacaccgacaagagcctggagctgatcagaaagcacggcttcagcgtggccctgttcgcccccggctgggtgtacgagtgcctggagaagaaggacttcttccagaaccaggacaagttctggggcagactggagagatacctgcccacccacagcatctgcagcctgcccttcgtgaccagcttctgcctgggcatgggcgccagaagagtgtgctacggccaggaggaggccgtgggcccctggtaccacctgagcgcccaggagatccagcccctgttcggcgagcacagactgggcggcgacggcagaggctgggtgagaacccactgctgcctggaggacgcctggcacggcggcagcagcctgctggtgagaggcgtgatcccccccgaggtgggcaacgtggccgtgagactgttcagcctgcaggcccccgtgccccccaagatctacctgagcatggtgtacaagctggagggccccaccgacgtgaccgtggccctggagctgaccaccggcgacgccggcagctgccacatcggcggcatcagcgtgctgaacgccgagaccagcagcagacacagcctgagacccctgagagtgccccccaccaagctggccagatgggtgggcagatgcggcagacagctgagcggcggctgggtgcagcactgctacgaggtgagcctgagaggctgcctgctgctggacctgctggtgtgcttcagcagaccccccggcagcagagaggaggagagcttcacctgcagactgggcgagatccaggtggtggacgccgccagcctgctggcccccctgccccaggtgcaggccgtgaccatcagccacatcagatggcagcccagcgccagcgagagagagggcccccccgccctgctgcagctgagctgcaccctgcactggagcttcctgctgagccaggtgagatgcttcagaatccactgctggggcggcatgagcgacgacagccccggcagagagctgcccagacccgagatgcccatgttcctgggcctggccttcgccacccagtacagaatcgtggacctgctggtggaggccgccggccccggccaggacagaagaatggagttcctggtggagcccgtgcccaaggagggcttcagagtgccccaggccgagtggggcagagccgtgctgctgtacagcgcccccgcctag

SEQ ID NO: 13490 - DNA, 396 bp, Artificial Sequence
  Description of Artificial Sequence: Synthetic coding sequence
atggagctgagagtgcacatggtgagccacaccggcgagatgccctacaaggtgagactgggcctgagccccggccccggcctgggcggccccagaatcctgcccgccgagcccttcacctggggcgccgtgagacacctgccccacagcagctgccagggcgcctgcctgccctgcctgccctgcctgagcagcgcccccctgagcagacagggcctgagcgccgccagcccccccagaagcctgctgggcccctgcttcttcccctggagaaccggcctggccagcagcggccagctgagccccgaggccctgctgtgcaccatcctgcacaccagaagcggcgtgctgcccgagagcagccacagaggcctgcccctggtgcccgccctgtag

SEQ ID NO: 13491 - DNA, 909 bp, Artificial Sequence
  Description of Artificial Sequence: Synthetic coding sequence
atggagcacggcatcgtgaaggactggaacgacatggagagaatctggcagtacgtgtacagcaaggaccagctgcagaccttcagcgaggagcaccccgtgctgctgaccgaggcccccctgaaccccagaaagaacagagagagagccgccgaggtgttcttcgagaccttcaacgtgcccgccctgttcatcagcatgcaggccgtgctgagcctgtacgccaccggcagaaccaccggcgtggtgctggacagcggcgacggcgtgacccacgccgtgcccatctacgagggcttcgccatgccccacagcatcatgagaatcgacatcgccggcagagacgtgagcagattcctgagactgtacctgagaaaggagggctacgacttccacagcagcagcgagttcgagatcgtgaaggccatcaaggagagagcctgctacctgagcatcaacccccagaaggacgagaccctggagaccgagaaggcccagtactacctgcccgacggcagcaccatcgagatcggccccagcagattcagagcccccgagctgctgttcagacccgacctgatcggcgaggagagcgagggcatccacgaggtgctggtgttcgccatccagaagagcgacatggacctgagaagaaccctgttcagcaacatcgtgctgagcggcggcagcaccctgttcaagggcttcggcgacagactgctgagcgaggtgaagaagctggcccccaaggacgtgaagatcagaatcagcgccccccaggagagactgtacagcacctggatcggcggcagcatcctggccagcctggacaccttcaagaagatgtgggtgagcaagaaggagtacgaggaggacggcgccagaagcatccacagaaagaccttctag

SEQ ID NO: 13492 - DNA, 780 bp, Artificial Sequence
  Description of Artificial Sequence: Synthetic coding sequence
atgctgagatgcggccagatgatgctggcccaggccctgatctgcagacacctgggcagagactggagctgggagaagcagaaggagcagcccaaggagtaccagagaatcctgcagtgcttcctggacagaaaggactgctgctacagcatccaccagatggcccagatgggcgtgggcgagggcaagagcatcggcgagtggttcggccccaacaccgtggcccaggtgctgaagaagctggccctgttcgacgagtggaacagcctggccgtgtacgtgagcatggacaacaccgtggtgatcgaggacatcaagaagatgtgcagagtgctgcccctgagcgccgacaccgccggcgacagaccccccgacagcctgaccgccagcaaccagagcgacgagctgatcttcctggacccccacaccacccagaccttcgtggacaccgaggagaacggcaccgtgaacgaccagaccttccactgcctgcagagcccccagagaatgaacatcctgaacctggaccccagcgtggccctgggcttcttctgcaaggaggagaaggacttcgacaactggtgcagcctggtgcagaaggagatcctgaaggagaacctgagaatgttcgagctggtgcagaagcaccccagccactggccccccttcgtgccccccgccaagcccgaggtgaccaccaccggcgccgagttcatcgacagcaccgagcagctggaggagttcgacctggaggaggacttcgagatcctgagcgtgtag

SEQ ID NO: 13493 - DNA, 957 bp, Artificial Sequence
  Description of Artificial Sequence: Synthetic coding sequence
atgagagcccagagcgacgagctggagaagatcgagaagcacggcagaagcagcaaggacaaggagaacgccaagagcctggacaagcccgagcagttcctgtacgagctgagcctgatccccaacttcagcgagagagtgttctgcatcctgttccagagcaccttcagcgagagcatctgcagcatcagaagaaagctggagctgctgcagaagctgtgcgagaccctgaagaacggccccggcgtgatgcaggtgctgggcctggtgctggccttcggcaactacatgaacggcggcaacaagaccagaggccaggccgacggcttcggcctggacatcctgcccaagctgaaggacgtgaagagcagcgacaacagcagaagcctgctgagctacatcgtgagctactacctgagaaacttcgacgaggacgccggcaaggagcagtgcctgttccccctgcccgagccccaggacctgttccaggccagccagatgaagttcgaggacttccagaaggacctgagaaagctgaagaaggacctgaaggcctgcgaggtggaggccggcaaggtgtaccaggtgagcagcaaggagcacatgcagcccttcaaggagaacatggagcagttcatcatccaggccaagatcgaccaggaggccgaggagaacagcctgaccgagacccacaagtgcttcctggagaccaccgcctacttcttcatgaagcccaagctgggcgagaaggaggtgagccccaacgccttcttcagcatctggcacgagttcagcagcgacttcaaggacttctggaagaaggagaacaagctgctgctgcaggagagagtgaaggaggccgaggaggtgtgcagacagaagaagggcaagagcctgtacaagatcaagcccagacacgacagcggcatcaaggccaagatcagcatgaagacctag

SEQ ID NO: 13494 - DNA, 345 bp, Artificial Sequence
  Description of Artificial Sequence: Synthetic coding sequence
atgagcagcagcatgtggtacatcatgcagagcatccagagcaagtacagcctgagcgagagactgatcagaaccatcgccgccatcagaagcttcccccacgacaacgtggaggacctgatcagaggcggcgccgacgtgaactgcacccacggcaccctgaagcccctgcactgcgcctgcatggtgagcgacgccgactgcgtggagctgctgctggagaagggcgccgaggtgaacgccctggacggctacaacagaaccgccctgcactacgccgccgagaaggacgaggcctgcgtggaggtgctgctggagtacggcgccaaccccaacgccctgtag

SEQ ID NO: 13495 - DNA, 1365 bp, Artificial Sequence; identical to SEQ ID NO: 9722
  Description of Artificial Sequence: Synthetic coding sequence

SEQ ID NO: 13496 - DNA, 1047 bp, Artificial Sequence; identical to SEQ ID NO: 9854
  Description of Artificial Sequence: Synthetic coding sequence

SEQ ID NO: 13497 - DNA, 2163 bp, Artificial Sequence
  Description of Artificial Sequence: Synthetic coding sequence
atgtacggcagcgccagaagcgtgggcaaggtggagcccagcagccagagccccggcagaagccccagactgcccagaagccccagactgggccacagaagaaccaacagcaccggcggcagcagcggcagcagcgtgggcggcggcagcggcaagaccctgagcatggagaacatccagagcctgaacgccgcctacgccaccagcggccccatgtacctgagcgaccacgagaacgtgggcagcgagacccccaagagcaccatgaccctgggcagaagcggcggcagactgccctacggcgtgagaatgaccgccatgggcagcagccccaacatcgccagcagcggcgtggccagcgacaccatcgccttcggcgagcaccacctgccccccgtgagcatggccagcaccgtgccccacagcctgagacaggccagagacaacaccatcatggacctgcagacccagctgaaggaggtgctgagagagaacgacctgctgagaaaggacgtggaggtgaaggagagcaagctgagcagcagcatgaacagcatcaagaccttctggagccccgagctgaagaaggagagagccctgagaaaggacgaggccagcaagatcaccatctggaaggagcagtacagagtggtgcaggaggagaaccaggtggacgccctgagactgagactggaggagaaggagaccatgctgaacaagaagaccaagcagatccaggacatggccgaggagaagggcacccaggccggcgagatccacgacctgaaggacatgctggacgtgaaggagagaaaggtgaacgtgctgcagaagaagatcgagaacctgcaggagcagctgagagacaaggagaagcagatgagcagcctgaaggagagagtgaagagcctgcaggccgacaccaccaacaccgacaccgccctgaccaccctggaggaggccctggccgagaaggagagaaccatcgagagactgaaggagcagagagacagagacgagagagagaagcaggaggagatcgacaactacaagaaggacctgaaggacctgaaggagaaggtgagcctgctgcagggcgacctgagcgagaaggaggccagcctgctggacctgaaggagcacgccagcagcctggccagcagcggcctgaagaaggacagcagactgaagaccctggagatcgccctggagcagaagaaggaggagtgcctgaagatggagagccagctgaagaaggcccacgaggccgccctggaggccagagccagccccgagatgagcgacagaatccagcacctggagagagagatcaccagatacaaggacgagagcagcaaggcccaggccgaggtggacagactgctggagatcctgaaggaggtggagaacgagaagaacgacaaggacaagaagatcgccgagctggagagcctgaccagcagacaggtgaaggaccagaacaagaaggtggccaacctgaagcacaaggagcaggtggagaagaagaagagcgcccagatgctggaggaggccagaagaagagaggacaacctgaacgacagcagccagcagctgcaggacagcctgagaaagaaggacgacagaatcgaggagctggaggaggccctgagagagagcgtgcagatcaccgccgagagagagatggtgctggcccaggaggagagcgccagaaccaacgccgagaagcaggtggaggagctgctgatggccatggagaaggtgaagcaggagctggagagcatgaaggccaagctgagcagcacccagcagagcctggccgagaaggagacccacctgaccaacctgagagccgagagaagaaagcacctggaggaggtgctggagatgaagcaggaggccctgctggccgccatcagcgagaaggacgccaacatcgccctgctggagctgagcagcagcaagaagaagacccaggaggaggtggccgccctgaagagagagaaggacagactggtgcagcagctgaagcagcagacccagaacagaatgaagctgatggccgacaactacgaggacgaccacttcaagagcagccacagcaaccagaccaaccacaagcccagccccgaccaggacgaggaggagggcatctgggcctag

SEQ ID NO: 13498 - DNA, 768 bp, Artificial Sequence
  Description of Artificial Sequence: Synthetic coding sequence
atggccgccagcaccatgagcgtgtgcagcagcgcctgcagcgacagctggcaggtggacgcctgccccgagagctgctgcgagccccactgctgcgccctgagctgctgcgcccccgccccctgcctgaccctggtgtgcacccccgtgagcagagtgagcagcccctgctgccaggccgcctgcgagcccagcccctgccagagcggctgcaccagcagctgcacccccagctgctgccagcagagcagctgccagcccgcctgctgcaccagcagcccctgccagcaggcctgctgcgtgcccgtgtgctgcaagcccgtgtgctgcctgcccacctgcagcaaggacagcagcagctgctgccagcagagcagctgccagcccacctgctgcgccagcagcagcagccagcagagctgctgcgtgcccgtgtgctgcaagcccgtgtgctacgtgcccacctgcagcgaggacagcagcagctgctgccagcagagcagctgccaccccgcctgctgcaccagcagcccctgccagcaggcctgctgcgtgcccgtgagatgcaagcccgtgtgctgcaagcccatctgctgcgtgcccgtgtgcagcggcgccagcaccagctgctgccagcagagcagctgccagcccgcctgctgcaccaccagctgctgcagacccagcagcagcgtgagcctgctgtgcagacccgtgtgcagacccgcctgctgcagcctgtgcagcggccaggagagcagctgctag

SEQ ID NO: 13499 - DNA, 2562 bp, Artificial Sequence
  Description of Artificial Sequence: Synthetic coding sequence
atgagcgagaaggtggactggctgcagagccagaacggcgtgtgcaaggtggacgtgtacagccccggcgacaaccaggcccaggactggaagatggacaccagcaccgaccccgtgagagtgctgagctggctgagaagagacctggagaagagcaccgccgagttccaggacgtgagattcaagcccggcgagagcttcggcggcgagaccagcaacagcggcgacccccacaagggcttcagcgtggactactacaacaccaccaccaagggcacccccgagagactgcacttcgagatgacccacaaggagatcccctgccagggccccagagcccagctgggcaacggcagcagcgtggacgaggtgagcttctacgccaacagactgaccaacctggtgatcgccatggccagaaaggagatcaacgagaagatcgacggcagcgagaacaagtgcgtgtaccagagcctgtacatgggcaacgagcccacccccaccaagagcctgagcaagatcgccagcgagctggtgaacgagaccgtgagcgcctgcagcagaaacgccgcccccgacaaggcccccggcagcggcgacagagtgagcggcagcagccagagcccccccaacctgaagtacaagagcaccctgaagatcaaggagagcaccaaggagagacagggccccgacgacaagccccccagcaagaagagcttcttctacaaggaggtgttcgagagcagaaacggcgactacgccagagagggcggcagattcttccccagagagagaaagagattcagaggccaggagagacccgacgacttcaccgccagcgtgagcgagggcatcatgacctacgccaacagcgtggtgagcgacatgatggtgagcatcatgaagaccctgaagatccaggtgaaggacaccaccatcgccaccatcctgctgaagaaggtgctgctgaagcacgccaaggaggtggtgagcgacctgatcgacagcttcctgagaaacctgcacagcgtgaccggcaccctgatgaccgacacccagttcgtgagcgccgtgaagagaaccgtgttcagccacggcagccagaaggccaccgacatcatggacgccatgctgagaaagctgtacaacgtgatgttcgccaagaaggtgcccgagcacgtgagaaaggcccaggacaaggccgagagctacagcctgatcagcatgaagggcatgggcgaccccaagaacagaaacgtgaacttcgccatgaagagcgagaccaagctgagagagaagatgtacagcgagcccaagagcgaggaggagacctgcgccaagaccctgggcgagcacatcatcaaggagggcctgaccctgtggcacaagacccagcagaaggagtgcaagagcctgggcttccagcacgccgccttcgaggcccccaacacccagagaaagcccgccagcgacatcagcttcgagtaccccgaggacatcggcaacctgagcctgcccccctacccccccgagaagcccgagaacttcatgtacgacagcgacagctgggccgaggacctgatcgtgagcgccctgctgctgatccagtaccacctggcccagggcggcagaagagacgccagaagcttcgtggaggccgccggcaccaccaacttccccgccaacgagccccccgtggcccccgacgagagctgcctgaagagcgcccccatcgtgggcgaccaggagcaggccgagaagaaggacctgagaagcgtgttcttcaacttcatcagaaacctgctgagcgagaccatcttcaagagagaccagagccccgagcccaaggtgcccgagcagcccgtgaaggaggacagaaagctgtgcgagagacccctggccagcagcccccccagactgtacgaggacgacgagacccccggcgccctgagcggcctgaccaagatggccgtgagccagatcgacggccacatgagcggccagatggtggagcacctgatgaacagcgtgatgaagctgtgcgtgatcatcgccaagagctgcgacgccagcctggccgagctgggcgacgacaagagcggcgacgccagcagactgaccagcgccttccccgacagcctgtacgagtgcctgcccgccaagggcaccggcagcgccgaggccgtgctgcagaacgcctaccaggccatccacaacgagatgagaggcaccagcggccagccccccgagggctgcgccgcccccaccgtgatcgtgagcaaccacaacctgaccgacaccgtgcagaacaagcagctgcaggccgtgctgcagtgggtggccgccagcgagctgaacgtgcccatcctgtacttcgccggcgacgacgagggcatccaggagaagctgctgcagctgagcgccgccgccgtggacaagggctgcagcgtgggcgaggtgctgcagagcgtgctgagatacgagaaggagagacagctgaacgaggccgtgggcaacgtgacccccctgcagctgctggactggctgatggtgaacctgtag

SEQ ID NO: 13500 - DNA, 1263 bp, Artificial Sequence
  Description of Artificial Sequence: Synthetic coding sequence
atggtgcacggcagaaaggccaacgcccaggtgatggagagcgaggagttcatgctgctgcccgccaaccagctgatcgacatcatcagcagcgacgagctgaacgtgagaagcgaggagcaggtgttcaacgccgtgatggcctgggtgaagtacagcatccaggagagaagaccccagctgccccaggtgctgcagcacgtgagactgcccctgctgagccccaagttcctggtgggcaccgtgggcagcgaccccctgatcaagagcgacgaggagtgcagagacctggtggacgaggccaagaactacctgctgctgccccaggagagacccctgatgcagggccccagaaccagacccagaaagcccatcagatgcggcgaggtgctgttcgccgtgggcggctggtgcagcggcgacgccatcagcagcgtggagagatacgacccccagaccaacgagtggagaatggtggccagcatgagcaagagaagatgcggcgtgggcgtgagcgtgctggacgacctgctgtacgccgtgggcggccacgacggcagcagctacctgaacagcgtggagagatacgaccccaagaccaaccagtggagcagcgacgtggcccccaccagcacctgcagaaccagcgtgggcgtggccgtgctgggcggcttcctgtacgccgtgggcggccaggacggcgtgagctgcctgaacatcgtggagagatacgaccccaaggagaacaagtggaccagagtggccagcatgagcaccagaagactgggcgtggccgtggccgtgctgggcggcttcctgtacgccgtgggcggcagcgacggcaccagccccctgaacaccgtggagagatacaacccccaggagaacagatggcacaccatcgcccccatgggcaccagaagaaagcacctgggctgcgccgtgtaccaggacatgatctacgccgtgggcggcagagacgacaccaccgagctgagcagcgccgagagatacaaccccagaaccaaccagtggagccccgtggtggccatgaccagcagaagaagcggcgtgggcctggccgtggtgaacggccagctgatggccgtgggcggcttcgacggcaccacctacctgaagaccatcgaggtgttcgaccccgacgccaacacctggagactgtacggcggcatgaactacagaagactgggcggcggcgtgggcgtgatcaagatgacccactgcgagagccacatctggtag

SEQ ID NO: 13501 - DNA, 519 bp, Artificial Sequence
  Description of Artificial Sequence: Synthetic coding sequence
atgagctgcaccatcgagaaggccctggccgacgccaaggccctggtggagagactgagagaccacgacgacgccgccgagagcctgatcgagcagaccaccgccctgaacaagagagtggaggccatgaagcagtaccaggaggagatccaggagctgaacgaggtggccagacacagacccagaagcaccctggtgatgggcatccagcaggagaacagacagatcagagagctgcagcaggagaacaaggagctgagaaccagcctggaggagcaccagagcgccctggagctgatcatgagcaagtacagagagcagatgttcagactgctgatggccagcaagaaggacgaccccggcatcatcatgaagctgaaggagcagcacagcaagatcgacatggtgcacagaaacaagagcgagggcttcttcctggacgccagcagacacatcctggaggccccccagcacggcctggagagaagacacctggaggccaaccagaacgtgcactag

SEQ ID NO: 13502 - DNA, 813 bp, Artificial Sequence
  Description of Artificial Sequence: Synthetic coding sequence
atgctgttcatcttccccctgagcctgccctggagacccagctgctggaaggagagctgcagcaccggccagagacaggccggcagaagcagagaggacagcgtgacccccccccccagcagcccctggcccaccccccccgccggcgccatgagcaccaagcaggaggccagaagagacgagggcgaggccagaaccagaggccaggaggcccagctgagagacagagcccacctgagcctgcacaaggacagcgccgacctgctgcccctggacagcctgaagagactgggcaccagcaaggacctgcagcccagaagcgtgatccagagaagactggtggagggcaaccccaactggctgcagggcgagccccccagaatgcaggacctgatccacggccaggagagcagaagaaagaccagcagaaccgagatccccgccctgctggtgaactgcaagtgccaggaccagctgctgagagtggccgtggacaccggcacccagtacaacagaatcagcgccggctgcctgagcagactgggcctggagaagagagtgctgaaggccagcgccggcgacctggcccccggcccccccacccaggtggagcagctggagctgcagctgggccaggagaccgtggtgtgcagcgcccaggtggtggacgccgagagccccgagttctgcctgggcctgcagaccctgctgagcctgaagtgctgcatcgacctggagcacggcgtgctgagactgaaggcccccttcagcgagctgcccttcctgcccctgtaccaggagcccggccagtag

SEQ ID NO: 13503 - DNA, 243 bp, Artificial Sequence
  Description of Artificial Sequence: Synthetic coding sequence
accagctgctgcagacccagcagcagcgtgagcctgctgtgccaccccgtgtgcagctgcagccccgcctgccagcccacctgctgcatccacagcccctgccaggccagctgctacgtgcccgtgagctgccagcccatcatctacgtgacccccagctgccagagcagcggctgctgccagcccccctgcaccaccgccctgtgcagacccatcagctgcagcacccccagctgctgctag

SEQ ID NO: 13504 - DNA, 2013 bp, Artificial Sequence
  Description of Artificial Sequence: Synthetic coding sequence
atggccctgggcgaggagaaggccgaggccgaggccagcgaggacaccaaggcccagagctacggcagaggcagctgcagagagagagagctggacatccccggccccatgagcggcgagcagccccccagactggaggccgagggcggcctgatcagccccgtgtggggcgccgagggcatccccgcccccacctgctggatcggcaccgaccccggcggccccagcagagcccaccagccccaggccagcgacgccaacagagagcccgtggccgagagaagcgagcccgccctgagcggcctgccccccgccaccatgggcagcggcgacctgctgctgagcggcgagagccaggtggagaagaccaagctgagcagcagcgaggagttcccccagaccctgagcctgcccagaaccaccaccatctgcagcggccacgacgccgacaccgaggacgaccccagcctggccgacctgccccaggccctggacctgagccagcagccccacagcagcggcctgagctgcctgagccagtggaagagcgtgctgagccccggcagcgccgcccagcccagcagctgcagcatcagcgccagcagcaccggcagcagcctgcagggccaccaggagagagccgagcccagaggcggcagcctggccaaggtgagcagcagcctggagcccgtggtgccccaggagcccagcagcgtggtgggcctgggccccagaccccagtggagcccccagcccgtgttcagcggcggcgacgccagcggcctgggcagaagaagactgagcttccaggccgagtactgggcctgcgtgctgcccgacagcctgccccccagccccgacagacacagccccctgtggaaccccaacaaggagtacgaggacctgctggactacacctaccccctgagacccggcccccagctgcccaagcacctggacagcagagtgcccgccgaccccgtgctgcaggacagcggcgtggacctggacagcttcagcgtgagccccgccagcaccctgaagagccccaccaacgtgagccccaactgcccccccgccgaggccaccgccctgcccttcagcggccccagagagcccagcctgaagcagtggcccagcagagtgccccagaagcagggcggcatgggcctggccagctggagccagctggccagcacccccagagcccccggcagcagagacgccagatgggagagaagagagcccgccctgagaggcgccaaggacagactgaccatcggcaagcacctggacatgggcagcccccagctgagaaccagagacagaggctggcccagccccagacccgagagagagaagagaaccagccagagcgccagaagacccacctgcaccgagagcagatggaagagcgaggaggaggtggagagcgacgacgagtacctggccctgcccgccagactgacccaggtgagcagcctggtgagctacctgggcagcatcagcaccctggtgaccctgcccaccggcgacatcaagggccagagccccctggaggtgagcgacagcgacggccccgccagcttccccagcagcagcagccagagccagctgccccccggcgccgccctgcagggcagcggcgaccccgagggccagaacccctgcttcctgagaagcttcgtgagagcccacgacagcgccggcgagggcagcctgggcagcagccaggccctgggcgtgagcagcggcctgctgaagaccagacccagcctgcccgccagactggacagatggcccttcagcgaccccgacgtggagggccagctgcccagaaagggcggcgagcagggcaaggagagcctggtgcagtgcgtgaagaccttctgctgccagctggaggagctgatctgctggctgtacaacgtggccgacgtgaccgaccacggcaccgccgccagaagcaacctgaccagcctgaagagcagcctgcagctgtacagattctag

SEQ ID NO: 13505 - DNA, 702 bp, Artificial Sequence
  Description of Artificial Sequence: Synthetic coding sequence
atgaagcagctgatcgaggacaccgagaagaacaaggtgtacgtggccatggtgaccgactacggcgccttcatcaagatccccggctgcagaaagcagggcctggtgcacagaacccacatgagcagctgcagagtggacaagcccagcgagatcgtggacgtgggcgacaaggtgtgggtgaagctgatcggcagagagatgaagaacgacagaatcaaggtgagcctgagcatgaaggtggtgaaccagggcaccggcaaggacctggaccccaacaacgtgatcatcgagcaggaggagagaagaagaagaagcttccaggactacaccggccagaagatcaccctggaggccgtgctgaacaccacctgcaagaagtgcggctgcaagggccacttcgccaaggactgcttcatgcagcccggcggcaccaagtacagcctgatccccgacgaggaggaggagaaggaggaggccaagagcgccgagttcgagaagcccgaccccaccagaaaccccagcagaaagagaaagaaggagaagaagaagaagaagcacagagacagaaagagcagcgacagcgacagcagcgacagcgagagcgacaccggcaagagagccagacacaccagcaaggacagcaaggccgccaagaagaagaagaagaagaagaagcacaagaagaagcacaaggagtag

SEQ ID NO: 13506 - DNA, 492 bp, Artificial Sequence
  Description of Artificial Sequence: Synthetic coding sequence
atgggctggagactgctgacccaggacgagggccccgccctggtgcccggcggcagactgggcgacctgtgggactaccaccagcacagatacctgcagggcgtgcccgagggcgtgagagacctgccccccggcgtggccctgcccctggagagcaacctggccttcatgaacggcgtgagcttcaccaagggctgctacatcggccaggagctgaccgccagaacccaccacatgggcgtgatcagaaagagactgttccccgtgagattcctggaccccctgcccaccagcggcatcacccccggcgccaccgtgctgaccgccagcggccagaccgtgggcaagttcagagccggccagggcaacgtgggcctggccctgctgtggagcgagaagatcaagggccccctgcacatcagagccagcgagggcgcccaggtggccctggccgccagcgtgcccgactggtggcccaccgtgagcaagtag

SEQ ID NO: 13507 - DNA, 804 bp, Artificial Sequence
  Description of Artificial Sequence: Synthetic coding sequence
atggccatggagatgagactgcccgtggccagaaagcccctgagcgagagactgggcagagacaccaagaagcacctggtggtgcccggcgacaccatcaccaccgacaccggcttcatgagaggccacggcacctacatgggcgaggagaagctgatcgccagcgtggccggcagcgtggagagagtgaacaagctgatctgcgtgaaggccctgaagaccagatacatcggcgaggtgggcgacatcgtggtgggcagaatcaccgaggtgcagcagaagagatggaaggtggagaccaacagcagactggacagcgtgctgctgctgagcagcatgaacctgcccggcggcgagctgagaagaagaagcgccgaggacgagctggccatgagaggcttcctgcaggagggcgacctgatcagcggcgtgctggtgcaggtgagccccagcctggtgaagagacagaagacccacttccacgacctgccctgcggcgccagcgtgatcctgggcaacaacggcttcatctggatctaccccacccccgagcacaaggaggaggaggccggcggcttcatcgccaacctggagcccgtgagcctggccgacagagaggtgatcagcagactgagaaactgcatcatcagcctggtgacccagagaatgatgctgtacgacaccagcatcctgtactgctacgaggccagcctgccccaccagatcaaggacatcctgaagcccgagatcatggaggagatcgtgatggagaccagacagagactgctggagcaggagggctag

SEQ ID NO: 13508 - DNA, 3111 bp, Artificial Sequence
  Description of Artificial Sequence: Synthetic coding sequence
atgcccgtgttcaaggaggtgaaggtgcacctgctggaggacgccggcatcgagaaggacgccgtgacccaggagaccagaatcagccccagcggcatcgacagcgccaccaccgtggccgccgccaccgccgccgccatcgccaccgccgcccccctgatcaaggtgcagagcgacctggaggccaaggtgaacagcgtgaccgagctgctgagcaagctgcaggagaccgacaagcacctgcagagagtgaccgagcagcagaccagcatccagagaaagcaggagaagctgcactgccacgaccacgagaagcagatgaacgtgttcatggagcagcacatcagacacctggagaagctgcagcagcagcagatcgacatccagacccacttcatcagcgccgccctgaagaccagcagcttccagcccgtgagcatgcccagcagcagagccgtggagaagtacagcgtgaagcccgagcaccccaacctgggcagctgcaaccccagcctgtacaacaccttcgccagcaagcaggcccccctgaaggaggtggaggacaccagcttcgacaagcagaagagccccctggagacccccgcccccagaagattcgcccccgtgcccgtgagcagagacgacgagctgagcaagagagagaacctgctggaggagaaggagaacatggaggtgagctgccacagaggcaacgtgagactgctggagcagatcctgaacaacaacgacagcctgaccagaaagagcgagagcagcaacaccaccagcctgaccagaagcaagatcggctggacccccgagaagaccaacagattccccagctgcgaggagctggagaccaccaaggtgaccatgcagaagagcgacgacgtgctgcacgacctgggccagaaggagaaggagaccaacagcatggtgcagcccaaggagagcctgagcatgctgaagctgcccgacctgccccagaacagcgtgaagctgcagaccaccaacaccaccagaagcgtgctgaaggacgccgagaagatcctgagaggcgtgcagaacaacaagaaggtgctggaggagaacctggaggccatcatcagagccaaggacggcgccgccatgtacagcctgatcaacgccctgagcaccaacagagagatgagcgagaagatcagaatcagaaagaccgtggacgagtggatcaagaccatcagcgccgagatccaggacgagctgagcagaaccgactacgagcagaagagattcgaccagaagaaccagagaaccaagaagggccagaacatgaccaaggacatcagaaccaacacccaggacaagaccgtgaacaagagcgtgatccccagaaagcacagccagaagcagatcgaggagcacttcagaaacctgcccatgagaggcatgcccgccagcagcctgcagaaggagagaaaggagggcctgctgaaggccaccaccgtgatccaggacgaggactacatgctgcaggtgtacggcaagcccgtgtaccagggccacagaagcaccctgaagaagggcccctacctgagattcaacagccccagccccaagagcagaccccagagacccaaggtgatcgagagagtgaagggcaccaaggtgaagagcatcagaacccagaccgacttctacgccaccaagcccaagaagatggacagcaagatgaagcacagcgtgcccgtgctgccccacggcgaccagcagtacctgttcagccccagcagagagatgcccaccttcagcggcaccctggagggccacctgatccccatggccatcctgctgggccagacccagagcaacagcgacaccatgccccccgccggcgtgatcgtgagcaagccccaccccgtgaccgtgaccaccagcatcccccccagcagcagaaaggtggagaccggcgtgaagaagcccaacatcgccatcgtggagatgaagagcgagaagaaggaccccccccagctgaccgtgcaggtgctgcccagcgtggacatcgacagcatcagcaacagcagcgccgacgtgctgagccccctgagcagccccaaggaggccagcctgccccccgtgcagacctggatcaagacccccgagatcatgaaggtggacgaggaggaggtgaagttccccggcaccaacttcgacgagatcatcgacgtgatccaggaggaggagaagtgcgacgagatccccgacagcgagcccatcctggagttcaacagaagcgtgaaggccgacagcaccaagtacaacggcccccccttcccccccgtggccagcaccttccagcccaccgccgacatcctggacaaggtgatcgagagaaaggagaccctggagaacagcctgatccagtgggtggagcaggagatcatgagcagaatcatcagcggcctgttccccgtgcagcagcagatcgcccccagcatcagcgtgagcgtgagcgagaccagcgagcccctgaccagcgacatcgtggagggcaccagcagcggcgccctgcagctgttcgtggacgccggcgtgcccgtgaacagcaacgtgatcaagcacttcgtgaacgaggccctggccgagaccatcgccgtgatgctgggcgacagagaggccaagaagcagggccccgtggccaccggcgtgagcggcgacgccagcaccaacgagacctacctgcccgccagagtgtgcacccccctgcccaccccccagcccacccccccctgcagccccagcagccccgccaaggagtgcgtgctggtgaagacccccgacagcagcccctgcgacagcgaccacgacatggccttccccgtgaaggagatctgcgccgagaagggcgacgacatgcccgccatcatgctggtgaacacccccaccgtgacccccaccaccacccccccccccgccgccgccgtgttcacccccaccctgagcgacatcagcatcgacaagctgaaggtgagcagccccgagctgcccaagccctggggcgacggcgacctgcccctggaggaggagaaccccaacagcccccaggaggagctgcaccccagagccatgtag

SEQ ID NO: 13509 - DNA, 3351 bp, Artificial Sequence; identical to SEQ ID NO: 10541
  Description of Artificial Sequence: Synthetic coding sequence

SEQ ID NO: 13510 - DNA, 816 bp, Artificial Sequence
  Description of Artificial Sequence: Synthetic coding sequence
atgagacagctgcaccccgaggccatcgccgccatccagagcaaggccctgttcagcaaggccgaggagcagctgctgagcaaggtgggcagcaccagccagcccaccctggagaccttccaggacctgctgcacagacaccccgacgccttctacctggccagaaccgccaaggccctgcaggcccactggcagctgatgaagcagtactacctgctggaggaccagaccgtgcagcccctgcccaagggcgaccaggtgctgaacttcagcgacgccgaggacctgatcgacgacagcaagctgaaggacatgagagacgaggtgctggagcacgagctgatggtggccgacagaagacagaagagagagatcagacagctggagcaggagctgcacaagtggcaggtgctggtggacagcatcaccggcatgagcagccccgacttcgacaaccagaccctggccgtgctgagaggcagaatggtgagatacctgatgagaagcagagagatcaccctgggcagagccaccaaggacaaccagatcgacgtggacctgagcctggagggccccgcctggaagatcagcagaaagcagggcgtgatcaagctgaagaacaacggcgacttcttcatcgccaacgagggcagaagacccatctacatcgacggcagacccgtgctgtgcggcagcaagtggagactgagcaacaacagcgtggtggagatcgccagcctgagattcgtgttcctgatcaaccaggacctgatcgccctgatcagagccgaggccgccaagatcaccccccagtag

SEQ ID NO: 13511 - DNA, 2751 bp, Artificial Sequence
  Description of Artificial Sequence: Synthetic coding sequence
atggagatgcccctgccccccgacgaccaggagctgagaaacgtgatcgacaagctggcccagttcgtggccagaaacggccccgagttcgagaagatgaccatggagaagcagaaggacaaccccaagttcagcttcctgttcggcggcgagttctacagctactacaagtgcaagctggccctggagcagcagcagctgatctgcaagcagcagacccccgagctggagcccgccgccaccatgccccccctgccccagccccccctggcccccgccgcccccatcccccccgcccagggcgcccccagcatggacgagctgatccagcagagccagtggaacctgcagcagcaggagcagcacctgctggccctgagacaggagcaggtgaccgccgccgtggcccacgccgtggagcagcagatgcagaagctgctggaggagacccagctggacatgaacgagttcgacaacctgctgcagcccatcatcgacacctgcaccaaggacgccatcagcgccggcaagaactggatgttcagcaacgccaagagccccccccactgcgagctgatggccggccacctgagaaacagaatcaccgccgacggcgcccacttcgagctgagactgcacctgatctacctgatcaacgacgtgctgcaccactgccagagaaagcaggccagagagctgctggccgccctgcagaaggtggtggtgcccatctactgcaccagcttcctggccgtggaggaggacaagcagcagaagatcgccagactgctgcagctgtgggagaagaacggctacttcgacgacagcatcatccagcagctgcagagccccgccctgggcctgggccagtaccaggccaccctgatcaacgagtacagcagcgtggtgcagcccgtgcagctggccttccagcagcagatccagaccctgaagacccagcacgaggagttcgtgaccagcctggcccagcagcagcagcagcagcagcagcagcagcagcagctgcagatgccccagatggaggccgaggtgaaggccaccccccccccccccgcccccccccccgcccccgcccccgcccccgccatcccccccaccacccagcccgacgacagcaagccccccatccagatgcccggcagcagcgagtacgaggcccccggcggcgtgcaggaccccgccgccgccggccccagaggccccggcccccacgaccagatcccccccaacaagcccccctggttcgaccagccccaccccgtggccccctggggccagcagcagccccccgagcagcccccctacccccaccaccagggcggccccccccactgccccccctggaacaacagccacgagggcatgtggggcgagcagagaggcgaccccggctggaacggccagagagacgccccctggaacaaccagcccgacgccgcctggaacagccagttcgagggcccctggaacagccagcacgagcagcccccctggggcggcggccagagagagccccccttcagaatgcagagacccccccacttcagaggccccttccccccccaccagcagcacccccagttcaaccagcccccccacccccacaacttcaacagattcccccccagattcatgcaggacgacttcccccccagacaccccttcgagagacccccctacccccacagattcgactacccccagggcgacttccccgccgagatgggccccccccaccaccaccccggccacagaatgccccaccccggcatcaacgagcaccccccctgggccggcccccagcaccccgacttcggcccccccccccacggcttcaacggccagcccccccacatgagaagacagggccccccccacatcaaccacgacgaccccagcctggtgcccaacgtgccctacttcgacctgcccgccggcctgatggcccccctggtgaagctggaggaccacgagtacaagcccctggaccccaaggacatcagactgcccccccccatgccccccagcgagagactgctggccgccgtggaggccttctacagcccccccagccacgacagacccagaaacagcgagggctgggagcagaacggcctgtacgagttcttcagagccaagatgagagccagaagaagaaagggccaggagaagagaaacagcggccccagcagaagcagaagcagaagcaagagcagaggcagaagcagcagcagaagcaacagcagaagcagcaagagcagcggcagctacagcagaagcagaagcagaagctgcagcagaagctacagcagaagcagaagcagaagcagaagcagaagcagaagcagcagaagcagaagcagaagccagagcagaagcagaagcaagagctacagccccggcagaagaagaagaagcagaagcagaagccccaccccccccagcagcgccggcctgggcagcaacagcgccccccccatccccgacagcagactgggcgaggagaacaagggccaccagatgctggtgaagatgggctggagcggcagcggcggcctgggcgccaaggagcagggcatccaggaccccatcaagggcggcgacgtgagagacaagtgggaccagtacaagggcgtgggcgtggccctggacgacccctacgagaactacagaagaaacaagagctacagcttcatcgccagaatgaaggccagagacgagtgcaagtag

SEQ ID NO: 13512 - DNA, 963 bp, Artificial Sequence
  Description of Artificial Sequence: Synthetic coding sequence
atgagcaagagcgagagccccaaggagcccgagcagctgagaaagctgttcatcggcggcctgagcttcgagaccaccgacgagagcctgagaagccacttcgagcagtggggcaccctgaccgactgcgtggtgatgagagaccccaacaccaagagaagcagaggcttcggcttcgtgacctacgccaccgtggaggaggtggacgccgccatgaacgccagaccccacaaggtggacggcagagtggtggagcccaagagagccgtgagcagagaggacagccagagacccggcgcccacctgaccgtgaagaagatcttcgtgggcggcatcaaggaggacaccgaggagcaccacctgagagactacttcgagcagtacggcaagatcgaggtgatcgagatcatgaccgacagaggcagcggcaagaagagaggcttcgccttcgtgaccttcgacgaccacgacagcgtggacaagatcgtgatccagaagtaccacaccgtgaacggccacaactgcgaggtgagaaaggccctgagcaagcaggagatggccagcgccagcagcagccagagaggcagaagcggcagcggcaacttcggcggcggcagaggcggcggcttcggcggcaacgacaacttcggcagaggcggcaacttcagcggcagaggcggcttcggcggcagcagaggcggcggcggctacggcggcagcggcgacggctacaacggcttcggcaacgacggcagcaacttcggcggcggcggcagctacaacgacttcggcaactacaacaaccagagcagcaacttcggccccatgaagggcggcaacttcggcggcagaagcagcggcccctacggcggcggcggccagtacttcgccaagcccagaaaccagggcggctacggcggcagcagcagcagcagcagctacggcagcggcagaagattctag

SEQ ID NO: 13513 - DNA, 735 bp, Artificial Sequence; identical to SEQ ID NO: 10072
  Description of Artificial Sequence: Synthetic coding sequence

SEQ ID NO: 13514 - DNA, 4125 bp, Artificial Sequence
  Description of Artificial Sequence: Synthetic coding sequence
atgaccagcgccgccgagatcaagaagccccccgtggcccccaagcccaagttcgtggtggccaacaacaagcccgcccccccccccatcgcccccaagcccgacatcgtgatcagcagcgtgccccagagcaccaagaagatgaagcccgccatcgcccccaagcccaaggtgctgaagaccagccccgtgagagagatcggccagagccccagcagaaagatcatgctgaacctggagggccacaagcaggagctggccgagagcaccgacaacttcaactgcaagtacgagggcaaccagagcaacgactacatcagccccatgtgcagctgcagcagcgagtgcatccacaagctgggccacagagagaacctgtgcgtgaagcagctggtgctggagcccctggagatgaacgagaacctggagaacagcaagatcgacgagaccctgaccatcaagaccagaagcaagtgcgacctgtacggcgagaaggccaagaaccagggcggcgtggtgctgaaggccagcgtgctggaggaggagctgaaggacgccctgatccaccagatgccccccttcatcagcgcccagaagcacagacccaccgacagccccgagatgaacggcggctgcaacagcaacggccagttcagaatcgagttcgccgacctgagccccagccccagcagcttcgagaaggtgcccgaccaccacagctgccacctgcagctgcccagcgacgagtgcgagcacttcgagacctgccaggacgacagcgagaagagcaacaactgcttccagagcagcgagctggaggccctggagaacggcaagagaagcaccctgatcagcagcgacggcgtgagcaagaagagcgaggtgaaggacctgggccccctggagatccacctggtgccctacacccccaagttccccacccccaagcccagaaagaccagaaccgccagactgctgagacagaagtgcgtggacacccccagcgagagcaccgaggagcccggcaacagcgacagcagcagcagctgcctgaccgagaacagcctgaagatcaacaagatcagcgtgctgcaccagaacgtgctgtgcaagcaggagcaggtggacaagatgaagctgggcaacaagagcgagctgaacatggagagcaacagcgacgcccaggacctggtgaacagccagaaggccatgtgcaacgagaccaccagcttcgagaagatggcccccagcttcgacaaggacagcaacctgagcagcgacagcaccaccgtggacggcagcagcatgagcctggccgtggacgagggcaccggcttcatcagatgcaccgtgagcatgagcctgcccaagcagctgaagctgacctgcaacgagcacctgcagagcggcagaaacctgggcgtgagcgccccccagatgcagaaggagagcgtgatcaaggaggagaacagcctgagaatcgtgcccaagaagccccagagacacagcctgcccgccaccggcgtgctgaagaaggccgccagcgaggagctgctggagaagagcagctaccccagcagcgaggagaagagcagcgagaagagcctggagagaaaccacctgcagcacctgtgcgcccagaacagaggcgtgagcagcagcttcgacatgcccaagagagccagcgagaagcccgtgtggaagctgccccaccccatcctgcccttcagcggcaaccccgagttcctgaagagcgtgaccgtgagcagcaacagcgagcccagcaccgccctgaccaagcccagagccaagagcctgagcgccatggacgtggagaagtgcaccaagccctgcaaggacagcaccaagaagaacagcttcaagaagctgctgagcatgaagctgagcatctgcttcatgaagagcgacttccagaagttctggagcaagagcagccagctgggcgacaccaccaccggccacctgagcagcggcgagcagaagggcatcgagagcgactggcagggcctgctggtgggcgaggagaagagaagcaagcccatcaaggcctacagcaccgagaactacagcctggagagccagaagaagagaaagaagagcagaggccagaccagcgccgccaacggcctgagagccgagagcctggacgaccagatgctgagcagagagagcagcagccaggccccctacaagagcgtgaccagcctgtgcgcccccgagtacgagaacatcagacactacgaggagatccccgagtacgagaacctgcccttcatcatggccatcagaaagacccaggagctggagtggcagaacagcagcagcatggaggacgccgacgccaacgtgtacgaggtggaggagccctacgaggcccccgacggccagctgcagctgggccccagacaccagcacagcagcagcggcgccagccaggaggagcagaacgacctgggcctgggcgacctgcccagcgacgaggaggagatcatcaacagcagcgacgaggacgacgtgagcagcgagagcagcaagggcgagcccgaccccctggaggacaagcaggacgaggacaacggcatgaagagcaaggtgcaccacatcgccaaggagatcatgagcagcgagaaggtgttcgtggacgtgctgaagctgctgcacatcgacttcagagacgccgtggcccacgccagcagacagctgggcaagcccgtgatcgaggacagaatcctgaaccagatcctgtactacctgccccagctgtacgagctgaacagagacctgctgaaggagctggaggagagaatgctgcactggaccgagcagcagagaatcgccgacatcttcgtgaagaagggcccctacctgaagatgtacagcacctacatcaaggagttcgacaagaacatcgccctgctggacgagcagtgcaagaagaaccccggcttcgccgccgtggtgagagagttcgagatgagccccagatgcgccaacctggccctgaagcactacctgctgaagcccgtgcagagaatcccccagtacagactgctgctgaccgactacctgaagaacctgatcgaggacgccggcgactacagagacacccaggacgccctggccgtggtgatcgaggtggccaaccacgccaacgacaccatgaagcagggcgacaacttccagaagctgatgcagatccagtacagcctgaacggccaccacgagatcgtgcagcccggcagagtgttcctgaaggagggcatcctgatgaagctgagcagaaaggtgatgcagcccagaatgttcttcctgttcaacgacgccctgctgtacaccacccccgtgcagagcggcatgtacaagctgaacaacatgctgagcctggccggcatgaaggtgagaaagcccacccaggaggcctaccagaacgagctgaagatcgagagcgtggagagaagcttcatcctgagcgccagcagcgccaccgagagagacgagtggctggaggccatcagcagagccatcgaggagtacgccaagaagagaatcaccttctgccccagcagaagcctggacgaggccgacagcgagaacaaggaggaggtgagccccctgggcagcaaggcccccatctggatccccgacaccagagccaccatgtgcatgatctgcaccagcgagttcaccctgacctggagaagacaccactgcagagcctgcggcaagatcgtgtgccaggcctgcagcagcaacaagtacggcctggactacctgaagaaccagcccgccagagtgtgcgagcactgcttccaggagctgcagaagctggaccaccagcacagccccagaatcggcagccccggcaaccacaagagccccagcagcgccctgagcagcgtgctgcacagcatccccagcggcagaaagcagaagaagatccccgccgccctgaaggaggtgagcgccaacaccgaggacagcagcatgagcggctacctgtacagaagcaagggcaacaagaagccctggaagcacttctggttcgtgatcaagaacaaggtgctgtacacctacgccgccagcgaggtgagaagcgagatctag

SEQ ID NO: 13515 - DNA, 1446 bp, Artificial Sequence; identical to SEQ ID NO: 11023
  Description of Artificial Sequence: Synthetic coding sequence

SEQ ID NO: 13516 - DNA, 468 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacaccagcggcagcatccagctgagcgaggagcagaagagcgccctggccttcctgaacagaggccagcccagcagcagcaacgccggcaacaagagactgagcaccatcgacgagagcggcagcatcctgagcgactag

SEQ ID NO: 13517 - DNA, 420 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacaccagcggcagcatccagctgagcgaggagcagaagagcgccctggccttcctgaacagaggccagcccagcagcagcaacgccggctag

SEQ ID NO: 13518 - DNA, 3282 bp, Artificial Sequence
  Description of Artificial Sequence: Synthetic coding sequence
atgggcggcaaggcctggcccagaagagccgtgggcaccgccggcggcccctgcgccgagcagatcagcgcccccttccagaccctgctgatgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 13519 - DNA, 231 bp, Artificial Sequence
  Description of Artificial Sequence: Synthetic coding sequence
atgaacagcgtgggcgaggcctgcaccgacatgaagagagagtacgaccagtgcttcaacagatggttcgccgagaagttcctgaagggcgacagcagcggcgacccctgcaccgacctgttcaagagataccagcagtgcgtgcagaaggccatcaaggagaaggagatccccatcgagggcctggagttcatgggccacggcaaggagaagcccgagaacagcagctag

SEQ ID NO: 13520 - DNA, 735 bp, Artificial Sequence; identical to SEQ ID NO: 10072
  Description of Artificial Sequence: Synthetic coding sequence

SEQ ID NO: 13521 - DNA, 774 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagtgttctaccacggctgctggctgctgagcggctgcgactag

SEQ ID NO: 13522 - DNA, 804 bp, Artificial Sequence
  Description of Artificial Sequence: Synthetic coding sequence
atgagcaagagcgagagccccaaggagcccgagcagctgagaaagctgttcatcggcggcctgagcttcgagaccaccgacgagagcctgagaagccacttcgagcagtggggcaccctgaccgactgcgtggtgatgagagaccccaacaccaagagaagcagaggcttcggcttcgtgacctacgccaccgtggaggaggtggacgccgccatgaacgccagaccccacaaggtggacggcagagtggtggagcccaagagagccgtgagcagagaggacagccagagacccggcgcccacctgaccgtgaagaagatcttcgtgggcggcatcaaggaggacaccgaggagcaccacctgagagactacttcgagcagtacggcaagatcgaggtgatcgagatcatgaccgacagaggcagcggcaagaagagaggcttcgccttcgtgaccttcgacgaccacgacagcgtggacaagatcgtgatccagaagtaccacaccgtgaacggccacaactgcgaggtgagaaaggccctgagcaagcaggagatggccagcgccagcagcagccagagaggcagaagcggcagcggcaacttcggcggcggcagctacaacgacttcggcaactacaacaaccagagcagcaacttcggccccatgaagggcggcaacttcggcggcagaagcagcggcccctacggcggcggcggccagtacttcgccaagcccagaaaccagggcggctacggcggcagcagcagcagcagcagctacggcagcggcagaagattctag

SEQ ID NO: 13523 - DNA, 531 bp, Artificial Sequence
  Description of Artificial Sequence: Synthetic coding sequence
atgaacgagagcaagcccggcgacagccagaacctggcctgcgtgttctgcagaaagcacgacgactgccccaacaagtacggcgagaagaagaccaaggagaagtggaacctgaccgtgcactactactgcctgctgatgagcagcggcatctggcagagaggcaaggaggaggagggcgtgtacggcttcctgatcgaggacatcagaaaggaggtgaacagagccagcaagctgaagtgctgcgtgtgcaagaagaacggcgccagcatcggctgcgtggcccccagatgcaagagaagctaccacttcccctgcggcctgcagagagagtgcatcttccagttcaccggcaacttcgccagcttctgctgggaccacagacccgtgcagatcatcaccagcaacaactacagagagagcctgccctgcaccatctgcctggagttcatcgagcccatccccagctacaacatcctgagaagcccctgctgcaagaacgcctggttccacagagactgcctgcagtag

SEQ ID NO: 13524 - DNA, 3171 bp, Artificial Sequence
  Description of Artificial Sequence: Synthetic coding sequence
atgctgagcgtggtggagaacggcctggacccccaggccgccatccccgtgatcaagaagaagctggtgggcagcgtgaaggccctgcagaagcagtacgtgagcctggacaccgtggtgaccagcgaggacggcgacgccaacaccatgtgcagcgccctggaggccgtgttcatccacggcctgcacgccaagcacatcagagccgaggccggcggcaagagaaagaagagcgcccaccagaagcccctgccccagcccgtgttctggcccctgctgaaggccgtgacccacaagcacatcatcagcgagctggagcacctgaccttcgtgaacaccgacgtgggcagatgcagagcctggctgagactggccctgaacgacggcctgatggagtgctacctgaagctgctgctgcaggagcaggccagactgcacgagtactaccagcccaccgccctgctgagagacgccgaggagggcgagttcctgctgagcttcctgcagggcctgaccagcctgagcttcgagctgagctacaagagcgccatcctgaacgagtggaccctgacccccctggccctgagcggcctgtgccccctgagcgagctggaccccctgagcaccagcggcgccgagctgcagagaaaggagagcctggacagcatcagccacagcagcggcagcgaggacatcgaggtgcaccacagcggccacaagatcagaagaaaccagaagctgaccgccagcagcctgagcctggacaccgccagcagcagccagctgagctgcagcctgaacagcgacagctgcctgctgcaggagaacggcagcaagagccccgaccactgcgaggagcccatgagctgcgacagcgacctgggcaccgccaacgccgaggacagcgacagaagcctgcaggaggtgctgctggagttcagcaaggcccaggtgaacagcgtgcccaccaacggcctgagccaggagaccgagatccccaccccccaggccagcctgagcctgcacggcctgaacaccagcacctacctgcactgcgaggcccccgccgagcccctgcccgcccaggccgccagcggcacccaggacggcgtgcacgtgcaggagcccagaccccaggcccccagccccctggacctgcagcagcccgtggagagcaccagcggccagcagcccagcagcaccgtgagcgagaccgccagagaggtgggccagggcaacggcctgcagaaggcccaggcccacgacggcgccggcctgaagctggtggtgagcagccccaccagccccaagaacaagagctggatcagcgaggacgacttctacagacccagcagagagcagcccctggagagcgccagcgaccaccccatcgccagctacagaggcacccccggcagcagacccggcctgcacagacacttcagccaggagcccagaaagaactgcagcctgggcgccctggaccaggcctgcgtgcccagccccggcagaagacaggcccaggccgcccccagccagggccacaagagcttcagagtggtgcacagaagacagatgggcctgagcaaccccttcagaggcctgatgaagctgggcaccgtggagagaagaggcgccatgggcatctggaaggagctgttctgcgagctgagccccctggagttcagactgtacctgagcaacgaggagcacacctgcgtggagaactgcagcctgctgagatgcgagagcgtgggccccgcccacagcgacggcagattcgagctggtgttcagcggcaagaagctggccctgagagccagcagccaggacgaggccgaggactggctggacagagtgagagaggccctgcagaaggtgagaccccagcaggaggacgagtgggtgaacgtgcagtaccccgaccagcccgaggagccccccgaggccccccagggctgcctgagccccagcgacctgctgagcgagcccgccgccctgcagggcacccagttcgactggagcagcgcccaggtgcccgagcccgacgccatcaaggagagcctgctgtacctgtacatggacagaacctggatgccctacatcttcagcctgagcctggaggccctgaagtgcttcagaatcagaaacaacgagaagatgctgagcgacagccacggcgtggagaccatcagagacatcctgcccgacaccagcctgggcggccccagcttcttcaagatcatcaccgccaaggccgtgctgaagctgcaggccggcaacgccgaggaggccgccctgtggagagacctggtgagaaaggtgctggccagctacctggagaccgccgaggaggccgtgaccctgggcggcagcctggacgagaactgccaggaggtgctgaagttcgccaccagagagaacggcttcctgctgcagtacctggtggccatccccatggagaagggcctggacagccagggctgcttctgcgccggctgcagcagacagatcggcttcagcttcgtgagacccaagctgtgcgccttcagcggcctgtactactgcgacatctgccaccaggacgacgccagcgtgatccccgccagaatcatccacaactgggacctgaccaagagacccatctgcagacaggccctgaagttcctgacccagatcagagcccagcccctgatcaacctgcagatggtgaacgccagcctgtacgagcacgtggagagaatgcacctgatcggcagaagaagagagcagctgaagctgctgggcgactacctgggcctgtgcagaagcggcgccctgaaggagctgagcaagagactgaaccacagaaactacctgctggagagcccccacagattcagcgtggccgacctgcagcagatcgccgacggcgtgtacgagggcttcctgaaggccctgatcgagttcgccagccagcacgtgtaccactgcgacctgtgcacccagagaggcttcatctgccagatctgccagcaccacgacatcatcttccccttcgagttcgacaccaccgtgagatgcgccgagtgcaagaccgtgttccaccagagctgccaggccgtggtgaagaagggctgccccagatgcgccagaagaagaaagtaccaggagcagaacatcttcgcctag

SEQ ID NO: 13525 - DNA, 390 bp, Artificial Sequence; identical to SEQ ID NO: 10956
  Description of Artificial Sequence: Synthetic coding sequence

SEQ ID NO: 13526 - DNA, 348 bp, Artificial Sequence
  Description of Artificial Sequence: Synthetic coding sequence
atgaccaagaagagaagaaacaacggcagagccaagaagggcagaggccacgtgcagcccatcagatgcaccaactgcgccagatgcgtgcccaaggacaaggccatcaagaagttcgtgatcagaaacatcgtggaggccgccgccgtgagagacatcagcgaggtgagcgtgttcgacgcctacgtgctgcccaagctgtacgtgaagctgcactactgcgtgagctgcgccatccacagcaaggtggtgagaaacagaagcagagaggccagaaaggacagaacccccccccccagattcagacccgccggcgccgcccccggccccccccccaagcccatgtag

SEQ ID NO: 13527 - DNA, 1899 bp, Artificial Sequence; identical to SEQ ID NO: 9855
  Description of Artificial Sequence: Synthetic coding sequence

SEQ ID NO: 13528 - DNA, 390 bp, Artificial Sequence; identical to SEQ ID NO: 10956
  Description of Artificial Sequence: Synthetic coding sequence

SEQ ID NO: 13529 - DNA, 5220 bp, Artificial Sequence
  Description of Artificial Sequence: Synthetic coding sequence
atgatggagggcaacggcaccgagaacagctgcagcagaaccagaggctggctgcagcaggacaacgacgccaagccctggctgtggaagttcagcaactgcttcagcagacccgagcagaccctgccccacagcccccagaccaaggagtacatggagaacaagaaggtggccgtggagctgaaggacgtgcccagccccctgcacgccggcagcaagctgttccccgccgtgcccctgcccgacatcagaagcctgcagcagcccaagatccagctgagcagcgtgcccaaggtgagctgctgcgcccactgccccaacgagcccagcaccagccccatgagattcggcggcggcggcggcggcagcggcggcaccagcagcctgatccaccccggcgccctgctggacagccagagcaccagaaccatcacctgccaggtgggcagcggcttcgccttccagagcgccagcagcctgcagaacgccagcgccagaaacaacctggccggcatcgccagcgacttccccagcatgtgcctggagagcaacctgagcagctgcaagcacctgccctgctgcggcaagctgcacttccagagctgccacggcaacgtgcacaagctgcaccagttccccagcctgcagggctgcaccagcgccggctacttcccctgcagcgacttcaccagcggcgcccccggccacctggaggagcacatcagccagagcgagctgaccccccacctgtgcaccaacagcctgcacctgaacgtggtgccccccgtgtgcctgaagggcagcctgtactgcgaggactgcctgaacaagcccgccagaaacagcatcatcgacgccgccaaggtgtggcccaacatccccccccccaacacccagcccgcccccctggccgtgcccctgtgcaacggctgcggcaccaagggcaccggcaaggagaccaccctgctgctggccaccagcctgggcaaggccgccagcaagttcgaggtggccgtggccggccaggtgctggagaacctgccccccatcggcgtgttctgggacatcgagaactgcagcgtgcccagcggcagaagcgccaccgccgtggtgcagagaatcagagagaagttcttcaagggccacagagaggccgagttcatctgcgtgtgcgacatcagcaaggagaacaaggaggtgatccaggagctgaacaactgccaggtgaccgtggcccacatcaacgccaccgccaagaacgccgccgacgacaagctgagacagagcctgagaagattcgccaacacccacaccgcccccgccaccgtggtgctggtgagcaccgacgtgaacttcgccctggagctgagcgacctgagacacagacacggcttccacatcatcctggtgcacaagaaccaggccagcgaggccctgctgcaccacgccaacgagctgatcagattcgaggagttcatcagcgacctgccccccagactgcccctgaagatgccccagtgccacaccctgctgtacgtgtacaacctgcccgccaacaaggacggcaagagcgtgagcaacagactgagaagactgagcgacaactgcggcggcaaggtgctgagcatcaccggctgcagcgccatcctgagattcatcaaccaggacagcgccgagagagcccagaagagaatggagaacgaggacgtgttcggcaacagaatcatcgtgagcttcacccccaagaacagagagctgtgcgagaccaagagcagcaacgccatcgccgacaaggtgaagagccccaagaagctgaagaaccccaagctgtgcctgatcaaggacgccagcgagcagagcagcagcgccaaggccacccccggcaagggcagccaggccaacagcggcagcgccaccaagaacaccaacgtgaagagcctgcaggagctgtgcagaatggagagcaagaccggccacagaaacagcgagcaccagcagggccacctgagactggtggtgcccacccacggcaacagcagcgccgccgtgagcacccccaagaacagcggcgtggccgagcccgtgtacaagaccagccagaagaaggagaacctgagcgccagaagcgtgaccagcagccccgtggagaagaaggacaaggaggagaccgtgttccaggtgagctaccccagcgccttcagcaagctggtggccagcagacaggtgagccccctgctggccagccagagctggagcagcagaagcatgagccccaacctgctgaacagagccagccccctggccttcaacatcgccaacagcagcagcgaggccgactgccccgaccccttcgccaacggcgccgacgtgcaggtgagcaacatcgactacagactgagcagaaaggagctgcagcagctgctgcaggaggccttcgccagacacggcaaggtgaagagcgtggagctgagcccccacaccgactaccagctgaaggccgtggtgcagatggagaacctgcaggacgccatcggcgccgtgaacagcctgcacagatacaagatcggcagcaagaagatcctggtgagcctggccaccggcgccgccagcaagagcctgagcctgctgagcgccgagaccatgagcgtgctgcaggacgcccccgcctgctgcctgcccctgttcaagttcaccgacatctacgagaagaagttcggccacaagctgaacgtgagcgacctgtacaagctgaccgacaccgtggccatcagagagcagggcaacggcagactggtgtgcctgctgcccagcagccaggccagacagagccccctgggcagcagccagagccacgacggcagcagcaccaactgcagccccatcatcttcgaggagctggagtaccacgagcccgtgtgcagacagcactgcagcaacaaggacttcagcgagcacgagttcgaccccgacagctacaagatccccttcgtgatcctgagcctgaagaccttcgccccccaggtgcacagcctgctgcagacccacgagggcaccgtgcccctgctgagcttccccgactgctacatcgccgagttcggcgacctggaggtggtgcaggagaaccagggcggcgtgcccctggagcacttcatcacctgcgtgcccggcgtgaacatcgccaccgcccagaacggcatcaaggtggtgaagtggatccacaacaagccccccccccccaacaccgacccctggctgctgagaagcaagagccccgtgggcaacccccagctgatccagttcagcagagaggtgatcgacctgctgaagagccagcccagctgcgtgatccccatcagccacttcatccccagctaccaccaccacttcgccaagcagtgcagagtgagcgactacggctacagcaagctgatcgagctgctggaggccgtgccccacgtgctgcagatcctgggcatgggcagcaagagactgctgaccctgacccacagagcccaggtgaagagattcacccaggacctgctgaagctgctgaagagccaggccagcaagcaggtgatcgtgagagagttcagccaggcctaccactggtgcttcagcaaggactgggacgtgaccgagtacggcgtgtgcgagctgatcgacatcgtgagcgagatccccgacaccaccatctgcctgagccagcaggacaacgagatggtgatctgcatccccaagagagagagaacccaggacgagatcgagagaaccaagcagttcagcaaggacgtggtggacctgctgagacaccagccccacttcagaatgcccttcaacaagttcatccccagctaccaccaccacttcggcagacagtgcaagctggcctactacggcttcaccaagctgctggagctgttcgaggccatccccgacaccctgcaggtgctggagtgcggcgaggagaagatcctgaccctgaccgaggtggagagattcaaggccctggccgcccagttcgtgaagctgctgagaagccagaaggacaactgcctgatgatgaccgacctgctgaccgagtacgccaagaccttcggctacaccttcagactgcaggactacgacgtgagcagcatcagcgccctgacccagaagctgtgccacgtggtgaaggtggccgacatcgagagcggcagacagatccagctgatcaacagaaagagcctgagaagcctgaccgcccagctgctggtgctgctgatgagctgggagggcaccacccacctgagcgtggaggagctgaagagacactacgagagcacccacaacacccccctgaacccctgcgagtacggcttcatgaccctgaccgagctgctgaagagcctgccctacctggtggaggtgttcaccaacgacaagatggaggagtgcgtgaagctgaccagcctgtacctgttcgccaagaacgtgagaagcctgctgcacacctaccactaccagcagatcttcctgcacgagttcagcatggcctacaccaagtacgtgggcgagaccctgcagcccaagacctacggccacagcagcgtggaggagctgctgggcgccatcccccaggtggtgtggatcaagggccacggccacaagagaatcgtggtgctgaagaacgacatgaagagcagactgagcagcctgagcctgagccccgccaaccacgagaaccagcccagcgagggcgagagaatcctggaggtgcccgagagccacaccgccagcgagctgaagctgggcgccgacggcagcggccccagccacaccgagcaggagctgctgagactgaccgacgacagccccgtggacctgctgtgcgcccccgtgcccagctgcctgcccagcccccagctgagacccgaccccgtgatcctgcagagcgccgacctgatccagttcgaggagagaccccaggagcccagcgagatcatgatcctgaaccaggaggagaagatggagatccccatccccggcaagagcaagaccctgaccagcgacagcagcagcagctgcatcagcgccgccgtgcccgtgcccccctgccccagcagcgagaccagcgagagcctgctgagcaaggaccccgtggagagccccgccaagaagcagcccaagaacagagtgaagctggccgccaacttcagcctggcccccatcaccaagctgtag

SEQ ID NO: 13530 - DNA, 390 bp, Artificial Sequence; identical to SEQ ID NO: 10956
  Description of Artificial Sequence: Synthetic coding sequence

SEQ ID NO: 13531 - DNA, 432 bp, Artificial Sequence
  Description of Artificial Sequence: Synthetic coding sequence
atgaccctgagatgcctggagcccagcggcaacggcggcgagggcaccagaagccagtggggcaccgccggcagcgccgaggagcccagcccccaggccgccagactggccaaggccctgagagagctgggccagaccggctggtactggggcagcatgaccgtgaacgaggccaaggagaagctgaaggaggcccccgagggcaccttcctgatcagagacagcagccacagcgactacctgctgaccatcagcgtgaagaccagcgccggccccaccaacctgagaatcgagtaccaggacggcaagttcagactggacagcatcatctgcgtgaagagcaagctgaagcagttcgacagcgtggtgcacctgatcgactactacgtgcagatgtgcaaggacaagagaaccggccccgaggccccctag

SEQ ID NO: 13532 - DNA, 156 bp, Artificial Sequence
  Description of Artificial Sequence: Synthetic coding sequence
atgagcagcagcatgtggtacatcatgcagagcatccagagcaagtacagcctgagcgagagactgatcagaaccatcgccgccatcagaagcttcccccacgacaacgtggaggacctgatcagaggcggcgccgacgtgaactgcacccactag

SEQ ID NO: 13533 - DNA, 1902 bp, Artificial Sequence
  Description of Artificial Sequence: Synthetic coding sequence
atggaggagagccccctgagcagagcccccagcagaggcggcgtgaacttcctgaacgtggccagaacctacatccccaacaccaaggtggagtgccactacaccctgccccccggcaccatgcccagcgccagcgactggatcggcatcttcaaggtggaggccgcctgcgtgagagactaccacaccttcgtgtggagcagcgtgcccgagagcaccaccgacggcagccccatccacaccagcgtgcagttccaggccagctacctgcccaagcccggcgcccagctgtaccagttcagatacgtgaacagacagggccaggtgtgcggccagagcccccccttccagttcagagagcccagacccatggacgagctggtgaccctggaggaggccgacggcggcagcgacatcctgctggtggtgcccaaggccaccgtgctgcagaaccagctggacgagagccagcaggagagaaacgacctgatgcagctgaagctgcagctggagggccaggtgaccgagctgagaagcagagtgcaggagctggagagagccctggccaccgccagacaggagcacaccgagctgatggagcagtacaagggcatcagcagaagccacggcgagatcaccgaggagagagacatcctgagcagacagcagggcgaccacgtggccagaatcctggagctggaggacgacatccagaccatcagcgagaaggtgctgaccaaggaggtggagctggacagactgagagacaccgtgaaggccctgaccagagagcaggagaagctgctgggccagctgaaggaggtgcaggccgacaaggagcagagcgaggccgagctgcaggtggcccagcaggagaaccaccacctgaacctggacctgaaggaggccaagagctggcaggaggagcagagcgcccaggcccagagactgaaggacaaggtggcccagatgaaggacaccctgggccaggcccagcagagagtggccgagctggagcccctgaaggagcagctgagaggcgcccaggagctggccgccagcagccagcagaaggccaccctgctgggcgaggagctggccagcgccgccgccgccagagacagaaccatcgccgagctgcacagaagcagactggaggtggccgaggtgaacggcagactggccgagctgggcctgcacctgaaggaggagaagtgccagtggagcaaggagagagccggcctgctgcagagcgtggaggccgagaaggacaagatcctgaagctgagcgccgagatcctgagactggagaaggccgtgcaggaggagagaacccagaaccaggtgttcaagaccgagctggccagagagaaggacagcagcctggtgcagctgagcgagagcaagagagagctgaccgagctgagaagcgccctgagagtgctgcagaaggagaaggagcagctgcaggaggagaagcaggagctgctggagtacatgagaaagctggaggccagactggagaaggtggccgacgagaagtggaacgaggacgccaccaccgaggacgaggaggccgccgtgggcctgagctgccccgccgccctgaccgacagcgaggacgagagccccgaggacatgagactgcccccctacggcctgtgcgagagaggcgaccccggcagcagccccgccggccccagagaggccagccccctggtggtgatcagccagcccgcccccatcagcccccacctgagcggccccgccgaggacagcagcagcgacagcgaggccgaggacgagaagagcgtgctgatggccgccgtgcagagcggcggcgaggaggccaacctgctgctgcccgagctgggcagcgccttctacgacatggccagatag

SEQ ID NO: 13534 - DNA, 810 bp, Artificial Sequence; identical to SEQ ID NO: 12242
  Description of Artificial Sequence: Synthetic coding sequence

SEQ ID NO: 13535 - DNA, 618 bp, Artificial Sequence
  Description of Artificial Sequence: Synthetic coding sequence
atggacaaggacagccagggcctgctggacagcagcctgatggccagcggcaccgccagcagaagcgaggacgaggagagcctggccggccagaagagagccagcagccaggccctgggcaccatccccaagagaagaagcagcagcagattcatcaagagaaagaagttcgacgacgagctggtggagagcagcctggccaagagcagcaccagagccaagggcgccagcggcgtggagcccggcagatgcagcggcagcgagcccagcagcagcgagaagaagaaggtgagcaaggcccccagcacccccgtgccccccagccccgcccccgcccccggcctgaccaagagagtgaagaagagcaagcagcccctgcaggtgaccaaggacctgggcagatggaagcccgccgacgacctgctgctgatcaacgccgtgctgcagaccaacgacctgaccagcgtgcacctgggcgtgaagttcagctgcagattcaccctgagagaggtgcaggagagatggtacgccctgctgtacgaccccgtgatcagcaagctggcctgccaggccatgagacagctgcaccccgaggccatcgccgccatccagagctag

SEQ ID NO: 13536 - DNA, 540 bp, Artificial Sequence
  Description of Artificial Sequence: Synthetic coding sequence
atggactggacccccagactgcccagcagacacatcatcagcgagctggagcacctgaccttcgtgaacaccgacgtgggcagatgcagagcctggctgagactggccctgaacgacggcctgatggagtgctacctgaagctgctgctgcaggagcaggccagactgcagctgcagagaaaggagagcctggacagcatcagccacagcagcggcagcgaggacatcgaggtgcaccacagcggccacaagatcagaagaaaccagaagctgaccgccagcagcctgagcctggacaccgccagcagcagccagctgagctgcagcctgaacagcgacagctgcctgctgcaggagaacggcagcaagagccccgaccactgcgaggagcccatgagctgcgacagcgacctgggcaccgccaacgccgaggacagcgacagaagcctgcaggagaagaccagagccggcagccagagaatgaccagcaccggcctgcccggcagcaacccctggagagtgctgcagaccacccagtag

SEQ ID NO: 13537 - DNA, 735 bp, Artificial Sequence; identical to SEQ ID NO: 10072
  Description of Artificial Sequence: Synthetic coding sequence

SEQ ID NO: 13538 - DNA, 558 bp, Artificial Sequence
  Description of Artificial Sequence: Synthetic coding sequence
atggacaaggacagccagggcctgctggacagcagcctgatggccagcggcaccgccagcagaagcgaggacgaggagagcctggccggccagaagagagccagcagccaggccctgggcaccatccccaagagaagaagcagcagcagattcatcaagagaaagaagttcgacgacgagctggtggagagcagcctggccaagagcagcaccagagccaagggcgccagcggcgtggagcccggcagatgcagcggcagcgagcccagcagcagcgagaagaagaaggtgagcaaggcccccagcacccccgtgccccccagccccgcccccgcccccggcctgaccaagagagtgaagaagagcaagcagcccctgcaggtgaccaaggacctgggcagatggaagcccgccgacgacctgctgctgatcaacgccgtgctgcagaccaacgacctgaccagcgtgcacctgggcgtgaagttcagctgcagattcaccctgagagaggtgcaggagagatggtacgccctgctgtacgaccccgtgatcagctag

SEQ ID NO: 13539 - DNA, 3003 bp, Artificial Sequence
  Description of Artificial Sequence: Synthetic coding sequence
atggtggagtgcttcgagagcggcggcaccagactgagcctgagcagcttcaacgtgagctgcgacagcctgagagagcagctgagagagtggagatgcttccagtggtggagaatggactggacccccagactgcccagcagacacatcatcagcgagctggagcacctgaccttcgtgaacaccgacgtgggcagatgcagagcctggctgagactggccctgaacgacggcctgatggagtgctacctgaagctgctgctgcaggagcaggccagactgcacgagtactaccagcccaccgccctgctgagagacgccgaggagggcgagttcctgctgagcttcctgcagggcctgaccagcctgagcttcgagctgagctacaagagcgccatcctgaacgagtggaccctgacccccctggccctgagcggcctgtgccccctgagcgagctggaccccctgagcaccagcggcgccgagctgcagagaaaggagagcctggacagcatcagccacagcagcggcagcgaggacatcgaggtgcaccacagcggccacaagatcagaagaaaccagaagctgaccgccagcagcctgagcctggacaccgccagcagcagccagctgagctgcagcctgaacagcgacagctgcctgctgcaggagaacggcagcaagagccccgaccactgcgaggagcccatgagctgcgacagcgacctgggcaccgccaacgccgaggacagcgacagaagcctgcaggaggtgctgctggagttcagcaaggcccaggtgaacagcgtgcccaccaacggcctgagccaggagaccgagatccccaccccccaggccagcctgagcctgcacggcctgaacaccagcacctacctgcactgcgaggcccccgccgagcccctgcccgcccaggccgccagcggcacccaggacggcgtgcacgtgcaggagcccagaccccaggcccccagccccctggacctgcagcagcccgtggagagcaccagcggccagcagcccagcagcaccgtgagcgagaccgccagagaggtgggccagggcaacggcctgcagaaggcccaggcccacgacggcgccggcctgaagctggtggtgagcagccccaccagccccaagaacaagagctggatcagcgaggacgacttctacagacccagcagagagcagcccctggagagcgccagcgaccaccccatcgccagctacagaggcacccccggcagcagacccggcctgcacagacacttcagccaggagcccagaaagaactgcagcctgggcgccctggaccaggcctgcgtgcccagccccggcagaagacaggcccaggccgcccccagccagggccacaagagcttcagagtggtgcacagaagacagatgggcctgagcaaccccttcagaggcctgatgaagctgggcaccgtggagagaagaggcgccatgggcatctggaaggagctgttctgcgagctgagccccctggagttcagactgtacctgagcaacgaggagcacacctgcgtggagaactgcagcctgctgagatgcgagagcgtgggccccgcccacagcgacggcagattcgagctggtgttcagcggcaagaagctggccctgagagccagcagccaggacgaggccgaggactggctggacagagtgagagaggccctgcagaaggtgagaccccagcaggaggacgagtgggtgaacgtgcagtaccccgaccagcccgaggagccccccgaggccccccagggctgcctgagccccagcgacctgctgagcgagcccgccgccctgcagggcacccagttcgactggagcagcgcccaggtgcccgagcccgacgccatcaaggagagcctgctgtacctgtacatggacagaacctggatgccctacatcttcagcctgagcctggaggccctgaagtgcttcagaatcagaaacaacgagaagatgctgagcgacagccacggcgtggagaccatcagagacatcctgcccgacaccagcctgggcggccccagcttcttcaagatcatcaccgccaaggccgtgctgaagctgcaggccggcaacgccgaggaggccgccctgtggagagacctggtgagaaaggtgctggccagctacctggagaccgccgaggaggccgtgaccctgggcggcagcctggacgagaactgccaggaggtgctgaagttcgccaccagagagaacggcttcctgctgcagtacctggtggccatccccatggagaagggcctggacagccagggctgcttctgcgccggctgcagcagacagatcggcttcagcttcgtgagacccaagctgtgcgccttcagcggcctgtactactgcgacatctgccaccaggacgacgccagcgtgatccccgccagaatcatccacaactgggacctgaccaagagacccatctgcagacaggccctgaagttcctgacccagatcagagcccagcccctgatcaacctgcagatggtgaacgccagcctgtacgagcacgtggagagaatgcacctgatcggcagaagaagagagcagctgaagctgctgggcgactacctgggcctgtgcagaagcggcgccctgaaggagctgagcaagagactgaaccacagaaactacctgctggagagcccccacagattcagcgtggccgacctgcagcagatcgccgacggcgtgtacgagggcttcagccccaaggtgcccagcgaggccgccggcctgagaccctggggcgccagaagccccgaggccgccagcgccttcagatgcatcgacagcagccacctgcccagcctgagaaaggtggtgcccaccctgttcctgaagtgctacttcatgcagtacaccgtgcccagcgagcagggcagcggccccgaggagagcctgcagtgcatcgagggcatcgccgccgtgtag

SEQ ID NO: 13540 - DNA, 525 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacaccagcggcagcatccagctgagcgaggagcagaagagcgccctggccttcctgaacagaggccagcccagcagcagcaacgccggcaacaagagactgagcaccatcgacgagagcggcagcatcctgagcgacatcagcttcgacaagaccgacgagagcctggactgggacagcagcctggtgaagacctag

SEQ ID NO: 13541 - DNA, 2904 bp, Artificial Sequence
  Description of Artificial Sequence: Synthetic coding sequence
atggactggacccccagactgcccagcagacacatcatcagcgagctggagcacctgaccttcgtgaacaccgacgtgggcagatgcagagcctggctgagactggccctgaacgacggcctgatggagtgctacctgaagctgctgctgcaggagcaggccagactgcacgagtactaccagcccaccgccctgctgagagacgccgaggagggcgagttcctgctgagcttcctgcagggcctgaccagcctgagcttcgagctgagctacaagagcgccatcctgaacgagtggaccctgacccccctggccctgagcggcctgtgccccctgagcgagctggaccccctgagcaccagcggcgccgagctgcagagaaaggagagcctggacagcatcagccacagcagcggcagcgaggacatcgaggtgcaccacagcggccacaagatcagaagaaaccagaagctgaccgccagcagcctgagcctggacaccgccagcagcagccagctgagctgcagcctgaacagcgacagctgcctgctgcaggagaacggcagcaagagccccgaccactgcgaggagcccatgagctgcgacagcgacctgggcaccgccaacgccgaggacagcgacagaagcctgcaggaggtgctgctggagttcagcaaggcccaggtgaacagcgtgcccaccaacggcctgagccaggagaccgagatccccaccccccaggccagcctgagcctgcacggcctgaacaccagcacctacctgcactgcgaggcccccgccgagcccctgcccgcccaggccgccagcggcacccaggacggcgtgcacgtgcaggagcccagaccccaggcccccagccccctggacctgcagcagcccgtggagagcaccagcggccagcagcccagcagcaccgtgagcgagaccgccagagaggtgggccagggcaacggcctgcagaaggcccaggcccacgacggcgccggcctgaagctggtggtgagcagccccaccagccccaagaacaagagctggatcagcgaggacgacttctacagacccagcagagagcagcccctggagagcgccagcgaccaccccatcgccagctacagaggcacccccggcagcagacccggcctgcacagacacttcagccaggagcccagaaagaactgcagcctgggcgccctggaccaggcctgcgtgcccagccccggcagaagacaggcccaggccgcccccagccagggccacaagagcttcagagtggtgcacagaagacagatgggcctgagcaaccccttcagaggcctgatgaagctgggcaccgtggagagaagaggcgccatgggcatctggaaggagctgttctgcgagctgagccccctggagttcagactgtacctgagcaacgaggagcacacctgcgtggagaactgcagcctgctgagatgcgagagcgtgggccccgcccacagcgacggcagattcgagctggtgttcagcggcaagaagctggccctgagagccagcagccaggacgaggccgaggactggctggacagagtgagagaggccctgcagaaggtgagaccccagcaggaggacgagtgggtgaacgtgcagtaccccgaccagcccgaggagccccccgaggccccccagggctgcctgagccccagcgacctgctgagcgagcccgccgccctgcagggcacccagttcgactggagcagcgcccaggtgcccgagcccgacgccatcaaggagagcctgctgtacctgtacatggacagaacctggatgccctacatcttcagcctgagcctggaggccctgaagtgcttcagaatcagaaacaacgagaagatgctgagcgacagccacggcgtggagaccatcagagacatcctgcccgacaccagcctgggcggccccagcttcttcaagatcatcaccgccaaggccgtgctgaagctgcaggccggcaacgccgaggaggccgccctgtggagagacctggtgagaaaggtgctggccagctacctggagaccgccgaggaggccgtgaccctgggcggcagcctggacgagaactgccaggaggtgctgaagttcgccaccagagagaacggcttcctgctgcagtacctggtggccatccccatggagaagggcctggacagccagggctgcttctgcgccggctgcagcagacagatcggcttcagcttcgtgagacccaagctgtgcgccttcagcggcctgtactactgcgacatctgccaccaggacgacgccagcgtgatccccgccagaatcatccacaactgggacctgaccaagagacccatctgcagacaggccctgaagttcctgacccagatcagagcccagcccctgatcaacctgcagatggtgaacgccagcctgtacgagcacgtggagagaatgcacctgatcggcagaagaagagagcagctgaagctgctgggcgactacctgggcctgtgcagaagcggcgccctgaaggagctgagcaagagactgaaccacagaaactacctgctggagagcccccacagattcagcgtggccgacctgcagcagatcgccgacggcgtgtacgagggcttcctgaaggccctgatcgagttcgccagccagcacgtgtaccactgcgacctgtgcacccagagaggcttcatctgccagatctgccagcaccacgacatcatcttccccttcgagttcgacaccaccgtgagatgcgccgagtgcaagaccgtgttccaccagagctgccaggccgtggtgaagaagggctgccccagatgcgccagaagaagaaagtaccaggagcagaacatcttcgcctag

SEQ ID NO: 13542 - DNA, 1446 bp, Artificial Sequence; identical to SEQ ID NO: 11023
  Description of Artificial Sequence: Synthetic coding sequence

SEQ ID NO: 13543 - DNA, 462 bp, Artificial Sequence
  Description of Artificial Sequence: Synthetic coding sequence
atggcccccggcagcagaggcgagagaagcagcttcagaagcagaagaggccccggcgtgcccagcccccagcccgacgtgaccatgctgagcagactgctgaaggagcaccaggccaagcagaacgagagaaaggagctgcaggagaagagaagaagagaggccatcaccgccgccacctgcctgaccgaggccctggtggaccacctgaacgtgggcgtggcccaggcctacatgaaccagagaaagctggaccacgaggtgaagaccctgcaggtgcaggccgcccagttcgccaagcagaccggccagtggatcggcatggtggagaacttcaaccaggccctgaaggagatcggcgacgtggagaactgggccagaagcatcgagctggacatgagaaccatcgccaccgccctggagtacgtgtacaagggccagctgcagagcgcccccagctag

SEQ ID NO: 13544 - DNA, 1311 bp, Artificial Sequence
  Description of Artificial Sequence: Synthetic coding sequence
atgctgtggaacttcaagccccacgccagagcctacagatacgtgggccacaaggacgtggtgaccagcgtgcagttcagcccccacggcaacctgctggccagcgccagcagagacagaaccgtgagactgtggatccccgacaagagaggcaagttcagcgagttcaaggcccacaccgcccccgtgagaagcgtggacttcagcgccgacggccagttcctggccaccgccagcgaggacaagagcatcaaggtgtggagcatgtacagacagagattcctgtacagcctgtacagacacacccactgggtgagatgcgccaagttcagccccgacggcagactgatcgtgagctgcagcgaggacaagaccatcaagatctgggacaccaccaacaagcagtgcgtgaacaacttcagcgacagcgtgggcttcgccaacttcgtggacttcaaccccagcggcacctgcatcgccagcgccggcagcgaccagaccgtgaaggtgtgggacgtgagagtgaacaagctgctgcagcactaccaggtgcacagcggcggcgtgaactgcatcagcttccaccccagcggcaactacctgatcaccgccagcagcgacggcaccctgaagatcctggacctgctggagggcagactgatctacaccctgcagggccacaccggccccgtgttcaccgtgagcttcagcaagggcggcgagctgttcgccagcggcggcgccgacacccaggtgctgctgtggagaaccaacttcgacgagctgcactgcaagggcctgaccaagagaaacctgaagagactgcacttcgacagccccccccacctgctggacatctaccccagaaccccccacccccacgaggagaaggtggagaccgtggagatcaaccccaagctggaggtgatcgacctgcagatcagcaccccccccgtgatggacatcctgagcttcgacagcaccaccaccaccgagaccagcggcagaaccctgcccgacaagggcgaggaggcctgcggctacttcctgaaccccagcctgatgagccccgagtgcctgcccaccaccaccaagaagaagaccgaggacatgagcgacctgccctgcgagagccagagaagcatccccctggccgtgaccgacgccctggagcacatcatggagcagctgaacgtgctgacccagaccgtgagcatcctggagcagagactgaccctgaccgaggacaagctgaaggactgcctggagaaccagcagaagctgttcagcgccgtgcagcagaagagctag

SEQ ID NO: 13545 - DNA, 597 bp, Artificial Sequence; identical to SEQ ID NO: 10225
  Description of Artificial Sequence: Synthetic coding sequence

SEQ ID NO: 13546 - DNA, 597 bp, Artificial Sequence; identical to SEQ ID NO: 10225
  Description of Artificial Sequence: Synthetic coding sequence

SEQ ID NO: 13547 - DNA, 495 bp, Artificial Sequence
  Description of Artificial Sequence: Synthetic coding sequence
atgatggagggcaacggcaccgagaacagctgcagcagaaccagaggctggctgcagcaggacaacgacgccaagccctggctgtggaagttcagcaactgcttcagcagacccgagcagaccctgccccacagcccccagaccaaggagtacatggagaacaagaaggtggccgtggagctgaaggacgtgcccagccccctgcacgccggcagcaagctgttccccgccgtgcccctgcccgacatcagaagcctgcagcagcccaagatccagctgagcagcgtgcccaaggtgagctgctgcgcccactgccccaacgagcccagcaccagccccatgagattcggcggcggcggcggcggcagcggcggcaccagcagcctgatccaccccggcgccctgctggacagccagagcaccagaaccatcacctgccaggtgggcagcggcttcgccttccagagcgccagcagcctgcagaacgccagctag

SEQ ID NO: 13548 - DNA, 855 bp, Artificial Sequence
  Description of Artificial Sequence: Synthetic coding sequence
atgctgagcgtggtggagaacggcctggacccccaggccgccatccccgtgatcaagaagaagctggtgggcagcgtgaaggccctgcagaagcagtacgtgagcctggacaccgtggtgaccagcgaggacggcgacgccaacaccatgtgcagcgccctggaggccgtgttcatccacggcctgcacgccaagcacatcagagccgaggccggcggcaagagaaagaagagcgcccaccagaagcccctgccccagcccgtgttctggcccctgctgaaggccgtgacccacaagcacatcatcagcgagctggagcacctgaccttcgtgaacaccgacgtgggcagatgcagagcctggctgagactggccctgaacgacggcctgatggagtgctacctgaagctgctgctgcaggagcaggccagactgcagctgcagagaaaggagagcctggacagcatcagccacagcagcggcagcgaggacatcgaggtgcaccacagcggccacaagatcagaagaaaccagaagctgaccgccagcagcctgagcctggacaccgccagcagcagccagctgagctgcagcctgaacagcgacagctgcctgctgcaggagaacggcagcaagagccccgaccactgcgaggagcccatgagctgcgacagcgacctgggcaccgccaacgccgaggacagcgacagaagcctgcaggacatcaagatcttcagctgggcccagtggctgacccccgtgatccccgccctgtgggaggccgaggccggcggcagccagagacagcagatcgagaccttcctggccaacaccgtgaagccccacctgtactag

SEQ ID NO: 13549 - DNA, 3282 bp, Artificial Sequence
  Description of Artificial Sequence: Synthetic coding sequence
atgggcggcaaggcctggcccagaagagccgtgggcaccgccggcggcccctgcgccgagcagatcagcgcccccttccagaccctgctgatgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagagaggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcagctgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcaccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 13550 - DNA, 3621 bp, Artificial Sequence
  Description of Artificial Sequence: Synthetic coding sequence
atgaccagcgccgccgagatcaagaagccccccgtggcccccaagcccaagttcgtggtggccaacaacaagcccgcccccccccccatcgcccccaagcccgacatcgtgatcagcagcgtgccccagagcaccaagaagatgaagcccgccatcgcccccaagcccaaggtgctgaagaccagccccgtgagagagatcggccagagccccagcagaaagatcatgctgaacctggagggccacaagcaggagctggccgagagcaccgacaacttcaactgcaagtacgagggcaaccagagcaacgactacatcagccccatgtgcagctgcagcagcgagtgcatccacaagctgggccacagagagaacctgtgcgtgaagcagctggtgctggagcccctggagatgaacgagaacctggagaacagcaagatcgacgagaccctgaccatcaagaccagaagcaagtgcgacctgtacggcgagaaggccaagaaccagggcggcgtggtgctgaaggccagcgtgctggaggaggagctgaaggacgccctgatccaccagatgccccccttcatcagcgcccagaagcacagacccaccgacagccccgagatgaacggcggctgcaacagcaacggccagttcagaatcgagttcgccgacctgagccccagccccagcagcttcgagaaggtgcccgaccaccacagctgccacctgcagctgcccagcgacgagtgcgagcacttcgagacctgccaggacgacagcgagaagagcaacaactgcttccagagcagcgagctggaggccctggagaacggcaagagaagcaccctgatcagcagcgacggcgtgagcaagaagagcgaggtgaaggacctgggccccctggagatccacctggtgccctacacccccaagttccccacccccaagcccagaaagaccagaaccgccagactgctgagacagaagtgcgtggacacccccagcgagagcaccgaggagcccggcaacagcgacagcagcagcagctgcctgaccgagaacagcctgaagatcaacaagatcagcgtgctgcaccagaacgtgctgtgcaagcaggagcaggtggacaagatgaagctgggcaacaagagcgagctgaacatggagagcaacagcgacgcccaggacctggtgaacagccagaaggccatgtgcaacgagaccaccagcttcgagaagatggcccccagcttcgacaaggacagcaacctgagcagcgacagcaccaccgtggacggcagcagcatgagcctggccgtggacgagggcaccggcttcatcagatgcaccgtgagcatgagcctgcccaagcagctgaagctgacctgcaacgagcacctgcagagcggcagaaacctgggcgtgagcgccccccagatgcagaaggagagcgtgatcaaggaggagaacagcctgagaatcgtgcccaagaagccccagagacacagcctgcccgccaccggcgtgctgaagaaggccgccagcgaggagctgctggagaagagcagctaccccagcagcgaggagaagagcagcgagaagagcctggagagaaaccacctgcagcacctgtgcgcccagaacagaggcgtgagcagcagcttcgacatgcccaagagagccagcgagaagcccgtgtggaagctgccccaccccatcctgcccttcagcggcaaccccgagttcctgaagagcgtgaccgtgagcagcaacagcgagcccagcaccgccctgaccaagcccagagccaagagcctgagcgccatggacgtggagaagtgcaccaagccctgcaaggacagcaccaagaagaacagcttcaagaagctgctgagcatgaagctgagcatctgcttcatgaagagcgacttccagaagttctggagcaagagcagccagctgggcgacaccaccaccggccacctgagcagcggcgagcagaagggcatcgagagcgactggcagggcctgctggtgggcgaggagaagagaagcaagcccatcaaggcctacagcaccgagaactacagcctggagagccagaagaagagaaagaagagcagaggccagaccagcgccgccaacggcctgagagccgagagcctggacgaccagatgctgagcagagagagcagcagccaggccccctacaagagcgtgaccagcctgtgcgcccccgagtacgagaacatcagacactacgaggagatccccgagtacgagaacctgcccttcatcatggccatcagaaagacccaggagctggagtggcagaacagcagcagcatggaggacgccgacgccaacgtgtacgaggtggaggagccctacgaggcccccgacggccagctgcagctgggccccagacaccagcacagcagcagcggcgccagccaggaggagcagaacgacctgggcctgggcgacctgcccagcgacgaggaggagatcatcaacagcagcgacgaggacgacgtgagcagcgagagcagcaagggcgagcccgaccccctggaggacaagcaggacgaggacaacggcatgaagagcaaggtgcaccacatcgccaaggagatcatgagcagcgagaaggtgttcgtggacgtgctgaagctgctgcacatcgacttcagagacgccgtggcccacgccagcagacagctgggcaagcccgtgatcgaggacagaatcctgaaccagatcctgtactacctgccccagctgtacgagctgaacagagacctgctgaaggagctggaggagagaatgctgcactggaccgagcagcagagaatcgccgacatcttcgtgaagaagggcccctacctgaagatgtacagcacctacatcaaggagttcgacaagaacatcgccctgctggacgagcagtgcaagaagaaccccggcttcgccgccgtggtgagagagttcgagatgagccccagatgcgccaacctggccctgaagcactacctgctgaagcccgtgcagagaatcccccagtacagactgctgctgaccgactacctgaagaacctgatcgaggacgccggcgactacagagacacccaggacgccctggccgtggtgatcgaggtggccaaccacgccaacgacaccatgaagcagggcgacaacttccagaagctgatgcagatccagtacagcctgaacggccaccacgagatcgtgcagcccggcagagtgttcctgaaggagggcatcctgatgaagctgagcagaaaggtgatgcagcccagaatgttcttcctgttcaacgacgccctgctgtacaccacccccgtgcagagcggcatgtacaagctgaacaacatgctgagcctggccggcatgaaggtgagaaagcccacccaggaggcctaccagaacgagctgaagatcgagagcgtggagagaagcttcatcctgagcgccagcagcgccaccgagagagacgagtggctggaggccatcagcagagccatcgaggagtacgccaagaagagaatcaccttctgccccagcagaagcctggacgaggccgacagcgagaacaagtag

SEQ ID NO: 13551 - DNA, 435 bp, Artificial Sequence
  Description of Artificial Sequence: Synthetic coding sequence
atggacaaggacagccagggcctgctggacagcagcctgatggccagcggcaccgccagcagaagcgaggacgaggagagcctggccggccagaagagagccagcagccaggccctgggcaccatccccaagagaagaagcagcagcagaaccctgtacagattcatcaagagaaagaagttcgacgacgagctggtggagagcagcctggccaagagcagcaccagagccaagggcgccagcggcgtggagcccggcagatgcagcggcagcgagcccagcagcagcgagaagaagaaggtgagcaaggcccccagcacccccgtgccccccagccccgcccccgcccccggcctgaccaagagagtgaagaagagcaagcagcccctgcaggtgaccaaggacctgggcagatggaagcccgccgacgactag

SEQ ID NO: 13552 - DNA, 810 bp, Artificial Sequence; identical to SEQ ID NO: 12242
  Description of Artificial Sequence: Synthetic coding sequence

SEQ ID NO: 13553 - DNA, 501 bp, Artificial Sequence
  Description of Artificial Sequence: Synthetic coding sequence
atggccaacgaccccctggagggcttccacgaggtgaacctggccagccccaccagccccgacctgctgggcgtgtacgagagcggcacccaggagcagaccaccagccccagcgtgatctacagaccccaccccagcgccctgagcagcgtgcccatccaggccaacgccctggacgtgagcgagctgcccacccagcccgtgtacagcagccccagaagactgaactgcgccgagatcagcagcatcagcttccacgtgaccgaccccgccccctgcagcaccagcggcgtgaccgccggcctgaccaagctgaccaccagaaaggacaactacaacgccgagagagagttcctgcagggcgccaccatcaccgaggcctgcgacggcagcgacgacatcttcggcctgagcaccgacagcctgagcagactgagaagccccagcgtgctggaggtgagagagaagggctacgagagactgaaggaggagctggcctag

SEQ ID NO: 13554 - DNA, 390 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacaccagcggcagcatccagctgagcgaggagcagaagagcgccctggccttcctgaactag

SEQ ID NO: 13555 - DNA, 486 bp, Artificial Sequence
  Description of Artificial Sequence: Synthetic coding sequence
atgaccctgagatgcctggagcccagcggcaacggcggcgagggcaccagaagccagtggggcaccgccggcagcgccgaggagcccagcccccaggccgccagactggccaaggccctgagagagctgggccagaccggctggtactggggcagcatgaccgtgaacgaggccaaggagaagctgaaggaggcccccgagggcaccttcctgatcagagacagcagccacagcgactacctgctgaccatcagcgtgaagaccagcgccggccccaccaacctgagaatcgagtaccaggacggcaagttcagactggacagcatcatctgcgtgaagagcaagctgaagcagttcgacagcgtggtgcacctgatcgactactacgtgcagatgtgcaaggacaagagaaccggccccgaggcccccagaaacggcaccgtgcacctgtacctgaccaagcccctgtacaccagcgccccctag

SEQ ID NO: 13556 - DNA, 1389 bp, Artificial Sequence; identical to SEQ ID NO: 10274
  Description of Artificial Sequence: Synthetic coding sequence

SEQ ID NO: 13557 - DNA, 576 bp, Artificial Sequence; identical to SEQ ID NO: 9211
  Description of Artificial Sequence: Synthetic coding sequence

SEQ ID NO: 13558 - DNA, 1212 bp, Artificial Sequence
  Description of Artificial Sequence: Synthetic coding sequence
atggccagcagcagcgtgccccccgccaccgtgagcgccgccaccgccggccccggccccggcttcggcttcgccagcaagaccaagaagaagcacttcgtgcagcagaaggtgaaggtgttcagagccgccgaccccctggtgggcgtgttcctgtggggcgtggcccacagcatcaacgagctgagccaggtgcccccccccgtgatgctgctgcccgacgacttcaaggccagcagcaagatcaaggagtactgcccccaggtgttcagaaacctgagagacagattcggcatcgacgaccaggactacctggtgagcctgaccagaaacccccccagcgagagcgagggcagcgacggcagattcctgatcagctacgacagaaccctggtgatcaaggaggtgagcagcgaggacatcgccgacatgcacagcaacctgagcaactaccaccagtacatcgtgaagtgccacggcaacaccctgctgccccagttcctgggcatgtacagagtgagcgtggacaacgaggacagctacatgctggtgatgagaaacatgttcagccacagactgcccgtgcacagaaagtacgacctgaagggcagcctggtgagcagagaggccagcgacaaggagaaggtgaaggagctgcccaccctgaaggacatggacttcctgaacaagaaccagaaggtgtacatcggcgaggaggagaagaagatcttcctggagaagctgaagagagacgtggagttcctggtgcagctgaagatcatggactacagcctgctgctgggcatccacgacatcatcagaggcagcgagcccgaggaggaggcccccgtgagagaggacgagagcgaggtggacggcgactgcagcctgaccggcccccccgccctggtgggcagctacggcaccagccccgagggcatcggcggctacatccacagccacagacccctgggccccggcgagttcgagagcttcatcgacgtgtacgccatcagaagcgccgagggcgccccccagaaggaggtgtacttcatgggcctgatcgacatcctgacccagtacgacgccaagaagaaggccgcccacgccgccaagaccgtgaagcacggcgccggcgccgagatcagcaccgtgcaccccgagcagtacgccaagagattcctggacttcatcaccaacatcttcgcctag

SEQ ID NO: 13559 - DNA, 576 bp, Artificial Sequence
  Description of Artificial Sequence: Synthetic coding sequence
aagatcgaggtgatcgagatcatgaccgacagaggcagcggcaagaagagaggcttcgccttcgtgaccttcgacgaccacgacagcgtggacaagatcgtgatccagaagtaccacaccgtgaacggccacaactgcgaggtgagaaaggccctgagcaagcaggagatggccagcgccagcagcagccagagaggcagaagcggcagcggcaacttcggcggcggcagaggcggcggcttcggcggcaacgacaacttcggcagaggcggcaacttcagcggcagaggcggcttcggcggcagcagaggcggcggcggctacggcggcagcggcgacggctacaacggcttcggcaacgacggcagcaacttcggcggcggcggcagctacaacgacttcggcaactacaacaaccagagcagcaacttcggccccatgaagggcggcaacttcggcggcagaagcagcggcccctacggcggcggcggccagtacttcgccaagcccagaaaccagggcggctacggcggcagcagcagcagcagcagctacggcagcggcagaagattctag

SEQ ID NO: 13560 - DNA, 543 bp, Artificial Sequence
  Description of Artificial Sequence: Synthetic coding sequence
atggagctgaccatcttcatcctgagactggccatctacatcctgaccttccccctgtacctgctgaacttcctgggcctgtggagctggatctgcaagaagtggttcccctacttcctggtgagattcaccgtgatctacaacgagcagatggccagcaagaagagagagctgttcagcaacctgcaggagttcgccggccccagcggcaagctgagcctgctggaggtgggctgcggcaccggcgccaacttcaagttctacccccccggctgcagagtgacctgcatcgaccccaaccccaacttcgagaagttcctgatcaagagcatcgccgagaacagacacctgcagttcgagagattcgtggtggccgccggcgagaacatgcaccaggtggccgacggcagcgtggacgtggtggtgtgcaccctggtgctgtgcagcgtgaagaaccaggagagaatcctgagagaggtgtgcagagtgctgagacccggcggcgccttctacttcatggagcacgtggccgccgagtgctag

SEQ ID NO: 13561 - DNA, 1431 bp, Artificial Sequence
  Description of Artificial Sequence: Synthetic coding sequence
atgggcctgaagaagatgaagggcctgagctacgacgaggccttcgccatggccaacgaccccctggagggcttccacgaggtgaacctggccagccccaccagccccgacctgctgggcgtgtacgagagcggcacccaggagcagaccaccagccccagcgtgatctacagaccccaccccagcgccctgagcagcgtgcccatccaggccaacgccctggacgtgagcgagctgcccacccagcccgtgtacagcagccccagaagactgaactgcgccgagatcagcagcatcagcttccacgtgaccgaccccgccccctgcagcaccagcggcgtgaccgccggcctgaccaagctgaccaccagaaaggacaactacaacgccgagagagagttcctgcagggcgccaccatcaccgaggcctgcgacggcagcgacgacatcttcggcctgagcaccgacagcctgagcagactgagaagccccagcgtgctggaggtgagagagaagggctacgagagactgaaggaggagctggccaaggcccagagagagctgaagctgaaggacgaggagtgcgagagactgagcaaggtgagagaccagctgggccaggagctggaggagctgaccgccagcctgttcgaggaggcccacaagatggtgagagaggccaacatcaagcaggccaccgccgagaagcagctgaaggaggcccagggcaagatcgacgtgctgcaggccgaggtggccgccctgaagaccctggtgctgagcagcagccccaccagccccacccaggagcccctgcccggcggcaagacccccttcaagaagggccacaccagaaacaagagcaccagcagcgccatgagcggcagccaccaggacctgagcgtgatccagcccatcgtgaaggactgcaaggaggccgacctgagcctgtacaacgagttcagactgtggaaggacgagcccaccatggacagaacctgccccttcctggacaagatctaccaggaggacatcttcccctgcctgaccttcagcaagagcgagctggccagcgccgtgctggaggccgtggagaacaacaccctgagcatcgagcccgtgggcctgcagcccatcagattcgtgaaggccagcgccgtggagtgcggcggccccaagaagtgcgccctgaccggccagagcaagagctgcaagcacagaatcaagctgggcgacagcagcaactactactacatcagccccttctgcagatacagaatcaccagcgtgtgcaacttcttcacctacatcagatacatccagcagggcctggtgaagcagcaggacgtggaccagatgttctgggaggtgatgcagctgagaaaggagatgagcctggccaagctgggctacttcaaggaggagctgtag

SEQ ID NO: 13562 - DNA, 336 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacacctag

SEQ ID NO: 13563 - DNA, 324 bp, Artificial Sequence
  Description of Artificial Sequence: Synthetic coding sequence
atgatcaagaacctggaggtgcagctgagaagagccaccgacgagatgaaggcctacatcagcagcgaccagcaggagaagagaaaggccatcagagagcagtacaccaagaacaccgccgagcaggagaacctgggcaagaagctgagagagaagcagaaggtgatcagagagagccacggccccaacatgaagcaggccaagatgtggagagacctggagcagctgatggagtgcaagaagcagtgcttcctgaagcagcagagccagaccagcatcggccaggtgatccaggagggcggcgaggacagactgatcctgtag

SEQ ID NO: 13564 - DNA, 2772 bp, Artificial Sequence
  Description of Artificial Sequence: Synthetic coding sequence
atgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagagaggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcagctgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcaccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 13565 - DNA, 2076 bp, Artificial Sequence
  Description of Artificial Sequence: Synthetic coding sequence
atggaggagagccccctgagcagagcccccagcagaggcggcgtgaacttcctgaacgtggccagaacctacatccccaacaccaaggtggagtgccactacaccctgccccccggcaccatgcccagcgccagcgactggatcggcatcttcaaggtggaggccgcctgcgtgagagactaccacaccttcgtgtggagcagcgtgcccgagagcaccaccgacggcagccccatccacaccagcgtgcagttccaggccagctacctgcccaagcccggcgcccagctgtaccagttcagatacgtgaacagacagggccaggtgtgcggccagagcccccccttccagttcagagagcccagacccatggacgagctggtgaccctggaggaggccgacggcggcagcgacatcctgctggtggtgcccaaggccaccgtgctgcagaaccagctggacgagagccagcaggagagaaacgacctgatgcagctgaagctgcagctggagggccaggtgaccgagctgagaagcagagtgcaggagctggagagagccctggccaccgccagacaggagcacaccgagctgatggagcagtacaagggcatcagcagaagccacggcgagatcaccgaggagagagacatcctgagcagacagcagggcgaccacgtggccagaatcctggagctggaggacgacatccagaccatcagcgagaaggtgctgaccaaggaggtggagctggacagactgagagacaccgtgaaggccctgaccagagagcaggagaagctgctgggccagctgaaggaggtgcaggccgacaaggagcagagcgaggccgagctgcaggtggcccagcaggagaaccaccacctgaacctggacctgaaggaggccaagagctggcaggaggagcagagcgcccaggcccagagactgaaggacaaggtggcccagatgaaggacaccctgggccaggcccagcagagagtggccgagctggagcccctgaaggagcagctgagaggcgcccaggagctggccgccagcagccagcagaaggccaccctgctgggcgaggagctggccagcgccgccgccgccagagacagaaccatcgccgagctgcacagaagcagactggaggtggccgaggtgaacggcagactggccgagctgggcctgcacctgaaggaggagaagtgccagtggagcaaggagagagccggcctgctgcagagcgtggaggccgagaaggacaagatcctgaagctgagcgccgagatcctgagactggagaaggccgtgcaggaggagagaacccagaaccaggtgttcaagaccgagctggccagagagaaggacagcagcctggtgcagctgagcgagagcaagagagagctgaccgagctgagaagcgccctgagagtgctgcagaaggagaaggagcagctgcaggaggagaagcaggagctgctggagtacatgagaaagctggaggccagactggagaaggtggccgacgagaagtggaacgaggacgccaccaccgaggacgaggaggccgccgtgggcctgagctgccccgccgccctgaccgacagcgaggacgagagccccgaggacatgagactgcccccctacggcctgtgcgagagaggcgaccccggcagcagccccgccggccccagagaggccagccccctggtggtgatcagccagcccgcccccatcagcccccacctgagcggccccgccgaggacagcagcagcgacagcgaggccgaggacgagaagagcgtgctgatggccgccgtgcagagcggcggcgaggaggccaacctgctgctgcccgagctgggcagcgccttctacgacatggccagcggcttcaccgtgggcaccctgagcgagaccagcaccggcggccccgccacccccacctggaaggagtgccccatctgcaaggagagattccccgccgagagcgacaaggacgccctggaggaccacatggacggccacttcttcttcagcacccaggaccccttcaccttcgagtag

SEQ ID NO: 13566 - DNA, 366 bp, Artificial Sequence
  Description of Artificial Sequence: Synthetic coding sequence
atgaacgagagcaagcccggcgacagccagaacctggcctgcgtgttctgcagaaagcacgacgactgccccaacaagtacggcgagaagaagaccaaggagaagtggaacctgaccgtgcactactactgcctgctgatgagcagcggcatctggcagagaggcaaggaggaggagggcgtgtacggcttcctgatcgaggacatcagaaaggaggtgaacagagccagcaagctgaagtgctgcgtgtgcaagaagaacggcgccagcatcggctgcgtggcccccagatgcaagagaagctaccacttcccctgcggcctgcagagagagtgcatcttccagttcaccggcaacttcgcctag

SEQ ID NO: 13567 - DNA, 657 bp, Artificial Sequence; identical to SEQ ID NO: 10167
  Description of Artificial Sequence: Synthetic coding sequence

SEQ ID NO: 13568 - DNA, 1899 bp, Artificial Sequence; identical to SEQ ID NO: 9855
  Description of Artificial Sequence: Synthetic coding sequence

SEQ ID NO: 13569 - DNA, 1134 bp, Artificial Sequence; identical to SEQ ID NO: 11011
  Description of Artificial Sequence: Synthetic coding sequence

SEQ ID NO: 13570 - DNA, 1134 bp, Artificial Sequence; identical to SEQ ID NO: 11011
  Description of Artificial Sequence: Synthetic coding sequence

SEQ ID NO: 13571 - DNA, 774 bp, Artificial Sequence; identical to SEQ ID NO: 13521
  Description of Artificial Sequence: Synthetic coding sequence

SEQ ID NO: 13572 - DNA, 1446 bp, Artificial Sequence; identical to SEQ ID NO: 11023
  Description of Artificial Sequence: Synthetic coding sequence

SEQ ID NO: 13573 - DNA, 597 bp, Artificial Sequence; identical to SEQ ID NO: 10225
  Description of Artificial Sequence: Synthetic coding sequence

SEQ ID NO: 13574 - DNA, 345 bp, Artificial Sequence
  Description of Artificial Sequence: Synthetic coding sequence
atgaccaccagacaggccaccaaggaccccctgctgagaggcgtgagccccacccccagcaagatccccgtgagaagccagaagagaacccccttccccaccgtgaccagctgcgccgtggaccaggagaaccaggaccccagaagatgggtgcagaagccccccctgaacatccagagacccctggtggacagcgccggccccagacccaaggccagacaccaggccgagaccagccagagactggtgggcatcagccagcccagaaaccccctggaggagctgagacccagccccagaggccagaacgtgggccccggcccccccgcccagaccgaggcctag

SEQ ID NO: 13575 - DNA, 1446 bp, Artificial Sequence; identical to SEQ ID NO: 11023
  Description of Artificial Sequence: Synthetic coding sequence

SEQ ID NO: 13576 - DNA, 396 bp, Artificial Sequence; identical to SEQ ID NO: 11822
  Description of Artificial Sequence: Synthetic coding sequence

SEQ ID NO: 13577 - DNA, 765 bp, Artificial Sequence; identical to SEQ ID NO: 10001
  Description of Artificial Sequence: Synthetic coding sequence

SEQ ID NO: 13578 - DNA, 2772 bp, Artificial Sequence
  Description of Artificial Sequence: Synthetic coding sequence
atgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 13579 - DNA, 5229 bp, Artificial Sequence
  Description of Artificial Sequence: Synthetic coding sequence
atgatggagggcaacggcaccgagaacagctgcagcagaaccagaggctggctgcagcaggacaacgacgccaagccctggctgtggaagttcagcaactgcttcagcagacccgagcagaccctgccccacagcccccagaccaaggagtacatggagaacaagaaggtggccgtggagctgaaggacgtgcccagccccctgcacgccggcagcaagctgttccccgccgtgcccctgcccgacatcagaagcctgcagcagcccaagatccagctgagcagcgtgcccaaggtgagctgctgcgcccactgccccaacgagcccagcaccagccccatgagattcggcggcggcggcggcggcagcggcggcaccagcagcctgatccaccccggcgccctgctggacagccagagcaccagaaccatcacctgccaggtgggcagcggcttcgccttccagagcgccagcagcctgcagaacgccagcgccagaaacaacctggccggcatcgccagcgacttccccagcatgtgcctggagagcaacctgagcagctgcaagcacctgccctgctgcggcaagctgcacttccagagctgccacggcaacgtgcacaagctgcaccagttccccagcctgcagggctgcaccagcgccggctacttcccctgcagcgacttcaccagcggcgcccccggccacctggaggagcacatcagccagagcgagctgaccccccacctgtgcaccaacagcctgcacctgaacgtggtgccccccgtgtgcctgaagggcagcctgtactgcgaggactgcctgaacaagcccgccagaaacagcatcatcgacgccgccaaggtgtggcccaacatccccccccccaacacccagcccgcccccctggccgtgcccctgtgcaacggctgcggcaccaagggcaccggcaaggagaccaccctgctgctggccaccagcctgggcaaggccgccagcaagttcggcagccccgaggtggccgtggccggccaggtgctggagaacctgccccccatcggcgtgttctgggacatcgagaactgcagcgtgcccagcggcagaagcgccaccgccgtggtgcagagaatcagagagaagttcttcaagggccacagagaggccgagttcatctgcgtgtgcgacatcagcaaggagaacaaggaggtgatccaggagctgaacaactgccaggtgaccgtggcccacatcaacgccaccgccaagaacgccgccgacgacaagctgagacagagcctgagaagattcgccaacacccacaccgcccccgccaccgtggtgctggtgagcaccgacgtgaacttcgccctggagctgagcgacctgagacacagacacggcttccacatcatcctggtgcacaagaaccaggccagcgaggccctgctgcaccacgccaacgagctgatcagattcgaggagttcatcagcgacctgccccccagactgcccctgaagatgccctgccacaccctgctgtacgtgtacaacctgcccgccaacaaggacggcaagagcgtgagcaacagactgagaagactgagcgacaactgcggcggcaaggtgctgagcatcaccggctgcagcgccatcctgagattcatcaaccaggacagcgccgagagagcccagaagagaatggagaacgaggacgtgttcggcaacagaatcatcgtgagcttcacccccaagaacagagagctgtgcgagaccaagagcagcaacgccatcgccgacaaggtgaagagccccaagaagctgaagaaccccaagctgtgcctgatcaaggacgccagcgagcagagcagcagcgccaaggccacccccggcaagggcagccaggccaacagcggcagcgccaccaagaacaccaacgtgaagagcctgcaggagctgtgcagaatggagagcaagaccggccacagaaacagcgagcaccagcagggccacctgagactggtggtgcccacccacggcaacagcagcgccgccgtgagcacccccaagaacagcggcgtggccgagcccgtgtacaagaccagccagaagaaggagaacctgagcgccagaagcgtgaccagcagccccgtggagaagaaggacaaggaggagaccgtgttccaggtgagctaccccagcgccttcagcaagctggtggccagcagacaggtgagccccctgctggccagccagagctggagcagcagcagaagcatgagccccaacctgctgaacagagccagccccctggccttcaacatcgccaacagcagcagcgaggccgactgccccgaccccttcgccaacggcgccgacgtgcaggtgagcaacatcgactacagactgagcagaaaggagctgcagcagctgctgcaggaggccttcgccagacacggcaaggtgaagagcgtggagctgagcccccacaccgactaccagctgaaggccgtggtgcagatggagaacctgcaggacgccatcggcgccgtgaacagcctgcacagatacaagatcggcagcaagaagatcctggtgagcctggccaccggcgccgccagcaagagcctgagcctgctgagcgccgagaccatgagcgtgctgcaggacgcccccgcctgctgcctgcccctgttcaagttcaccgacatctacgagaagaagttcggccacaagctgaacgtgagcgacctgtacaagctgaccgacaccgtggccatcagagagcagggcaacggcagactggtgtgcctgctgcccagcagccaggccagacagagccccctgggcagcagccagagccacgacggcagcagcaccaactgcagccccatcatcttcgaggagctggagtaccacgagcccgtgtgcagacagcactgcagcaacaaggacttcagcgagcacgagttcgaccccgacagctacaagatccccttcgtgatcctgagcctgaagaccttcgccccccaggtgcacagcctgctgcagacccacgagggcaccgtgcccctgctgagcttccccgactgctacatcgccgagttcggcgacctggaggtggtgcaggagaaccagggcggcgtgcccctggagcacttcatcacctgcgtgcccggcgtgaacatcgccaccgcccagaacggcatcaaggtggtgaagtggatccacaacaagccccccccccccaacaccgacccctggctgctgagaagcaagagccccgtgggcaacccccagctgatccagttcagcagagaggtgatcgacctgctgaagagccagcccagctgcgtgatccccatcagccacttcatccccagctaccaccaccacttcgccaagcagtgcagagtgagcgactacggctacagcaagctgatcgagctgctggaggccgtgccccacgtgctgcagatcctgggcatgggcagcaagagactgctgaccctgacccacagagcccaggtgaagagattcacccaggacctgctgaagctgctgaagagccaggccagcaagcaggtgatcgtgagagagttcagccaggcctaccactggtgcttcagcaaggactgggacgtgaccgagtacggcgtgtgcgagctgatcgacatcgtgagcgagatccccgacaccaccatctgcctgagccagcaggacaacgagatggtgatctgcatccccaagagagagagaacccaggacgagatcgagagaaccaagcagttcagcaaggacgtggtggacctgctgagacaccagccccacttcagaatgcccttcaacaagttcatccccagctaccaccaccacttcggcagacagtgcaagctggcctactacggcttcaccaagctgctggagctgttcgaggccatccccgacaccctgcaggtgctggagtgcggcgaggagaagatcctgaccctgaccgaggtggagagattcaaggccctggccgcccagttcgtgaagctgctgagaagccagaaggacaactgcctgatgatgaccgacctgctgaccgagtacgccaagaccttcggctacaccttcagactgcaggactacgacgtgagcagcatcagcgccctgacccagaagctgtgccacgtggtgaaggtggccgacatcgagagcggcagacagatccagctgatcaacagaaagagcctgagaagcctgaccgcccagctgctggtgctgctgatgagctgggagggcaccacccacctgagcgtggaggagctgaagagacactacgagagcacccacaacacccccctgaacccctgcgagtacggcttcatgaccctgaccgagctgctgaagagcctgccctacctggtggaggtgttcaccaacgacaagatggaggagtgcgtgaagctgaccagcctgtacctgttcgccaagaacgtgagaagcctgctgcacacctaccactaccagcagatcttcctgcacgagttcagcatggcctacaccaagtacgtgggcgagaccctgcagcccaagacctacggccacagcagcgtggaggagctgctgggcgccatcccccaggtggtgtggatcaagggccacggccacaagagaatcgtggtgctgaagaacgacatgaagagcagactgagcagcctgagcctgagccccgccaaccacgagaaccagcccagcgagggcgagagaatcctggaggtgcccgagagccacaccgccagcgagctgaagctgggcgccgacggcagcggccccagccacaccgagcaggagctgctgagactgaccgacgacagccccgtggacctgctgtgcgcccccgtgcccagctgcctgcccagcccccagctgagacccgaccccgtgatcctgcagagcgccgacctgatccagttcgaggagagaccccaggagcccagcgagatcatgatcctgaaccaggaggagaagatggagatccccatccccggcaagagcaagaccctgaccagcgacagcagcagcagctgcatcagcgccgccgtgcccgtgcccccctgccccagcagcgagaccagcgagagcctgctgagcaaggaccccgtggagagccccgccaagaagcagcccaagaacagagtgaagctggccgccaacttcagcctggcccccatcaccaagctgtag

SEQ ID NO: 13580 - DNA, 774 bp, Artificial Sequence; identical to SEQ ID NO: 13521
  Description of Artificial Sequence: Synthetic coding sequence

SEQ ID NO: 13581 - DNA, 1134 bp, Artificial Sequence; identical to SEQ ID NO: 11011
  Description of Artificial Sequence: Synthetic coding sequence

SEQ ID NO: 13582 - DNA, 495 bp, Artificial Sequence; identical to SEQ ID NO: 13223
  Description of Artificial Sequence: Synthetic coding sequence

SEQ ID NO: 13583 - DNA, 393 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacaccagcggcagcatccagctgagcgaggagcagaagagcgccctggccttcctgaacagatag

SEQ ID NO: 13584 - DNA, 324 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgtag

SEQ ID NO: 13585 - DNA, 885 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacaccagcggcagcatccagctgagcgaggagcagaagagcgccctggccttcctgaacagaggccagcccagcagcagcaacgccggcaacaagagactgagcaccatcgacgagagcggcagcatcctgagcgacatcagcttcgacaagaccgacgagagcctggactgggacagcagcctggtgaagaccttcaagctgaagaagagagagaagagaagaagcaccagcagacagttcgtggacggcccccccggccccgtgaagaagaccagaagcatcggcagcgccgtggaccagggcaacgagagcatcgtggccaagaccaccgtgaccgtgcccaacgacggcggccccatcgaggccgtgagcaccatcgagaccgtgccctactggaccagaagcagaagaaagaccggcaccctgcagccctggaacagcgacagcaccctgaacagcagacagctggagcccagaaccgagaccgacagcgtgggcaccccccagagcaacggcggcatgagactgcacgacttcgtgagcaagaccgtgtag

SEQ ID NO: 13586 - DNA, 504 bp, Artificial Sequence; identical to SEQ ID NO: 9773
  Description of Artificial Sequence: Synthetic coding sequence

SEQ ID NO: 13587 - DNA, 882 bp, Artificial Sequence
  Description of Artificial Sequence: Synthetic coding sequence
atgctgagagagcccagaaagcagggcctggccggcagagcccacctgctgagccccggcaccaccggcagcatgaagacccccgtggagctggccgtgagcggcatgcagaccctgggcctgcagcacagatgcagaggcggctacagagtgaaggccagaaccagctacgtggacgagaccctgttcggcagccccgccggcaccagacccaccccccccgacttcgaccccccctgggtggagaaggccaacagaaccagaggcgtgggcaaggaggccagcaaggccctgggcgccaagggcagctgcgagaccacccccagcagaggcagcacccccaccctgacccccagaaagaagaacaagtacagacccatcagccacacccccagctactgcgacgagagcctgttcggcagcagaagcgagggcgccagcttcggcgcccccagaatggccaagggcgacgccgccaagctgagagccctgctgtggacccccccccccacccccagaggcagccacagccccagacccagagaggcccccctgagagccatccaccccgccggccccagcaagaccgagcccggccccgccgccgacagccagaagctgagcatgggcggcctgcacagcagcagacccctgaagagaggcctgagccacagcctgacccacctgaacgtgcccagcaccggccaccccgccaccagcgccccccacaccaacggcccccaggacctgagacccagcaccagcggcgtgaccttcagaagccccctggtgaccagcagagccagaagcgtgagcatcagcgtgcccagcacccccagaagaggcggcgccacccagaagcccaagcccccctggaagtag

SEQ ID NO: 13588 - DNA, 3282 bp, Artificial Sequence; identical to SEQ ID NO: 13549
  Description of Artificial Sequence: Synthetic coding sequence

SEQ ID NO: 13589 - DNA, 276 bp, Artificial Sequence
  Description of Artificial Sequence: Synthetic coding sequence
atgggcaagaagaccaagagaaccgccgacagcagcagcagcgaggacgaggaggagtacgtggtggagaaggtgctggacagaagagtggtgaagggccaggtggagtacctgctgaagtggaagggcttcagcgaggagcacaacacctgggagcccgagaagaacctggactgccccgagctgatcagcgagttcatgaagaagtacaagaagatgaaggagggcgagaacaacaagcccagagagaagagcgagagcaacaagagaaagtag

SEQ ID NO: 13590 - DNA, 390 bp, Artificial Sequence; identical to SEQ ID NO: 10956
  Description of Artificial Sequence: Synthetic coding sequence

SEQ ID NO: 13591 - DNA, 1134 bp, Artificial Sequence; identical to SEQ ID NO: 11011
  Description of Artificial Sequence: Synthetic coding sequence

SEQ ID NO: 13592 - DNA, 2031 bp, Artificial Sequence; identical to SEQ ID NO: 9296
  Description of Artificial Sequence: Synthetic coding sequence

SEQ ID NO: 13593 - DNA, 456 bp, Artificial Sequence
  Description of Artificial Sequence: Synthetic coding sequence
atggacaccatgatgctgaacgtgagaaacctgttcgagcagctggtgagaagagtggagatcctgagcgagggcaacgaggtgcagttcatccagctggccaaggacttcgaggacttcagaaagaagtggcagagaaccgaccacgagctgggcaagtacaaggacctgctgatgaaggccgagaccgagagaagcgccctggacgtgaagctgaagcacgccagaaaccaggtggacgtggagatcaagagaagacagagagccgaggccgactgcgagaagctggagagacagatccagctgatcagagagatgctgatgtgcgacaccagcggcagcatccagctgagcgaggagcagaagagcgccctggccttcctgaacagaggccagcccagcagcagcaacgccggcaacaagagactgagcaccatcgacgagagcggcagctag

SEQ ID NO: 13594 - DNA, 1446 bp, Artificial Sequence; identical to SEQ ID NO: 11023
  Description of Artificial Sequence: Synthetic coding sequence

SEQ ID NO: 13595 - DNA, 765 bp, Artificial Sequence; identical to SEQ ID NO: 10001
  Description of Artificial Sequence: Synthetic coding sequence

SEQ ID NO: 13596 - DNA, 1446 bp, Artificial Sequence; identical to SEQ ID NO: 11023
  Description of Artificial Sequence: Synthetic coding sequence

SEQ ID NO: 13597 - DNA, 1974 bp, Artificial Sequence
  Description of Artificial Sequence: Synthetic coding sequence
atgctgggccccagctgggacggcgacgaggccgagagcaccggcgagatcatcagactgggcgacaccgcccacaccttcagcctgagaagcaacggcgcccagtgccccaacgagatgctgagcaagaaggccctggccagccccagcagcaagagccacgaggacatgctgtacccccccagcgtgctgagcaagagcagaaccagcttcgtggaggacaccgagaccctgagcgtgagcggcatccccaacgccagaaagctgggcgagcccatcagagccgccatccccctgcaccccccctaccaccccagcgagcccagagccccctgccccatcggcaaggagtacctgcacagcagccactgcagccccgccgtgaacagcaccggcgagcacaccgagttcagcggcgacctggacgacggcctgttcctgatcagcaagctgcccaagggcagcaagtgggaggtgtaccccgcccaggtgcagggccccagaaccagaaagccccccaagggcaagagaaacgagaacagagccaccgccagcagctgcaacagccccttcccccagagacccagaaagagactgaccgagcaggagctgcacgacgtgagcgagaagctgagccagagactgagcgagctggactggatgctgaagagcgccctgggcgacagaatcaaggagaagaccgaccacaaggaggagaacaccggcaacgaggaggtggaggacggcaccgaggagaccctgagccagcacagcgacggcatcgtggagtacggccccaagaagagcagacccggcctgagcatgagaagaaagcccccctacagaagccacagcctgagccccagccccgtgaacaagcacaagcagttccacctggagagaaagagacagagaaagcccagagagaccgacgtgagacagttccaggcccaggccttcaccgaggccttcgagagagagctgagaagacacaaggtgcaggagaacatcggccccctgagaatccacgagaaggaggaggagaccgagaagatctacagaggcgaggccgtgagaaagggcacccccgagtgcagccagccctggaagatctacagcagaaagaccaccacccagagcctgagaggcggcctgcccaagcccaacaaggccgtgcccatgaaggtgagcgagcacagcctgctgcccctgatgctggagcagttccccttcctgtacgtgagcggccccaccctgagcaagatgtggaagcagcagatcgcccaggtggagcagctgaagaaggaggcctgcagagagaacagaagcaagaagaagctgcaggacgagatcgaggaggccctgagaagacacgacctgctgaccaccctggtgaagaaggagtacgagcacaacaagagactgcaggacttcaaggactgcatcagaagacagagactgacccagagcaagatcaaggagaacagacagcagatcgtgagagccagaaagtactacgacgactacagagtgcagctgtgcgccaagatgatgagaatgagaaccagagaggagatgatcttcaagaagctgttcgaggagggcctgaacatccagaagcagagactgagagacctgagaaactacgccaaggagaagagagacgagcagagaagaagacaccaggacgagctggacagcatggagaactactacaaggaccagttcagcctgctggccgaggccatcagccaggagcaccaggagctgaaggccagagagaagagccaggcccagaccctgcacaaggtgaagagagagctgagaagcaagatggagaaggagatccagcagctgcaggacatgatcacccagaacgacgacgacgtgttcttcagagagctggaggccgagagattcagaagcagactgcagctggccagcttccagtacagcaagagccccagcctgtag

SEQ ID NO: 13598 - DNA, 507 bp, Artificial Sequence
  Description of Artificial Sequence: Synthetic coding sequence
atgcagaccttcctgaagggcaagagagtgggctactggctgagcgagaagaagatcaagaagctgaacttccaggccttcgccgagctgtgcagaaagagaggcatggaggtggtgcagctgaacctgagcagacccatcgaggagcagggccccctggacgtgatcatccacaagctgaccgacgtgatcctggaggccgaccagaacgacagccagagcctggagctggtgcacagattccaggagtacatcgacgcccaccccgagaccatcgtgctggaccccctgcccgccatcagaaccctgctggacagaagcaagagctacgagctgatcagaaagatcgaggcctacatggaggacgacagaatctgcagcccccccttcatggagctgaccagcctgtgcggcgacgacaccatgagactgctggagaagaacggcctgaccttccccttcatctgcaagaccagagtggcccacggcaccaacagccacgagtag

SEQ ID NO: 13599 - DNA, 2211 bp, Artificial Sequence
  Description of Artificial Sequence: Synthetic coding sequence
atgctgatccccgccctgcagatcagcgacagcgagagcgtgggcctggaggacggcatcgagcagagcgcctacctgaccgagagcaagatgaacgagagcaagcccggcgacagccagaacctggcctgcgtgttctgcagaaagcacgacgactgccccaacaagtacggcgagaagaagaccaaggagaagtggaacctgaccgtgcactactactgcctgctgatgagcagcggcatctggcagagaggcaaggaggaggagggcgtgtacggcttcctgatcgaggacatcagaaaggaggtgaacagagccagcaagctgaagtgctgcgtgtgcaagaagaacggcgccagcatcggctgcgtggcccccagatgcaagagaagctaccacttcccctgcggcctgcagagagagtgcatcttccagttcaccggcaacttcgccagcttctgctgggaccacagacccgtgcagatcatcaccagcaacaactacagagagagcctgccctgcaccatctgcctggagttcatcgagcccatccccagctacaacatcctgagaagcccctgctgcaagaacgcctggttccacagagactgcctgcaggtgcaggccatcaacgccggcgtgttcttcttcagatgcaccatctgcaacaacagcgacatcttccagaaggagatgctgagaatgggcatccacatccccgagaaggacgccagctgggagctggaggagaacgcctaccaggagctgctgcagcactacgagagatgcgacgtgagaagatgcagatgcaaggagggcagagactacaacgcccccgacagcaagtgggagatcaagagatgccagtgctgcggcagcagcggcacccacctggcctgcagcagcctgagaagctgggagcagaactgggagtgcctggagtgcagaggcatcatctacaacagcggcgagttccagaaggccaagaagcacgtgctgcccaacagcaacaacgtgggcatcaccgactgcctgctggaggagagcagccccaagctgcccagacagagccccggcagccagagcaaggacctgctgagacagggcagcaagttcagaagaaacgtgagcaccctgctgatcgagctgggcttccagatcaagaagaagaccaagagactgtacatcaacaaggccaacatctggaacagcgccctggacgccttcagaaacagaaacttcaaccccagctacgccatcgaggtggcctacgtgatcgagaacgacaacttcggcagcgagcaccccggcagcaagcaggagttcctgagcctgctgatgcagcacctggagaacagcagcctgttcgagggcagcctgagcaagaacctgagcctgaacagccaggccctgaaggagaacctgtactacgaggccggcaagatgctggccatcagcctggtgcacggcggccccagccccggcttcttcagcaagaccctgttcaactgcctggtgtacggccccgagaacacccagcccatcctggacgacgtgagcgacttcgacgtggcccagatcatcatcagaatcaacaccgccaccaccgtggccgacctgaagagcatcatcaacgagtgctacaactacctggagctgatcggctgcctgagactgatcaccaccctgagcgacaagtacatgctggtgaaggacatcctgggctaccacgtgatccagagagtgcacacccccttcgagagcttcaagcagggcctgaagaccctgggcgtgctggagaagatccaggcctaccccgaggccttctgcagcatcctgtgccacaagcccgagagcctgagcgccaagatcctgagcgagctgttcaccgtgcacaccctgcccgacgtgaaggccctgggcttctggaacagctacctgcaggccgtggaggacggcaagagcaccaccaccatggaggacatcctgatcttcgccaccggctgcagcagcatcccccccgccggcttcaagcccacccccagcatcgagtgcctgcacgtggacttccccgtgggcaacaagtgcaacaactgcctggccatccccatcaccaacacctacaaggagttccaggagaacatggacttcaccatcagaaacaccctgagactggagaaggaggagagcagccactacatcggccactag

SEQ ID NO: 13600 - DNA, 1131 bp, Artificial Sequence
  Description of Artificial Sequence: Synthetic coding sequence
atggccaacagcgccaacaccaacaccgtgcccaagctgtacagaagcgtgatcgaggacgtgatcaacgacgtgagagacatcttcctggacgacggcgtggacgagcaggtgctgatggagctgaagaccctgtgggagaacaagctgatgcagagcagagccgtggacggcttccacagcgaggagcagcagctgctgctgcaggtgcagcagcagcaccagccccagcagcagcagcaccaccaccaccaccaccaccagcaggcccagccccagcagaccgtgccccagcaggcccagacccagcaggtgctgatccccgccagccagcaggccaccgccccccaggtgatcgtgcccgacagcaagctgatccagcacatgaacgccagcaacatgagcgccgccgccaccgccgccaccctggccctgcccgccggcgtgacccccgtgcagcagatcctgaccaacagcggccagctgctgcaggtggtgagagccgccaacggcgcccagtacatcttccagccccagcagagcgtggtgctgcagcagcaggtgatcccccagatgcagcccggcggcgtgcaggcccccgtgatccagcaggtgctggcccccctgcccggcggcatcagcccccagaccggcgtgatcatccagccccagcagatcctgttcaccggcaacaagacccaggtgatccccaccaccgtggccgcccccacccccgcccaggcccagatcaccgccaccggccagcagcagccccaggcccagcccgcccagacccaggcccccctggtgctgcaggtggacggcaccggcgacaccagcagcgaggaggacgaggacgaggaggaggactacgacgacgacgaggaggaggacaaggagaaggacggcgccgaggacggccaggtggaggaggagcccctgaacagcgaggacgacgtgagcgacgaggagggccaggagctgttcgacaccgagaacgtggtggtgtgccagtacgacaagatccacagaagcaagaacaagtggaagttccacctgaaggacggcatcatgaacctgaacggcagagactacatcttcagcaaggccatcggcgacgccgagtggtag

SEQ ID NO: 13601 - DNA, 237 bp, Artificial Sequence
  Description of Artificial Sequence: Synthetic coding sequence
atggagaccgactgcaaccccatggagctgagcagcatgagcggcttcgaggagggcagcgagctgaacggcttcgagggcaccgacatgaaggacatgagactggaggccgaggccgtggtgaacgacgtgctgttcgccgtgaacaacatgttcgtgagcaagagcctgagatgcgccgacgacgtggcctacatcaacgtggagaccaaggagagaaacagatactgcctgtag

SEQ ID NO: 13602 - DNA, 747 bp, Artificial Sequence; identical to SEQ ID NO: 12476
  Description of Artificial Sequence: Synthetic coding sequence

SEQ ID NO: 13603 - DNA, 2370 bp, Artificial Sequence
  Description of Artificial Sequence: Synthetic coding sequence
atgagcgcccagaccagccccgccgagaagggcctgaaccccggcctgatgtgccaggagagctacgcctgcagcggcaccgacgaggccatcttcgagtgcgacgagtgctgcagcctgcagtgcctgagatgcgaggaggagctgcacagacaggagagactgagaaaccacgagagaatcagactgaagcccggccacgtgccctactgcgacctgtgcaagggcctgagcggccacctgcccggcgtgagacagagagccatcgtgagatgccagacctgcaagatcaacctgtgcctggagtgccagaagagaacccacagcggcggcaacaagagaagacaccccgtgaccgtgtacaacgtgagcaacctgcaggagagcctggaggccgaggagatggacgaggagaccaagagaaagaagatgaccgagaaggtggtgagcttcctgctggtggacgagaacgaggagatccaggtgaccaacgaggaggacttcatcagaaagctggactgcaagcccgaccagcacctgaaggtggtgagcatcttcggcaacaccggcgacggcaagagccacaccctgaaccacaccttcttctacggcagagaggtgttcaagaccagccccacccaggagagctgcaccgtgggcgtgtgggccgcctacgaccccgtgcacaaggtggccgtgatcgacaccgagggcctgctgggcgccaccgtgaacctgagccagagaaccagactgctgctgaaggtgctggccatcagcgacctggtgatctacagaacccacgccgacagactgcacaacgacctgttcaagttcctgggcgacgccagcgaggcctacctgaagcacttcaccaaggagctgaaggccaccaccgccagatgcggcctggacgtgcccctgagcaccctgggccccgccgtgatcatcttccacgagaccgtgcacacccagctgctgggcagcgaccaccccagcgaggtgcccgagaagctgatccaggacagattcagaaagctgggcagattccccgaggccttcagcagcatccactacaagggcaccagaacctacaacccccccaccgacttcagcggcctgagaagagccctggagcagctgctggagaacaacaccaccagaagccccagacaccccggcgtgatcttcaaggccctgaaggccctgagcgacagattcagcggcgagatccccgacgaccagatggcccacagcagcttcttccccgacgagtacttcacctgcagcagcctgtgcctgagctgcggcgtgggctgcaagaagagcatgaaccacggcaaggagggcgtgccccacgaggccaagagcagatgcagatacagccaccagtacgacaacagagtgtacacctgcaaggcctgctacgagagaggcgaggaggtgagcgtggtgcccaagaccagcgccagcaccgacagcccctggatgggcctggccaagtacgcctggagcggctacgtgatcgagtgccccaactgcggcgtggtgtacagaagcagacagtactggttcggcaaccaggaccccgtggacaccgtggtgagaaccgagatcgtgcacgtgtggcccggcaccgacggcttcctgaaggacaacaacaacgccgcccagagactgctggacggcatgaacttcatggcccagagcgtgagcgagctgagcctgggccccaccaaggccgtgaccagctggctgaccgaccagatcgcccccgcctactggagacccaacagccagatcctgagctgcaacaagtgcgccaccagcttcaaggacaacgacaccaagcaccactgcagagcctgcggcgagggcttctgcgacagctgcagcagcaagaccagacccgtgcccgagagaggctggggccccgcccccgtgagagtgtgcgacaactgctacgaggccagaaacgtgcagctggccgtgaccgaggcccaggtggacgacgagggcggcaccctgatcgccagaaaggtgggcgaggccgtgcagaacaccctgggcgccgtggtgaccgccatcgacatccccctgggcctggtgaaggacgccgccagacccgcctactgggtgcccgaccacgagatcctgcactgccacaactgcagaaaggagttcagcatcaagctgagcaagcaccactgcagagcctgcggccagggcttctgcgacgagtgcagccacgacagaagagccgtgcccagcagaggctgggaccaccccgtgagagtgtgcttcaactgcaacaagaagcccgcctggaccagcctgagcgtgatgaccggcaagggccccctgtgctag

SEQ ID NO: 13604 - DNA, 2271 bp, Artificial Sequence
  Description of Artificial Sequence: Synthetic coding sequence
ctggccggcaacgagaccgagtgggtgaccatcgccaacaacctgctgttcaagtgccacatccacctgagaatccacgagctgcaggactgcgacgccaacgtgttcatcgccctgtaccagagcatcctgggcgagaaggtgcccgacctgatcgtgatccccagaagccaggaggacgacgcccacaacgtgcaggccgtgatcgacagcctggccctggactacctgcaggtgagcctgagccacatcaccgccctgtacagcgtgagcagaagaaagtacagcgagagaagaatgctgggccccagctgggacggcgacgaggccgagagcaccggcgagatcatcagactgggcgacaccgcccacaccttcagcctgagaagcaacggcgcccagtgccccaacgagatgctgagcaagaaggccctggccagccccagcagcaagagccacgaggacatgctgtacccccccagcgtgctgagcaagagcagaaccagcttcgtggaggacaccgagaccctgagcgtgagcggcatccccaacgccagaaagctgggcgagcccatcagagccgccatccccctgcaccccccctaccaccccagcgagcccagagccccctgccccatcggcaaggagtacctgcacagcagccactgcagccccgccgtgaacagcaccggcgagcacaccgagttcagcggcgacctggacgacggcctgttcctgatcagcaagctgcccaagggcagcaagtgggaggtgtaccccgcccaggtgcagggccccagaaccagaaagccccccaagggcaagagaaacgagaacagagccaccgccagcagctgcaacagccccttcccccagagacccagaaagagactgaccgagcaggagctgcacgacgtgagcgagaagctgagccagagactgagcgagctggactggatgctgaagagcgccctgggcgacagaatcaaggagaagaccgaccacaaggaggagaacaccggcaacgaggaggtggaggacggcaccgaggagaccctgagccagcacagcgacggcatcgtggagtacggccccaagaagagcagacccggcctgagcatgagaagaaagcccccctacagaagccacagcctgagccccagccccgtgaacaagcacaagcagttccacctggagagaaagagacagagaaagcccagagagaccgacgtgagacagttccaggcccaggccttcaccgaggccttcgagagagagctgagaagacacaaggtgcaggagaacatcggccccctgagaatccacgagaaggaggaggagaccgtgggcaagaacatccagagaagaagcttcgtgaaggagctgcagaacgtggtgagccccggcagattcaccctggagaagccccagagaagagtgagaggcggcctgcccaagcccaacaaggccgtgcccatgaaggtgagcgagcacagcctgctgcccctgatgctggagcagttccccttcctgtacgtgagcggccccaccctgagcaagatgtggaagcagcagatcgcccaggtggagcagctgaagaaggaggcctgcagagagaacagaagcaagaagaagctgcaggacgagatcgaggaggccctgagaagacacgacctgctgaccaccctggtgaagaaggagtacgagcacaacaagagactgcaggacttcaaggactgcatcagaagacagagactgacccagagcaagatcaaggagaacagacagcagatcgtgagagccagaaagtactacgacgactacagagtgcagctgtgcgccaagatgatgagaatgagaaccagagaggagatgatcttcaagaagctgttcgaggagggcctgaacatccagaagcagagactgagagacctgagaaactacgccaaggagaagagagacgagcagagaagaagacaccaggacgagctggacagcatggagaactactacaaggaccagttcagcctgctggccgaggccatcagccaggagcaccaggagctgaaggccagagagaagagccaggcccagaccctgcacaaggtgaagagagagctgagaagcaagatggagaaggagatccagcagctgcaggacatgatcacccagaacgacgacgacgtgttcttcagagagctggaggccgagagattcagaagcagactgcagctggccagcttccagtacagcaagagccccagcctgtag

SEQ ID NO: 13605 - DNA, 420 bp, Artificial Sequence; identical to SEQ ID NO: 12293
  Description of Artificial Sequence: Synthetic coding sequence

SEQ ID NO: 13606 - DNA, 300 bp, Artificial Sequence
  Description of Artificial Sequence: Synthetic coding sequence
atgaccgacaccagaagaagagtgaaggtgtacaccctgaacgaggacagacagtgggacgacagaggcaccggccacgtgagcagcggctacgtggagagactgaagggcatgagcctgctggtgagagccgagagcgacggcagcctgctgctggagagcaagatcaaccccaacaccgcctaccagaagcagcaggacaccctgatcgtgtggagcgaggccgagaactacgacctggccctgagcttccaggagaaggccggctgcgacgagatctgggagaagatctgccagtag

SEQ ID NO: 13607 - DNA, 2463 bp, Artificial Sequence; identical to SEQ ID NO: 10174
  Description of Artificial Sequence: Synthetic coding sequence

SEQ ID NO: 13608 - DNA, 396 bp, Artificial Sequence
  Description of Artificial Sequence: Synthetic coding sequence
atgaacgagagcaagcccggcgacagccagaacctggcctgcgtgttctgcagaaagcacgacgactgccccaacaagtacggcgagaagaagaccaaggagaagtggaacctgaccgtgcactactactgcctgctgatgagcagcggcatctggcagagaggcaaggaggaggagggcgtgtacggcttcctgatcgaggacatcagaaaggaggtgaacagagccagcaagctgaagtgctgcgtgtgcaagaagaacggcgccagcatcggctgcgtggcccccagatgcaagagaagctaccacttcccctgcggcctgcagagagagtgcatcttccagttcaccggcaacttcgccagcttctgctgggaccacagacccgtgcagtag

SEQ ID NO: 13609 - DNA, 5934 bp, Artificial Sequence
  Description of Artificial Sequence: Synthetic coding sequence
atggccgccagaagcgcccccagctgccacctgagactggagtgggtgtacggctacagaggccaccagtgcagaaacaacctgtactacaccgccgccaaggagatcgtgtacttcgtggccggcgtgggcgtggtgtacagccccagagagcacagacagaagttctacagaggccacagcgacgacatcatcagcctggccctgcaccccgagagagtgctggtggccaccggccaggtgggcaaggagccctacatctgcatctgggacagctacaccgtgcagaccatcagcgtgctgaaggacgtgcacacccacggcatcgcctgcctggccttcgacctggacggccagagactggtgagcgtgggcctggacagcaagaacgccgtgtgcgtgtgggactggaagagaggcaagatgctgagcatggcccccggccacaccgacagaatcttcgacatcagctgggacctgtaccagcccaacaagctggtgagctgcggcgtgaagcacatcaagttctggagcctgtgcggcaacgccctgacccccaagagaggcgtgttcggcaagaccggcgacctgcagaccatcctgtgcctggcctgcgccagagacgagctgacctacagcggcgccctgaacggcgacatctacgtgtggaagggcatcaacctgatcagaaccatccagggcgcccacgccgccggcatcttcagcatgaacgcctgcgaggagggcttcgccaccggcggcagagacggctgcatcagactgtgggacctgaccttcaagcccatcaccgtgatcgacctgagagagaccgaccagggctacaagggcctgagcgtgagaagcgtgtgctggagaggcgaccacatcctggtgggcacccaggacagcgagatcttcgagatcgtggtgcaggagagaaacaagcccttcctgatcatgcagggccactgcgagggcgagctgtgggccctggccgtgcaccccaccaagcccctggccgtgaccggcagcgacgacagaagcgtgagaatctggagcctggtggaccacgccctgatcgccagatgcaacatggaggagcccatcagatgcgccgccgtgaacgccgacggcatccacctggccctgggcatgaaggacggcagcttcaccgtgctgagagtgagagacatgaccgaggtggtgcacatcaaggacagaaaggaggccatccacgagctgaagtacagccccgacggcacctacctggccgtgggctgcaacgacagcagcgtggacatctacggcgtggcccagagatacaagaaggtgggcgagtgcctgggcagcctgagcttcatcacccacctggactggagcagcgacagcagatacctgcagaccaacgacggcaacggcaagagactgttctacagaatgcccggcggcaaggaggtgaccagcaccgaggagatcaagggcgtgcactgggccagctggacctgcgtgagcggcctggaggtgaacggcatctggcccaagtacagcgacatcaacgacatcaacagcgtggacggcaactacatcggccaggtgctggtgaccgccgacgactacggcatcatcaagctgttcagatacccctgcctgagaaagggcgccaagttcagaaagtacatcggccacagcgcccacgtgaccaacgtgagatggagccacgactaccagtgggtgatcagcatcggcggcgccgaccacagcgtgttccagtggaagttcatccccgagagaaagctgaaggacgccgtgcacatcgccccccaggagagcctggccgacagccacagcgacgagagcgacagcgacctgagcgacgtgcccgagctggacagcgagatcgagcaggagacccagctgacctacagaagacaggtgtacaaggaggacctgccccagctgaaggagcagtgcaaggagaagcagaagagcgccaccagcaagagaagagagagagcccccggcaacagcatcagactgcacttcgtgcacggctacagaggctacgactgcagaagcaacctgttctacacccagatcggcgagatcgtgtaccacgtggccgccgtgggcgtgatctacaacagacagcagaacacccagagattctacctgggccacgacgacgacatcctgtgcctgaccatccaccccctgaaggactacgtggccaccggccaggtgggcagagaccccagcatccacatctgggacaccgagaccatcaagcccctgagcatcctgaagggccaccaccagtacggcgtgagcgccgtggacttcagcgccgacggcaagagactggccagcgtgggcatcgacgacagccacaccgtggtgctgtgggactggaagaagggcgagaagctgagcatcgccagaggcagcaaggacaagatcttcgtggtgaagatgaacccctacgtgcccgacaagctgatcaccgccggcatcaagcacatgaagttctggagaaaggccggcggcggcctgatcggcagaaagggctacatcggcaccctgggcaagaacgacaccatgatgtgcgccgtgtacggctggaccgaggagatggccttcagcggcaccagcaccggcgacgtgtgcatctggagagacatcttcctggtgaagaccgtgaaggcccacgacggccccgtgttcagcatgcacgccctggagaagggcttcgtgaccggcggcaaggacggcatcgtggccctgtgggacgacagcttcgagagatgcctgaagacctacgccatcaagagagccgccctggcccccggcagcaagggcctgctgctggaggacaaccccagcatcagagccatcagcctgggccacggccacatcctggtgggcaccaagaacggcgagatcctggaggtggacaagagcggccccatcaccctgctggtgcagggccacatggagggcgaggtgtggggcctggccacccacccctacctgcccatctgcgccaccgtgagcgacgacaagaccctgagaatctgggacctgagccccagccactgcatgctggccgtgagaaagctgaagaagggcggcagatgctgctgcttcagccccgacggcaaggccctggccgtgggcctgaacgacggcagcttcctgatggccaacgccgacaccctggaggacctggtgagcttccaccacagaaaggacatgatcagcgacatcagattcagccccggcagcggcaagtacctggccgtggccagccacgacagcttcatcgacatctacaacgtgatgagcagcaagagagtgggcatctgcaagggcgccaccagctacatcacccacatcgactgggacatcagaggcaagctgctgcaggtgaacaccggcgccaaggagcagctgttcttcgaggcccccagaggcaagaagcagaccatccccagcgtggaggtggagaagatcgcctgggccagctggaccagcgtgctgggcctgtgctgcgagggcatctggcccgtgatcggcgaggtgaccgacgtgaccgccagctgcctgaccagcgacaagatggtgctggccaccggcgacgacctgggcttcgtgaagctgttcagataccccaccaagggcaagttcggcaagttcaagagatacgtggcccacagcacccacgtgaccaacgtgagatggacctacgacgacagcatgctggtgaccctgggcggcaccgacatgagcctgatggtgtggaccaacgagatggagggctacagagagaagagaccctgcgacagcgaggagagcgacatcgacagcgaggaggacggcggctacgacagcgacgtgaccagagagaacgagatcagctacaccatcagagccctgagcaccaacatcagacccatgctgggcatcaagccccacctgcagcagaaggagcccagcatcgacgagagacagggcgtggtgagaggcagcagaccccccgtgagcagagcccccccccagcccgagaagctgcagaccaacaacgtgggcaagaagaagagacccatcgaggacctggtgctggagctgatcttcggctacagaggcagagactgcagaaacaacgtgcactacctgaacgacggcgacgacatcatctaccacaccgccagcgtgggcatcctgcacaacgtggccaccggcagccagagcttctaccaggagcacaacgacgacatcctgtgcctgaccgtgaaccagcaccccaagttcatcaacatcgtggccaccggccaggtgggcgacagcgccgacatgagcgccaccgcccccagcatccacatctgggacgccatgaacaagcagaccctgagcatcctgagatgctaccacagcaagggcgtgtgcagcgtgagcttcagcgccaccggcaagctgctgctgagcgtgggcctggaccccgagcacaccatcaccatctggagatggcaggagggcgccaagatcgccagcagagccggccacaaccagagaatcttcgtggccgagttcagacccgacagcgacacccagttcgtgagcgtgggcgtgaagcacgtgaagttctggaccctggccggcagagccctgctgagcaagaagggcctgctgagcaccctggaggacgccagaatgcagaccatgctggccatcgccttcggcgccaacaacctgaccttcaccggcaccatcagcggcgacgtgtgcgtgtggaaggaccacatcctgtgcagaatcgtggccagagcccacaacggccccgtgttcgccatgtacaccaccctgagagacggcctgatcgtgaccggcggcaaggagagacccagcaaggagggcggcgccgtgaagctgtgggaccaggagctgagaagatgcagagccttcagactggagaccggccaggccaccgactgcgtgagaagcgtgtgcagaggcaagggcaagatcctggtgggcaccagaaacgccgagatcatcgaggtgggcgagaagaacgccgcctgcaacatcctggtgaacggccacgtggacggccccatctggggcctggccacccaccccagcagagacttcttcctgagcgccgccgaggacggcaccgtgagactgtgggacatcgccgacaagaagatgctgaacaaggtgaacctgggccacgccgccagaaccgtgtgctacagccccgagggcgacatggtggccatcggcatgaagaacggcgagttcatcatcctgctggtgagcagcctgaagatctggggcaagaagagagacagaagatgcgccatccacgacatcagattcagccccgacagcagatacctggccgtgggcagcagcgagaacagcgtggacttctacgacctgaccctgggccccaccctgaacagaatcagctactgcaaggacatccccagcttcgtgatccagatggacttcagcgccgacagcagctacctgcaggtgagcagcggctgctacaagagacacgtgtacgaggtgcccagcggcaagcacctgatggaccacgccgccatcgacagaatcacctgggccacctggaccagcatcctgggcgacgaggtgctgggcatctggagcagacacgccgagaaggccgacgtgaactgcgcctgcgtgagccacagcggcatcagcctggtgaccggcgacgacttcggcatggtgaagctgttcgacttcccctgccccgagaagttcgccaagcacaagagattcctgggccacagcccccacgtgaccaacatcagattcaccagcggcgacagacacgtggtgagcgccggcggcgacgactgcagcctgttcgtgtggaagtgcgtgcacaccccccactag

SEQ ID NO: 13610 - DNA, 2502 bp, Artificial Sequence
  Description of Artificial Sequence: Synthetic coding sequence
atgaccgacaccagaagaagagtgaaggtgtacaccctgaacgaggacagacagtgggacgacagaggcaccggccacgtgagcagcggctacgtggagagactgaagggcatgagcctgctggtgagagccgagagcgacggcagcctgctgctggagagcaagatcaaccccaacaccgcctaccagaagcagcaggacaccctgatcgtgtggagcgaggccgagaactacgacctggccctgagcttccaggagaaggccggctgcgacgagatctgggagaagatctgccaggtgcagggcaaggaccccagcgtggacatcacccaggacctggtggacgagagcgaggaggagagattcgacgacatgagcagccccggcctggagctgcccagctgcgagctgagcagactggaggagatcgccgagctggtggccagcagcctgcccagccccctgagaagagagaagctggccctggccctggagaacgagggctacatcaagaagctgctggagctgttccacgtgtgcgaggacctggagaacatcgagggcctgcaccacctgtacgagatcatcaagggcatcttcctgctgaacagaaccgccctgttcgaggtgatgttcagcgaggagtgcatcatggacgtgatcggctgcctggagtacgaccccgccctgagccagcccagaaagcacagagagttcctgaccaagaccgccaagttcaaggaggtgatccccatcagcgaccccgagctgaagcagaagatccaccagacctacagagtgcagtacatccaggacatggtgctgcccacccccagcgtgttcgaggagaacatgctgagcaccctgcacagcttcatcttcttcaacaaggtggagatcgtgggcatgctgcaggaggacgagaagttcctgaccgacctgttcgcccagctgaccgacgaggccaccgacgaggagaagagacaggagctggtgaacttcctgaaggagttctgcgccttcagccagaccctgcagccccagaacagagacgccttcttcaagaccctgagcaacatgggcatcctgcccgccctggaggtgatcctgggcatggacgacacccaggtgagaagcgccgccaccgacatcttcagctacctggtggagtacaaccccagcatggtgagagagttcgtgatgcaggaggcccagcagaacgacgacgtgagcaagaagctgaccgagcagaagatcaccagcaaggacatcctgctgatcaacctgatcatcgagcacatgatctgcgacaccgaccccgagctgggcggcgccgtgcagctgatgggcctgctgagaaccctggtggaccccgagaacatgctggccaccgccaacaagaccgagaagaccgagttcctgggcttcttctacaagcactgcatgcacgtgctgaccgcccccctgctggccaacaccaccgaggacaagcccagcaaggacgacttccagaccgcccagctgctggccctggtgctggagctgctgaccttctgcgtggagcaccacacctaccacatcaagaactacatcatcaacaaggacatcctgagaagagtgctggtgctgatggccagcaagcacgccttcctggccctgtgcgccctgagattcaagagaaagatcatcggcctgaaggacgagttctacaacagatacatcatgaagagcttcctgttcgagcccgtggtgaaggccttcctgaacaacggcagcagatacaacctgatgaacagcgccatcatcgagatgttcgagttcatcagagtggaggacatcaagagcctgaccgcccacgtgatcgagaactactggaaggccctggaggacgtggactacgtgcagaccttcaagggcctgaagctgagattcgagcagcagagagagagacaggacaaccccaagctggacagcatgagaagcatcctgagaaaccacagatacagaagagacgccagaaccctggaggacgaggaggagatgtggttcaacaccgacgaggacgacatggaggacggcgaggccgtggtgagccccagcgacaagaccaagaacgacgacgacatcatggaccccatcagcaagttcatggagagaaagaagctgaaggagagcgaggagaaggaggtgctgctgaagaccaacctgagcggcagacagagccccagcttcaagctgagcctgagcagcggcaccaagaccaacctgaccagccagagcagcaccaccaacctgcccggcagccccggcagccccggcagccccggcagccccggcagccccggcagcgtgcccaagaacaccagccagaccgccgccatcaccaccaagggcggcctggtgggcctggtggactaccccgacgacgacgaggacgacgacgaggacgaggacaaggaggacaccctgcccctgagcaagaaggccaagttcgacagctag

SEQ ID NO: 13611 - DNA, 3987 bp, Artificial Sequence
  Description of Artificial Sequence: Synthetic coding sequence
atgtggagaagaaagcaccccagaaccagcggcggcaccagaggcgtgctgagcggcaacagaggcgtggagtacggcagcggcagaggccacctgggcaccttcgagggcagatggagaaagctgcccaagatgcccgaggccgtgggcaccgaccccagcaccagcagaaagatggccgagctggaggaggtgaccctggacggcaagcccctgcaggccctgagagtgaccgacctgaaggccgccctggagcagagaggcctggccaagagcggccagaagagcgccctggtgaagagactgaagggcgccctgatgctggagaacctgcagaagcacagcaccccccacgccgccttccagcccaacagccagatcggcgaggagatgagccagaacagcttcatcaagcagtacctggagaagcagcaggagctgctgagacagagactggagagagaggccagagaggccgccgagctggaggaggccagcgccgagagcgaggacgagatgatccaccccgagggcgtggccagcctgctgccccccgacttccagagcagcctggagagacccgagctggagctgagcagacacagccccagaaagagcagcagcatcagcgaggagaagggcgacagcgacgacgagaagcccagaaagggcgagagaagaagcagcagagtgagacaggccagagccgccaagctgagcgagggcagccagcccgccgaggaggaggaggaccaggagacccccagcagaaacctgagagtgagagccgacagaaacctgaagaccgaggaggaggaggaggaggaggaggaggaggaggaggacgacgaggaggaggagggcgacgacgagggccagaagagcagagaggcccccatcctgaaggagttcaaggaggagggcgaggagatccccagagtgaagcccgaggagatgatggacgagagacccaagaccagaagccaggagcaggaggtgctggagagaggcggcagattcaccagaagccaggaggaggccagaaagagccacctggccagacagcagcaggagaaggagatgaagaccaccagccccctggaggaggaggagagagagatcaagagcagccagggcctgaaggagaagagcaagagccccagcccccccagactgaccgaggacagaaagaaggccagcctggtggccctgcccgagcagaccgccagcgaggaggagacccccccccccctgctgaccaaggaggccagcagcccccccccccacccccagctgcacagcgaggaggagatcgagcccatggagggccccgcccccgccgtgctgatccagctgagcccccccaacaccgacgccgacaccagagagctgctggtgagccagcacaccgtgcagctggtgggcggcctgagccccctgagcagccccagcgacaccaaggccgagagccccgccgagaaggtgcccgaggagagcgtgctgcccctggtgcagaagagcaccctggccgactacagcgcccagaaggacctggagcccgagagcgacagaagcgcccagcccctgcccctgaagatcgaggagctggccctggccaagggcatcaccgaggagtgcctgaagcagcccagcctggagcagaaggagggcagaagagccagccacaccctgctgcccagccacagactgaagcagagcgccgacagcagcagcagcagaagcagcagcagcagcagcagcagcagcagaagcagaagcagaagccccgacagcagcggcagcagaagccacagccccctgagaagcaagcagagagacgtggcccaggccagaacccacgccaaccccagaggcagacccaagatgggcagcagaagcaccagcgagagcagaagcagaagcagaagcagaagcagaagcgccagcagcaacagcagaaagagcctgagccccggcgtgagcagagacagcagcaccagctacaccgagaccaaggaccccagcagcggccaggaggtggccaccccccccgtgccccagctgcaggtgtgcgagcccaaggagagaaccagcaccagcagcagcagcgtgcaggccagaagactgagccagcccgagagcgccgagaagcacgtgacccagagactgcagcccgagagaggcagccccaagaagtgcgaggccgaggaggccgagccccccgccgccacccagccccagaccagcgagacccagaccagccacctgcccgagagcgagagaatccaccacaccgtggaggagaaggaggaggtgaccatggacaccagcgagaacagacccgagaacgacgtgcccgagccccccatgcccatcgccgaccaggtgagcaacgacgacagacccgagggcagcgtggaggacgaggagaagaaggagagcagcctgcccaagagcttcaagagaaagatcagcgtggtgagcaccaagggcgtgcccgccggcaacagcgacaccgagggcggccagcccggcagaaagagaagatggggcgccagcaccgccaccacccagaagaagcccagcatcagcatcaccaccgagagcctgaaggaggccgtggtggacctgcacgccgacgacagcagaatcagcgaggacgagaccgagagaaacggcgacgacggcacccacgacaagggcctgaagatctgcagaaccgtgacccaggtggtgcccgccgagggccaggagaacggccagagagaggaggaggaggaggagaaggagcccgaggccgagccccccgtgcccccccaggtgagcgtggaggtggccctgcccccccccgccgagcacgaggtgaagaaggtgaccctgggcgacaccctgaccagaagaagcatcagccagcagaagagcggcgtgagcatcaccatcgacgaccccgtgagaaccgcccaggtgcccagcccccccagaggcaagatcagcaacatcgtgcacatcagcaacctggtgagacccttcaccctgggccagctgaaggagctgctgggcagaaccggcaccctggtggaggaggccttctggatcgacaagatcaagagccactgcttcgtgacctacagcaccgtggaggaggccgtggccaccagaaccgccctgcacggcgtgaagtggccccagagcaaccccaagttcctgtgcgccgactacgccgagcaggacgagctggactaccacagaggcctgctggtggacagacccagcgagaccaagaccgaggagcagggcatccccagacccctgcacccccccccccccccccccgtgcagcccccccagcaccccagagccgagcagagagagcaggagagagccgtgagagagcagtgggccgagagagagagagagatggagagaagagagagaaccagaagcgagagagagtgggacagagacaaggtgagagagggccccagaagcagaagcagaagcagagacagaagaagaaaggagagagccaagagcaaggagaagaagagcgagaagaaggagaaggcccaggaggagccccccgccaagctgctggacgacctgttcagaaagaccaaggccgccccctgcatctactggctgcccctgaccgacagccagatcgtgcagaaggaggccgagagagccgagagagccaaggagagagagaagagaagaaaggagcaggaggaggaggagcagaaggagagagagaaggaggccgagagagagagaaacagacagctggagagagagaagagaagagagcacagcagagagagagacagagagagagagagagagagagagagagacagaggcgacagagacagagacagagagagagacagagagagaggcagagagagagacagaagagacaccaagagacacagcagaagcagaagcagaagcacccccgtgagagacagaggcggcagaagatag

SEQ ID NO: 13612 - DNA, 1089 bp, Artificial Sequence; identical to SEQ ID NO: 11369
  Description of Artificial Sequence: Synthetic coding sequence

SEQ ID NO: 13613 - DNA, 420 bp, Artificial Sequence; identical to SEQ ID NO: 12293
  Description of Artificial Sequence: Synthetic coding sequence

SEQ ID NO: 13614 - DNA, 2256 bp, Artificial Sequence
  Description of Artificial Sequence: Synthetic coding sequence
atgagcgaggaggagctgaccaaggccatggagggcctgggcatggacgagggcgacggcgagggcaacatcctgcccatcatgcagagcatcatgcagaacctgctgagcaaggacgtgctgtaccccagcctgaaggagatcaccgagaagtaccccgagtggctgcagagccacagagagagcctgccccccgagcagttcgagaagtaccaggagcagcacagcgtgatgtgcaagatctgcgagcagttcgaggccgagacccccaccgacagcgagaccacccagaaggccagattcgagatggtgctggacctgatgcagcagctgcaggacctgggccacccccccaaggagctggccggcgagatgctgacctggctgttcttctgcggcagccagtgggtgtacggcccctggctgacctacgtgggctggctgcagcagaccagcttcaagatgagcagcaagggcagcagcaccgacggcagaaccgacctggccaacggcagcctgagcagcagccccgaggagatgagcggcgccgaggagggcagagagaccagcagcggcatcgaggtggaggccagcgacctgagcctgagcctgaccggcgacgacggcggccccaacagaaccagcaccgagagcagaggcaccgacaccgagagcagcggcgaggacaaggacagcgacagcatggaggacaccggccactacagcatcaacgacgagaacagagtgcacgacagaagcgaggaggaggaggaggaggaggaggaggaggaggaggagcagcccagaagaagagtgcagagaaagagagccaacagagaccaggacagcagcgacgacgagagagccctggaggactgggtgagcagcgagaccagcgccctgcccagacccagatggcaggccctgcccgccctgagagagagagagctgggcagcagcgccagattcgtgtacgaggcctgcggcgccagagtgttcgtgcagagattcagactgcagcacggcctggagggccacaccggctgcgtgaacaccctgcacttcaaccagagaggcacctggctggccagcggcagcgacgacctgaaggtggtggtgtgggactgggtgagaagacagcccgtgctggacttcgagagcggccacaagagcaacgtgttccaggccaagttcctgcccaacagcggcgacagcaccctggccatgtgcgccagagacggccaggtgagagtggccgagctgagcgccacccagtgctgcaagaacaccaagagagtggcccagcacaagggcgccagccacaagctggccctggagcccgacagcccctgcaccttcctgagcgccggcgaggacgccgtggtgttcaccatcgacctgagacaggacagacccgccagcaagctggtggtgaccaaggagaaggagaagaaggtgggcctgtacaccatctacgtgaaccccgccaacacccaccagttcgccgtgggcggcagagaccagttcgtgagaatctacgaccagagaaagatcgacgagaacgagaacaacggcgtgctgaagaagttctgcccccaccacctggtgaacagcgagagcaaggccaacatcacctgcctggtgtacagccacgacggcaccgagctgctggccagctacaacgacgaggacatctacctgttcaacagcagccacagcgacggcgcccagtacgtgaagagatacaagggccacagaaacaacgccaccgtgaagggcgtgaacttctacggccccaagagcgagttcgtggtgagcggcagcgactgcggccacatcttcctgtgggagaagagcagctgccagatcatccagttcatggagggcgacaagggcggcgtggtgaactgcctggagccccacccccacctgcccgtgctggccaccagcggcctggaccacgacgtgaagatctgggcccccaccgccgaggccagcaccgagctgaccggcctgaaggacgtgatcaagaagaacaagagagagagagacgaggacagcctgcaccagaccgacctgttcgacagccacatgctgtggttcctgatgcaccacctgagacagagaagacaccacagaagatggagagagcccggcgtgggcgccaccgacgccgacagcgacgagagccccagcagcagcgacaccagcgacgaggaggagggccccgacagagtgcagtgcatgcccagctag

SEQ ID NO: 13615 - DNA, 1056 bp, Artificial Sequence; identical to SEQ ID NO: 9507
  Description of Artificial Sequence: Synthetic coding sequence

SEQ ID NO: 13616 - DNA, 588 bp, Artificial Sequence
  Description of Artificial Sequence: Synthetic coding sequence
atgcccctgcccttcggcctgaagctgaagagaaccagaagatacaccgtgagcagcaagagctgcctggtggccagaatccagctgctgaacaacgagttcgtggagttcaccctgagcgtggagagcaccggccaggagagcctggaggccgtggcccagagactggagctgagagaggtgacctacttcagcctgtggtactacaacaagcagaaccagagaagatgggtggacctggagaagcccctgaagaagcagctggacaagtacgccctggagcccaccgtgtacttcggcgtggtgttctacgtgcccagcgtgagccagctgcagcaggagatcaccagataccagtactacctgcagctgaagaaggacatcctggagggcagcatcccctgcaccctggagcaggccatccagctggccggcctggccgtgcaggccgacttcggcgacttcgaccagtacgagagccaggacttcctgcagaagttcgccctgttccccgtgggctggctgcaggacgagaaggtgctggaggaggccacccagaaggtggccctgctgcaccagaagtactag

SEQ ID NO: 13617 - DNA, 354 bp, Artificial Sequence
  Description of Artificial Sequence: Synthetic coding sequence
atgggcgacaagaagagccccaccagacccaagagacagcccaagcccagcagcgacgagggctactgggactgcagcgtgtgcaccttcagaaacagcgccgaggccttcaagtgcatgatgtgcgacgtgagaaagggcaccagcaccagagacagcaaggagggcggcaagctggtgagctacagcaccgccagcctgggcgtgagaggcaccctgagaaacagagtgggcggcggcagcagcgaggagaagaagcaggccgagtacctggcccccggcagaagaagaaacatcgtgcacagaggcgtgggccccggccagagaagcggccccagcctgaaggaggcctag

SEQ ID NO: 13618 - DNA, 3285 bp, Artificial Sequence; identical to SEQ ID NO: 9577
  Description of Artificial Sequence: Synthetic coding sequence

SEQ ID NO: 13619 - DNA, 1353 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccagcggcaactacgtgggcgacagcgacctgcagctggagagaatcagcgtgtactacaacgaggccagcagccacaagtacgtgcccagagccatcctggtggacctggagcccggcaccatggacagcgtgagaagcggcgccttcggccacctgttcagacccgacaacttcatcttcggccagagcggcgccggcaacaactgggccaagggccactacaccgagggcgccgagctggtggacagcgtgctggacgtggtgagaaaggagtgcgagaactgcgactgcctgcagggcttccagctgacccacagcctgggcggcggcaccggcagcggcatgggcaccctgctgatcagcaaggtgagagaggagtaccccgacagaatcatgaacaccttcagcgtggtgcccagccccaaggtgagcgacaccgtggtggagccctacaacgccaccctgagcatccaccagctggtggagaacaccgacgagacctactgcatcgacaacgaggccctgtacgacatctgcttcagaaccctgaagctggccacccccacctacggcgacctgaaccacctggtgagcgccaccatgagcggcgtgaccaccagcctgagattccccggccagctgaacgccgacctgagaaagctggccgtgaacatggtgcccttccccagactgcacttcttcatgcccggcttcgcccccctgaccgccagaggcagccagcagtacagagccctgaccgtgcccgagctgacccagcagatgttcgacgccaagaacatgatggccgcctgcgaccccagacacggcagatacctgaccgtggccaccgtgttcagaggcagaatgagcatgaaggaggtggacgagcagatgctggccatccagagcaagaacagcagctacttcgtggagtggatccccaacaacgtgaaggtggccgtgtgcgacatcccccccagaggcctgaagatgagcagcaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggagggcgagatgtacgaggacgacgaggaggagagcgaggcccagggccccaagtag

SEQ ID NO: 13620 - DNA, 240 bp, Artificial Sequence
  Description of Artificial Sequence: Synthetic coding sequence
atgaacgagagcaagcccggcgacagccagaacctggcctgcgtgttctgcagaaagcacgacgactgccccaacaagtacggcgagaagaagaccaaggagaagtggaacctgaccgtgcactactactgcctgctgatgagcagcggcatctggcagagaggcaaggaggaggagggcgtgtacggcttcctgatcgaggacatcagaaaggaggtgaacagagccagcaagctgtag

SEQ ID NO: 13621 - DNA, 1785 bp, Artificial Sequence; identical to SEQ ID NO: 12095
  Description of Artificial Sequence: Synthetic coding sequence

SEQ ID NO: 13622 - DNA, 540 bp, Artificial Sequence
  Description of Artificial Sequence: Synthetic coding sequence
atggccgagagcagcagcgagagcgaccacttcagatgcagagacagactgagcccctgggccgccagaagcacccacagaggcaccagaagcctgcccaccgtggaggtgaccgagaaggtgaacaccatcaccagcaccctgcaggacaccagcagaaacctgagacaggtggaccagatgctgggcagatacagagagtacagcaacggccaggccggcgccatcgagcacctgaaggagagcctggagcagagcatcgaccagctgagaagccagagactgctgagaaacagcggcggcagaagcatcagcgtgaccagcctgagcgccagcgacctggacggcggcaccggcagcgagctgcaccacttcccccccaccagccccctgaaggactacggcgacccccagggcatcaagagaatgagaagcagaaccggcgtgagattcgtgcaggagaccgacgacatgacccagctgcacggcttccaccagagcctgagagacctgagcagcgagcagatcagactgggctag

SEQ ID NO: 13623 - DNA, 1056 bp, Artificial Sequence; identical to SEQ ID NO: 9507
  Description of Artificial Sequence: Synthetic coding sequence

SEQ ID NO: 13624 - DNA, 330 bp, Artificial Sequence
  Description of Artificial Sequence: Synthetic coding sequence
atggagaccgactgcaaccccatggagctgagcagcatgagcggcttcgaggagggcagcgagctgaacggcttcgagggcaccgacatgaaggacatgagactggaggccgaggccgtggtgaacgacgtgctgttcgccgtgaacaacatgttcgtgagcaagagcctgagatgcgccgacgacgtggcctacatcaacgtggagaccaaggagagaaacagatactgcctggagctgaccgaggccggcctgaaggtggtgggctacgccttcgaccaggtggacgaccacctgcagaccccctaccacgagaccgtgtacagctag

SEQ ID NO: 13625 - DNA, 387 bp, Artificial Sequence
  Description of Artificial Sequence: Synthetic coding sequence
atggccgagagcagcagcgagagcgaccacttcagatgcagagacagactgagcccctgggccgccagaagcacccacagaggcaccagaagcctgcccaccgtggaggtgaccgagaaggtgaacaccatcaccagcaccctgcaggacaccagcagaaacctgagacaggtggaccagatgctgggcagatacagagagtacagcaacggccaggccggcgccatcgagcacctgaaggagagcctggagcagagcatcgaccagctgagaagccagagactgctgagaaacagcggcggcagaagcatcagcgtgaccagcctgagcgccagcgacctggacggcggcaccggcagcgagctgcaccacttcccccccacctag

SEQ ID NO: 13626 - DNA, 369 bp, Artificial Sequence; identical to SEQ ID NO: 10169
  Description of Artificial Sequence: Synthetic coding sequence

SEQ ID NO: 13627 - DNA, 420 bp, Artificial Sequence; identical to SEQ ID NO: 12293
  Description of Artificial Sequence: Synthetic coding sequence

SEQ ID NO: 13628 - DNA, 4602 bp, Artificial Sequence
  Description of Artificial Sequence: Synthetic coding sequence
atgcccgtgaagagactgagagaggtggtgagccagaaccacggcgaccacctggtgctgctgaaggacgagctgccctgcgtgccccccgccctgagcgccaacaagagactgcccgtgggcaccggcaccagcctgaacggcaccagcagaggcagcagcgacctgaccagcgccagaaactgctaccagcccctgctggagaaccccatggtgagcgagagcgacttcagcaaggacgtggccgtgcaggtgctgcccctggacaagatcgaggagaacaacaagcagaaggccaacgacatcttcatcagccagtacaccatgggccagaaggacgccctgagaaccgtgctgaagcagaaggcccagagcatgcccgtgttcaaggaggtgaaggtgcacctgctggaggacgccggcatcgagaaggacgccgtgacccaggagaccagaatcagccccagcggcatcgacagcgccaccaccgtggccgccgccaccgccgccgccatcgccaccgccgcccccctgatcaaggtgcagagcgacctggaggccaaggtgaacagcgtgaccgagctgctgagcaagctgcaggagaccgacaagcacctgcagagagtgaccgagcagcagaccagcatccagagaaagcaggagaagctgcactgccacgaccacgagaagcagatgaacgtgttcatggagcagcacatcagacacctggagaagctgcagcagcagcagatcgacatccagacccacttcatcagcgccgccctgaagaccagcagcttccagcccgtgagcatgcccagcagcagagccgtggagaagtacagcgtgaagcccgagcaccccaacctgggcagctgcaaccccagcctgtacaacaccttcgccagcaagcaggcccccctgaaggaggtggaggacaccagcttcgacaagcagaagagccccctggagacccccgcccccagaagattcgcccccgtgcccgtgagcagagacgacgagctgagcaagagagagaacctgctggaggagaaggagaacatggaggtgagctgccacagaggcaacgtgagactgctggagcagatcctgaacaacaacgacagcctgaccagaaagagcgagagcagcaacaccaccagcctgaccagaagcaagatcggctggacccccgagaagaccaacagattccccagctgcgaggagctggagaccaccaaggtgaccatgcagaagagcgacgacgtgctgcacgacctgggccagaaggagaaggagaccaacagcatggtgcagcccaaggagagcctgagcatgctgaagctgcccgacctgccccagaacagcgtgaagctgcagaccaccaacaccaccagaagcgtgctgaaggacgccgagaagatcctgagaggcgtgcagaacaacaagaaggtgctggaggagaacctggaggccatcatcagagccaaggacggcgccgccatgtacagcctgatcaacgccctgagcaccaacagagagatgagcgagaagatcagaatcagaaagaccgtggacgagtggatcaagaccatcagcgccgagatccaggacgagctgagcagaaccgactacgagcagaagagattcgaccagaagaaccagagaaccaagaagggccagaacatgaccaaggacatcagaaccaacacccaggacaagaccgtgaacaagagcgtgatccccagaaagcacagccagaagcagatcgaggagcacttcagaaacctgcccatgagaggcatgcccgccagcagcctgcagaaggagagaaaggagggcctgctgaaggccaccaccgtgatccaggacgaggactacatgctgcaggtgtacggcaagcccgtgtaccagggccacagaagcaccctgaagaagggcccctacctgagattcaacagccccagccccaagagcagaccccagagacccaaggtgatcgagagagtgaagggcaccaaggtgaagagcatcagaacccagaccgacttctacgccaccaagcccaagaagatggacagcaagatgaagcacagcgtgcccgtgctgccccacggcgaccagcagtacctgttcagccccagcagagagatgcccaccttcagcggcaccctggagggccacctgatccccatggccatcctgctgggccagacccagagcaacagcgacaccatgccccccgccggcgtgatcgtgagcaagccccaccccgtgaccgtgaccaccagcatcccccccagcagcagaaaggtggagaccggcgtgaagaagcccaacatcgccatcgtggagatgaagagcgagaagaaggaccccccccagctgaccgtgcaggtgctgcccagcgtggacatcgacagcatcagcaacagcagcgccgacgtgctgagccccctgagcagccccaaggaggccagcctgccccccgtgcagacctggatcaagacccccgagatcatgaaggtggacgaggaggaggtgaagttccccggcaccaacttcgacgagatcatcgacgtgatccaggaggaggagaagtgcgacgagatccccgacagcgagcccatcctggagttcaacagaagcgtgaaggccgacagcaccaagtacaacggcccccccttcccccccgtggccagcaccttccagcccaccgccgacatcctggacaaggtgatcgagagaaaggagaccctggagaacagcctgatccagtgggtggagcaggagatcatgagcagaatcatcagcggcctgttccccgtgcagcagcagatcgcccccagcatcagcgtgagcgtgagcgagaccagcgagcccctgaccagcgacatcgtggagggcaccagcagcggcgccctgcagctgttcgtggacgccggcgtgcccgtgaacagcaacgtgatcaagcacttcgtgaacgaggccctggccgagaccatcgccgtgatgctgggcgacagagaggccaagaagcagggccccgtggccaccggcgtgagcggcgacgccagcaccaacgagacctacctgcccgccagagtgtgcacccccctgcccaccccccagcccacccccccctgcagccccagcagccccgccaaggagtgcgtgctggtgaagacccccgacagcagcccctgcgacagcgaccacgacatggccttccccgtgaaggagatctgcgccgagaagggcgacgacatgcccgccatcatgctggtgaacacccccaccgtgacccccaccaccacccccccccccgccgccgccgtgttcacccccaccctgagcgacatcagcatcgacaagctgaaggtgagcagccccgagctgcccaagccctggggcgacggcgacctgcccctggaggaggagaaccccaacagcccccaggaggagctgcaccccagagccatcgtgatgagcgtggccaaggacgaggagcccgagagcatggacttccccgcccagccccccccccccgagcccgtgcccttcatgcccttccccgccggcaccaaggcccccagccccagccagatgcccggcagcgacagcagcaccctggagagcaccctgagcgtgaccgtgaccgagaccgagaccctggacaagcccatcagcgagggcgagatcctgttcagctgcggccagaagctggcccccaagatcctggaggacatcggcctgtacctgaccaacctgaacgacagcctgagcagcaccctgcacgacgccgtggagatggaggacgacccccccagcgagggccaggtgatcagaatgagccacaagaagttccacgccgacgccatcctgagcttcgccaagcagaaccaggagagcgccgtgagccagcaggccgtgtaccacagcgaggacctggagaacagcgtgggcgagctgagcgagggccagagaccccagctgaccgccgccgccgagaacatcctgatgggccacagcctgtacatgcagccccccgtgaccaacacccagagcctggaccagcagtgcgaccccaagcccctgagcagacagttcgacaccgtgagcggcagcatctacgaggacagctgcgccagccacggccccatgagcctgggcgagctggagctggagcccaacagcaagctggtgctgcccaccaccctgctgaccgcccaggagaacgacgtgaacctgcccgtggccgccgaggacttcagccagtaccagctgaagcagaaccaggacgtgaagcaggtggagcacaagcccagccagagctacctgagagtgagaaacaagagcgacatcgcccccagccagcagcaggtgagccccggcgacatggacagaacccagatcgagctgaacccctacctgacctgcgtgttcagcggcggcaaggccgtgcccctgagcgccagccagatgccccccgccaagatgagcgtgatgctgcccagcgtgaacctggaggactgcagccagagcctgagcctgagcaccatgcaggaggacatggagagcagcggcgccgacaccttctag

SEQ ID NO: 13629 - DNA, 2334 bp, Artificial Sequence
  Description of Artificial Sequence: Synthetic coding sequence
atgagcgcccagaccagccccgccgagaagggcctgaaccccggcctgatgtgccaggagagctacgcctgcagcggcaccgacgaggccatcttcgagtgcgacgagtgctgcagcctgcagtgcctgagatgcgaggaggagctgcacagacaggagagactgagaaaccacgagagaatcagactgaagcccggccacgtgccctactgcgacctgtgcaagggcctgagcggccacctgcccggcgtgagacagagagccatcgtgagatgccagacctgcaagatcaacctgtgcctggagtgccagaagagaacccacagcggcggcaacaagagaagacaccccgtgaccgtgtacaacgtgagcaacctgcaggagagcctggaggccgaggagatggacgaggagaccaagagaaagaagatgaccgagaaggtggtgagcttcctgctggtggacgagaacgaggagatccaggtgaccaacgaggaggacttcatcagaaagctggactgcaagcccgaccagcacctgaaggtggtgagcatcttcggcaacaccggcgacggcaagagccacaccctgaaccacaccttcttctacggcagagaggtgttcaagaccagccccacccaggagagctgcaccgtgggcgtgtgggccgcctacgaccccgtgcacaaggtggccgtgatcgacaccgagggcctgctgggcgccaccgtgaacctgagccagagaaccagactgctgctgaaggtgctggccatcagcgacctggtgatctacagaacccacgccgacagactgcacaacgacctgttcaagttcctgggcgacgccagcgaggcctacctgaagcacttcaccaaggagctgaaggccaccaccgccagatgcggcctggacgtgcccctgagcaccctgggccccgccgtgatcatcttccacgagaccgtgcacacccagctgctgggcagcgaccaccccagcgaggtgcccgagaagctgatccaggacagattcagaaagctgggcagattccccgaggccttcagcagcatccactacaagggcaccagaacctacaacccccccaccgacttcagcggcctgagaagagccctggagcagctgctggagaacaacaccaccagaagccccagacaccccggcgtgatcttcaaggccctgaaggccctgagcgacagattcagcggcgagatccccgacgaccagatggcccacagcagcttcttccccgacgagtacttcacctgcagcagcctgtgcctgagctgcggcgtgggctgcaagaagagcatgaaccacggcaaggagggcgtgccccacgaggccaagagcagatgcagatacagccaccagtacgacaacagagtgtacacctgcaaggcctgctacgagagaggcgaggaggtgagcgtggtgcccaagaccagcgccagcaccgacagcccctggatgggcctggccaagtacgcctggagcggctacgtgatcgagtgccccaactgcggcgtggtgtacagaagcagacagtactggttcggcaaccaggaccccgtggacaccgtggtgagaaccgagatcgtgcacgtgtggcccggcaccgacggcttcctgaaggacaacaacaacgccgcccagagactgctggacggcatgaacttcatggcccagagcgtgagcgagctgagcctgggccccaccaaggccgtgaccagctggctgaccgaccagatcgcccccgcctactggagacccaacagccagatcctgagctgcaacaagtgcgccaccagcttcaaggacaacgacaccaagcaccactgcagagcctgcggcgagggcttctgcgacagctgcagcagcaagaccagacccgtgcccgagagaggctggggccccgcccccgtgagagtgtgcgacaactgctacgaggccagaaacgtgcagctggccgtgaccgaggcccaggtggacgacgagggcggcaccctgatcgccagaaaggtgggcgaggccgtgcagaacaccctgggcgccgtggtgaccgccatcgacatccccctgggcctggtgaaggacgccgccagacccgcctactgggtgcccgaccacgagatcctgcactgccacaactgcagaaaggagttcagcatcaagctgagcaagcaccactgcagagcctgcggccagggcttctgcgacgagtgcagccacgacagaagagccgtgcccagcagaggctgggaccaccccgtgagagtgtgcttcaactgcaacaagaagcccggcgacctgtag

SEQ ID NO: 13630 - DNA, 867 bp, Artificial Sequence
  Description of Artificial Sequence: Synthetic coding sequence
atggagaagctgagcgccctgcaggagcagaagggcgagctgagaaagagactgagctacaccacccacaagctggagaagctggagaccgagttcgacagcaccagacactacctggagatcgagctgagaagagcccaggaggagctggagaaggtgaccgagaagctgagaagaatccagagcaactacatggccctgcagagaatcaaccaggagctggaggacaagctgtacagaatgggccagcactacgaggaggagaagagagccctgagccacgagatcgtggccctgaacagccacctgctggaggccaaggtgaccatcgacaagctgagcgaggacaacgagctgtacagaaaggactgcaacctggccgcccagctgctgcagtgcagccagacctacggcagagtgcacaaggtgagcgagctgcccagcgacttccaggagagagtgagcctgcacatggagaagcacggctgcagcctgcccagccccctgtgccaccccgcctacgccgacagcgtgcccacctgcgtgatcgccaaggtgctggagaagcccgaccccgccagcctgagcagcagactgagcgacgccagcgccagagacctggccttctgcgacggcgtggagaagcccggccccagacccccctacaagggcgacatctactgcagcgacaccgccctgtactgccccgaggagagaagaagagacagaagacccagcgtggacgcccccgtgaccgacgtgggcttcctgagagcccagaacagcaccgacagcgccgccgaggaggaggaggaggccgaggccgccgccttccccgccggcttccagcacgaggccttcccctag

SEQ ID NO: 13631 - DNA, 1263 bp, Artificial Sequence
  Description of Artificial Sequence: Synthetic coding sequence
tgaacccaggccatggccctggagacccccacccccggcccccccagagagggccagagccccgccagccaggccggcacccagcacccccccgcccaggccaccgcccacagccagagcagccccgagttcaagggcagcctggccagcctgagcgacagcctgggcgtgagcgtgatggccaccgaccaggacagctacagcaccagcagcaccgaggaggagctggagcagttcagcagccccagcgtgaagaagaagcccagcatgatcctgggcaaggccagacacagactgagcttcgccagcttcagcagcatgttccacgccttcctgagcaacaacagaaagctgtacaagaaggtggtggagctggcccaggacaagggcagctacttcggcagcctggtgcaggactacaaggtgtacagcctggagatgatggccagacagaccagcagcaccgagatgctgcaggagatcagaaccatgatgacccagctgaagagctacctgctgcagagcaccgagctgaaggccctggtggaccccgccctgcacagcgaggaggagctggaggccatcgtggagagcgccctgtacaagtgcgtgctgaagcccctgaaggaggccatcaacagctgcctgcaccagatccacagcaaggacggcagcctgcagcagctgaaggagaaccagctggtgatcctggccaccaccaccaccgacctgggcgtgaccaccagcgtgcccgaggtgcccatgatggagaagatcctgcagaagttcaccagcatgcacaaggcctacagccccgagaagaagatcagcatcctgctgaagacctgcaagctgatctacgacagcatggccctgggcaaccccggcaagccctacggcgccgacgacttcctgcccgtgctgatgtacgtgctggccagaagcaacctgaccgagatgctgctgaacgtggagtacatgatggagctgatggaccccgccctgcagctgggcgagggcagctactacctgaccaccacctacggcgccctggagcacatcaagagctacgacaagatcaccgtgaccagacagctgagcgtggaggtgcaggacagcatccacagatgggagagaagaagaaccctgaacaaggccagagccagcagaagcagcgtgcaggtgagacccgagagcggcagaggccccgtgggcccctgccccagacaccacccctgctgcctgctggccaaggagccctag

SEQ ID NO: 13632 - DNA, 2466 bp, Artificial Sequence
  Description of Artificial Sequence: Synthetic coding sequence
atggccggcagcgacgccgagtgggtgaccatcgccaacaacctgctgttcaagtgccacatccacctgagaatccacgagctgcaggactgcgacgccaacgtgttcatcgccctgtaccagagcatcctgggcgagaaggtgcccgacctgatcgtgatccccagaagccaggaggacgacgcccacaacgtgcaggccgtgatcgacagcctggccctggactacctgcaggtgagcctgagccacatcaccggcgagaacatcgtgaagggcgacaaggagagcatcaagaacctgctggagatcttcgacggcctgctggagtacctgaccgagagaatcagcgagaccagccacgagaagagcgagaccgagcagtacttcaaggagagcgacagaggcgagagactggaggagcccgagagcaccaaggagagcaagagcagctggaagagagtgagcttcggcagatgcagcctgagcagcgagatgctgggccccagctgggacggcgacgaggccgagagcaccggcgagatcatcagactgggcgacaccgcccacaccttcagcctgagaagcaacggcgcccagtgccccaacgagatgctgagcaagaaggccctggccagccccagcagcaagagccacgaggacatgctgtacccccccagcgtgctgagcaagagcagaaccagcttcgtggaggacaccgagaccctgagcgtgagcggcatccccaacgccagaaagctgggcgagcccatcagagccgccatccccctgcaccccccctaccaccccagcgagcccagagccccctgccccatcggcaaggagtacctgcacagcagccactgcagccccgccgtgaacagcaccggcgagcacaccgagttcagcggcgacctggacgacggcctgttcctgatcagcaagctgcccaagggcagcaagtgggaggtgtaccccgcccaggtgcagggccccagaaccagaaagccccccaagggcaagagaaacgagaacagagccaccgccagcagctgcaacagccccttcccccagagacccagaaagagactgaccgagcaggagctgcacgacgtgagcgagaagctgagccagagactgagcgagctggactggatgctgaagagcgccctgggcgacagaatcaaggagaagaccgaccacaaggaggagaacaccggcaacgaggaggtggaggacggcaccgaggagaccctgagccagcacagcgacggcatcgtggagtacggccccaagaagagcagacccggcctgagcatgagaagaaagcccccctacagaagccacagcctgagccccagccccgtgaacaagcacaagcagttccacctggagagaaagagacagagaaagcccagagagaccgacgtgagacagttccaggcccaggccttcaccgaggccttcgagagagagctgagaagacacaaggtgcaggagaacatcggccccctgagaatccacgagaaggaggaggagaccgagaagatctacagaggcgaggccgtgagaaagggcacccccgagtgcagccagccctggaagatctacagcagaaagaccaccacccagagcctgagaggcggcctgcccaagcccaacaaggccgtgcccatgaaggtgagcgagcacagcctgctgcccctgatgctggagcagttccccttcctgtacgtgagcggccccaccctgagcaagatgtggaagcagcagatcgcccaggtggagcagctgaagaaggaggcctgcagagagaacagaagcaagaagaagctgcaggacgagatcgaggaggccctgagaagacacgacctgctgaccaccctggtgaagaaggagtacgagcacaacaagagactgcaggacttcaaggactgcatcagaagacagagactgacccagagcaagatcaaggagaacagacagcagatcgtgagagccagaaagtactacgacgactacagagtgcagctgtgcgccaagatgatgagaatgagaaccagagaggagatgatcttcaagaagctgttcgaggagggcctgaacatccagaagcagagactgagagacctgagaaactacgccaaggagaagagagacgagcagagaagaagacaccaggacgagctggacagcatggagaactactacaaggaccagttcagcctgctggccgaggccatcagccaggagcaccaggagctgaaggccagagagaagagccaggcccagaccctgcacaaggtgaagagagagctgagaagcaagatggagaaggagatccagcagctgcaggacatgatcacccagaacgacgacgacgtgttcttcagagagctggaggccgagagattcagaagcagactgcagctggccagcttccagtacagcaagagccccagcctgtag

SEQ ID NO: 13633 - DNA, 4560 bp, Artificial Sequence
  Description of Artificial Sequence: Synthetic coding sequence
atgagaatccccgaccagaagtacgtgaccctgaagctgaacgacgtgatcagattcggctacgacagcaacatgtacgtgctggagagagtgcagcacagagtgcccgaggaggccctgaagcacgagaagtacaccagccagctgcaggtgagcgtgaagggcctggcccccaagagaagcgaggccctgcccgagcacaccccctactgcgaggccagcaaccccagacccgagaagggcgacagaagacccggcaccgaggccgccagctacagaacccccctgtacggccagcccagctggtggggcgaggacgacggcagcaccctgcccgacgcccagagacagggcgagccctaccccgagagacccaagggccccgtgcagcaggacggcgagctgcacggcttcagagcccccgccgagccccagggctgcagcttcagaagagagcccagctacttcgagatccccaccaaggagaccccccagcccagccagccccccgaggtgcccgcccacgagatgcccaccaaggacgccgaggccggcggcggcggcgccgcccccgtggtgcagagccacgccagcttcaccatcgagttcgacgactgcagccccggcaagatgaagatcaaggaccacatcaccaagttcagcctgagacagagaagaccccccggcaaggaggccacccccggcgagatggtgagcgccgagaccaaggtggccgactggctggtgcagaacgaccccagcctgctgcacagagtgggccccggcgacgacagacacagcaccaagagcgacctgcccgtgcacaccagaaccctgaagggccacaagcacgaggacggcacccagagcgacagcgaggaccccctggccaaggccgccagcgccgccggcgtgcccctggaggccagcggcgagcaggtgagactgcagagacagatcaagagagacccccaggagctgctgcacaaccagcaggccttcgtgatcgagttcttcgacgaggacacccccagaaagaagagaagccagagcttcacccacagccccagcggcgaccccaaggccgacaagagaagaggccccacccccgccgacagagacagacccagcgtgcccgcccccgtgcaggccggcggcagaagcagcggcccccagagagccggcagcctgaagagagagaagaccgaggagagactgggcagccccagccccgccagcagaacccccgccagacccttcggcagcgtgggcagaagaagcagactggcccaggacttcatggcccagtgcctgagagagagcagccccgccgccagacccagccccgagaaggtgccccccgtgctgcccgcccccctgaccccccacggcaccagccccgtgggcccccccacccccccccccgcccccaccgacccccagctgaccaaggccagaaagcaggaggaggacgacagcctgagcgacgccggcacctacaccatcgagaccgaggcccaggacaccgaggtggaggaggccagaaagatgatcgaccaggtgttcggcgtgctggagagccccgagctgagcagagccagcagcgccaccttcagacccgtgatcagaggcgacagagacgagagcgacgacggcggcgtggcccagagaatggccctgctgcaggagttcgccagcagacccctgggcgccgccccccaggccgagcaccagggcctgcccgtgcccggcagccccggcggccagaagtgggtgagcagatgggccagcctggccgacagctacagcgaccccggcctgaccgaggacggcctgggcagaagaggcggcgagcccgagggcagcctgcccgtgagaatgagaagaagactgccccagctgcccagcgagagagccgacagccccgccggccccgagagcagcagaagaagcggccccggcccccccgagctggacagcgagcagcccagcagactgttcggccaggaggagctggaccccgacagcctgagcgacgccagcggcagcgacggcggcagaggccccgagcccggcgtggagccccaggacagcagaagaagaagcccccaggagggccccacctggagcagaggcagaagaagccccagagcccccggcgagcccacccccgccagcttcttcatcggcgaccagaacggcgacgccgtgctgagcagaaagcccctggccgcccccggcgacggcgagggcctgggccagaccgcccagcccagcccccccgccagagacggcgtgtacgtgagcgccaacggcagaatggtgatccagctgagacccggcagaagccccgagcccgacggccccgcccccgccttcctgagacaggagagcttcaccaaggagcccgccagcggcccccccgcccccggcaagcccccccacatcagcagccaccccctgctgcaggacctggccgccaccagagccgccagaatggacttccacagccaggacacccacctgatcctgaaggagaccgagaccgccctggccgccctggaggccagactgctgagcaacagcgtggacgccgagtgcgagggcggcagcacccccagaccccccgaggacgccctgagcggcgacagcgacgtggacaccgccagcaccgtgagcctgagaagcggcaagagcggccccagccccaccaccccccagcccctgagagcccagaaggagatgagccccagcccccccgccgcccaggaccccggcggcaccgccctggtgagcgccagagagcagagcagcgagagacagcaccaccccctgggccccaccgacatgggcagaggcgagcccgtgagaagaagcgccatcagaagaggccacagacccagaggcagcctggactggcccagcgaggagagaggccccgtgctggcccacctgcccagcagcgacgtgatggccagcaaccacgagacccccgaggccaccggcgccggcagactgggcagcagaagaaagcccgccgcccccccccccagccccgccgccagagaggagcagagcagaagcagcgccagcagccagaagggcccccaggccctgaccagaagcaacagcctgagcacccccagacccaccagagccagcagactgagaagagccagactgggcgacgccagcgacaccgaggccgccgacggcgagagaggcagcctgggcaaccccgagcccgtgggcagacccgccgccgagcaggccaagaagctgagcagactggacatcctggccatgcccagaaagagagccggcagcttcaccggcaccagcgaccccgaggccgcccccgccagaaccagcttcagcggcagaagcgtggagctgtgctgcgccagcagaaagcccaccatggccgaggccagagccgtgagcagaaaggccgccaacaccgccaccaccaccggccccagacagcccttcagcagagccagaagcggcagcgccagatacaccagcaacaccagaagaagacagcagggcagcgactacaccagcaccagcgaggaggagtacggcagcagacacggcagccccaagcacaccagaagccacaccagcaccgccacccagacccccagagccggcagcagcagcagagccagaagcagagcccccggccccagagacaccgacgacgacgaggaggagcccgacccctacggcttcatcgtgcagaccgccgagatcgccgagatcgccagactgagccagaccctggtgaaggacgtggccatcctggcccaggagatccacgacgtggccggcgacggcgacaccctgggcagcagcgagcccgcccacagcgccagcctgagcaacatgcccagcacccccgccagcaccatcagcgccagagaggagctggtgcagagaatccccgaggccagcctgaacttccagaaggtgccccccggcagcctgaacagcagagacttcgaccagaacatgaacgacagctgcgaggacgccctggccaacaagaccagacccagaaacagagaggaggtgatcttcgacaacctgatgctgaaccccgtgagccagctgagccaggccatcagagagaacaccgagcacctggccgagaagatgaagatcctgttccagaacaccggcagagcctgggaggacctggaggccagaatcaacgccgagaacgaggtgcccatcctgaagaccagcaacaaggagatcagcagcatcctgaaggagctgagaagagtgcagaagcagctggaggtgatcaacgccatcgtggaccccagcggcagcctggacctgctgaccggcaacagaagcctggccagcagcgcccagcccggcctgggcaagggcagagtggccgcccagagcccccccagccccgccagcgccgaggccctgctgcccgccctgcccctgagaaacttcccccagagagccagctgcggcccccccagcctgcccgaccccaccttcctgcccgacgccgagagattcctgatctag

SEQ ID NO: 13634 - DNA, 378 bp, Artificial Sequence; identical to SEQ ID NO: 9790
  Description of Artificial Sequence: Synthetic coding sequence

SEQ ID NO: 13635 - DNA, 3525 bp, Artificial Sequence; identical to SEQ ID NO: 10034
  Description of Artificial Sequence: Synthetic coding sequence

SEQ ID NO: 13636 - DNA, 1245 bp, Artificial Sequence; identical to SEQ ID NO: 9509
  Description of Artificial Sequence: Synthetic coding sequence

SEQ ID NO: 13637 - DNA, 2256 bp, Artificial Sequence; identical to SEQ ID NO: 13614
  Description of Artificial Sequence: Synthetic coding sequence

SEQ ID NO: 13638 - DNA, 1056 bp, Artificial Sequence; identical to SEQ ID NO: 9702
  Description of Artificial Sequence: Synthetic coding sequence

SEQ ID NO: 13639 - DNA, 2394 bp, Artificial Sequence
  Description of Artificial Sequence: Synthetic coding sequence
atggccgtgcagggcagccagagaagactgctgggcagcctgaacagcacccccaccgccatcccccagctgggcctggccgccaaccagaccggcgccagatgcctggaggtgagcatcagcgacggcctgttcctgagcctgggcctggtgagcctggtggagaacgccctggtggtggccaccatcgccaagaacagaaacctgcacagccccatgtactgcttcatctgctgcctggccctgagcgacctgctggtgagcggcagcaacgtgctggagaccgccgtgatcctgctgctggaggccggcgccctggtggccagagccgccgtgctgcagcagctggacaacgtgatcgacgtgatcacctgcagcagcatgctgagcagcctgtgcttcctgggcgccatcgccgtggacagatacatcagcatcttctacgccctgagataccacagcatcgtgaccctgcccagagccagaagagccgtggccgccatctgggtggccagcgtggtgttcagcaccctgttcatcgcctactacgaccacgtggccgtgctgctgtgcctggtggtgttcttcctggccatgctggtgctgatggccgtgctgtacgtgcacatgctggccagagcctgccagcacgcccagggcatcgccagactgcacaagagacagagacccgtgcaccagggcttcggcctgaagggcgccgtgaccctgaccatcctgctgggcatcttcttcctgtgctggggccccttcttcctgcacctgaccctgatcgtgctgtgccccgagcaccccacctgcggctgcatcttcaagaacttcaacctgttcctggccctgatcatctgcaacgccatcatcgaccccctgatctacgccttccacagccaggagctgagaagaaccctgaaggaggtgctgacctgcagctgcagccaggacagagccctggtgagctgggacgtgaagagcctgggcggcagcgtgtgccaggagctgctgccccagcagccccaggagaagggcctgtgcgaccagaaggccagcagcaccgccctgcagagactgctgcagaaggagttctgggaggtgatcagcgacgagcacggcatcgaccccagcggcaactacgtgggcgacagcgacctgcagctggagagaatcagcgtgtactacaacgaggccagcagccacaagtacgtgcccagagccatcctggtggacctggagcccggcaccatggacagcgtgagaagcggcgccttcggccacctgttcagacccgacaacttcatcttcggccagagcggcgccggcaacaactgggccaagggccactacaccgagggcgccgagctggtggacagcgtgctggacgtggtgagaaaggagtgcgagaactgcgactgcctgcagggcttccagctgacccacagcctgggcggcggcaccggcagcggcatgggcaccctgctgatcagcaaggtgagagaggagtaccccgacagaatcatgaacaccttcagcgtggtgcccagccccaaggtgagcgacaccgtggtggagccctacaacgccaccctgagcatccaccagctggtggagaacaccgacgagacctactgcatcgacaacgaggccctgtacgacatctgcttcagaaccctgaagctggccacccccacctacggcgacctgaaccacctggtgagcgccaccatgagcggcgtgaccaccagcctgagattccccggccagctgaacgccgacctgagaaagctggccgtgaacatggtgcccttccccagactgcacttcttcatgcccggcttcgcccccctgaccgccagaggcagccagcagtacagagccctgaccgtgcccgagctgacccagcagatgttcgacgccaagaacatgatggccgcctgcgaccccagacacggcagatacctgaccgtggccaccgtgttcagaggcagaatgagcatgaaggaggtggacgagcagatgctggccatccagagcaagaacagcagctacttcgtggagtggatccccaacaacgtgaaggtggccgtgtgcgacatcccccccagaggcctgaagatgagcagcaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggagggcgagatgtacgaggacgacgaggaggagagcgaggcccagggccccaagtag

SEQ ID NO: 13640 - DNA, 99 bp, Artificial Sequence
  Description of Artificial Sequence: Synthetic coding sequence
atggccgagagcagcagcgagagcgaccacttcagatgcagagacagactgagcccctgggccgccagaagcacccacagaggcaccagaagcctgtag

SEQ ID NO: 13641 - DNA, 453 bp, Artificial Sequence
  Description of Artificial Sequence: Synthetic coding sequence
atgaccgacaccagaagaagagtgaaggtgtacaccctgaacgaggacagacagtgggacgacagaggcaccggccacgtgagcagcggctacgtggagagactgaagggcatgagcctgctggtgagagccgagagcgacggcagcctgctgctggagagcaagatcaaccccaacaccgcctaccagaagcagcaggacaccctgatcgtgtggagcgaggccgagaactacgacctggccctgagcttccaggagaaggccggctgcgacgagatctgggagaagatctgccaggtgcagggcaaggaccccagcgtggacatcacccaggacctggtggacgagagcgaggaggagagattcgacgacatgagcagccccggcctggagctgcccagctgcgagctgagcagactggaggagatcgccgagctggtggccagcagctag

SEQ ID NO: 13642 - DNA, 504 bp, Artificial Sequence
  Description of Artificial Sequence: Synthetic coding sequence
atggactggaaggaggtgctgagaagaagactggccacccccaacacctgccccaacaagaagaagagcgagcaggagctgaaggacgaggagatggacctgttcaccaagtactacagcgagtggaagggcggcagaaagaacaccaacgagttctacaagaccatccccagattctactacagactgcccgccgaggacgaggtgctgctgcagaagctgagagaggagagcagagccgtgttcctgcagagaaagagcagagagctgctggacaacgaggagctgcagaacctgtggttcctgctggacaagcaccagaccccccccatgatcggcgaggaggccatgatcaactacgagaacttcctgaaggtgggcgagaaggccggcgccaagtgcaagcagttcttcaccgccaaggtgttcgccaagctgctgcacaccgacagctacggcagaatcagcatcatgcagttcttcaactacgtgatgagaaagtag

SEQ ID NO: 13643 - DNA, 507 bp, Artificial Sequence; identical to SEQ ID NO: 13598
  Description of Artificial Sequence: Synthetic coding sequence

SEQ ID NO: 13644 - DNA, 822 bp, Artificial Sequence
  Description of Artificial Sequence: Synthetic coding sequence
atgcccggcctgagctgcagattctaccagcacaagttccccgaggtggaggacgtggtgatggtgaacgtgagaagcatcgccgagatgggcgcctacgtgagcctgctggagtacaacaacatcgagggcatgatcctgctgagcgagctgagcagaagaagaatcagaagcatcaacaagctgatcagaatcggcagaaacgagtgcgtggtggtgatcagagtggacaaggagaagggctacatcgacctgagcaagagaagagtgagccccgaggaggccatcaagtgcgaggacaagttcaccaagagcaagaccgtgtacagcatcctgagacacgtggccgaggtgctggagtacaccaaggacgagcagctggagagcctgttccagagaaccgcctgggtgttcgacgacaagtacaagagacccggctacggcgcctacgacgccttcaagcacgccgtgagcgaccccagcatcctggacagcctggacctgaacgaggacgagagagaggtgctgatcaacaacatcaacagaagactgaccccccaggccgtgaagatcagagccgacatcgaggtggcctgctacggctacgagggcatcgacgccgtgaaggaggccctgagagccggcctgaactgcagcaccgagaacatgcccatcaagatcaacctgatcgccccccccagatacgtgatgaccaccaccaccctggagagaaccgagggcctgagcgtgctgagccaggccatggccgtgatcaaggagaagatcgaggagaagagaggcgtgttcaacgtgcagatgtag

SEQ ID NO: 13645 - DNA, 2757 bp, Artificial Sequence
  Description of Artificial Sequence: Synthetic coding sequence
tgaagaaccaacagcagattcgtgaaggtggtgctgatgagcgccaccatcagctgcaaggagttcgccgactacttcgccgtgcccgtgcagaacaagatgaaccccgcctacatcttcgaggtggagggcaagccccacagcgtggaggagtactacctgaacgacctggagcacatccaccacagcaagctgagcccccacctgctggaggagcccgtgatcaccaaggacatctacgaggtggccgtgagcctgatccagatgttcgacgacctggacatgaaggagagcggcaacaaggcctggagcggcgcccagttcgtgctggagagaagcagcgtgctggtgttcctgcccggcctgggcgagatcaactacatgcacgagctgctgaccagcctggtgcacaagagactgcaggtgtaccccctgcacagcagcgtggccctggaggagcagaacaacgtgttcctgagccccgtgcccggctacagaaagatcatcctgagcaccaacatcgccgagagcagcgtgaccgtgcccgacgtgaagtacgtgatcgacttctgcctgaccagaaccctggtgtgcgacgaggacaccaactaccagagcctgagactgagctgggccagcaagaccagctgcaaccagagaaagggcagagccggcagagtgagcagaggctactgctacagactggtgcacaaggacttctgggacaacagcatccccgaccacgtggtgcccgagatgctgagatgccccctgggcagcaccatcctgaaggtgaagctgctggacatgggcgagcccagagccctgctggccaccgccctgagcccccccggcctgagcgacatcgagagaaccatcctgctgctgaaggaggtgggcgccctggccgtgagcggccagagagaggacgagaacccccacgacggcgagctgaccttcctgggcagagtgctggcccagctgcccgtgaaccagcagctgggcaagctgatcgtgctgggccacgtgttcggctgcctggacgagtgcctgatcatcgccgccgccctgagcctgaagaacttcttcgccatgcccttcagacagcacctggacggctacagaaacaaggtgaacttcagcggcagcagcaagagcgactgcatcgccctggtggaggccttcaagacctggaaggcctgcagacagaccggcgagctgagataccccaaggacgagctgaactggggcagactgaactacatccagatcaagagaatcagagaggtggccgagctgtacgaggagctgaagaccagaatcagccagttcaacatgcacgtggacagcagaagacccgtgatggaccaggagtacatctacaagcagagattcatcctgcaggtggtgctggccggcgccttctaccccaactacttcaccttcggccagcccgacgaggagatggccgtgagagagctggccggcaaggaccccaagaccaccgtggtgctgaagcacatccccccctacggcttcctgtactacaagcagctgcagagcctgttcagacagtgcggccaggtgaagagcatcgtgttcgacggcgccaaggccttcgtggagttcagcagaaaccccaccgagagattcaagaccctgcccgccgtgtacatggccatcaagatgagccagctgaaggtgagcctggagctgagcgtgcacagcgccgaggagatcgagggcaaggtgcagggcatgaacgtgagcaagctgagaaacaccagagtgaacgtggacttccagaagcagaccgtggaccccatgcaggtgagcttcaacaccagcgacagaagccagaccgtgaccgacctgctgctgaccatcgacgtgaccgaggtggtggaggtgggccacttctggggctacagaatcgacgagaacaacagcgagatcctgaagaagctgaccgccgagatcaaccagctgaccctggtgcccctgcccacccacccccaccccgacctggtgtgcctggcccccttcgccgacttcgacaagcagagatacttcagagcccaggtgctgtacgtgagcggcaacagcgccgaggtgttcttcgtggactacggcaacaagagccacgtggacctgcacctgctgatggagatcccctgccagttcctggagctgcccttccaggccctggagttcaagatctgcaagatgagacccagcgccaagagcctggtgtgcggcaagcactggagcgacggcgccagccagtggttcgccagcctggtgagcggctgcaccctgctggtgaaggtgttcagcgtggtgcacagcgtgctgcacgtggacgtgtaccagtacagcggcgtgcaggacgccatcaacatcagagacgtgctgatccagcagggctacgccgagctgaccgaggagagctacgagagcaaggtgaacatcctgagagccgccatcaacaagctggtgtgcgacggccccaacggctgcaagtgcctgggccccgagagagtggcccagctgcaggacatcgccagacagaagctgctgggcctgttctgccagagcaagcccagagagaagatcgtgcccaagtggcacgagaagccctacgagtggaaccaggtggaccccaagctggtgatggagcaggccgacagagagagcagcagaggcaagaacaccttcctgtaccagctgcacaagctggtggtgctgggcacctag

SEQ ID NO: 13646 - DNA, 507 bp, Artificial Sequence
  Description of Artificial Sequence: Synthetic coding sequence
atggagaagctgagcgccctgcaggagcagaagggcgagctgagaaagagactgagctacaccacccacaagctggagaagctggagaccgagttcgacagcaccagacactacctggagatcgagctgagaagagcccaggaggagctggagaaggtgaccgagaagctgagaagaatccagagcaactacatggccctgcagagaatcaaccaggagctggaggacaagctgtacagaatgggccagcactacgaggaggagaagagagccctgagccacgagatcgtggccctgaacagccacctgctggaggccaaggtgaccatcgacaagctgagcgaggacaacgagctgtacagaaaggactgcaacctggccgcccagctgctgcagtgcagccagacctacggcagagtgcacaaggtgagcgagctgcccagcgacttccaggagagagtgagcctgcacatggagaagcacggctgcagcctgcccagcccctag

SEQ ID NO: 13647 - DNA, 636 bp, Artificial Sequence
  Description of Artificial Sequence: Synthetic coding sequence
atggacatgggcaaccagcaccccagcatcagcagactgcaggagatccagaaggaggtgaagagcgtggagcagcaggtgatcggcttcagcggcctgagcgacgacaagaactacaagaagctggagagaatcctgaccaagcagctgttcgagatcgacagcgtggacaccgagggcaagggcgacatccagcaggccagaaagagagccgcccaggagaccgagagactgctgaaggagctggagcagaacgccaaccacccccacagaatcgagatccagaacatcttcgaggaggcccagagcctggtgagagagaagatcgtgcccttctacaacggcggcaactgcgtgaccgacgagttcgaggagggcatccaggacatcatcctgagactgacccacgtgaagaccggcggcaagatcagcctgagaaaggccagataccacaccctgaccaagatctgcgccgtgcaggagatcatcgaggactgcatgaagaagcagcccagcctgcccctgagcgaggacgcccaccccagcgtggccaagatcaacttcgtgatgtgcgaggtgaacaaggccagaggcgtgctgatcgccctgctgatgggcgtgaacaacaacgagtag

SEQ ID NO: 13648 - DNA, 2985 bp, Artificial Sequence
  Description of Artificial Sequence: Synthetic coding sequence
atgagccagtggacccccgagtacaacgagctgtacaccctgaaggtggacatgaagagcgagatccccagcgacgcccccaagacccaggagagcctgaagggcatcctgctgcaccccgagcccatcggcgccgccaagagcttccccgccggcgtggagatgatcaacagcaaggtgggcaacgagttcagccacctgtgcgacgacagccagaagcaggagaaggagatgaacggcaaccagcaggagcaggagaagagcctggtggtgagaaagaagagaaagagccagcaggccggccccagctacgtgcagaactgcgtgaaggagaaccagggcatcctgggcctgagacagcacctgggcacccccagcgacgaggacaacgacagcagcttcagcgactgcctgagcagccccagcagcagcctgcacttcggcgacagcgacaccgtgaccagcgacgaggacaaggaggtgagcgtgagacacagccagaccatcctgaacgccaagagcagaagccacagcgccagaagccacaagtggcccagaaccgagaccgagagcgtgagcggcctgctgatgaagagaccctgcctgcacggcagcagcctgagaagactgccctgcagaaagagattcgtgaagaacaacagcagccagagaacccagaagcagaaggagagaatcctgatgcagagaaagaagagagaggtgctggccagaagaaagtacgccctgctgcccagcagcagcagcagcagcgagaacgacctgagcagcgagagcagcagcagcagcagcaccgagggcgaggaggacctgttcgtgagcgccagcgagaaccaccagaacaaccccgccgtgcccagcggcagcatcgacgaggacgtggtggtgatcgaggccagcagcaccccccaggtgaccgccaacgaggagatcaacgtgaccagcaccgacagcgaggtggagatcgtgaccgtgggcgagagctacagaagcagaagcaccctgggccacagcagaagccactggagccagggcagcagcagccacgccagcagaccccaggagcccagaaacagaagcagaatcagcaccgtgatccagcccctgagacagaacgccgccgaggtggtggacctgaccgtggacgaggacgagcccaccgtggtgcccaccaccagcgccagaatggagagccaggccaccagcgccagcatcaacaacagcaaccccagcaccagcgagcaggccagcgacaccgccagcgccgtgaccagcagccagcccagcaccgtgagcgagaccagcgccaccctgaccagcaacagcaccaccggcaccagcatcggcgacgacagcagaagaaccaccagcagcgccgtgaccgagaccggcccccccgccatgcccagactgcccagctgctgcccccagcacagcccctgcggcggcagcagccagaaccaccacgccctgggccacccccacaccagctgcttccagcagcacggccaccacttccagcaccaccaccaccaccaccacaccccccaccccgccgtgcccgtgagccccagcttcagcgaccccgcctgccccgtggagagacccccccaggtgcaggccccctgcggcgccaacagcagcagcggcaccagctaccacgagcagcaggccctgcccgtggacctgagcaacagcggcatcagaagccacggcagcggcagcttccacggcgccagcgccttcgacccctgctgccccgtgagcagcagcagagccgccatcttcggccaccaggccgccgccgccgcccccagccagcccctgagcagcatcgacggctacggcagcagcatggtggcccagccccagccccagccccccccccagcccagcctgagcagctgcagacactacatgccccccccctacgccagcctgaccagacccctgcaccaccaggccagcgcctgcccccacagccacggcaacccccccccccagacccagccccccccccaggtggactacgtgatcccccaccccgtgcacgccttccacagccagatcagcagccacgccaccagccaccccgtggccccccccccccccacccacctggccagcaccgccgcccccatcccccagcacctgccccccacccaccagcccatcagccaccacatccccgccaccgccccccccgcccagagactgcacccccacgaggtgatgcagagaatggaggtgcagagaagaagaatgatgcagcaccccaccagagcccacgagagaccccccccccacccccacagaatgcaccccaactacggccacggccaccacatccacgtgccccagaccatgagcagccaccccagacaggcccccgagagaagcgcctgggagctgggcatcgaggccggcgtgaccgccgccacctacacccccggcgccctgcacccccacctggcccactaccacgccccccccagactgcaccacctgcagctgggcgccctgcccctgatggtgcccgacatggccggctacccccacatcagatacatcagcagcggcctggacggcaccagcttcagaggccccttcagaggcaacttcgaggagctgatccacctggaggagagactgggcaacgtgaacagaggcgccagccagggcaccatcgagagatgcacctacccccacaagtacaagaaggtgaccaccgactggttcagccagagaaagctgcactgcaagcaggacggcgaggagggcaccgaggaggacaccgaggagaagtgcaccatctgcctgagcatcctggaggagggcgaggacgtgagaagactgccctgcatgcacctgttccaccaggtgtgcgtggaccagtggctgatcaccaacaagaagtgccccatctgcagagtggacatcgaggcccagctgcccagcgagagctag

SEQ ID NO: 13649 - DNA, 1158 bp, Artificial Sequence; identical to SEQ ID NO: 10045
  Description of Artificial Sequence: Synthetic coding sequence

SEQ ID NO: 13650 - DNA, 7464 bp, Artificial Sequence
  Description of Artificial Sequence: Synthetic coding sequence
tgagaggaggaggaggacgacgacgacgaggaggaggaggtgagcgaggtggagagcttcatcctggaccaggacgacctggagaaccccatgctggagaccgccagcaagctgctgctgagcggcaccgccgacggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgagagccgagagcaccgccaacgccggccagagcgacaacagaagcctggccgaggcctgcagcgagggcgacgtgaacgccgtgagaaagctgctgatcgagggcagaagcgtgaacgagcacaccgaggagggcgagagcctgctgtgcctggcctgcagcgccggctactacgagctggcccaggtgctgctggccatgcacgccaacgtggaggacagaggcatcaagggcgacatcacccccctgatggccgccgccaacggcggccacgtgaagatcgtgaagctgctgctggcccacaaggccgacgtgaacgcccagagcagcaccggcaacaccgccctgacctacgcctgcgccggcggctacgtggacgtggtgaaggtgctgctggagagcggcgccagcatcgaggaccacaacgagaacggccacacccccctgatggaggccggcagcgccggccacgtggaggtggccagactgctgctggagaacggcgccggcatcaacacccacagcaacgagttcaaggagagcgccctgaccctggcctgctacaagggccacctggagatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccagcctggaggaggtgaacgacgagggctacacccccctgatggaggccgccagagagggccacgaggagatggtggccctgctgctgggccagggcgccaacatcaacgcccagaccgaggagacccaggagaccgccctgaccctggcctgctgcggcggcttcctggaggtggccgacttcctgatcaaggccggcgccgacatcgagctgggctgcagcacccccctgatggaggccgcccaggagggccacctggagctggtgaagtacctgctggccgccggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacgtgtgcaccgtgcagttcctgatcagcaagggcgccaacgtgaacagaaccaccgccaacaacgaccacaccgtgctgagcctggcctgcgccggcggccacctggccgtggtggagctgctgctggcccacggcgccgaccccacccacagactgaaggacggcagcaccatgctgatcgaggccgccaagggcggccacaccagcgtggtgtgctacctgctggactaccccaacaacctgctgagcgcccccccccccgacgtgacccagctgaccccccccagccacgacctgaacagagcccccagagtgcccgtgcaggccctgcccatggtggtgcccccccaggagcccgacaagccccccgccaacgtggccaccaccctgcccatcagaaacaaggccgccagcaagcagaagagcagcagccacctgcccgccaacagccaggacgtgcagggctacatcaccaaccagagccccgagagcatcgtggaggaggcccagggcaagctgaccgagctggagcagagaatcaaggaggccatcgagaagaacgcccagctgcagagcctggagctggcccacgccgaccagctgaccaaggagaagatcgaggagctgaacaagaccagagaggagcagatccagaagaagcagaagatcctggaggagctgcagaaggtggagagagagctgcagctgaagacccagcagcagctgaagaagcagtacctggaggtgaaggcccagagaatccagctgcagcagcagcagcagcagagctgccagcacctgggcctgctgacccccgtgggcgtgggcgagcagctgagcgagggcgactacgccagactgcagcaggtggaccccgtgctgctgaaggacgagccccagcagaccgccgcccagatgggcttcgcccccatccagcccctggccatgccccaggccctgcccctggccgccggccccctgccccccggcagcatcgccaacctgaccgagctgcagggcgtgatcgtgggccagcccgtgctgggccaggcccagctggccggcctgggccagggcatcctgaccgagacccagcagggcctgatggtggccagccccgcccagaccctgaacgacaccctggacgacatcatggccgtgagcggcagagccagcgccatgagcaacacccccacccacagcatcgccgccagcatcagccagccccagacccccacccccagccccatcatcagccccagcgccatgctgcccatctaccccgccatcgacatcgacgcccagaccgagagcaaccacgacaccgccctgaccctggcctgcgccggcggccacgaggagctggtgcagaccctgctggagagaggcgccagcatcgagcacagagacaagaagggcttcacccccctgatcctggccgccaccgccggccacgtgggcgtggtggagatcctgctggacaacggcgccgacatcgaggcccagagcgagagaaccaaggacacccccctgagcctggcctgcagcggcggcagacaggaggtggtggagctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacaccgccgccgtgaagctgctgctggacatgggcagcgacatcaacgcccagatcgagaccaacagaaacaccgccctgaccctggcctgcttccagggcagaaccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatcggcagaggcgcccacatcgacgtgagaaacaagaagggcaacacccccctgtggctggccgccaacggcggccacctggacgtggtgcagctgctggtgcaggccggcgccgacgtggacgccgccgacaacagaaagatcacccccctgatggccgccttcagaaagggccacgtgaaggtggtgagatacctggtgaaggaggtgaaccagttccccagcgacagcgagtgcatgagatacatcgccaccatcaccgacaaggagatgctgaagaagtgccacctgtgcatggagagcatcgtgcaggccaaggacagacaggccgccgaggccaacaagaacgccagcatcctgctggaggagctggacctggagaagctgagagaggagagcagaagactggccctggccgccaagagagagaagagaaaggagaagagaagaaagaagaaggaggagcagagaagaaagctggaggagatcgaggccaagaacaaggagaacttcgagctgcaggccgcccaggagaaggagaagctgaaggtggaggacgagcccgaggtgctgaccgagccccccagcgccaccaccaccaccaccatcggcatcagcgccacctggaccaccctggccggcagccacggcaagagaaacaacaccatcaccaccaccagcagcaagagaaagaacagaaagaacaagatcacccccgagaacgtgcagatcatcttcgacgaccccctgcccatcagctacagccagcccgagaaggtgaacggcgagagcaagagcagcagcaccagcgagagcggcgacagcgacaacatgagaatcagcagctgcagcgacgagagcagcaacagcaacagcagcagaaagagcgacaaccacagccccgccgtggtgaccaccaccgtgagcagcaagaagcagcccagcgtgctggtgaccttccccaaggaggagagaaagagcgtgagcggcaaggccagcatcaagctgagcgagaccatcagcgagggcaccagcaacagcctgagcacctgcaccaagagcggccccagccccctgagcagccccaacggcaagctgaccgtggccagccccaagagaggccagaagagagaggagggctggaaggaggtggtgagaagaagcaagaaggtgagcgtgcccagcaccgtgatcagcagagtgatcggcagaggcggctgcaacatcaacgccatcagagagttcaccggcgcccacatcgacatcgacaagcagaaggacaagaccggcgacagaatcatcaccatcagaggcggcaccgagagcaccagacaggccacccagctgatcaacgccctgatcaaggaccccgacaaggagatcgacgagctgatccccaagaacagactgaagagcagcagcgccaacagcaagatcggcagcagcgcccccaccaccaccgccgccaacaccagcctgatgggcatcaagatgaccaccgtggccctgagcagcaccagccagaccgccaccgccctgaccgtgcccgccatcagcagcgccagcacccacaagaccatcaagaaccccgtgaacaacgtgagacccggcttccccgtgagcctgcccctggcctacccccccccccagttcgcccacgccctgctggccgcccagaccttccagcagatcagaccccccagactgcccatgacccacttcggcggcaccttcccccccgcccagagcacctggggccccttccccgtgagacccctgagccccgccagagccaccaacagccccaagccccacatggtgcccagacacagcaaccagaacagcagcggcagccaggtgaacagcgccggcagcctgaccagcagccccaccaccaccaccagcagcagcgccagcaccgtgcccggcaccagcaccaacggcagccccagcagccccagcgtgagaagacagctgttcgtgaccgtggtgaagaccagcaacgccaccaccaccaccgtgaccaccaccgccagcaacaacaacaccgcccccaccaacgccacctaccccatgcccaccgccaaggagcactaccccgtgagcagccccagcagccccagcccccccgcccagcccggcggcgtgagcagaaacagccccctggactgcggcagcgccagccccaacaaggtggccagcagcagcgagcaggaggccggcagcccccccgtggtggagaccaccaacaccagaccccccaacagcagcagcagcagcggcagcagcagcgcccacagcaaccagcagcagccccccggcagcgtgagccaggagcccagaccccccctgcagcagagccaggtgcccccccccgaggtgagaatgaccgtgccccccctggccaccagcagcgcccccgtggccgtgcccagcaccgcccccgtgacctaccccatgccccagacccccatgggctgcccccagcccacccccaagatggagacccccgccatcagaccccccccccacggcaccaccgccccccacaagaacagcgccagcgtgcagaacagcagcgtggccgtgctgagcgtgaaccacatcaagagaccccacagcgtgcccagcagcgtgcagctgcccagcaccctgagcacccagagcgcctgccagaacagcgtgcaccccgccaacaagcccatcgcccccaacttcagcgcccccctgcccttcggccccttcagcaccctgttcgagaacagccccaccagcgcccacgccttctggggcggcagcgtggtgagcagccagagcacccccgagagcatgctgagcggcaagagcagctacctgcccaacagcgaccccctgcaccagagcgacaccagcaaggcccccggcttcagaccccccctgcagagacccgcccccagccccagcggcatcgtgaacatggacagcccctacggcagcgtgacccccagcagcacccacctgggcaacttcgccagcaacatcagcggcggccagatgtacggccccggcgcccccctgggcggcgcccccgccgccgccaacttcaacagacagcacttcagccccctgagcctgctgaccccctgcagcagcgccagcaacgacagcagcgcccagagcgtgagcagcggcgtgagagcccccagccccgcccccagcagcgtgcccctgggcagcgagaagcccagcaacgtgagccaggacagaaaggtgcccgtgcccatcggcaccgagagaagcgccagaatcagacagaccggcaccagcgcccccagcgtgatcggcagcaacctgagcaccagcgtgggccacagcggcatctggagcttcgagggcatcggcggcaaccaggacaaggtggactggtgcaaccccggcatgggcaaccccatgatccacagacccatgagcgaccccggcgtgttcagccagcaccaggccatggagagagacagcaccggcatcgtgacccccagcggcaccttccaccagcacgtgcccgccggctacatggacttccccaaggtgggcggcatgcccttcagcgtgtacggcaacgccatgatcccccccgtggcccccatccccgacggcgccggcggccccatcttcaacggcccccacgccgccgaccccagctggaacagcctgatcaagatggtgagcagcagcaccgagaacaacggcccccagaccgtgtggaccggcccctgggccccccacatgaacagcgtgcacatgaaccagctgggctag

SEQ ID NO: 13651 - DNA, 33 bp, Artificial Sequence
  Description of Artificial Sequence: Synthetic coding sequence
atggccctgccccacgacagcaacgagacctag

SEQ ID NO: 13652 - DNA, 462 bp, Artificial Sequence
  Description of Artificial Sequence: Synthetic coding sequence
atggccaccatgatcccccccgtgaagctgaagtggctggagcacctgaacagcagctggatcaccgaggacagcgagagcatcgccaccagagagggcgtggccgtgctgtacagcaagctggtgagcaacaaggaggtggtgcccctgccccagcaggtgctgtgcctgaagggcccccagctgcccgacttcgagagagagagcctgagcagcgacgagcaggaccactacctggacgccctgctgagcagccagctggccctggccaagatggtgtgcagcgacagccccttcgccggcgccctgagaaagagactgctggtgctgcagagagtgttctacgccctgagcaacaagtaccacgacaagggcaaggtgaagcagcagcagcacagccccgagagcagcagcggcagcgccgacgtgcacagcgtgagcgagagacccagaagcagctag

SEQ ID NO: 13653 - DNA, 111 bp, Artificial Sequence
  Description of Artificial Sequence: Synthetic coding sequence
atgctgccccccaagcacctgagcgccaccaagcccaagaagagctgggcccccaacctgtacgagctggacagcgacctgaccaaggagcccgacgtgatcatcggctag

SEQ ID NO: 13654 - DNA, 315 bp, Artificial Sequence
  Description of Artificial Sequence: Synthetic coding sequence
atggcccagagcggcggcgaggccagacccggccccaagaccgccgtgcagatcagagtggccatccaggaggccgaggacgtggacgagctggaggacgaggaggagggcgccgagaccagaggcgccggcgaccccgccagatacctgagccccggctggggcagcgccagcgaggaggagcccagcagaggccacagaaccgcccagctgccctggctggagagccagcaggtgttcagcctgaagcccttcctgctgcccaccggcatcgagctgacccccgagaacccctggggcagcagcgtgagctag

SEQ ID NO: 13655 - DNA, 645 bp, Artificial Sequence
  Description of Artificial Sequence: Synthetic coding sequence
atggccctgccccacgacagcaacgagaccagctacctgctgccccccaacaacgaggactggggcagacagaccatccccgacttcgtgtacggccagaaggacctgatggccgagggcatccagtggcccagaaacgcccccggcatccccgacgccctgccccagagccccttcgacgccgccctgtgcagcgcctggaagcagagagtggagctgggcctgttcagatacagactgagagagctgcagacccagatcctgcccggcgccgtgggcttcgtggcccagctgaacgtggagagaggcgtgcagagaagacccccccagaccatcaagagcgtgagacaggccttcgaccccgtgcagttcaacttcaacaagatcagacccggcgaggtgctgttcagactgcacagagagcccgacctgcccggcaccctgctgcaggaggacatcctggtggtgatcaacgtgagccccctggagtggggccacgtgctgctggtgcccgagcccgccagacagctgccccagagactgctgcccggcgccctgagagccggcatcgaggccgtgctgctgagcctgcaccccggcttcagagtgggcttcaacagcctgggcggcctggccagcgtgtag

SEQ ID NO: 13656 - DNA, 2988 bp, Artificial Sequence
  Description of Artificial Sequence: Synthetic coding sequence
atgagccagtggacccccgagtacaacgagctgtacaccctgaaggtggacatgaagagcgagatccccagcgacgcccccaagacccaggagagcctgaagggcatcctgctgcaccccgagcccatcggcgccgccaagagcttccccgccggcgtggagatgatcaacagcaaggtgggcaacgagttcagccacctgtgcgacgacagccagaagcaggagaaggagatgaacggcaaccagcaggagcaggagaagagcctggtggtgagaaagaagagaaagagccagcaggccggccccagctacgtgcagaactgcgtgaaggagaaccagggcatcctgggcctgagacagcacctgggcacccccagcgacgaggacaacgacagcagcttcagcgactgcctgagcagccccagcagcagcctgcacttcggcgacagcgacaccgtgaccagcgacgaggacaaggaggtgagcgtgagacacagccagaccatcctgaacgccaagagcagaagccacagcgccagaagccacaagtggcccagaaccgagaccgagagcgtgagcggcctgctgatgaagagaccctgcctgcacggcagcagcctgagaagactgccctgcagaaagagattcgtgaagaacaacagcagccagagaacccagaagcagaaggagagaatcctgatgcagagaaagaagagagaggtgctggccagaagaaagtacgccctgctgcccagcagcagcagcagcagcgagaacgacctgagcagcgagagcagcagcagcagcagcaccgagggcgaggaggacctgttcgtgagcgccagcgagaaccaccagaacaaccccgccgtgcccagcggcagcatcgacgaggacgtggtggtgatcgaggccagcagcaccccccaggtgaccgccaacgaggagatcaacgtgaccagcaccgacagcgaggtggagatcgtgaccgtgggcgagagctacagaagcagaagcaccctgggccacagcagaagccactggagccagggcagcagcagccacgccagcagaccccaggagcccagaaacagaagcagaatcagcaccgtgatccagcccctgagacagaacgccgccgaggtggtggacctgaccgtggacgaggacgagcccaccgtggtgcccaccaccagcgccagaatggagagccaggccaccagcgccagcatcaacaacagcaaccccagcaccagcgagcaggccagcgacaccgccagcgccgtgaccagcagccagcccagcaccgtgagcgagaccagcgccaccctgaccagcaacagcaccaccggcaccagcatcggcgacgacagcagaagaaccaccagcagcgccgtgaccgagaccggcccccccgccatgcccagactgcccagctgctgcccccagcacagcccctgcggcggcagcagccagaaccaccacgccctgggccacccccacaccagctgcttccagcagcacggccaccacttccagcaccaccaccaccaccaccacaccccccaccccgccgtgcccgtgagccccagcttcagcgaccccgcctgccccgtggagagacccccccaggtgcaggccccctgcggcgccaacagcagcagcggcaccagctaccacgagcagcaggccctgcccgtggacctgagcaacagcggcatcagaagccacggcagcggcagcttccacggcgccagcgccttcgacccctgctgccccgtgagcagcagcagagccgccatcttcggccaccaggccgccgccgccgcccccagccagcccctgagcagcatcgacggctacggcagcagcatggtggcccagccccagccccagccccccccccagcccagcctgagcagctgcagacactacatgccccccccctacgccagcctgaccagacccctgcaccaccaggccagcgcctgcccccacagccacggcaacccccccccccagacccagccccccccccaggtggactacgtgatcccccaccccgtgcacgccttccacagccagatcagcagccacgccaccagccaccccgtggccccccccccccccacccacctggccagcaccgccgcccccatcccccagcacctgccccccacccaccagcccatcagccaccacatccccgccaccgccccccccgcccagagactgcacccccacgaggtgatgcagagaatggaggtgcagagaagaagaatgatgcagcaccccaccggcctgttcgtgttctgcgtgagcagaagagcccacgagagaccccccccccacccccacagaatgcaccccaactacggccacggccaccacatccacgtgccccagaccatgagcagccaccccagacaggcccccgagagaagcgcctgggagctgggcatcgaggccggcgtgaccgccgccacctacacccccggcgccctgcacccccacctggcccactaccacgccccccccagactgcaccacctgcagctgggcgccctgcccctgatggtgcccgacatggccggctacccccacatcagatacatcagcagcggcctggacggcaccagcttcagaggccccttcagaggcaacttcgaggagctgatccacctggaggagagactgggcaacgtgaacagaggcgccagccagggcaccatcgagagatgcacctacccccacaagtacaagaagagaaagctgcactgcaagcaggacggcgaggagggcaccgaggaggacaccgaggagaagtgcaccatctgcctgagcatcctggaggagggcgaggacgtgagaagactgccctgcatgcacctgttccaccaggtgtgcgtggaccagtggctgatcaccaacaagaagtgccccatctgcagagtggacatcgaggcccagctgcccagcgagagctag

SEQ ID NO: 13657 - DNA, 1851 bp, Artificial Sequence
  Description of Artificial Sequence: Synthetic coding sequence
atggccggcggcagaggcgcccccggcagaggcagagacgagccccccgagagctacccccagagacaggaccacgagctgcaggccctggaggccatctacggcgccgacttccaggacctgagacccgacgcctgcggccccgtgaaggagccccccgagatcaacctggtgctgtacccccagggcctgaccggcgaggaggtgtacgtgaaggtggacctgagagtgaagtgcccccccacctaccccgacgtggtgcccgagatcgagctgaagaacgccaagggcctgagcaacgagagcgtgaacctgctgaagagcagactggaggagctggccaagaagcactgcggcgaggtgatgatcttcgagctggcctaccacgtgcagagcttcctgagcgagcacaacaagcccccccccaagagcttccacgaggagatgctggagagaagagcccaggaggagcagcagagactgctggaggccaagagaaaggaggagcaggagcagagagagatcctgcacgagatccagagaagaaaggaggagatcaaggaggagaagaagagaaaggagatggccaagcaggagagactggagatcgccagcctgagcaaccaggaccacaccagcaagaaggaccccggcggccacagaaccgccgccatcctgcacggcggcagccccgacttcgtgggcaacggcaagcacagagccaacagcagcggcagaagcagaagagagagacagtacagcgtgtgcaacagcgaggacagccccggcagctgcgagatcctgtacttcaacatgggcagccccgaccagctgatggtgcacaagggcaagtgcatcggcagcgacgagcagctgggcaagctggtgtacaacgccctggagaccgccaccggcggcttcgtgctgctgtacgagtgggtgctgcagtggcagaagaagatgggccccttcctgaccagccaggagaaggagaagatcgacaagtgcaagaagcagatccagggcaccgagaccgagttcaacagcctggtgaagctgagccaccccaacgtggtgagatacctggccatgaacctgaaggagcaggacgacagcatcgtggtggacatcctggtggagcacatcagcggcgtgagcctggccgcccacctgagccacagcggccccatccccgtgcaccagctgagaagatacaccgcccagctgctgagcggcctggactacctgcacagcaacagcgtggtgcacaaggtgctgagcgccagcaacgtgctggtggacgccgagggcaccgtgaagatcaccgactacagcatcagcaagagactggccgacatctgcaaggaggacgtgttcgagcagaccagagtgagattcagcgacaacgccctgccctacaagaccggcaagaagggcgacgtgtggagactgggcctgctgctgctgagcctgagccagggccaggagtgcggcgagtaccccgtgaccatccccagcgacctgcccgccgacttccaggacttcctgaagaagtgcgtgtgcctggacgacaaggagagatggagcccccagcagctgctgaagcacagcttcatcaacccccagcccaagatgcccctggtggagcagagccccgaggacagcgagggccaggactacgtggagaccgtgatccccagcaacagactgcccagcgccgccttcttcagcgagacccagagacagttcagcagatacttcatcgagttcgaggagctgcagctgctgggcaagggcgccttcggcgccgtgatcaaggtgtggtacagagtgatccccagccccctgtag

SEQ ID NO: 13658 - DNA, 396 bp, Artificial Sequence
  Description of Artificial Sequence: Synthetic coding sequence
atgagccagtggacccccgagtacaacgagctgtacaccctgaaggtggacatgaagagcgagatccccagcgacgcccccaagacccaggagagcctgaagggcatcctgctgcaccccgagcccatcggcgccgccaagagcttccccgccggcgtggagatgatcaacagcaaggtgggcaacgagttcagccacctgtgcgacgacagccagaagcaggagaaggagatgaacggcaaccagcaggagcaggagaagagcctggtggtgagaaagaagagaaagagccagcaggccggccccagctacgtgcagaactgcgtgaaggagaaccagggcatcctgggcctgagacagcacctgggcacccccagcgacgaggacaacgactag

SEQ ID NO: 13659 - DNA, 1863 bp, Artificial Sequence
  Description of Artificial Sequence: Synthetic coding sequence
atggcccccgacagcgaccccttccccgagggccccctgctgaagctgctgcccctggacgccagagacagaggcacccagagatgcagactgggccccgccgccctgcacgccctgggcgccagactgggcagcgccgtgaagatcagcctgcccgacggcggcagctgcctgtgcaccgcctggcccagaagagacggcgccgacggcttcgtgcagctggaccccctgtgcgccagccccggcgccgccgtgggcgccagcagaagcagaagaagcctgagcctgaacagactgctgctggtgccctgcccccccctgagaagagtggccgtgtggcccgtgctgagagagagagccggcgcccccggcgccagaaacaccgccgccgtgctggaggccgcccaggagctgctgagaaacagacccatcagcctgggccacgtggtggtggccccccccggcgcccccggcctggtggccgccctgcacatcgtgggcggcacccccagccccgaccccgccggcctggtgacccccagaaccagagtgagcctgggcggcgagccccccagcgaggcccagccccagcccgaggtgcccctgggcggcctgagcgaggccgccgacagcctgagagagctgctgagactgcccctgagataccccagagccctgaccgccctgggcctggccgtgcccagaggcgtgctgctggccggcccccccggcgtgggcaagacccagctggtgagagccgtggccagagaggccggcgccgagctgctggccgtgagcgcccccgccctgcagggcagcagacccggcgagaccgaggagaacgtgagaagagtgttccagagagccagagagctggccagcagaggccccagcctgctgttcctggacgagatggacgccctgtgcccccagagaggcagcagagcccccgagagcagagtggtggcccaggtgctgaccctgctggacggcgccagcggcgacagagaggtggtggtggtgggcgccaccaacagacccgacgccctggaccccgccctgagaagacccggcagattcgacagagaggtggtgatcggcacccccaccctgaagcagagaaaggagatcctgcaggtgatcaccagcaagatgcccatcagcagccacgtggacctgggcctgctggccgagatgaccgtgggctacgtgggcgccgacctgaccgccctgtgcagagaggccgccatgcacgccctgctgcacagcgagaagaaccaggacaaccccgtgatcgacgagatcgacttcctggaggccttcaagaacatccagcccagcagcttcagaagcgtgatcggcctgatggacatcaagcccgtggactgggaggagatcggcggcctggaggacgtgaagctgaagctgaagcagagcatcgagtggcccctgaagttcccctgggagttcgtgagaatgggcctgacccagcccaagggcgtgctgctgtacggcccccccggctgcgccaagaccaccctggtgagagccctggccaccagctgccactgcagcttcgtgagcgtgagcggcgccgacctgttcagccccttcgtgggcgacagcgagaaggtgctgagccagatcttcagacaggccagagccagcacccccgccatcctgttcctggacgagatcgacagcatcctgggcgccagaagcgccagcaagaccggctgcgacgtgcaggagagagtgctgagcgtgctgctgaacgagctggacggcgtgggcctgaagaccatcgagagaagaggcagcaagagcagccagcagggcaagtacaaggagctgaagaagtag

SEQ ID NO: 13660 - DNA, 4767 bp, Artificial Sequence; identical to SEQ ID NO: 10006
  Description of Artificial Sequence: Synthetic coding sequence

SEQ ID NO: 13661 - DNA, 63 bp, Artificial Sequence
  Description of Artificial Sequence: Synthetic coding sequence
atggccaccatgatcccccccgtgaagctgaagtggctggagcacctgaacagcagctggtag

SEQ ID NO: 13662 - DNA, 4389 bp, Artificial Sequence
  Description of Artificial Sequence: Synthetic coding sequence
atgtaccagcccgaggacgacaacaacagcgacgtgaccagcgacgacgacatgaccagaaacagaagagagagcagccccccccacagcgtgcacagcttcagcgacagagactgggacagaagaggcagaagcagagacatggagcccagagacagatggagccacaccagaaaccccagaagcagaatgccccccagagacctgagcctgcccgtggtggccaagaccagcttcgagatggacagagaggacgacagagacagcagagcctacgagagcagaagccaggacgccgagagctaccagaacgtggtggacctggccgaggacagaaagccccacaacaccatccaggacaacatggagaactacagaaagctgctgagcctggtgcagctggccgaggacgacggccacagccacatgacccagggccacagcagcagaagcaagagaagcgcctaccccagcaccagcagaggcctgaagaccatgcccgaggccaagaagagcacccacagaagaggcatctgcgaggacgagagcagccacggcgtgatcatggagaagttcatcaaggacgtgagcagaagcagcaagagcggcagagccagagagagcagcgacagaagccagagattccccagaatgagcgacgacaactggaaggacatcagcctgaacaagagagagagcgtgatccagcagagagtgtacgagggcaacgccttcagaggcggcttcagattcaacagcaccctggtgagcagaaagagagtgctggagagaaagagaagataccacttcgacaccgacggcaagggcagcatccacgaccagaagggctgccccagaaagaagcccttcgagtgcggcagcgagatgagaaaggccatgagcgtgagcagcctgagcagcctgagcagccccagcttcaccgagagccagcccatcgacttcggcgccatgccctacgtgtgcgacgagtgcggcagaagcttcagcgtgatcagcgagttcgtggagcaccagatcatgcacaccagagagaacctgtacgagtacggcgagagcttcatccacagcgtggccgtgagcgaggtgcagaagagccaggtgggcggcaagagattcgagtgcaaggactgcggcgagaccttcaacaagagcgccgccctggccgagcacagaaagatccacgccagaggctacctggtggagtgcaagaaccaggagtgcgaggaggccttcatgcccagccccaccttcagcgagctgcagaagatctacggcaaggacaagttctacgagtgcagagtgtgcaaggagaccttcctgcacagcagcgccctgatcgagcaccagaagatccacttcggcgacgacaaggacaacgagagagagcacgagagagagagagagagagagagaggcgagaccttcagacccagccccgccctgaacgagttccagaagatgtacggcaaggagaagatgtacgagtgcaaggtgtgcggcgagaccttcctgcacagcagcagcctgaaggagcaccagaagatccacaccagaggcaaccccttcgagaacaagggcaaggtgtgcgaggagaccttcatccccggccagagcctgaagagaagacagaagacctacaacaaggagaagctgtgcgacttcaccgacggcagagacgccttcatgcagagcagcgagctgagcgagcaccagaagatccacagcagaaagaacctgttcgagggcagaggctacgagaagagcgtgatccacagcggccccttcaccgagagccagaagagccacaccatcaccagacccctggagagcgacgaggacgagaaggccttcaccatcagcagcaacccctacgagaaccagaagatccccaccaaggagaacgtgtacgaggccaagagctacgagagaagcgtgatccacagcctggccagcgtggaggcccagaagagccacagcgtggccggccccagcaagcccaaggtgatggccgagagcaccatccagagcttcgacgccatcaaccaccagagagtgagagccggcggcaacaccagcgagggcagagagtacagcagaagcgtgatccacagcctggtggccagcaagccccccagaagccacaacggcaacgagctggtggagagcaacgagaagggcgagagcagcatctacatcagcgacctgaacgacaagagacagaagatccccgccagagagaacccctgcgagggcggcagcaagaacagaaactacgaggacagcgtgatccagagcgtgttcagagccaagccccagaagagcgtgcccggcgagggcagcggcgagttcaagaaggacggcgagttcagcgtgcccagcagcaacgtgagagagtaccagaaggccagagccaagaagaagtacatcgagcacagaagcaacgagaccagcgtgatccacagcctgcccttcggcgagcagaccttcagacccagaggcatgctgtacgagtgccaggagtgcggcgagtgcttcgcccacagcagcgacctgaccgagcaccagaagatccacgacagagagaagcccagcggcagcagaaactacgagtggagcgtgatcagaagcctggcccccaccgacccccagaccagctacgcccaggagcagtacgccaaggagcaggccagaaacaagtgcaaggacttcagacagttcttcgccaccagcgaggacctgaacaccaaccagaagatctacgaccaggagaagagccacggcgaggagagccagggcgagaacaccgacggcgaggagacccacagcgaggagacccacggccaggagaccatcgaggaccccgtgatccagggcagcgacatggaggacccccagaaggacgaccccgacgacaagatctacgagtgcgaggactgcggcctgggcttcgtggacctgaccgacctgaccgaccaccagaaggtgcacagcagaaagtgcctggtggacagcagagagtacacccacagcgtgatccacacccacagcatcagcgagtaccagagagactacaccggcgagcagctgtacgagtgccccaagtgcggcgagagcttcatccacagcagcttcctgttcgagcaccagagaatccacgagcaggaccagctgtacagcatgaagggctgcgacgacggcttcatcgccctgctgcccatgaagcccagaagaaacagagccgccgagagaaaccccgccctggccggcagcgccatcagatgcctgctgtgcggccagggcttcatccacagcagcgccctgaacgagcacatgagactgcacagagaggacgacctgctggagcagagccagatggccgaggaggccatcatccccggcctggccctgaccgagttccagagaagccagaccgaggagagactgttcgagtgcgccgtgtgcggcgagagcttcgtgaaccccgccgagctggccgaccacgtgaccgtgcacaagaacgagccctacgagtacggcagcagctacacccacaccagcttcctgaccgagcccctgaagggcgccatccccttctacgagtgcaaggactgcggcaagagcttcatccacagcaccgtgctgaccaagcacaaggagctgcacctggaggaggaggaggaggacgaggccgccgccgccgccgccgccgccgcccaggaggtggaggccaacgtgcacgtgccccaggtggtgctgagaatccagggcctgaacgtggaggccgccgagcccgaggtggaggccgccgagcccgaggtggaggccgccgagcccgaggtggaggccgccgagcccaacggcgaggccgagggccccgacggcgaggccgccgagcccatcggcgaggccggccagcccaacggcgaggccgagcagcccaacggcgacgccgacgagcccgacggcgccggcatcgaggaccccgaggagagagccgaggagcccgagggcaaggccgaggagcccgagggcgacgccgacgagcccgacggcgtgggcatcgaggaccccgaggagggcgaggaccaggagatccaggtggaggagccctactacgactgccacgagtgcaccgagaccttcaccagcagcaccgccttcagcgagcacctgaagacccacgccagcatgatcatcttcgagcccgccaacgccttcggcgagtgcagcggctacatcgagagagccagcaccagcaccggcggcgccaaccaggccgacgagaagtacttcaagtgcgacgtgtgcggccagctgttcaacgacagactgagcctggccagacaccagaacacccacaccggctag

SEQ ID NO: 13663 - DNA, 438 bp, Artificial Sequence
  Description of Artificial Sequence: Synthetic coding sequence
atggccaccatgatcccccccgtgaagctgaagtggctggagcacctgaacagcagctggatcaccgaggacagcgagagcatcgccaccagagagggcgtggccgtgctgtacagcaagctggtgagcaacaaggaggtggtgcccctgccccagcaggtgctgtgcctgaagggcccccagctgcccgacttcgagagagagagcctgagcagcgacgagcaggaccactacctggacgccctgctgagcagccagctggccctggccaagatggtgtgcagcgacagccccttcgccggcgccctgagaaagagactgctggtgctgcagagagtgttctacgccctgagcaacaagtaccacgacaagggcaaggtgaagcagcagcagcacagccccgagagcagcagcggcagcgccgacgtgcacagctag

SEQ ID NO: 13664 - DNA, 4284 bp, Artificial Sequence
  Description of Artificial Sequence: Synthetic coding sequence
tgagccaagcaggagagactggagatcgccagcctgagcaaccaggaccacaccagcaagaaggaccccggcggccacagaaccgccgccatcctgcacggcggcagccccgacttcgtgggcaacggcaagcacagagccaacagcagcggcagaagcagaagagagagacagtacagcgtgtgcaacagcgaggacagccccggcagctgcgagatcctgtacttcaacatgggcagccccgaccagctgatggtgcacaagggcaagtgcatcggcagcgacgagcagctgggcaagctggtgtacaacgccctggagaccgccaccggcggcttcgtgctgctgtacgagtgggtgctgcagtggcagaagaagatgggccccttcctgaccagccaggagaaggagaagatcgacaagtgcaagaagcagatccagggcaccgagaccgagttcaacagcctggtgaagctgagccaccccaacgtggtgagatacctggccatgaacctgaaggagcaggacgacagcatcgtggtggacatcctggtggagcacatcagcggcgtgagcctggccgcccacctgagccacagcggccccatccccgtgcaccagctgagaagatacaccgcccagctgctgagcggcctggactacctgcacagcaacagcgtggtgcacaaggtgctgagcgccagcaacgtgctggtggacgccgagggcaccgtgaagatcaccgactacagcatcagcaagagactggccgacatctgcaaggaggacgtgttcgagcagaccagagtgagattcagcgacaacgccctgccctacaagaccggcaagaagggcgacgtgtggagactgggcctgctgctgctgagcctgagccagggccaggagtgcggcgagtaccccgtgaccatccccagcgacctgcccgccgacttccaggacttcctgaagaagtgcgtgtgcctggacgacaaggagagatggagcccccagcagctgctgaagcacagcttcatcaacccccagcccaagatgcccctggtggagcagagccccgaggacagcgagggccaggactacgtggagaccgtgatccccagcaacagactgcccagcgccgccttcttcagcgagacccagagacagttcagcagatacttcatcgagttcgaggagctgcagctgctgggcaagggcgccttcggcgccgtgatcaaggtgcagaacaagctggacggctgctgctacgccgtgaagagaatccccatcaaccccgccagcagacagttcagaagaatcaagggcgaggtgaccctgctgagcagactgcaccacgagaacatcgtgagatactacaacgcctggatcgagagacacgagagacccgccggccccggcacccccccccccgacagcggccccctggccaaggacgacagagccgccagaggccagcccgccagcgacaccgacggcctggacagcgtggaggccgccgcccccccccccatcctgagcagcagcgtggagtggagcaccagcggcgagagaagcgccagcgccagattccccgccaccggccccggcagcagcgacgacgaggacgacgacgaggacgagcacggcggcgtgttcagccagagcttcctgcccgccagcgacagcgagagcgacatcatcttcgacaacgaggacgagaacagcaagagccagaaccagatggagtactgcgagaagagcaccctgagagacaccatcgaccagggcctgtacagagacaccgtgagactgtggagactgttcagagagatcctggacggcctggcctacatccacgagaagggcatgatccacagagacctgaagcccgtgaacatcttcctggacagcgacgaccacgtgaagatcggcgacttcggcctggccaccgaccacctggccttcagcgccgacagcaagcaggacgaccagaccggcgacctgatcaagagcgaccccagcggccacctgaccggcatggtgggcaccgccctgtacgtgagccccgaggtgcagggcagcaccaagagcgcctacaaccagaaggtggacctgttcagcctgggcatcatcttcttcgagatgagctaccaccccatggtgaccgccagcgagagaatcttcgtgctgaaccagctgagagaccccaccagccccaagttccccgaggacttcgacgacggcgagcacgccaagcagaagagcgtgatcagctggctgctgaaccacgaccccgccaagagacccaccgccaccgagctgctgaagagcgagctgctgccccccccccagatggaggagagcgagctgcacgaggtgctgcaccacaccctgaccaacgtggacggcaaggcctacagaaccatgatggcccagatcttcagccagagaatcagccccgccatcgactacacctacgacagcgacatcctgaagggcaacttcagcatcagaaccgccaagatgcagcagcacgtgtgcgagaccatcatcagaatcttcaagagacacggcgccgtgcagctgtgcacccccctgctgctgcccagaaacagacagatctacgagcacaacgaggccgccctgttcatggaccacagcggcatgctggtgatgctgcccttcgacctgagaatccccttcgccagatacgtggccagaaacaacatcctgaacctgaagagatactgcatcgagagagtgttcagacccagaaagctggacagattccaccccaaggagctgctggagtgcgccttcgacatcgtgaccagcaccaccaacagcttcctgcccaccgccgagatcatctacaccatctacgagatcatccaggagttccccgccctgcaggagagaaactacagcatctacctgaaccacaccatgctgctgaaggccatcctgctgcactgcggcatccccgaggacaagctgagccaggtgtacatcatcctgtacgacgccgtgaccgagaagctgaccagaagagaggtggaggccaagttctgcaacctgagcctgagcagcaacagcctgtgcagactgtacaagttcatcgagcagaagggcgacctgcaggacctgatgcccaccatcaacagcctgatcaagcagaagaccggcatcgcccagctggtgaagtacggcctgaaggacctggaggaggtggtgggcctgctgaagaagctgggcatcaagctgcaggtgctgatcaacctgggcctggtgtacaaggtgcagcagcacaacggcatcatcttccagttcgtggccttcatcaagagaagacagagagccgtgcccgagatcctggccgccggcggcagatacgacctgctgatcccccagttcagaggcccccaggccctgggccccgtgcccaccgccatcggcgtgagcatcgccatcgacaagatcagcgccgccgtgctgaacatggaggagagcgtgaccatcagcagctgcgacctgctggtggtgagcgtgggccagatgagcatgagcagagccatcaacctgacccagaagctgtggaccgccggcatcaccgccgagatcatgtacgactggagccagagccaggaggagctgcaggagtactgcagacaccacgagatcacctacgtggccctggtgagcgacaaggagggcagccacgtgaaggtgaagagcttcgagaaggagagacagaccgagaagagagtgctggagaccgagctggtggaccacgtgctgcagaagctgagaaccaaggtgaccgacgagagaaacggcagagaggccagcgacaacctggccgtgcagaacctgaagggcagcttcagcaacgccagcggcctgttcgagatccacggcgccaccgtggtgcccatcgtgagcgtgctggcccccgagaagctgagcgccagcaccagaagaagatacgagacccaggtgcagaccagactgcagaccagcctggccaacctgcaccagaagagcagcgagatcgagatcctggccgtggacctgcccaaggagaccatcctgcagttcctgagcctggagtgggacgccgacgagcaggccttcaacaccaccgtgaagcagctgctgagcagactgcccaagcagagatacctgaagctggtgtgcgacgagatctacaacatcaaggtggagaagaaggtgagcgtgctgttcctgtacagctacagagacgactactacagaatcctgttctag

SEQ ID NO: 13665 - DNA, 4767 bp, Artificial Sequence; identical to SEQ ID NO: 10006
  Description of Artificial Sequence: Synthetic coding sequence

SEQ ID NO: 13666 - DNA, 3012 bp, Artificial Sequence; identical to SEQ ID NO: 12204
  Description of Artificial Sequence: Synthetic coding sequence

SEQ ID NO: 13667 - DNA, 150 bp, Artificial Sequence
  Description of Artificial Sequence: Synthetic coding sequence
atggccctgccccacgacagcaacgagaccagctacctgctgccccccaacaacgaggactggggcagacagaccatccccgacttcgtgtacggccagaaggacctgatggccgagggcatccagtggcccagaaacgcccccggctag

SEQ ID NO: 13668 - DNA, 375 bp, Artificial Sequence; identical to SEQ ID NO: 10236
  Description of Artificial Sequence: Synthetic coding sequence

SEQ ID NO: 13669 - DNA, 93 bp, Artificial Sequence
  Description of Artificial Sequence: Synthetic coding sequence
atggccaccgacagctgggccctggccgtggacgagcaggaggccgccgccgagagcagaaccgagctgcccagcccctacagcaccagctag

SEQ ID NO: 13670 - DNA, 804 bp, Artificial Sequence; identical to SEQ ID NO: 12088
  Description of Artificial Sequence: Synthetic coding sequence

SEQ ID NO: 13671 - DNA, 1113 bp, Artificial Sequence; identical to SEQ ID NO: 11344
  Description of Artificial Sequence: Synthetic coding sequence

SEQ ID NO: 13672 - DNA, 2712 bp, Artificial Sequence
  Description of Artificial Sequence: Synthetic coding sequence
atggccaccagcgccgacagccccagcagccccctgggcgccgaggacctgctgagcgacagcagcgagccccccggcctgaaccaggtgagcagcgaggtgaccagccagctgtacgccagcctgagactgagcagacaggccgaggccaccgccagagcccagctgtacctgcccagcaccagccccccccacgagggcctggacggcttcgcccaggagctgagcagaagcctgagcgtgggcctggagaagaacctgaagaagaaggacggcagcaagcacatcttcgagatggagagcgtgagaggccagctgcagaccatgctgcagaccagcagagacaccgcctacagagaccccctgatccccggcgccggcagcgagagaagagaggaggacagcttcgacagcgacagcaccgccaccctgctgaacaccagacccctgcaggacctgagccccagcagcagcgcccaggccctggaggagctgttccccagatacaccagcctgagacccggcccccccctgaacccccccgacttccagggcctgagagacgccctggacagcgagcacaccagaagaaagcactgcgagagacacatccagagcctgcagaccagagtgctggagctgcagcagcagctggccgtggccgtggccgccgacagaaagaaggacaccatgatcgagcagctggacaagaccctggccagagtggtggagggctggaacagacacgaggccgagagaaccgaggtgctgagaggcctgcaggaggagcaccaggccgccgagctgaccagaagcaagcagcaggagaccgtgaccagactggagcagagcctgagcgaggccatggaggccctgaacagagagcaggagagcgccagactgcagcagagagagagagagaccctggaggaggagagacaggccctgaccctgagactggaggccgagcagcagagatgctgcgtgctgcaggaggagagagacgccgccagagccggccagctgagcgagcacagagagctggagaccctgagagccgccctggaggaggagagacagacctgggcccagcaggagcaccagctgaaggagcactaccaggccctgcaggaggagagccaggcccagctggagagagagaaggagaagagccagagagaggcccaggccgcctgggagacccagcaccagctggccctggtgcagagcgaggtgagaagactggagggcgagctggacaccgccagaagagagagagacgccctgcagctggagatgagcctggtgcaggccagatacgagagccagagaatccagctggagagcgagctggccgtgcagctggagcagagagtgaccgagagactggcccaggcccaggagagcagcctgagacaggccgccagcctgagagagcaccacagaaagcagctgcaggacctgagcggccagcaccagcaggagctggccagccagctggcccagttcaaggtggagatggccgagagagaggagagacagcagcaggtggccgaggactacgagctgagactggccagagagcaggccagagtgtgcgagctgcagagcggcaaccagcagctggaggagcagagagtggagctggtggagagactgcaggccatgctgcaggcccactgggacgaggccaaccagctgctgagcaccaccctgcccccccccaacccccccgccccccccgccggccccagcagccccggcccccaggagcccgagaaggaggagagaagagtgtggaccatgccccccatggccgtggccctgaagcccgtgctgcagcagagcagagaggccagagacgagctgcccggcgccccccccgtgctgtgcagcagcagcagcgacctgagcctgctgctgggccccagcttccagagccagcacagcttccagcccctggagcccaagcccgacctgaccagcagcaccgccggcgccttcagcgccctgggcgccttccaccccgaccacagagccgagagacccttccccgaggaggaccccggccccgacggcgagggcctgctgaagcagggcctgccccccgcccagctggagggcctgaagaacttcctgcaccagctgctggagaccgtgccccagaacaacgagaaccccagcgtggacctgctgccccccaagagcggccccctgaccgtgcccagctgggaggaggccccccaggtgcccagaatccccccccccgtgcacaagaccaaggtgcccctggccatggccagcagcctgttcagagtgcccgagccccccagcagccacagccagggcagcggccccagcagcggcagccccgagagaggcggcgacggcctgaccttccccagacagctgatggaggtgagccagctgctgagactgtaccaggccagaggctggggcgccctgcccgccgaggacctgctgctgtacctgaagagactggagcacagcggcaccgacggcagaggcgacaacgtgcccagaagaaacaccgacagcagactgggcgagatccccagaaaggagatccccagccaggccgtgcccagaagactggccaccgcccccaagaccgagaagccccccgccagaaagaagagcggccaccccgcccccagcagcatgagaagcagaggcggcgtgtggagatag

SEQ ID NO: 13673 - DNA, 138 bp, Artificial Sequence
  Description of Artificial Sequence: Synthetic coding sequence
atgcccctgctggtggagggcagaagagtgagactgccccagagcgccggcgacctggtgagagcccacccccccctggaggcccccagccccttctgggtgctgatgatgcccctgctggtgaccctgtggagctag

SEQ ID NO: 13674 - DNA, 1083 bp, Artificial Sequence; identical to SEQ ID NO: 9805
  Description of Artificial Sequence: Synthetic coding sequence

SEQ ID NO: 13675 - DNA, 1353 bp, Artificial Sequence; identical to SEQ ID NO: 9393
  Description of Artificial Sequence: Synthetic coding sequence

SEQ ID NO: 13676 - DNA, 1113 bp, Artificial Sequence; identical to SEQ ID NO: 11344
  Description of Artificial Sequence: Synthetic coding sequence

SEQ ID NO: 13677 - DNA, 738 bp, Artificial Sequence
  Description of Artificial Sequence: Synthetic coding sequence
atgggcggcggctacgacctgaacctgttcgccagcccccccgacagcaacttcgtgtgcagcgtgtgccacggcgtgctgaagagacccgccagactgccctgcagccacatcttctgcaagaagtgcatcctgagatggctggccagacagaagacctgcccctgctgcagaaaggaggtgaagagaaagaaggtggtgcacatgaacaagctgagaaagaccatcggcagactggaggtgaagtgcaagaacgccgacgccggctgcatcgtgacctgccccctggcccacagaaagggccaccaggacagctgccccttcgagctgaccgcctgccccaacgagggctgcaccagccaggtgcccagaggcaccctggccgagcacagacagcactgccagcagggcagccagcagagatgccccctgggctgcggcgccaccctggaccccgccgagagagccagacacaactgctacagagagctgcacaacgcctggagcgtgagacaggagagaagaagacccctgctgctgagcctgctgagaagagtgagatggctggaccaggccaccagcgtggtgagaagagagctggccgagctgagcaacttcctggaggaggacaccgccctgctggagggcgccccccaggaggaggccgaggccgcccccgagggcaacgtgggcgccgaggtggtgggcgagcccagagccaacatcccctgcaagtag

SEQ ID NO: 13678 - DNA, 309 bp, Artificial Sequence; identical to SEQ ID NO: 10517
  Description of Artificial Sequence: Synthetic coding sequence

SEQ ID NO: 13679 - DNA, 1473 bp, Artificial Sequence; identical to SEQ ID NO: 11468
  Description of Artificial Sequence: Synthetic coding sequence

SEQ ID NO: 13680 - DNA, 1809 bp, Artificial Sequence; identical to SEQ ID NO: 10212
  Description of Artificial Sequence: Synthetic coding sequence

SEQ ID NO: 13681 - DNA, 618 bp, Artificial Sequence; identical to SEQ ID NO: 11163
  Description of Artificial Sequence: Synthetic coding sequence

SEQ ID NO: 13682 - DNA, 360 bp, Artificial Sequence; identical to SEQ ID NO: 10375
  Description of Artificial Sequence: Synthetic coding sequence

SEQ ID NO: 13683 - DNA, 1473 bp, Artificial Sequence
  Description of Artificial Sequence: Synthetic coding sequence
atgcccatgcccaccgagggcacccccccccccctgagcggcacccccatccccgtgcccgcctacttcagacacgccgagcccggcttcagcctgaagagacccagaggcctgagcagaagcctgcccccccccccccccgccaagggcagcatccccatcagcagactgttcccccccagaacccccggctggcaccagctgcagcccagaagagtgagcttcagaggcgaggccagcgagaccctgcagagccccggctacgaccccagcagacccgagagcttcttccagcagagcttccagagactgagcagactgggccacggcagctacggcgaggtgttcaaggtgagaagcaaggaggacggcagactgtacgccgtgaagagaagcatgagccccttcagaggccccaaggacagagccagaaagctggccgaggtgggcagccacgagaaggtgggccagcacccctgctgcgtgagactggagcaggcctgggaggagggcggcatcctgtacctgcagaccgagctgtgcggccccagcctgcagcagcactgcgaggcctggggcgccagcctgcccgaggcccaggtgtggggctacctgagagacaccctgctggccctggcccacctgcacagccagggcctggtgcacctggacgtgaagcccgccaacatcttcctgggccccagaggcagatgcaagctgggcgacttcggcctgctggtggagctgggcaccgccggcgccggcgaggtgcaggagggcgaccccagatacatggcccccgagctgctgcagggcagctacggcaccgccgccgacgtgttcagcctgggcctgaccatcctggaggtggcctgcaacatggagctgccccacggcggcgagggctggcagcagctgagacagggctacctgccccccgagttcaccgccggcctgagcagcgagctgagaagcgtgctggtgatgatgctggagcccgaccccaagctgagagccaccgccgaggccctgctggccctgcccgtgctgagacagcccagagcctggggcgtgctgtggtgcatggccgccgaggccctgagcagaggctgggccctgtggcaggccctgctggccctgctgtgctggctgtggcacggcctggcccaccccgccagctggctgcagcccctgggcccccccgccaccccccccggcagccccccctgcagcctgctgctggacagcagcctgagcagcaactgggacgacgacagcctgggccccagcctgagccccgaggccgtgctggccagaaccgtgggcagcaccagcacccccagaagcagatgcacccccagagacgccctggacctgagcgacatcaacagcgagccccccagaggcagcttccccagcttcgagcccagaaacctgctgagcctgttcgaggacaccctggaccccacctag

SEQ ID NO: 13684 - DNA, 1293 bp, Artificial Sequence
  Description of Artificial Sequence: Synthetic coding sequence
atgctggagagatggcaccagctgcagcccagaagagtgagcttcagaggcgaggccagcgagaccctgcagagccccggctacgaccccagcagacccgagagcttcttccagcagagcttccagagactgagcagactgggccacggcagctacggcgaggtgttcaaggtgagaagcaaggaggacggcagactgtacgccgtgaagagaagcatgagccccttcagaggccccaaggacagagccagaaagctggccgaggtgggcagccacgagaaggtgggccagcacccctgctgcgtgagactggagcaggcctgggaggagggcggcatcctgtacctgcagaccgagctgtgcggccccagcctgcagcagcactgcgaggcctggggcgccagcctgcccgaggcccaggtgtggggctacctgagagacaccctgctggccctggcccacctgcacagccagggcctggtgcacctggacgtgaagcccgccaacatcttcctgggccccagaggcagatgcaagctgggcgacttcggcctgctggtggagctgggcaccgccggcgccggcgaggtgcaggagggcgaccccagatacatggcccccgagctgctgcagggcagctacggcaccgccgccgacgtgttcagcctgggcctgaccatcctggaggtggcctgcaacatggagctgccccacggcggcgagggctggcagcagctgagacagggctacctgccccccgagttcaccgccggcctgagcagcgagctgagaagcgtgctggtgatgatgctggagcccgaccccaagctgagagccaccgccgaggccctgctggccctgcccgtgctgagacagcccagagcctggggcgtgctgtggtgcatggccgccgaggccctgagcagaggctgggccctgtggcaggccctgctggccctgctgtgctggctgtggcacggcctggcccaccccgccagctggctgcagcccctgggcccccccgccaccccccccggcagccccccctgcagcctgctgctggacagcagcctgagcagcaactgggacgacgacagcctgggccccagcctgagccccgaggccgtgctggccagaaccgtgggcagcaccagcacccccagaagcagatgcacccccagagacgccctggacctgagcgacatcaacagcgagccccccagaggcagcttccccagcttcgagcccagaaacctgctgagcctgttcgaggacaccctggaccccacctag

SEQ ID NO: 13685 - DNA, 666 bp, Artificial Sequence; identical to SEQ ID NO: 10386
  Description of Artificial Sequence: Synthetic coding sequence

SEQ ID NO: 13686 - DNA, 2232 bp, Artificial Sequence; identical to SEQ ID NO: 13489
  Description of Artificial Sequence: Synthetic coding sequence

SEQ ID NO: 13687 - DNA, 579 bp, Artificial Sequence
  Description of Artificial Sequence: Synthetic coding sequence
atgagcaccgccgccgtgcccgagctgaagcagatcagcagagtggaggccatgagactgggccccggctggagccacagctgccacgccatgctgtacgccgccaaccccggccagctgttcggcagaatccccatgagattcagcgtgctgatgcagatgagattcgacggcctgctgggcttccccggcggcttcgtggacagaagattctggagcctggaggacggcctgaacagagtgctgggcctgggcctgggctgcctgagactgaccgaggccgactacctgagcagccacctgaccgagggcccccacagagtggtggcccacctgtacgccagacagctgaccctggagcagctgcacgccgtggagatcagcgccgtgcacagcagagaccacggcctggaggtgggccccccccccggccccagacccccccccagaggcctggccctggccccctggaaggcccccatgggcgccggccccagagccggccccgccgtgcaccccgagggccccagcagaagactgccccagctgcccgagcagagactgagagagcacggctag

SEQ ID NO: 13688 - DNA, 2553 bp, Artificial Sequence
  Description of Artificial Sequence: Synthetic coding sequence
atgctggagagaagagccctgctgtggcagagagaggccggccccggctggggcgacagagccagagccggcaccggcggcgccggcggcggctgcggcggcgccatggccgagagaggccccgccttctgcggcctgtacgacaccagcagcctgctgagatactgcaacgacgacaacctgagcggcaccagcggcatggaggtggacgacagagtgagcgccctggagcagagactgcagctgcaggaggacgagctggccgtgctgaaggccgccctggccgacgccctgagaagactgagagcctgcgaggagcagggcgccgccctgagagccagaggcacccccaagggcagagccccccccagactgggcaccaccgccagcgtgtgccagctgctgaagggcctgcccaccagaacccccctgaacggcagcggcccccccagaagagtgggcggctacgccaccagccccagcagccccaagaaggaggccaccagcggcagaagcagcgtgagaagatacctgagccccgagagactggccagcgtgagaagagaggaccccagaagcagaaccaccagcagcagcagcaactgcagcgccaagaaggagggcaagaccaaggaggtgatcttcagcgtggaggacggcagcgtgaagatgttcctgagaggcagacccgtgcccatgatgatccccgacgagctggcccccacctacagcctggacaccagaagcgagctgcccagctgcagactgaagctggagtgggtgtacggctacagaggcagagactgcagagccaacctgtacctgctgcccaccggcgagatcgtgtacttcgtggccagcgtggccgtgctgtacagcgtggaggagcagagacagagacactacctgggccacaacgacgacatcaagtgcctggccatccaccccgacatggtgaccatcgccaccggccaggtggccggcaccaccaaggagggcaagcccctgcccccccacgtgagaatctgggacagcgtgagcctgagcaccctgcacgtgctgggcctgggcgtgttcgacagagccgtgtgctgcgtgggcttcagcaagagcaacggcggcaacctgctgtgcgccgtggacgagagcaacgaccacatgctgagcgtgtgggactgggccaaggagaccaaggtggtggacgtgaagtgcagcaacgaggccgtgctggtggccaccttccaccccaccgaccccaccgtgctgatcacctgcggcaagagccacatctacttctggaccctggagggcggcagcctgagcaagagacagggcctgttcgagaagcacgagaagcccaagtacgtgctgtgcgtgaccttcctggagggcggcgacgtggtgaccggcgacagcggcggcaacctgtacgtgtggggcaagggcggcaacagaatcacccaggccgtgctgggcgcccacgacggcggcgtgttcggcctgtgcgccctgagagacggcaccctggtgagcggcggcggcagagacagaagagtggtgctgtggggcagcgactacagcaagctgcaggaggtggaggtgcccgaggacttcggccccgtgagaaccgtggccgagggccacggcgacaccctgtacgtgggcaccaccagaaacagcatcctgcagggcagcgtgcacaccggcttcagcctgctggtgcagggccacgtggaggagctgtggggcctggccacccaccccagcagagcccagttcgtgacctgcggccaggacaagctggtgcacctgtggagcagcgacagccaccagcccctgtggagcagaatcatcgaggaccccgccagaagcgccggcttccaccccagcggcagcgtgctggccgtgggcaccgtgaccggcagatggctgctgctggacaccgagacccacgacctggtggccatccacaccgacggcaacgagcagatcagcgtggtgagcttcagccccgacggcgcctacctggccgtgggcagccacgacaacctggtgtacgtgtacaccgtggaccagggcggcagaaaggtgagcagactgggcaagtgcagcggccacagcagcttcatcacccacctggactgggcccaggacagcagctgcttcgtgaccaacagcggcgactacgagatcctgtactgggaccccgccacctgcaagcagatcaccagcgccgacgccgtgagaaacatggagtgggccaccgccacctgcgtgctgggcttcggcgtgttcggcatctggagcgagggcgccgacggcaccgacatcaacgccgtggccagaagccacgacggcaagctgctggccagcgccgacgacttcggcaaggtgcacctgttcagctacccctgctgccagcccagagccctgagccacaagtacggcggccacagcagccacgtgaccaacgtggccttcctgtgggacgacagcatggccctgaccaccggcggcaaggacaccagcgtgctgcagtggagagtggtgtag

SEQ ID NO: 13689 - DNA, 2502 bp, Artificial Sequence; identical to SEQ ID NO: 12300
  Description of Artificial Sequence: Synthetic coding sequence

SEQ ID NO: 13690 - DNA, 3351 bp, Artificial Sequence; identical to SEQ ID NO: 10541
  Description of Artificial Sequence: Synthetic coding sequence

SEQ ID NO: 13691 - DNA, 2055 bp, Artificial Sequence; identical to SEQ ID NO: 10439
  Description of Artificial Sequence: Synthetic coding sequence

SEQ ID NO: 13692 - DNA, 378 bp, Artificial Sequence
  Description of Artificial Sequence: Synthetic coding sequence
atggccgacgaggagctggaggccctgagaagacagagactggccgagctgcaggccaagcacggcgaccccggcgacgccgcccagcaggaggccaagcacagagaggccgagatgagaaacagcatcctggcccaggtgctggaccagagcgccagagccagactgagcaacctggccctggtgaagcccgagaagaccaaggccgtggagaactacctgatccagatggccagatacggccagctgagcgagaaggtgagcgagcagggcctgatcgagatcctgaagaaggtgagccagcagaccgagaagaccaccaccgtgaagttcaacagaagaaaggtgatggacagcgacgaggacgacgactactag

SEQ ID NO: 13693 - DNA, 3327 bp, Artificial Sequence; identical to SEQ ID NO: 10204
  Description of Artificial Sequence: Synthetic coding sequence

SEQ ID NO: 13694 - DNA, 594 bp, Artificial Sequence; identical to SEQ ID NO: 11983
  Description of Artificial Sequence: Synthetic coding sequence

SEQ ID NO: 13695 - DNA, 906 bp, Artificial Sequence; identical to SEQ ID NO: 10199
  Description of Artificial Sequence: Synthetic coding sequence

SEQ ID NO: 13696 - DNA, 990 bp, Artificial Sequence; identical to SEQ ID NO: 10497
  Description of Artificial Sequence: Synthetic coding sequence

SEQ ID NO: 13697 - DNA, 1263 bp, Artificial Sequence
  Description of Artificial Sequence: Synthetic coding sequence
atgctgagcagcttccccgtggtgctgctggagaccatgagccactacaccgacgagcccagattcaccatcgagcagatcgacctgctgcagagactgagaagaaccggcatgaccaagcacgagatcctgcacgccctggagaccctggacagactggaccaggagcacagcgacaagttcggcagaagaagcagctacggcggcagcagctacggcaacagcaccaacaacgtgcccgccagcagcagcaccgccaccgccagcacccagacccagcacagcggcatgagccccagccccagcaacagctacgacaccagcccccagccctgcaccaccaaccagaacggcagagagaacaacgagagactgagcaccagcaacggcaagatgagccccaccagataccacgccaacagcatgggccagagaagctacagcttcgaggccagcgaggaggacctggacgtggacgacaaggtggaggagctgatgagaagagacagcagcgtgatcaaggaggagatcaaggccttcctggccaacagaagaatcagccaggccgtggtggcccaggtgaccggcatcagccagagcagaatcagccactggctgctgcagcagggcagcgacctgagcgagcagaagaagagagccttctacagatggtaccagctggagaagaccaaccccggcgccaccctgagcatgagacccgcccccatccccatcgaggaccccgagtggagacagacccccccccccgtgagcgccaccagcggcaccttcagactgagaagaggcagcagattcacctggagaaaggagtgcctggccgtgatggagagctacttcaacgagaaccagtaccccgacgaggccaagagagaggagatcgccaacgcctgcaacgccgtgatccagaagcccggcaagaagctgagcgacctggagagagtgaccagcctgaaggtgtacaactggttcgccaacagaagaaaggagatcaagagaagagccaacatcgaggccgccatcctggagagccacggcatcgacgtgcagagccccggcggccacagcaacagcgacgacgtggacggcaacgactacagcgagcaggacgacagcaccagccacagcgaccaccaggaccccatcagcctggccgtggagatggccgccgtgaaccacaccatcctggccctggccagacagggcgccaacgagatcaagaccgaggccctggacgacgactag

SEQ ID NO: 13698 - DNA, 1263 bp, Artificial Sequence; identical to SEQ ID NO: 13697
  Description of Artificial Sequence: Synthetic coding sequence

SEQ ID NO: 13699 - DNA, 915 bp, Artificial Sequence
  Description of Artificial Sequence: Synthetic coding sequence
atgctgagcagcttccccgtggtgctgctggagaccatgagccactacaccgacgagcccagattcaccatcgagcagatcgacctgctgcagagactgagaagaaccggcatgaccaagcacgagatcctgcacgccctggagaccctggacagactggaccaggagcacagcgacaagttcggcagaagaagcagctacggcggcagcagctacggcaacagcaccaacaacgtgcccgccagcagcagcaccgccaccgccagcacccagacccagcacagcggcatgagccccagccccagcaacagctacgacaccagcccccagccctgcaccaccaaccagaacggcagagagaacaacgagagactgagcaccagcaacggcaagatgagccccaccagataccacgccaacagcatgggccagagaagctacagcttcgaggccagcgaggaggacctggacgtggacgacaaggtggaggagctgatgagaagagacagcagcgtgatcaaggaggagatcaaggccttcctggccaacagaagaatcagccaggccgtggtggcccaggtgaccggcatcagccagagcagaatcagccactggctgctgcagcagggcagcgacctgagcgagcagaagaagagagccttctacagatggtaccagctggagaagaccaaccccggcgccaccctgagcatgagacccgcccccatccccatcgaggaccccgagtggagacagacccccccccccgtgagcgccaccagcggcaccttcagactgagaagaggcagcagattcacctggagaaaggagtgcctggccgtgatggagagaaacacctggagccccgagagaagaatggaggagaacaagtggaagctgctgagcgccggctag

SEQ ID NO: 13700 - DNA, 1332 bp, Artificial Sequence
  Description of Artificial Sequence: Synthetic coding sequence
atgctgagcagcttccccgtggtgctgctggagaccatgagccactacaccgacgagcccagattcaccatcgagcagatcgacctgctgcagagactgagaagaaccggcatgaccaagcacgagatcctgcacgccctggagaccctggacagactggaccaggagcacagcgacaagttcggcagaagaagcagctacggcggcagcagctacggcaacagcaccaacaacgtgcccgccagcagcagcaccgccaccgccagcacccagacccagcacagcggcatgagccccagccccagcaacagctacgacaccagcccccagccctgcaccaccaaccagaacggcagagagaacaacgagagactgagcaccagcaacggcaagatgagccccaccagataccacgccaacagcatgggccagagaagctacagcttcgaggccagcgaggaggacctggacgtggacgacaaggtggaggagctgatgagaagagacagcagcgtgatcaaggaggagatcaaggccttcctggccaacagaagaatcagccaggccgtggtggcccaggtgaccggcatcagccagagcagaatcagccactggctgctgcagcagggcagcgacctgagcgagcagaagaagagagccttctacagatggtaccagctggagaagaccaaccccggcgccaccctgagcatgagacccgcccccatccccatcgaggaccccgagtggagacagacccccccccccgtgagcgccaccagcggcaccttcagactgagaagaggcagcagattcacctggagaaaggagtgcctggccgtgatggagagctacttcaacgagaaccagtaccccgacgaggccaagagagaggagatcgccaacgcctgcaacgccgtgatccagaagcccggcaagaagctgagcgacctggagagagtgaccagcctgaaggtgtacaactggttcgccaacagaagaaaggagatcaagagaagagccaacatcgccgccatcctggagagccacggcatcgacgtgcagagccccggcggccacagcaacagcgacgacgtggacggcaacgactacagcgagcaggacacctggcaggtgagaaacggcgaggaggaggagggcagaagcagcgagggcggcagagaggccgagaaggacgacagcaccagccacagcgaccaccaggaccccatcagcctggccgtggagatggccgccgtgaaccacaccatcctggccctggccagacagggcgccaacgagatcaagaccgaggccctggacgacgactag

SEQ ID NO: 13701 - DNA, 357 bp, Artificial Sequence
  Description of Artificial Sequence: Synthetic coding sequence
atgctgagcagcttccccgtggtgctgctggagaccatgagccactacaccgacgagcccagattcaccatcgagcagatcgacctgctgcagagactgagaagaaccggcatgaccaagcacgagatcctgcacgccctggagaccctggacagactggaccaggagcacagcgacaagttcggcagaagaagcagctacggcggcagcagctacggcaacagcaccaacaacgtgcccgccagcagcagcaccgccaccgccagcacccagacccagcacagcggcatgagccccagccccagcaacagctacgacaccagcccccagccctgcaccaccaaccagaacggctag

SEQ ID NO: 13702 - DNA, 1332 bp, Artificial Sequence; identical to SEQ ID NO: 13700
  Description of Artificial Sequence: Synthetic coding sequence

SEQ ID NO: 13703 - DNA, 1218 bp, Artificial Sequence
  Description of Artificial Sequence: Synthetic coding sequence
atgctgagcagcttccccgtggtgctgctggagaccatgagccactacaccgacgagcccagattcaccatcgagcagatcgacctgctgcagagactgagaagaaccggcatgaccaagcacgagatcctgcacgccctggagaccctggacagactggaccaggagcacagcgacaagttcggcagaagaagcagctacggcggcagcagctacggcaacagcaccaacaacgtgcccgccagcagcagcaccgccaccgccagcacccagacccagcacagcggcatgagccccagccccagcaacagctacgacaccagcccccagccctgcaccaccaaccagaacggcagagagaacaacgagagactgagcaccagcaacggcaagatgagccccaccagataccacgccaacagcatgggccagagaagctacagcttcgaggccagcgaggaggacctggacgtggacgacaaggtggaggagctgatgagaagagacagcagcgtgatcaaggaggagatcaaggccttcctggccaacagaagaatcagccaggccgtggtggcccaggtgaccggcatcagccagagcagaatcagccactggctgctgcagcagggcagcgacctgagcgagcagaagaagagagccttctacagatggtaccagctggagaagaccaaccccggcgccaccctgagcatgagacccgcccccatccccatcgaggaccccgagtggagacagacccccccccccgtgagcgccaccagcggcaccttcagactgagaagaggcagcagattcacctggagaaaggagtgcctggccgtgatggagagctacttcaacgagaaccagtaccccgacgaggccaagagagaggagatcgccaacgcctgcaacgccgtgatccagaagcccggcaagaagctgagcgacctggagagagtgaccagcctgaaggtgtacaactggttcgccaacagaagaaaggagatcaagagaagagccaacatcgccgccatcctggagagccacggcatcgacgtgcagagccccggcggccacagcaacagcgacgacgtggacggcaacgactacagcgagcaggacacctggcaggtgagaaacggcgaggaggaggagggcagaagcagcgagggcggcagagaggccgagaaggtggaggaggagagaagaatctag

SEQ ID NO: 13704 - DNA, 1380 bp, Artificial Sequence
  Description of Artificial Sequence: Synthetic coding sequence
atgacggccgaggagatgaaggcgacggaatctggtgcccagagtgcaccacttccaatggaaggagtcgatatatctccaaaacaggacgaaggcgtacttaaagtcatcaaacgagaaggcacaggtacagaaatgcctatgatcggagatagggtttttgtgcattacaccgggtggttactggatggcaccaaatttgacagtagcctcgaccggaaagacaaatttagtttcgatctgggaaaaggagaggttatcaaggcatgggacatcgcaatcgcaactatgaaagtcggtgaggtgtgtcatatcacttgtaaaccagagtacgcctatggaagcgccggcagcccccctaagatcccccccaacgctacgttggtttttgaagtggagctctttgagttcaagggagaagatctgactgaggaggaagacggcggcatcattcggcgcattcagacccgaggtgagggctatgccaaaccgaacgaaggcgctatcgtggaagtagccctggaggggtattataaggacaaacttttcgaccagagagaactccggttcgagatcggtgagggcgagaacctagacctcccctatggcctggagagggccatacagcgcatggaaaagggtgaacacagcatagtctacctgaaaccatcatatgctttcgggtcagtcggtaaggagaaattccagatcccacctaatgcagaactcaagtacgaactgcatctgaagtcattcgaaaaagctaaggaaagctgggaaatgaattctgaagagaagctagaacagtcaaccatcgtgaaggagagaggaacagtctatttcaaagagggaaagtacaagcaggcactgctgcagtacaagaaaatcgtaagctggcttgaatacgagtctagcttttccaatgaggaagctcagaaagcccaggcgttgcggctggcctcacaccttaatctggccatgtgccacctgaaactgcaggcgttttctgctgctattgagtcttgcaacaaggcccttgagctcgactccaataatgaaaagggcctcttccgaaggggtgaggcccatttagccgtcaacgattttgaactggcccgcgctgactttcagaaagtgctgcagctctatccaaataacaaggcagccaaaactcagctagcagtctgccaacagagaattaggcgacagctggctagagagaagaaactatacgcaaatatgtttgagaggctcgccgaggaagagaacaaagccaaggccgaagcctcgtctggcgatcaccccacagataccgaaatgaaagaggaacaaaagtctaatactgcagggtcacagtcacaggtggagacagaagcctag

SEQ ID NO: 13705 - DNA, 477 bp, Artificial Sequence
  Description of Artificial Sequence: Synthetic coding sequence
atggaaccacctgaaggagctggcacaggagagatcgtgaaagaggcggaagtcccgcaggctgccttgggagtcccagcccagggaacaggggataacggccacaccccagtggaagaagaggtcgggggtatccctgttcccgccccagggctgctccaggtgactgagcgaaggcagcctctgagtagtgtcagctcgcttgaggtgcattttgatttactggatctgaccgaactgactgacatgtcagatcaggaactggccgaagtattcgctgacagcgacgacgagaacctgaacaccgaatccccagctggcttgcatcccttacctcgcgctggttacctacgctccccttcatggacaagaacccgcgcggaacagtcgcatgaaaaacaacccctgggggacccggagcggcaggccaccgtccttgatacttttctaacggtggagagaccacaggaggattag

SEQ ID NO: 13706 - DNA, 954 bp, Artificial Sequence
  Description of Artificial Sequence: Synthetic coding sequence
atggcaagtgtgattccggcctctaacaggtccatgcgcagcgatcggaatacatacgttggcaagcgcttcgtccacgtgaagaacccctatctggatctcatggacgaggacatactgtaccacctcgacttagggactaagacgcacaacctccctgctatgtttggcgacgtgaagttcgtgtgtgtcggggggagcccaaatagaatgaaggctttcgcactgttcatgcataaggagctcggctttgaagaggccgaagaggacattaaggacatctgtgcagggactgacaggtactgtatgtacaagactgggccagttctggccatttcacacggcatgggcatcccttccatcagtatcatgctccatgaactgatcaaactgcttcatcatgccaggtgctgtgacgtgaccattatacgcattgggacctctgggggcatagggatcgctcccggaacagtggtgatcacagacatagcagtcgattcgttcttcaagccaagattcgagcaagtgatactcgacaacattgtcacgcggagcacagagctggataaggagctgagcgaggaactatttaactgctcaaaggagatccctaacttccctactctcgtgggtcatacgatgtgtacctacgacttttatgagggacaggggagactcgatggggctctgtgtagtttttctagggagaaaaagttggactatctgaagcgcgcttttaaagccggcgtccgtaatattgaaatggagtctactgtgtttgctgccatgtgtgggctgtgcggactcaaagcagctgttgtttgtgtgacgctcctcgatcggctggactgtgatcaaattaatctgccccatgacgtgctggtagagtaccaacaaagaccacagctcctgattagcaatttcatccggcgccgcctggggttgtgtgattag

SEQ ID NO: 13707 - DNA, 1095 bp, Artificial Sequence
  Description of Artificial Sequence: Synthetic coding sequence
atgtccgaagtggaagctgccgccggggccaccgccgtgccagctgctactgtgccggcaacagcggctggcgtcgtggcagtagtcgttcccgttccagcaggcgaaccccagaaggggggaggagcaggcggtggcggcggtgcagcgagtggacccgccgctgggacccctagcgcgcccggtagcagaacgcccggaaatccagcaacggccgttagcggcaccccggcaccccctgcccgctctcaggctgacaaacccgttctggcgattcaggtgcttggaacagtgaaatggtttaatgtcagaaatgggtacggcttcatcaataggaacgataccaaagaggacgtttttgttcaccaaaccgcaataaagcggaacaatccccgaaaattcctgcgttccgttggagacggcgagacagtggagtttgatgtggtggaaggcgagaagggcgcggaggctaccaatgttacaggaccagggggagtcccagtaaaaggctcccgctacgccccaaaccggcgtaagtcccgaaggttcataccacggcccccaagcgttgcaccaccacctatggtggcagagataccctcagcgggcaccggaccaggttccaagggcgaaagagccgaagactctggccagaggcccagacgctggtgtccacctcctttcttctaccgccggaggttcgttaggggtccaaggccccctaatcagcagcaacctatagaggggactgacagggtggagcccaaggagacagcacccttggagggccaccaacagcagggagacgagagagtgcctcccccacgattccgcccaaggtatcgtagaccttttcgccctagaccaagacagcaaccaacgacagaaggcggtgatggcgagacaaagccttcgcagggtccagccgacggctcccggcctgagccgcagaggccaaggaaccggccatactttcagagacgacgacagcaggctccaggcccccaacaggcaccaggccctagacagcccgcggcacctgaaacctcggcaccagtgaattcgggggatcccactacaaccatcctggaatag

SEQ ID NO: 13708 - DNA, 5706 bp, Artificial Sequence
  Description of Artificial Sequence: Synthetic coding sequence
atggcaacattcagaaataatcatatgaagacaaaagcgagtgtaagaaagtcgttttccgaggatgtcttccagtccgtgaagtccctgctgcagtcccagaaggagctgtgtagtgtgactgccgaagattgtctccaacaggacgagcacgcaaacctgacagaggtgaccttcttagggtttaacgaagagacagacgctgcccacattcaggacctggccgccgtgtccctagaactgccagacatccttaatagcctgcacttttgctcactgaatgaaaatgagattatttgtatgaagaacatcaataagccactggatattagttctgaccctttaaaccaatctcatccatcggggatgctgtgtgtaatgcgagtgtcccctaccagtccgcgcctgaggatcgatttcatcttttcactactgagcaagtacgccaccggcatccggtacaccctcgataccttcctgcatcagaagcaccagcttgaaacaacggacgaggacgatgacgataccaatcagagcgtttctagtatagaggacgactttgtcacagccttcgagcatttggaggaagaagaaactagtaaaccttacaacgatggtatgaacatcacagtcctccgctcccagtgtgatgccgcttcccagaccgtaaccggccatcacttggaaactcacgacctgaagatcctcatttcaagcggacaacagaagagtctggcaaaaccctccacaagtagcgtgaacgtgcttggccacaaagagctgccatcagttaagacatctgtgacaacctccatcagtgagccttggactcagagatctttctatcgttcaagcaatgcttctgataaagacagtgacctgcagaagacctttttcagctctagccccgcctacagctcagaaagcgagtgttcttccccctctcctgtcatcttcctcgacgaggaaggctaccagaagtccttaaaggccaagcttgaattacccaaaatccccgtgatgaaagatgacatcgaggatagcgatagtgaggtgtctgaatttttcgactctttcgaccagtttgatgagctcgagcaaacactggaaacctgcttgtttaataaagatcccgttatcgggaaaagctctcaaagaaaagggcacaaacatggaaaatcatgcatgaatccacagaagttcaagtttgacaggcccgccctgccggctaacgtccgtaaacccacccccaggaaacctgaaagcccatacggaaacctttgcgacgcccccgattcccctcggcccgtgaaggcgtcaagggaagattctggacttttctccccaatcaggagttcagcattctcccccctgggagggtgcacaccagctgagtgcttttgccagaccgatatcgggggcgaccggatacacgagaaccacgattctgtctattacacttacgaagactacgccaagtctatttcctgtgaggtgctggggtccgtgttaaggacacatcatactaatacattgtcgaacattaacagcattaaacatggcgagaataagacggttactttcaagcacggcaacctggaccaaaagaataagtccaagaacaagtcgttgatgatcaaggactcaatccagaaattcgccgccgacctggtggaaaaatcattcgggtccgcatttaaggacctgcagaagggcgtgagctcctgcaccaatgccctgtatcacctcgctatcaagctgacatcctcagtgctccagatggccttcgatgaattgagacgccagagggcattttctctgaaagaaagggccatcagtggtcttgctaatttcctggtctccgaagcactttcaaacgcactaaaagacctgcagtacgttaagaaacagatctttacaaatacggtagcgcggttcgccgctgacctcgctgaggaacttgttttcgagggcattatggaggtttgccagttcagctacccccagactccagctagccctcagtgtgggtcatttgattttgaggataaagtcgtcaaactgtatgccaaagatctctcagagtccgttatacaggaggcgttcatagagctgtcccaggtcgacgttacttttacaactaaggcagccgtctcagttagcactgataatattaagtatgtcagcgccgaatccgtggtgccttcgacccaggctgtgacattttctcctagcttccacaaccaggccattatggtgacgaagccagttcaagagtataagaaggaatataccgttcagcaggccctgttctgcacttctggtatcgtgacctctattccggttccgctcgccgggtccgctctcctgccttatcatatttccagcaccgcatgccaagccaaggcccacctatcatcagacgactccaattccaacggagactccgctcaagtgcatattgctactaaaaatcgtgaagaaaaagcagcctgcctcagaaacatatgcctaccatcagaacataaccccgggaaccagaacgactttaaacctaccaatgacgacatcgagatgcagtcttcaagcaaactcccaaacgatcccgctattattagtaatttttcagcagcggtcgtgcacacgatagtcaatgaaacgctggaatccatgacaagcttggaggtgacgaaaatggtcgacgagaggacagattatctaactaaatctctcaaggagaagaccccaccttttagtcactgtgatcaagctgttctgcagtgctctgaagccagctcaaataaagacatgttcgctgacagactgtccaagagcatcattaagcatagcattgataaaagcaagtcggttatacctaatatagataaaaatgctgtctacaaggaatctctgccggtgtccggggaagagtctcagctgaccccagaaaagagtcctaaattccctgacagccagaaccagctcacacattgctccctttctgcagccaaggattgcgtcccagagtgtaaagtgagtatggtgcacggatcctctttagagacgctcccgagttgcccagcggtgactggacagaagtcagatctgaaagaatcagccaaggatcagcctttgaagaagcataacttgaattcaacctcgctggaggcgctctcattcggccaagaaaaccctttccctcactcgcatacttttagctctaccgccttgacatgtgtcgatggtctccacgtcgaggacaagcagaaggtaagagaccgcaacgttatccccgatacgcctccttctacccctttggtacccagtcgcgcatcctctgagtgggatatcaaaaaactgactaaaaagttgaagggcgagctggctaaggaatttgctccggccacccccccttccacacctcataacagcagcgtcgggtccctctccgagaacgagcagaacacgatagagaaagaggagtttatgctgaagctgatgcgaagcttatccgaagaggtcgagagttcagaatcaggagaactgccagaagtcgacgtgaagagtgaacactccggcaagaaagtgcaattcgcggaagctctggcaacacacatcctgtccttggccactgagatggcggcctcccatctggataacaaaatcatccaggaaccaaaagttaagaacccctgcctgaatgtacaatcccagcggtcagtctcaccaacattcctcaatcctagtgacgaaaacctaaagactctctgtaattttgctggagacttggccgcagaggtgattaccgaggctgaaaagatcgctaaggtgcgtaactgcatgctctttaagcagaagaaaaatagctgttatgccgatggtgatgaagattataaggttgaagagaaactcgacatcgaggccgtcgtccatcctagggaggtggacccatttatattaagcctgcctcctagtagctgcatgtctggactgatgtataagtacccatcctgcgaatccgtgaccgatgagtatgccggtcatctgatccaaattttgaaacaggagggagggaacagcgaactcatcatggaccagtatgcgaaccggttggcctataggtcagtaaagagcggactacaggaagcggcaaaaaccaccaaagtacagtgtaactcgcggatgtttccagtgccctcttcccaggttaagaccaataaggaactgctgatgttctccaataaagaacaccatcaagaggccgacaaaaaacggcagtcgaagcgaaatgagggctacttctgtaagaatcagacatgtgagcgaacccttgatccctaccgcaatgaagtgagtcagctgtactccttttccacgtcgctagtgcacagcatcactaaggatgccaaggaggagctcactgcatcacttgtgggcctccccaagtctttgactgattcatgtctgttcgagaaatctgggtacgaggaagacaacgagtgccatgtcaccccagagctgcctaagtccctgcagccaagctcacagaatcaccggttttaccattccactggttctctgaatggctatggctgcggagacaacgtggttcaggcagtggaacaatacgccaagaaagttgtcgatgatacactggaacttaccctgggttccacagtcttccgggtgtccgaaacaacgaagtctgctgatcgcgtgacttatgccgagaagcttagtcctttgactgggcaagcctgccggtattgtgatctcaaggagctgcacaattgcactgggaattcttcccagcacttctttagacagggatctttggcctcgagcaaaccagccagcaatccaaagttctcatcccgctatcagaagtctaggatatttcatctgagcgtgccccagattcacgtcaacctggataagaaagctgttttagccgaaaagatcgtcgccgaggcaatagaaaaggcagaaagggagctgtccagcacatcgctggcagcagattcgggtattgggcaagagggagcttcttttgctgagagcctcgccacagaaacaatgaccgctgcagtcacgaatgtgggtcacgcggtctctagctcaaaggaaatcgaggatttccaaagcaccgaatcagtgtcctctcagcagatgaacttgtctattggcgatgactctactggttcttggtcaaacctttcttttgaagatgagcatcaggatgagtcttcatcctttcaccacctctcagagagcaatggcaattccagtagttggagttccctgggtttagaaggtgacctgtacgaggataatctgtcctttccgaccagcgactctgatggccccgacgacaaagatgaggagcatgaagacgaagttgaagggctggggcaggacggcaagaccttgttgatcaccaacattgatatggagccgtgcactgtcgacccccagctgcggatcatcctgcagtggcttatagcctctgaggccgaagtggccgaactttactttcacgactcagctaacaaagaattcatgctgctgagcaagcaactgcaggaaaagggatggaaagttggcgatttacttcaggccgttctgcagtactatgaggttatggagaaggcaagttccgaggagcggtgtaaatcattgttcgactggttgcttgaaaacgcctag

SEQ ID NO: 13709 - DNA, 417 bp, Artificial Sequence
  Description of Artificial Sequence: Synthetic coding sequence
atggccgaactgcagcagttgagggttcaggaagcagtcgagtcaatggtcaagtcgctcgaaagagagaacattcggaagatgcagggactgatgttcaggtgcagtgcttcctgctgtgaggatagccaggcatccatgaaacaggttcatcagtgtattgagaggtgccatgtgcctcttgctcaggcacaagctctggtgacttctgagctggaaaagtttcaggataggctcgcaaggtgtacgatgcactgtaatgacaaagctaaagatagcatagatgcaggatccaaggaactgcaagttaagcagcagctggactcatgtgtaaccaaatgcgttgatgatcatatgcatctgatcccaacaatgactaaaaaaatgaaagaggcccttctatccattggaaaatag

SEQ ID NO: 13710 - DNA, 1110 bp, Artificial Sequence
  Description of Artificial Sequence: Synthetic coding sequence
atgaccttggaggctatcagatattcaaggggatcactgcagattctggaccaactgctcctccctaagcagagtcgctacgaggcagtcggaagtgtgcatcaggcctgggaggcaatccgcgctatgaaggtgcgtggcgcccctgccatcgctttggttggatgtctctcattggccgtcgaattgcaggccggagccggcggccccgggcttgccgccctcgttgcttttgttagggacaaattatctttcctggttacggcccggccaacagccgtcaacatggcgagagcggcgcgcgacttggctgacgtcgctgcaagggaggcggaacgtgagggcgcaaccgaggaggcagttcgggaaagagttatttgttgtactgaagatatgcttgagaaagatctccgcgataatcgttcaattggagacctgggtgctcggcatctgcttgagcgggtcgcgccctcagggggtaaggtgactgtcctcacccactgtaataccggtgcattagctaccgcaggctacggtacggctctgggcgtgatcaggtccctgcacagcttaggtcggcttgaacacgcattctgtaccgaaacgagaccttataaccaaggtgccaggttgacggctttcgaattagtctatgagcagatccccgccacattgatcacggactctatggtcgccgccgccatggcccataggggcgtgtctgccgtggttgtcggtgctgatcgcgtcgtggcaaatggagatacagctaacaaggtggggacctatcagttagccatcgtggccaagcaccatggcattccgttctacgtggctgccccgtcttcctcctgcgacctgcgcttggagactggtaaagaaatcatcatcgaagaaagacccggtcaggaactcacagacgtgaatggggttcgaatcgccgccccagggatcggcgtgtggaaccccgcctttgatgtgacgccgcacgacctgatcactgggggcatcattacagaacttggcgtgttcgccccagaggaactgcggacagccctgaccactactattagcagccgcgacggaacattggacggtcctcaaatgtag

SEQ ID NO: 13711 - DNA, 3660 bp, Artificial Sequence
  Description of Artificial Sequence: Synthetic coding sequence
atgatgtccctcagcgtcaggccacagcgacggcttctttcggccagggtgaaccggagtcagagcttcgccggagtactcggtagccatgagagaggccccagatcatttcccgtctttagcccaccgggacctccacgaaagcctcccgcactctctcgggtttcaagaatgttctcagttgcccatcccgcagctaaggtgccccaacccgaaagactggatctagtctacaccgcccttaaaagaggcctcaccgcttatttggaggtgcaccagcaggaacaggagaaacttcagggccagatacgcgagtctaagaggaactcgcgactggggttcctgtatgatttggacaagcaggtgaaaagcattgagagattcctccggagactcgagttccatgcttcaaagattgacgaattgtatgaagcctattgcgtgcaacgacggttaagggacggcgcctacaacatggtgagggcctatactacagggagccccggatctagggaggcccgcgactcactggctgaggccacgagaggtcatagggagtacaccgagagtatgtgtctcctggagagcgaactggaggcacaactgggcgagttccatcttcgcatgaaaggcctcgcaggctttgcaagactgtgtgtgggcgaccagtatgaaatctgtatgaagtacggccgccagaggtggaagctgagaggtcgtattgaagggagcggtaagcaggtctgggacagtgaggagacgatcttcctgccgctcctgacagaattcctttctatcaaagtgactgagctcaaagggctagctaaccatgtggtcgtcggcagcgtttcttgcgagaccaaagatctgttcgcagccttaccccaggttgttgcagtagatatcaacgatttgggaactatcaagttgagcctggaggtgacatggagtcctttcgataaggatgaccagccatctgccgcttccagcgtcaataaagctagcactgtgactaagagattctccacgtactcccaatccccaccagatacaccttctctgcgggagcaggcattctacaacatgcttagacgccaggaggagctagagaatggcaccgcttggagcctctcctctgagtcttcggacgacagttccagtccccagctctccggcactgccagacatagccctgccccacgcccgctcgtgcaacagcccgagccactccctatccaggtggcgtttagacgcccagagaccccgtcttctggacccctggatgaggagggagcggtggcgccagtactggcgaacgggcacgcgccatactctaggactctgagccatattagtgaggcaagcgtcgacgcagccctcgcagaggcttcggtggaggcagtgggtccagaatccctggcttggggccctagtccgccgacccaccccgcacctacccatggcgagcacccctcacccgtccccccagccctggaccccggtcacagtgccactagctccactctcggaacgaccggatcagtgcccaccagtacagatcctgcaccatccgcccatctcgactccgttcacaaatccactgactccgggcctagtgagttacccggccctacgcacacaactaccggcagcacttattctgctattaccactacgcatagcgcccctagtcccctgactcacacaaccactggcagcacacataaaccaattatcagtacactaaccacaacaggaccaactttgaatattattggcccagtccaaactaccacaagtcccactcacacaatgccatcgccaacgcacaccactgcctccccgacgcacactagcacctcccctacccacacgcccacttcaccaacccataagacttctatgtcacctcctacaacgacgtctccaaccccatccggaatgggcttggtgcagacagccacctctcctacgcatccgacgacctctccaacacaccccaccacttctcctatcctaatcaatgtgagcccatctacctccttggagctcgcaacgctaagcagcccaagcaaacatagtgatcccacactccctgggactgattccctgccttgcagccccccagtaagcaactcatatacccaggcagatcctatggctccccgtacacctcatccaagtccagcacacagcagcagaaaacccctgacctcccccgcgcccgacccctccgagtcgaccgtacagtcactgagccctacaccttctccacctacccccgctcctcagcatagcgatctgtgtctagccatggctgtgcaaactcccgtaccaactgccgctggtggctccggcgaccgatcactggaagaggcacttggagcactgatggcagcccttgatgattacagaggccaattcccagaactacagggcctggagcaggaggtgacgcggctcgagtccttattgatgcaaaggcaggggctgacacggtctcgcgcttcatccctgtccattacggtggagcacgcactggaatctttcagttttctgaacgaagatgaggatgaggacaatgacgtccctggagaccgcccacctagttcgccagaggctggcgctgaagacagcatagattccccatcggcaaggcctctcagcaccggctgccccgccctcgatgccgcattggtgcgtcacctgtaccattgcagtcggctgctcctgaagttgggtacattcgggcccctccgctgtcaggaagcctgggctttggaacggttactgcgggaggcacgtgtcctggaggcagtgtgtgagtttagtcgccggtgggagatcccagcctcctccgctcaggaggtcgtgcagttcagtgcaagtcgaccaggctttttgactttctgggaccagtgcacggagaggttatcctgctttctgtgtcctgtcgaacgcgtcttactcactttttgtaaccagtacggtgcccgtctgagtctcagacagcccggcctggctgaggcagtctgcgtgaagtttttggaggatgccctgggacagaagctaccccgacggcctcagcccggaccgggtgagcaactgactgtgttccaattttggtcttttgtggagaccttggacagtcctaccatggaggcatacgtgaccgaaaccgccgaggaggtgcttctggtgcggaacctaaattcagacgatcaggccgtcgtcctcaaagcacttaggctggcacctgaaggacgccttagacgggacgggctgagggctctatctagtttgttggttcacggtaacaataaggtgatggctgccgtgagcactcagctgaggtcactcagtctcggcccaacttttcgtgagagagctttgctgtgcttcctggaccagctggaggacgaagacgtccagactagggtagcaggttgtctggcgctgggctgcattaaagcgccggagggcattgagcctctggtgtatctctgtcagacagatacagaggccgtcagagaagccgcacgtcagtctctgcagcagtgcggtgaagaagggcagtctgcccataggagacttgaggagtccctcgacgccctgcctcgaatcttcggtcccggttctatggcctcgacagccttttag

SEQ ID NO: 13712 - DNA, 1326 bp, Artificial Sequence
  Description of Artificial Sequence: Synthetic coding sequence
atggcaagtgttgccgctgcaagagccgtccccgttggaagcggcctgaggggactgcagagaacactgcccctggtcgttatattgggcgcaacgggtacaggaaagtccactctcgcgctgcaactgggccaaaggctcggtggtgaaatcgtaagcgccgactcaatgcaagtctatgaggggctcgacataatcactaataaggtcagcgcacaggagcaaagaatttgccgacaccatatgattagctttgtggatccactggtgacgaattatacggttgtggatttccgaaatagggccaccgcgctcattgaggacatcttcgcaagggacaagatcccaatcgtcgtcggaggtaccaattactatatcgagtcactgctctggaaggtcctcgtcaacaccaaacctcaggaaatggggaccgagaaggtgatcgaccggaaggtggaactggagaaagaagatggcctggttctccacaaacgactgtcacaggtggacccagagatggccgccaagttgcacccccacgacaaacgaaaagtggcacgatctctgcaggtgttcgaagagactggaataagtcactccgaatttttacataggcagcacacagaagagggaggaggtcccctcggcggaccgctaaaattcagcaacccttgcattttgtggctgcacgccgatcaggctgtcctggacgaacgcctggataaacgggtagatgatatgctggcagccggcctccttgaggagctgcgcgactttcacagaagatacaaccagaaaaacgtgtctgagaattcccaggactaccagcatggcatctttcagtctataggtttcaaggagtttcacgagtacctgataacagaagggaaatgtacattggaaacatctaaccagctcctgaagaaaggccctgggcctatcgtgccccccgtctacggcctcgaagtgtccgacgtgtccaagtgggaggagtccgtcctcgagcctgcccttgagatcgtacaatcatttattcagggtcataaaccaacagctactcccattaagatgccttataacgaagccgaaaataagcgcagttaccatctgtgtgacctgtgtgaccggataattatcggtgatagagagtgggccgctcatatcaaaagcaaaagtcacctgaaccagttaaagaaaagacggaggctggacagtgacgctgtcaacactatcgaaagtcaatcggtgtcccctgatcacaacaaggagcccaaggagaagggctcacctggacagaacgaccaggaacttaagtgctcagtgtag

SEQ ID NO: 13713 - DNA, 618 bp, Artificial Sequence
  Description of Artificial Sequence: Synthetic coding sequence
atggccgaaccccttcaaccagacccaggtgccgccgaagatgccgctgcgcaggctgtcgaaacccccgggtggaaagcccctgaagatgctggaccacagccaggtagctacgaaatccgtcactatgggccggctaaatgggtcagtacatctgtcgagtctatggactgggattcggccatacaaaccggtttcactaagcttaactcatacatccaagggaagaacgagaaggaaatgaagatcaagatgactgccccggtgacaagctatgttgaacctggatctggaccttttagcgagtccacgatcactattagcttatatatcccaagcgaacaacagtttgacccacctaggcccctggagtccgacgtgttcatcgaagaccgggccgaaatgacagtgttcgtcaggtcctttgacggattttcgtccgctcagaagaaccaggaacagctcctgacattggcctccattctcagagaggatggtaaagtgttcgatgagaaggtctattacaccgcaggctataacagccccgtgaagctgctcaatcgaaacaacgaggtttggctgattcagaaaaacgaaccaactaaagagaacgaatag

SEQ ID NO: 13714 - DNA, 624 bp, Artificial Sequence
  Description of Artificial Sequence: Synthetic coding sequence
atgtcctgcaccatcgaaaaaatcctgaccgatgcaaaaaccctcttggaacggctgcgtgagcacgacgctgccgctgaatctctggtcgatcagagtgcagcgctccacagaagggtggcggctatgcgggaggcaggtactgccttaccggaccagtaccaggaggacgctagtgatatgaaagatatgagcaagtacaagccccatatcctcctatcccaagagaatactcagatccgggacctccaacaggagaaccgggaactgtggattagcttggaggagcaccaagacgcactcgaacttatcatgtccaagtatcgcaaacagatgctccagctaatggtggcgaaaaaagcggtagatgccgagcctgtcctgaaagctcatcagagtcactcagctgaaatcgagtcccaaatcgatcgcatctgcgagatgggagaggttatgcggaaagccgtgcaggttgatgacgaccagttctgcaagatccaggagaagctggcccagttggaactggaaaacaaagagctccgtgaactcttaagcatttcctcagagtcattacaggctaggaaagagaactctatggataccgcctcccaggctatcaagtag

SEQ ID NO: 13715 - DNA, 1032 bp, Artificial Sequence
  Description of Artificial Sequence: Synthetic coding sequence
atgaatatccataggagcacaccaatcacaatcgccaggtatgggagaagtcggaataagactcaagatttcgaggaactgtctagtattcggtccgcagagccatcacaaagcttctctcccaacctgggctctccttccccccccgaaacacccaacctgtcacattgcgtgagctgtatcggaaaatatcttctgctcgaacctttagaaggtgaccatgtgtttagggccgtacacctccattcaggagaggaactagtgtgtaaggtgttcgacatctcttgttaccaagaatcgttggctccgtgcttttgtcttagtgctcatagcaatataaatcagataacggaaattatattaggagaaacaaaggcctatgtgttcttcgagcggtcctatggcgatatgcattcattcgttcgcacgtgtaagaaactgcgcgaggaagaagctgccaggctgttttaccagatagcatcagccgttgcccactgccacgacggaggattagtgttaagggacctgaagcttagaaagtttattttcaaggatgaggagcggactagagtgaagctggagtccctggaggacgcctacattttgcgcggcgatgatgactcactatctgacaaacatggctgccccgcttatgtctctcctgaaatcttaaataccagtggcagctattctggtaaagccgccgatgtgtggtccctgggtgtgatgttgtatactatgttggtgggaagatacccatttcatgacatcgaaccgtccagtttgtttagcaaaattagaagagggcaatttaacattcctgagacactgagcccaaaggctaagtgtctgattaggtcaatactgcgacgggagccttctgagaggctgacctcacaggagattctcgaccacccttggttctccacggacttcagcgtctcaaattctgcatatggggcaaaggaagtgtcagaccagctggtccccgacgtcaatatggaagaaaacctcgatcctttcttcaactag

SEQ ID NO: 13716 - DNA, 3048 bp, Artificial Sequence
  Description of Artificial Sequence: Synthetic coding sequence
atgagacggtttctcagacctggccatgatcctgttcgcgaacgcctgaagcgagacctgttccaattcaataaaactgtggaacacggtttcccccaccagccatctgctcttgggtacagtcctagcctccgaatactcgccatcggaacaagaagtggcgcgattaagctctacggagctcctggggtggaattcatgggtctccatcaagaaaataacgcagtgacacagatccatctgttgccgggacagtgccagttagtgacgctgctggacgataacagcctgcacctatggtcactgaaggtcaaaggtggtgcgtccgaactccaggaagacgaatcatttaccctgagaggccctcctggcgccgcaccctccgcgacccagataacagtggtattaccccactcctcttgcgagctactgtatttgggcactgagtctggtaacgtgttcgtggtccaactcccggctttccgggcactagaggacaggacaatctcatcagacgctgtgctgcaacggctgcctgaggaagcacggcaccgaagagtttttgaaatggtcgaggctcttcaggaacaccctcgggacccgaaccagatccttattggctattccagaggactcgtggtcatttgggacctgcaaggcagccgggtgttgtatcacttccttagcagtcagcagctagagaacatttggtggcagcgcgacggcagactactcgtttcatgccacagcgatggcagttactgccaatggcctgtttctagcgaggcgcaacagcctgagccactgcggagtctggtcccatatggtcctttcccttgcaaggctattacccgcatcctgtggttgaccaccaggcagggtctccccttcaccatcttccaggggggtatgccccgagcttcctacggcgatagacattgcatttccgtgatccacgatggtcaacagactgcctttgacttcaccagccgggtgattggtttcaccgtcctgacggaagccgaccctgccgctacttttgacgatccatacgcactggtggtgctagcagaggaggaactagtcgtcatcgatctccagacagccggctggccgcccgtgcagttgccatatctggcctccctgcactgctccgcgatcacctgttctcaccacgtgagcaatatccctcttaagttgtgggagaggattatcgctgcaggctctcgccagaacgctcatttctctactatggaatggcctattgatggaggcactagtcttacccccgcgccaccccagagagacctactgctgacaggacatgaggacggaaccgttcggttttgggacgcctcaggagtgtgcctacgtctcctgtataagctctccactgtgcgagttttcctaaccgataccgacccaaacgagaattttagcgcccagggcgaagacgagtggccccctttgcgaaaagtcggctcatttgatccctatagcgatgatccgcgtcttggaattcagaagatttttctttgcaaatatagtggttatctcgctgtggcggggaccgccggccaagttctggtgctcgaactcaacgacgaggcggcagagcaggctgtggagcaggtggaagccgatctcctccaagaccaagaagggtaccgctggaaaggtcacgaaaggctggccgccagatcaggacccgtcaggttcgagccaggcttccaaccattcgttctggtccaatgccagcccccagctgttgtcacaagcctggcgcttcattctgaatggcgtctcgtcgcttttggaaccagccacgggttcggcctcttcgaccatcagcagcggcgccaagtctttgttaaatgtacactacatccctccgaccagctggccctcgagggccccctttcaagagtgaaatctcttaagaagtcactgcgacaatcattcaggcggatgaggagatccagggtgagctcacggaagcggcacccagcgggacctcccggcgaagcccaggagggatccgctaaagccgagcggccaggtctgcagaatatggagcttgccccagtccagaggaagatcgaagcccgaagcgcagaagattccttcactgggttcgtgcgcactctctacttcgcggacacttacctcaaagatagcagtaggcactgcccaagcctctgggccgggacgaatggtgggacaatctatgctttctcgctcagagtacctccagcggagcgccgcatggacgagcctgtgagagcagagcaggcgaaagagattcagctcatgcacagagcacccgttgtcggaatcctcgttttggacggacacagcgtgcccttgcctgaacccctcgaggttgcacatgacctatccaagtcgccggatatgcagggcagtcatcagctactggtagtctcagaagagcagtttaaggtctttactctgcctaaggtctcagccaagctcaagctcaaactcacggccctagaggggtcacgagtgaggagggtcagcgttgcgcattttggcagcaggcgggccgaggattacggagagcaccacctcgccgtgttgaccaatttgggcgatatccaggtagtgagtctccctctgcttaaacctcaagtcagatactcctgtattaggagggaggacgtttccggcatagccagctgtgtgttcaccaagtatggacagggattctacctgatcagcccctcggagttcgagagatttagcctctcaaccaagtggttggtagagccgaggtgccttgtggacagtgcagagacaaaaaaccaccggcccgggaacggagctggccctaaaaaggctccctctagggcgcggaattctgggacacagtctgatggagaggaaaaacagcccgggctggtcatggagagggccttgctgagcgacgaaagagccgccaccggcgttcacatcgagcccccatggggagccgccagtgccatggctgagcagagtgagtggctgtctgtccaggctgcccgatag

SEQ ID NO: 13717 - DNA, 897 bp, Artificial Sequence
  Description of Artificial Sequence: Synthetic coding sequence
atggccgcagcggagccggcagtgctggctctgcccaattccggagcgggtggagctggtgcaccatctggaaccgtgccagtgctgttttgcttctctgtatttgctaggccatctagcgttcctcacggtgctggttatgaactcctgatacaaaaatttctgagcctgtacggagatcagatcgatatgcaccgtaagtttgtggtacaactgttcgccgaggagtggggccagtatgtggaccttcctaagggtttcgcggtgagcgaacggtgtaaggtgagattagtccccttgcagattcagctgaccacactcggcaacctgactcccagcagcacagtcttcttttgttgtgatatgcaggagagattcaggccagccatcaagtactttggcgacattatctctgtgggccaaagacttttgcagggagcccggattcttgggatcccggtaattgtgacggaacaatatccgaaagggctcggatccacagtgcaggaaattgacctgactggcgttaagcttgtgctccctaaaacgaagttttccatggtcctgcccgaagttgaggctgccctggcggagatccctggagtcaggagcgtcgttctttttggtgtcgaaacccacgtgtgcattcagcagacggccttagaattagtgggaaggggagtcgaggtgcacattgttgccgacgccacaagcagcagaagcatgatggatcgaatgttcgcacttgagcgccttgctagaacggggattatcgtgacaacctccgaagccgtcctgcttcagttggtggctgacaaggaccatcccaagtttaaagaaattcagaacctgattaaagcttcagcccccgaatctggtctcctgagcaaggtatag

SEQ ID NO: 13718 - DNA, 2439 bp, Artificial Sequence
  Description of Artificial Sequence: Synthetic coding sequence
atgagcgagcagggggacctgaatcaggctatcgctgaggaaggcggcaccgaacaggagaccgccactcccgagaatgggattgtcaaaagtgaatctctggatgaggaggagaaactggaactgcaacgcagattggaggcacagaaccaggaacggcggaaatcgaagagcggagcaggcaaaggtaaactgaccaggagcctggcagtgtgtgaggaaagctctgcccgaccaggcggagaatcacttcaggaccaggagagcatccaccttcaactgagctctttttccagcttgcaggaggaggataaatctagaaaggatgactcagagcgtgaaaaagaaaaggacaagaacaaagataaaacaagtgagaaaccaaagatcaggatgctgtctaaagattgctcccaggaatatacagattctaccggtatcgacctacatgagttcttgatcaacaccctcaaaaacaattcgcgggacaggatgattcttttgaaaatggagcaggaaataatcgacttcatagctgataacaataaccattacaagaagtttccacagatgtcatcctaccagcgtatgctggtacatcgcgtcgctgcctatttcggcctggaccataacgtcgaccagacgggcaaatctgtgattatcaacaaaacgtccagtacccgaatcccagagcagcggttttgcgagcacctgaaagacgagaagggggaggaaagtcagaaacgattcatactgaaacgggataactcttcaatcgacaaagaggataaccagcaaaatcgtatgcacccattccgggatgacagacggagtaagtccatcgaggagagggaggaagaataccaacgcgtacgcgagcgaatatttgcgcacgattctgtgtgctcacaggaatctcttttcgtagagaacagtagacttctcgaggacagcaacatttgcaacgaaacttataagaagcgtcagctgttcagaggcaacagagatggaagcggcaggacatctgggtctcggcagagttcgagcgaaaacgaactcaagtggtccgatcaccagcgggcatggtcttcaaccgactctgacagtagcaataggaacctgaaacctgcgatgacgaagaccgccagtttcggtgggatcaccgtgctcacgcgtggagatagtaccagctcgacccggagtacagggaagctgtccaaggcagggtctgaatcatctagctccgccggctcttctgggtccctgtctcggacccatccccccctgcagtcaactccactggtctctggggtcgccgcaggaagcccaggctgcgtgccgtacccagagaacggtatcggcggccaggttgcaccctcaagcacatcatatatcctgcttccattggaggccgctactggtatccccccagggtccattctcctgaacccacatacaggccagccctttgtgaatcccgacggcacccctgccatttacaacccacctacctcccagcagcctttacgtagcgccatggtgggacagtcccagcagcagccaccccaacagcaacccagcccacagccccagcagcaggtccaaccacctcagcctcagatggcaggccccctggtgacccaaagggatgatgtcgccacgcaattcggccagatgacactatctcggcaatctagtggcgaaacccccgaaccaccttcaggccctgtttatccaagctctctgatgcctcagccagcacagcagccctcctacgtaatagcttctacaggacagcagcttccaacgggcggctttagcggctccggcccccctatctcacagcaagttctgcagcccccaccttcacctcagggcttcgtgcagcagcctcccccggcccagatgcccgtctattattatccaagcggtcagtaccctacatccacaacacagcagtacaggcctatggcgccagtccagtacaacgctcagcggagccaacagatgccacaggctgcccagcaagccggctaccagcctgtcctgtcgggccaacaaggattccagggtctgatcggagtgcagcagccccctcagagccagaatgtgatcaacaatcagcagggcaccccagtccaaagcgtgatggtctcctaccctacgatgagctcctaccaggtgcccatgacacagggcagccagggcctccctcaacaaagttatcagcaacctatcatgctgcccaatcaggcgggacaaggctcactgcctgccactggcatgccagtgtattgcaacgtcaccccaccaactccgcagaacaaccttaggctgattggaccacattgcccctcatctactgtgcccgtaatgagcgcctcctgccggaccaattgtgccagcatgagcaatgctgggtggcaggtcaagttctag

SEQ ID NO: 13719 - DNA, 1191 bp, Artificial Sequence
  Description of Artificial Sequence: Synthetic coding sequence
atgaccaccttagtcctcgacaacggcgcttacaacgcgaagatcggctatagtcatgagaacgtgtcagtgattcctaactgtcaattccggagcaaaaccgcacgtctgaagacattcacagcgaaccagatcgacgagatcaaagacccatctggcctgttttatatcttgcccttccagaaaggatatctagttaattgggacgtgcagagacaggtgtgggactacctgttcggaaaggagatgtaccaagtagactttctcgacacaaacatcattataaccgagccttattttaactttacgtccattcaagagtccatgaatgaaatactatttgaagagtaccaattccaagcggtactccgggttaatgcaggagctctgtctgctcataggtacttcagggacaatccatctgagttgtgttgtatcattgttgactctggatacagctttacacacatagtcccttactgccgctccaagaagaaaaaggaagcgatcatcaggataaatgtcggagggaagctgcttaccaaccatttaaaggaaatcatctcttatagacaattacacgtgatggatgaaacacacgtgattaaccaggtgaaggaagatgtctgctatgttagccaggatttctatcgggacatggatatcgccaaactaaaaggagaagaaaataccgtcatgattgactacgtgttacctgacttcagcactatcaagaaaggattttgtaagcctagggaggagatggtgttgagcggtaaatataagtccggagaacaaatccttcggctcgctaatgagaggttcgccgtacctgagatcttgtttaatccttcagatatcggcatccaagaaatgggcattccggaagccatagtgtacagcattcagaaccttcccgaagaaatgcagccacattttttcaaaaatatcgtgctcactggcggaaacagtctcttcccaggcttccgagatagagtttactccgaggtcagatgcctgaccccaaccgattacgatgtctccgtagtgctgccagagaaccccattacctatgcatgggaagggggcaaactgatcagtgaaaatgatgatttcgaagacatggtggtgaccagggaagactacgaagagaacggccacagcgtttgcgaagagaaatttgatatatag

SEQ ID NO: 13720 - DNA, 1005 bp, Artificial Sequence
  Description of Artificial Sequence: Synthetic coding sequence
atggaacctggacccactgcagctcagcggagatgctcgctccctccgtggttgcctctgggtctactgttgtggtctgggctcgccttaggcgcccttccgttcggctctagcccacacagagtcttccacgatctgctttctgaacagcaactgctggaggtcgaggacctctctttgagcctacttcaggggggtgggcttgggcctttgtcgttgccccccgatctgccggacttggacccagagtgccgggaactactgctggattttgctaacagttccgcagagctgacagggtgcctcgtgcgctcagctcgccccgtcaggctatgccagacctgttatcctctgttccaacaggtggtgagtaaaatggacaacatttcgcgcgccgcagggaataccagcgaaagccagagctgcgcgcgcagcctgcttatggccgatcggatgcagattgttgtgatactaagcgaattcttcaataccacttggcaggaagccaactgtgccaactgtttgaccaacaacagcgaggaattatccaacagcactgtgtatttcctgaatttattcaatcatacactcacttgcttcgaacataacctacaaggtaatgctcactctctgctacagaccaagaactactctgaggtatgcaagaactgccgcgaggcatataagaccctgagctccctgtacagcgagatgcaaaagatgaacgagctcgagaataaagccgaaccgggaactcacctgtgcattgatgtggaggacgctatgaacattaccaggaagttgtggagtcggacctttaattgttctgtgccctgctccgatacagtccctgtgatcgcagtgagtgtctttatcctgtttttacccgtggtcttttacctctcctcttttctgcactctgaacagaaaaagaggaagttgatcctgcccaaacggctcaagtccagcacatcatttgcaaatatccaagaaaatagcaactag

SEQ ID NO: 13721 - DNA, 2172 bp, Artificial Sequence
  Description of Artificial Sequence: Synthetic coding sequence
atgagcacggcgactggccccgaggcggcccctaaacccagcgctaagtccatctacgaacagcgcaagcgctattctacagttgtgatggccgacgtctcccagtatcccgtcaaccacttagtgaccttttgtctaggggaagatgacggagtgcataccgtggaggacgcaagcaggaaacttgctgtgatggatagtcagggtcgagtctgggcccaggaaatgttacttcgcgtttcaccagaccacgtgacactgttggatccagctagcaaggaggagctagaaagttacccccttggagctattgttaggtgcgatgcagtcatgccgccgggccggtcacggagtctgctgctgctggtgtgccaggagccggaacgcgcccaaccagacgtgcatttctttcagggcttacggctgggggcagaattgattagagaagatatccagggggccctgcacaattataggagtggaagaggcgagcgaagagccgcagcacttcgggctacacaggaggagctgcaacgcgacagaagtcctgcggccgagacccccccccttcagcggcgcccgtccgtgcgagccgtgatctcgaccgtagaacgaggagcggggcgcggccggccgcaagctaagccaattcctgaggccgaggaagcccagaggcctgagcccgtgggcactagctcaaacgcagacagtgcatcacccgacctaggaccaagaggcccggacctggcggtacttcaagccgagagagaggtcgatatattaaatcacgtttttgatgatgtcgaatccttcgtgagccgactccagaaatcagctgaggctgccagagttctggagcacagagagcgaggacgcaggagtagacggcgcgctgccggagaaggccttctcaccctccgcgcaaagcccccgtctgaggccgagtacacagacgtgttacaaaaaataaagtatgctttctcacttctggcgcggctcaggggcaatattgcagatccatctagccctgagttgctccactttctcttcggacctctacagatgattgtgaatactagtggtggcccagagtttgcgagttccgtgagaaggcctcacctgacgtcagatgcagttgccctgctgagggataacgtgactccgcgtgagaacgagctgtggacctccttgggagatagctggactagacctggcttggagctgagccctgaagaagggcccccctaccgcccagaattcttttctggatgggaacccccggttactgatccacaaagcagggcctgggaggatcctgtggagaaacagctgcagcacgaaagacgtcgcagacagcaatctgcgccccaagtggccgtaaatgggcatcgcgatctcgagccagaatccgagcctcagcttgagtccgaaacagccggcaagtgggtgctttgcaactacgacttccaagctagaaactctagtgaattgtcagttaaacaaagggacgttctggaggtcttggacgacagcagaaagtggtggaaggttcgggaccctgctggccaggagggttacgtcccctataatatactcacgccctatccaggcccccgcctgcaccacagtcaaagccctgccaggtcccttaacagtactccgcctccccctccagcacccgccccagcccctcccccagccctcgcccggcctagatgggaccggcccagatgggattcgtgtgatagcctcaacggcttggacccaagcgagaaggaaaaatttagtcagatgctcattgtgaatgaggagctccaggctcgcctcgctcagggtagatctggacctagccgagcggtgcccggtcctcgggccccagagccacagctgagccccggctctgacgcatccgaagtcagagcttggctgcaagccaaggggttttcatcaggtacagtggacgcccttggcgtgctgactggggcccagttattcagcctgcagaaggaagagctacgcgccgtcagtcctgaagagggcgccagagtgtatagccaagtgactgtccagaggtccctcctggaggacaaggaaaaagtaagcgagctggaagctgttatggagaagcagaagaagaaggtcgagggcgaagtcgagatggaagttatttag

SEQ ID NO: 13722 - DNA, 5622 bp, Artificial Sequence
  Description of Artificial Sequence: Synthetic coding sequence
atgttctcaagacgcagtcacggggacgtgaagaagtctacccaaaaagtgttggacccaaaaaaagacgtcttaaccagacttaagcacttgagggccctgttagataacgtcgacgcgaacgacctaaagcagtttttcgagaccaactattctcagatttatttcatcttctacgagaatttcattgccttagaaaattctctgaagctaaaagggaacaataagagccaacgcgaagagctggactcaattctgttcttgtttgaaaagatcctgcagttcttgcctgagcgcatttttttccgatggcactaccaatccattgggtccacgttgaagaaattactccatacaggcaattcaatcaagattaggtgcgaaggcattcgactttttttgctttggcttcaggcactccaaaccaactgtgctgaagaacaggtgctgatatttgcatgcttggtgcctggattccccgccgtgatgagcagccgaggcccttgtaccctggagacactgattaatcccagccctagcgtcgccgacgtgaagatatacccggaagagatcactcccctcttgcccgccatttcaggggagaaaattgcagaggaccagacttgtttctttctccagattctcctaaaatatatggtgatccaggccgcctccctagaatggaagaataaggagaaccaggatacaggctttaaatttctcttcacgttgttccggaaatattacctcccacacctttttccctctttcaccaaactcactaacatttacaagcccgtactggacatcccgcacttgagacctaaacccgtgtacatcaccacaacacgggataatgaaaacatatactccacgaaaataccatatatggccgcccgggtggtcttcattaaatggattgtcacttttttccttgagaaaaagtatctgactgctacacagaacaccaaaaatggcgttgacgtgctgcccaagatcattcagactgtcggcggcggcgccgtacaagagcgtgcccccgaattggatgggggtgggcctaccgagcaggataagagccattcgaatagctccaccctgtccgatcgcagattaagtaactcctccctgtgcagtatcgaggaggaacacagaatggtctacgagatggtccagagaatcctcttgtccacaagaggttatgtgaactttgtcaatgaggtcttccaccaggcgttcctgcttccttcatgcgagatagccgtcaccagaaaggtggtccaggtctaccgcaagtggattctccaggacaaacctgtcttcatggaagaacctgatcgcaaagatgtggcgcaggaagacgccgaaaagctcggctttagcgagaccgactctaaagaggcttcgtccgaatcttctggtcacaagagaagctccagctggggacggacatatagctttacttccgccatgtctaggggctgcgtcaccgaagaagaaaatactaacgttaaagcgggtgtccaggccctgctgcaggtgttcctgactaattcggccaatatcttcctgcttgaaccctgcgccgaagtaccggtcctcctgaaagaacaggtagatgcttgcaaggccgtgctgatcatctttcgacggatgattatggagctgactatgaataagaagacctgggaacagatgctgcagatactgctgaggatcaccgaagccgttatgcaaaagcctaaagacaaacaaattaaagatcttttcgcccaatcgctcgcaggactgctattccgaaccctgatggtcgcatggattagagcaaatctctgcgtatacatctccagggaactgtgggatgattttctgggggtcctgtcttctcttacagaatgggaagaactgatcaatgagtgggctaatattatggattcattaactgccgtccttgcccggactgtttacggggtggagatgacaaatctgccattagataagttgtcagaacagaaagagaaaaaacagcgaggtaagggctgtgtgttggacccccaaaaggggacaacagtcggaagatccttctcactttcctggcgcagccaccctgatgtcacggaacccatgcgcttccgaagcgccaccacttctggtgccccaggagtggagaaagccaggaatatcgtgcggcagaaggcaaccgaagtggaagagtgccagcagtcagagaacgcgccagccgccggctcaggacatctgacagtgggccagcagcagcaggtgcttaggagtagttctacttcagacatccctgagcccctgtgtagtgattcctctcaaggacaaaaagctgaaaatactcaaaatagttcatcctctgaaccacagcctattcaagagaataaaggacatgttaaacgggaacacgaggggataacgattctcgtccggcggtcttcctccccggctgagcttgatctaaaagatgatctccagcagacccaaggcaagtgccgtgagcgccaaaaatccgagagcaccaactccgatacaacccttggatgtacaaacgaagcggagctgtctatgggtccatggcagacatgtgaggaagatcctgagttgaacacccctaccgatgtagtggcagatgccgatgctcgacactggctgcaattgagccctaccgatgcatccaatctaactgacagctccgaatgcctgacagacgattgttccataattgccggcggaagccttaccgggtggcatcctgactcggccgcagtcctgtggaggagagtattagggatcctgggtgacgtgaataatatccaaagccctaaaatacacgctagagtgttctgctacctgtatgagctctggtacaagctagccaagattagggataacctagccatctccctggataaccaatccagtccttcgcctccggtcctaatcccgcccctgcgcatgtttgcctcatggttatttaaggccgccaccctccctaatgagtataaggagggaaaattgcaggcataccgcctgatctgtgccatgatgacgagacgccaggatgtgctgcccaacagcgacttcttggtccacttctatctcgtgatgcacctgggactgaccagtgaggaccaggacatactgaacaccataatccggcactgccctcccaggttcttctctctaggtttccctggctttagtatgctggtaggcgacttcattactgctgctgccagggtgctttctacagacattttgactgccccaaggtctgaggcggttacagtgttgggcagcctcgtgtgtttccctaatacgtatcaggagatccctctacttcaatctgtgccagaagttaatgaagcgatcaccggcaccgaggatgttaagcattacctaatcaacattctgcttaaaaacgccaccgaagaacctaatgaatacgcacggtgtatagccgtgtgttcactcggagtctggatctgtgaggaactggcacagtgcacctctcacccgcaagtgaaagaggcgattaatgtcatcggcgtgacccttaaatttcccaacaagatcgtggcccaggtggcctgcgatgttttacaactgctggtttcgtactgggaaaagttacaaatgtttgagacctcactgcctcgcaagatggctgagatactggtggccacagtagccttcctactccctagcgcagagtacagttcagttgagaccgataagaagtttatagtctcactgctcctttgcctgctggattggtgcatggcactcccagtgtccgtgctgttgcatcctgtctccacagccgttctagaagagcagcatagcgccagagccccacttttggattatatctatagagtgcttcattgttgtgtgtgtgggtcaagcacatatacccagcagtcacattacatcctgactctggcggacctgtcctcgaccgactacgaccccttccttcccctcgcaaatgtgaaaagcagtgagcccgtccagtaccattctagtgccgagctgggaaacttgctcacagtggaggaagagaaaaaacggaggtcactggagctgatccctttgaccgctagaatggtcatggcacatctggtcaaccacctgggccactatcccttgtcgggtggccctgctatcctacacagcttggtctccgagaatcatgacaacgcacatgtcgaaggttcggagttgagcttcgaggtgtttcggtctcccaatctccagctctttgtctttaatgatagtacactgatctcctacctgcagacacccacagaagggccagtcggcgggtcccctgtagggagccttagcgatgtcagggtgattgtgcgcgatatcagcggaaaatattcatgggatgggaaagtgctatacggcccactcgaaggttgcctcgcccctaacggaagaaatccatcctttctgatcagttcttggcatcgagatacattcggaccgcagaaagattccagccaagtggaggagggagacgacgtgctggacaagctgctagaaaatataggccatacatctcctgaatgcctcctcccctcgcaacttaatctaaatgaaccgtccttgactccttgtggcatgaactacgatcaggagaaggagattattgaggtgatcctgcggcagaatgctcaggaagacgaatacatccagagtcacaacttcgactcggcaatgaaagtgacgtctcagggccaaccttcgccggtcgagccccgcgggccattctatttctgccgtctgttgcttgatgatctgggtatgaattcttgggatcgtcgcaagaatttccacttgctcaaaaaaaacagcaagctactgcgcgagcttaagaacctggactctagacagtgccgcgagacacacaaaattgctgtattttacattgccgaagggcaagaggataagtgttctattctctctaacgagagaggatctcaggcttatgaggacttcgtggccggacttggctgggaagtcgatctgtccacgcactgtgggttcatgggaggcctccagagaaacggcagtactggacaaacagctccgtattacgccacctccactgtcgaggttatctttcatgtgagtacacgcatgccctcagactccgatgatagtttgactaagaaattgcgccacctggggaacgacgaggttcacattgtctggagcgaacattccagggattatcgaaggggcatcatccctactgcctttggagacgttagcataatcatctatccaatgaagaatcacatgtttttcatcgctattacaaaaaaaccggaagtgccattctttgggcccctgttcgacggcgccattgtatccggcaagctgctcccttctttggtatgtgccacgtgtattaacgcaagtcgcgcagttaagtgcctgatcccattgtatcagtccttttacgaagaacgggccctgtacctagaggctattattcaaaatcatcgagaggtgatgaccttcgaggactttgcagctcaggttttcagcccatcaccatcatactccttaagtggaacagactag

SEQ ID NO: 13723 - DNA, 1041 bp, Artificial Sequence
  Description of Artificial Sequence: Synthetic coding sequence
atggctcgacctggacagagatggctggggaagtggttggtggcaatggtggtgtgggctttgtgccggttggctaccccattggcgaaaaatctcgagcccgtgtcttggagctctttgaacccgaagtttctgtccggcaaagggctggttatttaccctaaaataggtgataaattggatataatctgtccccgggccgaagccgggcgtccatatgaatattataagctgtacctggtgcggcccgagcaggccgctgcctgctctacagtgctggaccctaatgttctggttacgtgcaataggcctgaacaggaaatcaggtttacgattaaatttcaggaatttagccccaattacatggggctcgagtttaagaaacatcacgattattacataacgtcgacctccaatggatccctcgaaggcctcgaaaatagggagggtggtgtatgcaggactagaactatgaagattatcatgaaagtagggcaggacccaaacgctgtgacacccgagcagctgacaactagcaggccatcaaaggaggccgataacacagtgaaaatggctacacaggcccctggatctcgtggatccttaggcgattccgacggcaaacatgaaactgtcaatcaggaagaaaaatccgggccaggcgcgtcaggcgggagctctggtgatccggatggtttcttcaatagcaaagtggcacttttcgcagcggtgggggctggttgtgttatatttctcctgattatcattttcttgacagtcctgctcctgaaacttcggaaaagacatagaaagcatacacagcagcgcgccgccgctttgtctttgagcaccttggcgtctcccaaagggggatctggaaccgccggcaccgagccgagcgacatcattatccctctaagaaccaccgagaacaactattgtccgcactacgaaaaggtcagcggcgattacgggcacccggtttacatcgtgcaggaaatgcccccacagagccccgcgaacatttattacaaggtatag

SEQ ID NO: 13724 - DNA, 1617 bp, Artificial Sequence
  Description of Artificial Sequence: Synthetic coding sequence
atggcctccgatcccattttcacgctcgccccacctcttcattgccattatggcgcgttcccgccaaacgccagcggatgggagcagccaccaaatgcatctggcgtgagtgtggcaagcgccgcactcgctgcttccgcggctagccgcgtagccacctccactgacccatcttgcagcgggtttgctcccccagacttcaaccactgtcttaaggactgggactacaatgggctcccagtgctgaccacaaacgctattggacagtgggatctggtgtgtgatctgggatggcaggtgatcttggagcagatcttattcatcctcggctttgcctctggctacctgtttctgggctatcccgctgataggtttgggcgacgcggcattgtactccttaccctcggcctggtcgggccttgcggggtgggcggtgcagccgccggatcgtccacaggggtaatggcattacggtttttgctcgggtttctcctcgccggcgtagatctgggtgtgtatttgatgcgattggagctgtgcgaccctactcagagattacgcgtggctttggctggggaactcgtcggtgttggaggtcattttctctttcttggccttgctctggtctccaaagattggagatttctccagcgaatgatcaccgccccttgcattctgttcctcttttacggttggcccggcctttttcttgaaagtgcccgctggcttattgttaaacggcagatcgaagaagcccagtcagtgctgagaatactcgccgaaagaaatagacctcacggccagatgctgggggaagaagcccaggaggcgctacaggacttagagaacacctgtccgttgcccgccacgagcagcttcagcttcgcgagtttgttgaactatcgtaatatctggaaaaatctgctgatcctagggttcacaaacttcatcgctcatgccatccgacactgctatcagccagtcggtggcggcggcagtcccagtgacttttacttatgcagcttgctggcatccggtacggcagcccttgcctgtgtttttctgggggtgactgtggatcggttcggccggcgagggattctcctgctgtctatgactctgacaggcatcgccagtctggtattattaggactatgggattgcgagcatccaatttttcccaccgtctgggctcaacaaggcaaccctaacagggacctcaacgaagctgcgatcacaacattttctgttttgggtctgtttagttcccaggccgccgccatcctgagcactttgctggcagccgaggtgattcccaccacagttagaggacgaggtctggggctaattatggctctgggagctctcggcggcctctctgggcctgctcaacgcctgcacatgggacacggagctttcctgcagcatgtggtcctcgccgcctgcgctctcctgtgtatattgagtataatgctgctacccgaaactaagcgcaagctgttgcccgaggtccttcgggacggtgagctttgtcggcggccctctctcctgagacagccacctcccacacgatgcgaccacgtgccgcttctggctacacccaatcccgctctctag

SEQ ID NO: 13725 - DNA, 1128 bp, Artificial Sequence
  Description of Artificial Sequence: Synthetic coding sequence
atgagcacggccgggaaggtgattaaatgcaaggctgcagttttgtgggagctcaagaaacctttttccatcgaggaagtggaggtggccccgcccaaagcccacgaggttcgcataaaaatggttgccgtagggatctgtggaactgatgatcacgtcgtttctggaactatggtgacacctctgccggtgattctgggtcacgaagccgcggggatcgtggaaagcgttggggaaggtgtcacaaccgtgaagcccggggataaagtcatacccctcgccattcctcagtgtggaaagtgcagaatctgcaaaaacccagagtcaaactattgcctgaaaaatgatgtgtctaatcctcaaggaacattgcaggacggcacttccaggttcacttgccgcaggaaaccgattcatcatttcctcggaatctccaccttttcccagtacacagtagtcgacgagaatgccgtcgctaagatcgacgctgcatctccccttgagaaggtgtgtcttatcggctgcggtttctccacaggatacggatctgccgtgaacgtggcaaaagtcactccaggaagtacatgcgcggtgtttggactgggaggcgtgggtctttccgccattatgggctgcaaggccgccggggccgctcgtatcattgcagtagacatcaataaggacaaattcgctaaagccaaagagttgggagctacagaatgcataaatccacaggattacaaaaagcccattcaggaagtcctcaaagaaatgactgacgggggtgtggacttctcatttgaggtcattggcaggctggacactatgatggcctctcttctgtgctgccacgaggcctgcggcacatctgtgatagtgggcgtaccacccgactcccagaatctgagcatgaatcctatgttactgcttacaggtcggacatggaagggcgcaatcttaggaggttttaagtcgaaagaatgtgttccaaaactcgtggcggattttatggctaagaagttttccttggatgccctcataactcacgtgctgccatttgagaaaatcaacgaggggtttgatctcctgcactctgggaagtccatccgtaccattcttatgttctag

SEQ ID NO: 13726 - DNA, 1641 bp, Artificial Sequence
  Description of Artificial Sequence: Synthetic coding sequence
atgtgcagcctgggcctcttcccccctccccctccaaggggccaggtgacactatatgaacacaacaacgagctagtaacgggtagtagctatgagtcccctccacctgactttcgcggccagtggatcaacctccccgtcctgcagcttacaaaggatccgctgaaaaccccgggccggctggaccacggaacaaggacagcttttattcaccatcgagaacaggtgtggaagaggtgcatcaatatctggcgggacgtagggctgttcggcgtgctgaacgagattgccaatagcgaggaggaagtgttcgagtgggtgaaaaccgccagcgggtgggcactcgctctctgcaggtgggctagctccctgcatgggagtctctttcctcacctatccttaagatcagaagatttaattgctgagttcgctcaagtcacaaactggagtagttgctgtctgagagtgttcgcctggcaccctcataccaacaagttcgctgtcgcattgctggacgattctgttagagtctataatgcttcaagcactattgtgcctagcctgaaacaccgcctgcagcggaatgtcgcttctctggcttggaagcctctgtctgcaagcgtgttagcagtggcttgccagtcttgcatcttgatctggaccctcgaccctacttccttgtctactaggccctcatctggctgcgcccaggtgctgagccatcccggtcatacacctgtgacatcacttgcttgggcaccttccggcgggcgattgctgagcgcctcaccagtcgacgcagccattcgcgtgtgggacgtgtctacagagacctgcgttcccttaccatggttccgaggaggcggggtgactaacttgctatggtcaccggacggctctaaaatcctcgccaccacaccaagtgccgtgttccgcgtgtgggaggcccagatgtggacttgcgagagatggccaacactaagcggccgatgccaaaccgggtgttggtcaccggacggaagcagattgctgtttaccgtgctcggcgagccactaatatacagcctaagcttccccgaacgctgtggcgaggggaaggggtgtgtcggtggtgccaaatctgcgacaattgtggccgatctgtctgaaactacaatccaaacacctgacggagaagagagactcggaggcgaagcccattctatggtctgggacccatcgggagaacgactcgccgtgttaatgaaggggaagccacgcgtgcaagacggcaaaccagtcatactactgtttaggactagaaactcccccgttttcgagctgctaccgtgtggaatcattcagggagagcccggagcccaaccccagctgattacgttccatccaagctttaataagggcgccctcctgagtgtcggttggagcacaggacggatcgcccacatccctctgtacttcgtgaatgcacagttcccaaggttctccccagtgctcggcagggcccaggaacccccagcaggtggcggaggctctatccacgatttaccattgttcaccgagacatcaccaacatcagctccctgggacccactccctggtccaccaccagtcctcccgcacagtcctcactcccatctgtag

SEQ ID NO: 13727 - DNA, 576 bp, Artificial Sequence
  Description of Artificial Sequence: Synthetic coding sequence
atgggaaagaaaacgaagaggactgccgatagcagctcgtcagaagatgaagaggaatatgttgtcgagaaggtgctcgacaggcgggtcgtgaaaggccaggtggagtatcttctgaagtggaagggcttctcggaagaacacaacacgtgggagccagagaagaatctagattgccctgagctcatatccgaattcatgaaaaaatataaaaagatgaaggagggagaaaacaataaacctcgtgagaaatccgaaagcaataaaaggaagagcaacttctccaactccgcagacgacatcaagtcgaagaagaaacgtgagcaatcgaatgacatcgcaaggggcttcgagcggggcctcgaacccgagaaaatcatcggggctacggacagctgtggcgacttaatgtttctaatgaaatggaaggacacagacgaggcggacctggtcctggcaaaggaagcgaatgtcaagtgccctcagatcgtaattgctttttatgaagagcggctgacatggcacgcttatcctgaggacgcggaaaacaaggaaaaagagaccgccaaatcctag

SEQ ID NO: 13728 - DNA, 1554 bp, Artificial Sequence
  Description of Artificial Sequence: Synthetic coding sequence
atggggaggaaatccaaaaaatggggcaaaaaggtgtctcggtacgagggtaaggtgcggctgaaaaaagtcccagcaaaaaagctggtccctgcatggaaggaaaaggtcctgtgggcactgcttgccgtgctcctcgcaagctggaggctgtgggctatcaaagacttccaggagtgcacatggcaagtagtcctgaacgagtttaaacgagttggggagtctggagtttctgactccttttttgagcaggagcctgttgataccgtgagttctctcttccatatgctggtggattcacctattgacccatctgagaaataccttggcttcccatactacctgaaaattaactattcctgtgaggagaagccttccgaggacctggtgcggatgggtcatctcacaggactcaagccgctcgtactagtgaccttccagagcccggtaaacttctataggtggaaaatcgaacagctgcaaatccaaatggaagcagcgccatttcgcagcaagggcgggccgggcggtggtggacgcgatagaaatcttgcgggcatgaacatcaacggttttctcaagagggacagggacaataacatccaatttactgtgggcgaagaattgtttaatctgatgccacagtacttcgttggggtgagttccagaccgctgtggcacacagtggatcagtcgcctgtgctcattctgggaggaattcctaacgagaaatatgttcttatgaccgatacatctttcaaagacttctccctggttgaagtgaacggcgtcggccagatgctgtcaattgactcttgttgggttggttctttttactgtccccactctggatttacggcgaccatttatgatacgatagccactgagagcacattgttcattcgccagaaccagcttgtatattattttacaggtacgtacacaacactgtacgagcgcaaccggggcagcggcgagtgtgcagttgccgggccgactccaggggaagggacattggttaacccgagcacggagggttcctggattagagtccttgcttctgaatgtattaaaaaactgtgcccagtgtactttcacagcaatggaagtgagtatattatggccctgacaaccggtaagcatgagggatacgtgcactttggcactatccgtgtgacgacctgctcaatcatttggtccgagtatatagccggcgagtatactctgcttctgctcgtagagtccggctatggcaatgcatccaaacggtttcaagtggtgtcctacaatacagcgtccgatgatttagagctcctctaccacatccccgagtttatccctgaagcccgagggctcgagtttctgatgatcttaggcacagagtcctataccagcacggccatggctcctaaagggatcttctgcaatccttataacaatctcatctttatttgggggaacttcctgttgcagcgttcaggcaccagttggcgcgccgctactggctcaacctcgtgttccctgccacgcgctggaagatgtacttctgcctag

SEQ ID NO: 13729 - DNA, 1203 bp, Artificial Sequence
  Description of Artificial Sequence: Synthetic coding sequence
atgagcggtagagtgggtgatctgagccctaagcaggctgagacgctggccaaatttagagaaaacgtccaggacgtgctccccgccctgccaaatccagatgactactttttgctcagatggctgcgcgcccgaaacttcgacctccagaaatcagaagctctcctgcgaaagtatatggaatttcgaaaaaccatggacattgatcacatccttgattggcagcctcctgaagtaatccagaagtatatgcctggcgggttgtgtggatatgatcgcgacggatgtcccgtgtggtatgatatcatcgggcctctggatcctaagggcctgctgttctccgttactaagcaggatttgctgaagaccaagatgagagattgcgagagaattctacatgagtgcgacctccagacagaacgtctgggaaagaagatcgagacgatcgtgatgatcttcgattgtgagggattaggattaaagcacttttggaaaccacttgtggaggtgtaccaggaattttttggactactggaagaaaactaccctgagacactgaaattcatgctgatagttaaggccactaagcttttccccgtgggttacaacctcatgaagcctttccttagcgaagacactcggagaaagattattgtattgggaaacaattggaaggaggggctcctgaaactgatcagtccagaagagctgcccgcccagtttggtggaactctcacggaccccgacggtaatccaaagtgtctcactaaaatcaactacggaggggagattccgaagtccatgtatgtgcgggatcaggtgaaaacccagtatgagcactccgtacagattaatcgagggtcgagccaccaggtagagtacgagattttatttcctggatgtgtgctgcgctggcagttctccagtgatggcgccgacattggttttggggtgtttctgaaaactaagatgggagagcgacaacgtgccggggagatgactgacgtgctgcctagtcagagatataacgcccacatggtccctgaagatgggaatcttacttgcagcgaggcaggggtgtatgtgctaaggttcgacaatacctacagttttgtgcatgctaagaaggtcagttttactgtcgaagtgctcctccccgatgagggtatgcagaagtatgacaaggagcttacccccgtctag

SEQ ID NO: 13730 - DNA, 636 bp, Artificial Sequence
  Description of Artificial Sequence: Synthetic coding sequence
atggccgagcaacatggagcacccgagcaggctgcagccggtaagtcccacggggatctcggggggtcatataaggtgattctttatgaactggaaaatttccaaggtaagcggtgtgagctgtcagccgagtgcccatctctgaccgatagtctgctcgaaaaagtgggtagtatccaggtggagtcagggccctggctggctttcgaatctcgagcctttagaggggaacaattcgtcctagagaaaggggactatccaaggtgggacgcatggtccaattccagggactccgatagtcttctctcgttgaggcccctgaatatcgatagccctcaccacaagttacacctctttgagaatcccgcgttcagtgggcgaaaaatggagattgttgatgatgatgtgccttccctctgggcccacggctttcaggaccgggtggccagcgttcgcgccatcaacggcacttgggtaggctacgaatttcccgggtatagaggccggcaatatgtctttgagcgcggagaatatcggcattggaatgagtgggacgccagccagcctcaattgcaaagcgtacgccggattcgcgaccagaaatggcacaagagaggccggtttccctcttcctag

SEQ ID NO: 13731 - DNA, 387 bp, Artificial Sequence
  Description of Artificial Sequence: Synthetic coding sequence
atgacggaagccgatgtcaatcccaaagcttacccactggcagacgctcacctgaccaagaagctgctggacttagtccaacaaagttgcaattataagcaattacggaaaggtgctaatgaggcaaccaagactctcaatagaggaatctcggagtttattgtgatggctgccgacgccgagcctttagaaataatcctccacctgcccctgctctgcgaggataagaatgtcccctatgtattcgtgcggagcaagcaagccctagggcgggcctgtggcgttagccgcccagtaatcgcttgcagcgtgactataaaggaggggtcacagctgaagcagcagattcaaagcatccagcagtcaatcgagagactcctggtgtag

SEQ ID NO: 13732 - DNA, 2592 bp, Artificial Sequence
  Description of Artificial Sequence: Synthetic coding sequence
atggccggtccacgaggagcattgttggcttggtgcagacgacaatgcgaggggtatagaggggtggaaatccgtgaccttagctcatcctttagggacggcctggcattctgtgccatccttcatcggcatagacccgatctgctggacttcgacagcctaagcaaggacaacgtgttcgaaaataatcggctcgcgtttgaggtcgctgagaaggaactgggcattccagctttgttggacccaaatgatatggtcagcatgtccgtgcccgactgcttgtcaatcatgacctacgtgtctcaatactacaatcatttctgctctcctggacaagcgggagtaagtcctccgcgcaagggactcgctccctgcagcccgccctctgtggctcctacaccggtcgaacccgaggacgtagcccagggagaggagttatctagtgggtccctcagtgaacagggtacaggccagacacctagttcgacatgtgccgcatgtcagcagcacgtgcacctcgtgcagcgatacttagccgacggccgcctctaccatcgtcactgttttaggtgccgccgctgctccagtactctcctgccaggagcttacgagaatggtcccgaagagggaacttttgtgtgcgctgagcactgcgctaggctgggccctggcacacgtagtgggacacgccccgggcctttcagccagccaaagcagcagcaccagcagcagttggccgaagatgctaaggacgtccctggaggagggcccagcagtagcgcccctgccggtgccgaagctgacggacccaaagcgtcccccgaagctcgcccacagatacctacaaagccccgtgtgcccggaaaactgcaggagttagccagtccccctgctggtcgtcccacaccagcacctcgtaaggccagcgaatctacaactccagccccacccacgccacgtccgaggagctctttgcaacaggaaaacctggtagagcaggccggaagttccagcctggtcaatggccgactgcacgagctgccagtcccgaaaccaaggggcacgcctaaaccttcagaagggacccctgcccccaggaaggaccctccctggatcactctcgtgcaggccgagccaaaaaaaaagcccgcccctctgccacccagtagcagccccggccctccttcacaggatagtcggcaggtggagaacggagggacagaggaggtggcacagccgtcgccaacagcgagcctcgagtctaagccctacaacccattcgaggaggaagaagaggacaaagaagaggaggcccccgcggcccctagcctggccacaagccccgctttggggcacccggaatcaacacccaaaagcctgcatccttggtatggaatcacccctacgagctcccctaagaccaaaaaacgccccgcgccacgggctccaagtgctagcccgctggcactgcacgcttctcggctgtctcactctgaaccccccagtgccacaccgtctccagctctgtcagtagagtccctaagctcggaaagtgcttcgcaaacagccggggccgagttactggaacctccagccgtgccaaaaagcagctccgagcccgccgtgcacgccccagggacgccgggaaacccagtgtctctgagtaccaacagctccttggcttcatcaggagaactggtcgagcctcgcgttgaacaaatgcctcaggcgtccccaggtttggcgccccggacgagggggagtagcggccctcagcccgccaaaccatgcagcggagctactccgacacctcttctcctggtgggggatcgttccccagtgccatcgccaggatctagtagcccccagttgcaggttaagagctcgtgtaaagagaacccctttaatcgaaaaccttcacctgctgcaagccctgcaacaaagaaagccacaaagggaagcaaacctgtacggccgcctgcaccgggccacggtttcccacttatcaagcggaaggtgcaagcagatcagtacatcccagaggaggacatccatggcgagatggatactattgaaagaagactggatgctctggaacaccgaggagtccttttggaagagaagctccgaggggggttgaatgagggtagagaggatgatatgcttgttgactggtttaaactgattcatgagaaacatctcctcgtccgtcgagagagcgagctcatatacgtctttaaacagcagaacctcgaacagcggcaggccgacgtggaatatgagcttcggtgccttcttaacaaaccagaaaaggattggactgaggaggaccgggcccgggagaaggtcctgatgcaggaactagtgacgctgatcgagcagagaaatgccatcatcaattgtctggatgaagacagacagcgggaagaggaagaggataagatgcttgaggccatgattaaaaagaaggagttccagcgggaagcggaaccagaaggtaaaaagaaaggaaaatttaagacgatgaaaatgctgaaactgctgggaaacaagcgcgacgccaagtcaaaatcacctcgggacaagagttag

SEQ ID NO: 13733 - DNA, 708 bp, Artificial Sequence
  Description of Artificial Sequence: Synthetic coding sequence
atgtggaggggtagagctggagcactcctgagagtgtggggcttctggcccacaggcgtcccaaggaggagacctcttagctgcgatgcagcaagccaagccgggagtaattatcctagatgttggaactgtgggggcccctggggtcccggccgcgaagacaggttcttttgcccccagtgcagagctctccaagcacccgatcctacccgggactatttttctctcatggactgcaacagatccttccgggtggatacagcaaaactccagcataggtatcagcagctccagcgactagtgcacccagacttcttctcccagcgcagccagactgaaaaagatttttccgagaagcactcgacactggttaacgatgcctacaaaactctgctcgcccctctctcccgaggattgtatctgttgaaactgcacggaatcgaaattccagaacgcactgactacgaaatggaccgacaattcctgatcgaaatcatggaaattaacgagaaactggccgaggctgagagcgaggctgccatgaaggaaattgagagcatagtcaaggcaaaacaaaaggagttcacagataatgttagttccgccttcgagcaggacgatttcgaagaggctaaagaaatcctgactaagatgaggtacttttctaatatcgaagaaaagattaagctgaagaaaattcctttatag

SEQ ID NO: 13734 - DNA, 2010 bp, Artificial Sequence
  Description of Artificial Sequence: Synthetic coding sequence
atggctaccgaacgcagccggtctgccatggacagtcctgtgccggcatctatgttcgcccccgaaccatcctctcccggggctgctagagcggccgccgcagcagcaaggctgcacggagggttcgacagcgactgttctgaggacggggaggcgctaaacggcgaacccgagcttgatctgacctccaaactagtattggtctcccctacgagcgaacaatacgatagccttctacgccagatgtgggaaagaatggatgaggggtgcggggagacgatctacgtgatagggcagggttcagacgggactgaatacggactttcggaggcggacatggaagcatcttacgctacggtcaagtctatggcagagcagattgaggccgacgtgattctcctgagggagcggcaagaggctggggggagagttagggactatttggttaggaaaagagtgggggataatgactttttggaggttcgggttgctgtggtgggcaacgtggatgccggcaaatcaaccctgcttggggtcctcacccatggagagctcgataacgggcgaggatttgcacgacagaaacttttccggcacaagcacgagatcgaatctggccgcacctcgtctgtcggtaacgatatcctaggttttgatagcgagggcaacgtcgtgaacaagccagacagccatggcggatctctcgagtggacaaaaatatgtgaaaagagcaccaaggtgattactttcatcgacttagcgggccacgagaagtatctaaagactacggtgtttggtatgactggacacctgcccgacttctgtatgcttatggtgggtagcaacgcgggaatcgtgggtatgacaaaggagcacctcgggctggctctggcgctgaatgtccctgtttttgtcgttgtgactaagatcgacatgtgccccgctaacattttgcaagaaacactgaaactcctgcagaggctgctcaaatcacctgggtgtaggaaaatcccagtgctggtgcagagcaaagacgacgttatcgtcactgcatctaacttttcatcagagaggatgtgccccattttccagatcagcaacgttacgggcgaaaatctagatctgctgaagatgttcctcaatcttctgtcaccccgaacttcatatcgggaggaagaacccgccgaatttcagattgacgatacgtactctgtcccaggcgttggtacagtcgtgtctggaacaaccctgcgcgggttaatcaaactcaacgacaccctccttctcgggccagaccctttgggaaacttcctcagtatcgccgtgaaaagtatccacagaaaaagaatgcccgtgaaagaagtcaggggcgggcagaccgcctcctttgcccttaaaaaaattaaaagatcttctatccggaagggaatggtgatggtctcaccccgcctaaatccccaggcgtcttgggaatttgaggcagagattctggttctgcaccaccctaccacaatctcaccaaggtaccaggctatggttcactgcggtagcatccgtcagaccgcaactatcttgagtatggacaaggactgcctgagaacaggcgacaaggcaactgtgcattttaggttcattaagacgcccgaatacctgcatatcgaccaaaggctggtctttagggagggccggacaaaggccgtaggcacaatcaccaaactcctccagacgacaaacaattccccgatgaatagtaaaccacagcagataaaaatgcaaagtacgaagaagggccccctgaccaagcgggacgagggcggaccctccggaggcccagcggtcggggctccacctcccggcgatgaagcctctagtgtcggtgctgggcaaccagctgcttccagtaatctccagccccagccaaaaccatctagcggcggacgacgcagaggaggacaacggcacaaagtcaagtcgcagggtgcttgcgtaacaccagcttctggctgctag

SEQ ID NO: 13735 - DNA, 1656 bp, Artificial Sequence
  Description of Artificial Sequence: Synthetic coding sequence
atggctgcaccagctctatcctggcgacttccattgctcatccttctgctccccctggctacctcgtgggcctcagcagccgttaatggaacctcccagtttacttgcttttacaactcaagagcgaatatttcatgcgtgtggtcacaggatggcgccctccaggacacatcctgccaggtacacgcatggccagacagacggagatggaatcagacatgtgagttgctgcccgtgagccaagcttcgtgggcctgtaatttgattttaggagcccctgatagtcagaaactgacaactgttgatatcgtcacactgcgtgtgttgtgccgcgagggcgttcggtggagagtgatggcgatccaagattttaagcctttcgagaacttaagactgatggctccaattagtttacaggtggtgcacgtcgagacgcaccgttgtaacatttcctgggaaatttcacaagcctctcattactttgagagacacctggagtttgaggcccggacactgtcacccggtcacacctgggaggaggcccctctcctgacgcttaaacagaaacaagaatggatctgcctggagactcttacacctgatactcagtatgagtttcaagtccgagtgaagcccctccaaggtgaatttaccacatggagtccgtggtctcaaccgcttgccttcagaacaaagcctgctgcattgggtaaggataccataccctggctgggacatctcttggtcggtctctccggcgcttttgggttcatcattctggtgtacctcctcatcaactgcagaaataccggcccttggcttaagaaggtgctgaagtgcaatacccctgacccctctaagttcttttctcagctttcatccgaacacggcggcgatgtccaaaaatggctgtcgagtccctttccaagcagcagctttagcccaggagggcttgctcccgagattagccccttggaggtgctcgagcgggacaaagtcacacaactactgcttcagcaagacaaagtgcctgagcctgccagcctatcttccaaccactccctaactagttgttttacaaaccagggatatttttttttccacttgcccgacgcgctcgaaattgaagcgtgtcaggtgtatttcacttacgatccttactctgaagaggaccccgatgagggagtagcgggggctcccaccggctcttcaccacagccgctgcagccgctctctggagaggatgacgcatactgcacttttccatctagagatgatctgctgcttttctcaccctcactgctggggggccccagccctccatccaccgcgccaggcgggtcgggcgcaggagaagagaggatgccacccagtttgcaggagcgagtgcccagggactgggaccctcagcccctcggccctcctaccccaggggtacctgatctggtggacttccagcctccgccagaactcgtcttaagagaagccggtgaagaggtcccggatgccgggcctcgcgaaggcgtgtcatttccttggtcgcggcctcctggacagggggagtttcgtgccttgaacgctaggctgcctctgaataccgatgcctatctgagcttgcaagagcttcagggccaagatcctacacacctcgtgtag

SEQ ID NO: 13736 - DNA, 3516 bp, Artificial Sequence
  Description of Artificial Sequence: Synthetic coding sequence
atggaaaacaaccttaagacctgtcctaaggaagatggtgatttcgtttctgataaaatcaaatttaaaatcgaggaggaggacgatgacgggatcccaccagacagtctggagagaatggacttcaaatctgagcaggaagatatgaaacaaactgatagtggaggagagcgcgcaggcctggggggaacaggctgcagttgcaaacctccaggaaagtacctctccgccgagtccgaagacgactatggcgcccttttttcccagtactctagcacattgtacgacgtcgccatggaggcggtcacacaatccttgctgtcctcccgtaacatgtcttcccgaaaaaagtcacctgcatggaaacacttttttatctccccgcgcgactctaccaaggccatctgtatgtattgcgtaaaggagttttctagggggaaaaatgaaaaggatttgtccacaagttgcctgatgcggcatgtccggcgggcacatccaacagtactgattcaggagaatggtagtgtgagtgcggtgtctagctttccttcacccagcctcctgttacccccccagccagccgacgctggcgaccttagtaccatcctgtcaccaattaagctcgtgcagaaagtggccagcaagataccaagcccagaccgcatcactgaggaatccgtcagcgttgtgtctagcgaggagattagttctgatatgagtgtgtcagagaaatgcgggagagaggaggcacttgtgggctcaagtcctcatctgcctgctctgcactatgatgaacccgccgagaatcttgccgagaagagcctccctctacctaagtctacctcagggagccgtcggaggtctgctgtgtggaagcatttttacttgagtcctctggataactccaaagcagtctgtattcactgtatgaatgagttctcccgaggcaagaatggcaaggacttaggcacaagttgcctaatccgtcatatgtggagggcccacagagccatcgtgctgcaggagaatggtgggacaggaattcctcctctgtactccacgccccctacactgctgccatccctcctgcctcctgagggagagctgagcagcgttagctctagccctgtgaagcccgtgcgcgagtccccctcagcttctagcagccccgaccgactcacagaagacctccagtctcacttgaaccccggggacggactgatggaagatgtggcggccttcagcagcagtgatgacataggagaggcatctgcttccagccccgagaagcagcaggccgatggattatccccccgtctctttgagtctggcgccatctttcagcagaataagaaggtgatgaaacgcctgaagagtgaagtttggcaccatttttctctggcgccgatggacagcctgaaggcagagtgccgatattgtggatgcgcaatatcccgagggaagaaaggtgatgtgggaacgagctgcctcatgcggcacctgtatagacgccacccagaggttgtggggtctcagaaagggtttctgggggcgtccttagctaacagcccctacgccacattggcatctgccgagtctagcagctcgaagctaactgatctaccgaccgtggtgaccaagaacaatcaagttatgtttcctgttaactcaaaaaaaacgtccaagctctggaaccatttttctatctgttccgcggatagcacgaaggtggtctgtttacattgcggacgcaccataagtagggggaaaaagccaaccaacctcggtacatcatgcctgttgaggcacttacagagattccattctaacgtcctgaagacggaagtctcagaaactgcgaggccatctagcccagatacccgcgtgcccaggggcacagagcttagcggcgcgtccagctttgacgacacaaatgaaaagttttacgattctcatccggtagccaaaaagatcacatccctcattgctgagatgatcgctctcgacctacaaccctatagtttcgtcgataacgtcggctttaatcgtctgcttgaatatttaaaaccacagtattctttgcctgctccaagctacttcagtaggaccgccatccccggcatgtatgataatgtgaagcagattattatgagccacctgaaggaagccgaatcaggggttatacacttcacttcaggcatttggatgagtaaccagactcgagagtacctgaccctaaccgcccactgggtgtctttcgagtcacccgcccgacctaggtgcgacgaccatcactgcagtgccttactcgacgtgtcccaggttgactgcgactacagtggcaacagcattcaaaaacagctggagtgttggtgggaggcttgggtgactagcaccggactgcaagttggcataacggtcaccgacaatgcatccattgggaaaaccctcaatgagggcgaacatagctctgtgcagtgcttctcacataccgtaaatcttattgtctctgaagcaatcaaatcccagcgaatggtccaaaatctcctctccctcgcaagaaaaatctgcgagagagtacatcgtagccctaaagcaaaagagaaactagctgaactgcagcgcgaatacgccctcccccagcatcatctgattcaggatgtgccctcaaaatggtccacttctttccacatgctcgaaagactcatagaacagaagcgggctatcaatgaaatgagtgttgagtgcaacttcagagagcttatcagctgtgaccagtgggaggtcatgcagagtgtatgtagagctcttaaaccatttgaagctgccagcagagagatgagcactcagatgtcaaccctgagtcaagtcatcccaatggtgcatatcctgaaccgtaaagtggagatgcttttcgaggagacaatgggtatcgataccatgctccgaagcctgaaagaagctatggtttcgagactgagcgcaacgttacacgatcccagatacgttttcgctacattactagatccccgctacaaggcctcactcttcaccgaagaggaggctgagcagtacaagcaggacctgatccgggagttggaattaatgaatagcactagtgaagatgtagctgcttctcaccgatgcgacgcaggctccccttcgaaagactccgccgccgaggagaatttgtggtcattggtggccaaggttaagaaaaaagatccccgagaaaagctgcctgaggctatggtactagcctacctggaggaggaggtcttagaacactcctgtgatccgctgacctattggaacctcaagaaggcctcctggccaggattgagtgctctggccgttcgattcctgggctgccccccgtctatagtccccagcgaaaaattgttcaacacaccaacagagaatggcagcttaggtcagtcccgcctcatgatggagcatttcgaaaagctcatcttcctcaaggtcaacttgccgctcatttatttccagtactag

SEQ ID NO: 13737 - DNA, 744 bp, Artificial Sequence
  Description of Artificial Sequence: Synthetic coding sequence
atgcagccaatactgcttctactagcattcctgctgttaccgcgcgctgacgccggagagattattggtgggcacgaggccaagccccactcccggccctatatggcttacctgatgatctgggaccagaagtctctgaagagatgcggaggcttcctaattcgcgatgattttgtgttgaccgcagcccactgttgggggagctccattaatgttaccctcggcgctcacaatattaaagagcaggagccaacccagcaattcatccccgtcaaacgccctattcctcatccggcatacaacccaaagaatttctcaaacgatatcatgttgttacagctggagaggaaggccaagcgcaccagggccgtgcaaccacttaggctcccttcaaataaagcgcaggttaagcctggacaaacttgttcagtcgccgggtgggggcagaccgcacctcttggcaaacatagccatacgctgcaagaggtgaaaatgacagtgcaagaggaccgcaagtgcgaaagcgaccttaggcactactacgacagtacgatcgagctgtgcgtcggagatccggaaatcaagaaaacttctttcaagggagacagcggcggcccgctcgtttgtaataaagtggcacagggcatcgtgtcctatggccggaataacggaatgcccccaagggcctgcaccaaagtttcttccttcgtgcactggataaaaaagaccatgaagaggtactag

SEQ ID NO: 13738 - DNA, 1062 bp, Artificial Sequence
  Description of Artificial Sequence: Synthetic coding sequence
atggaggatggagtgttgaaagaaggcttcctagttaaaaggggtcatattgtccataactggaaggcccgctggttcatcctgcgccagaacaccttggtttactacaagctagaaggtggacggagagtgacccctccgaagggccgaatcctcctggatgggtgtactattacgtgtccttgcttggagtacgagaatcgccctttactgattaagctgaaaacccaaacctctactgaatactttctggaggcttgctctagggaggaacgcgatgcatgggcatttgaaatcaccggcgccattcacgcagggcagcccgggaaggtccagcaactgcactcattgagaaatagttttaagctcccaccccatattagtcttcacaggattgtggacaaaatgcacgattccaacactgggatccggtcttcgccaaacatggagcagggttcgacatacaaaaaaacattccttggatctagtctggtggattggctgattagcaattctttcacggcaagtcgcttagaagccgtgacactcgcctccatgctgatggaagagaacttcctgagacccgtcggcgtccgaagtatgggagcaattcgctccggtgatcttgcagaacaattcctcgatgactctacggcactttacactttcgccgaatcatataaaaagaagataagccctaaggaggagataagcctctcgactgtggaactcagcgggaccgtcgtgaagcagggttatttagccaagcaaggtcacaaacgaaaaaactggaaggttagaagattcgtgcttcgcaaagacccggcttttttgcactactacgatccttccaaagaagagaaccggcccgtggggggtttttctttaagggggtcgctcgtctcggccttggaagacaatggggtgcctaccggcgttaaggggaacgtgcagggaaacctgttcaaagtcattaccaaggacgacacgcattattacatacaggcatcatcaaaagctgagcgtgccgagtggattgaggcaattaagaagctgacatag

SEQ ID NO: 13739 - DNA, 2025 bp, Artificial Sequence
  Description of Artificial Sequence: Synthetic coding sequence
atggcagaagtgccagaggactatgactcaggccctgacgaggacggagagttggagccggagcgccccgaactccccgggttacacaaactgtacgagaacgcagaacctgacaccatggccaaagctgactctaagctgcctgcagagatataccaggaacctcagcccgaaacggaggaggaggattttaaagaaggcgagcctgattccgcgaaaaacgtccagctgaaacctgggggcacgtcgcaggagggaatcgctaaagagagcaaacgggacgttccatctgaaacagagccagggattcaccaggaggttaagtcagaaaccagccgggagatgggggagtttttcaaggacctcgaggctcctatggacgagacacataaagagagcgacctggaacctcctgaagaggcaaagcccaatgtaaccgaggatgtttttctcgaaagcgccatggagacagaccctgatccagtaccacccaccgaaaccatgtcagaagtatccggggcaaccgtgcgcgagagaaatctggagttactggaggaggagacagagcccggcgtgccagaagagagcctcagggtgcagcatgaagagacaggcttggaacccccagagcaaaccaagcaggatttcccctccgagaagctgggtgaatccctagaggagacagatttgcaaccgcctaaaatgaccaagcctgagacacccgaagaaacccagcgggaatcaaccgaaaaaaagcggacagagcctcctgaacaggctcgcctcgaattcctggagaaggagccgaggaagtcctccgaagaggctgggctggagccacccgaagagacacagcccgaagtacccgaggagatgcagcgcaaagctaccgaagagaagggaacagaactgccagaaaggaccaagccagattttcctgatcataaaccgaggaaatccaccgacgaaaacgttccagaaccactggaagaaattaagcttgagtttccagaagaagagagtaggaagaccaatgaagagactatcctggagcagagcgagatgatgaaaccggaatctcctgaggagatccgcaagtccaacgagaagaagaatccacagccccccgaagagactggaccagtccttccccaggaaatcaacccccaggttgaggagaagacccaaaccaagcccactgaaaaaattctggagctgcccgatgaaacaaagccccgagaaacccatgtggagttttcgaaagaggaccggcccgagcctatcaaatcgaagtatagtgttggtaacgacgagctggaacaccgggaacctaagaggggcaagctcagtctgtcagataagttccggaaggagtattacgcattagggagcctgcgtgagagtgaggaatctatcggaacccactacgagttcctgcagccactgcagaagctgcttaatgtatccgaagaatgctcatattctgacccgtctgaatcccagacggagcttagtgagttcgtccacgaaaaagaggtcgtagacctgagccaggagctgaaagagcgggtgtccgaagacgatgaaacacagcccgaaaaggggactgaacttcaattcgaacatctgaactgggaccccgaagaagtcgccgagtggatctcccagttggggtttccacagtataaggagtgttttattacaaactttatctccgggcggaagctcatccacgtaaactgtagtaacttaccacagatgggcattactaactttgaggatatgaaagccatcagtcgacacacccaggaactcctggagatcgaggagcctctgtttaaacgctccatttccttgccgtatcgcgatatcatcggcctgtatctggaacagaagggccatacaggcatcaagtccgatagtctgaccctctccgagttcgtgaaggcggccgggctgcaggattatgcacctgaaatcacagctcctgaagaaaacgaagaattgccatgcacagaaccttag

SEQ ID NO: 13740 - DNA, 1689 bp, Artificial Sequence
  Description of Artificial Sequence: Synthetic coding sequence
atgagacccgagccgggggggtgctgctgcaggagaacggtacgcgctaatggctgtgtggctaacggcgaggttagaaatgggtacgtgcgctcttctgcagccgcggccgctgctgctgctgctggtcaaatccatcacgtaactcagaacgggggcttatacaagcgtcctttcaacgaagcttttgaggagacaccaatgctagttgccgttctcacatacgtcggatacggtgtcctgaccctgttcgggtacttgagggacttcctgcgctactggcggatcgagaagtgccatcacgcaactgagcgggaagaacagaaggactttgtgtccctctaccaggatttcgagaacttttatacaaggaacctttacatgagaattagggacaattggaataggccaatttgtagcgttcctggcgcccgcgtcgatatcatggagagacagtctcacgattacaattggtccttcaagtacacaggcaacatcatcaaaggtgtgattaacatggggtcttataactacctgggctttgcccgaaacaccgggtcttgccaagaggctgctgccaaggtgcttgaagagtacggggccggagtgtgctcaacccgccaggaaataggaaaccttgacaaacatgaggagctcgaggagctggtggcaaggttcctgggcgtggaagccgctatggcctatggcatggggttcgccaccaactccatgaacatcccggctctggtaggcaaggggtgcctgatattatcggatgaactgaatcatgcctctttagtacttggagcccgtctgtcgggggccacaattcgcatattcaaacataacaacatgcagtcattggagaagctgctcaaggacgccatcgtctatggccagccaagaacacgccgaccctggaagaagattcttatactcgtggaaggtatatatagcatggaagggtccatcgtcagacttcccgaggtgattgcgctcaagaaaaagtacaaagcctatctgtacctggatgaggctcatagcattggggcactgggacccaccgggagaggcgttgtggagtatttcggcctggaccctgaagacgtggacgtcatgatggggacctttaccaaatcatttggagcgtctggcggctacatcggtggtaagaaagagcttattgattacttgagaacccactctcactctgcagtctacgccacatccctgtcgcctccagtggtggagcaaataattacttctatgaagtgtataatggggcaggacggcactagtctgggtaaagaatgtgttcaacagctggccgagaacactcggtacttccgccggcgcttgaaggaaatgggatttataatctatggtaacgaggattctccagtggtccccctgatgttgtatatgcctgcaaagatcggggcttttggcagagagatgctaaaaagaaacatcggtgttgtggttgtaggattcccagcaacacccatcatcgagtcccgcgcgagattctgtctgtctgcagcccacaccaaggaaatcctggacaccgctctgaaggaaatcgatgaagttggcgaccttctacaactaaagtactcacgacaccggttagtcccgttgttggatagacctttcgacgaaaccacgtatgaggaaactgaggactag

SEQ ID NO: 13741 - DNA, 2346 bp, Artificial Sequence
  Description of Artificial Sequence: Synthetic coding sequence
atgtccagcagctccccgaccggacagatagcaagtgcagccgatatcaaacaggagaacggaatggaatctgcatccgagggacaagaggctcatagagaggtcgcgggcggggccgccgtgggcctgtctccgcccgctcccgcacccttccccctggagcccggtgatgccgctactgctgccgctagggtgtccggtgaggagggagctgtggcagctgccgcagctggcgccgccgccgatcaggtgcagctccactctgagttgcttgggcgacaccaccatgcggccgccgcagccgctcaaacccccctggcatttagtcccgaccacgtcgcttgtgtgtgcgaggctctgcagcaaggggggaacttagatagacttgcccgattcctttggtccctgccacagagtgacctgctccgcggtaatgagtcccttcttaaggctagagccctggtggctttccaccagggaatctatccagagctctactctatattggagagtcactcttttgagagtgcgaaccaccctctgctacaacagctgtggtacaaagcccgatacacagaagccgagcgagccagaggcaggcccttgggcgcagtggataaatatcgccttcgacgcaaatttcctctgcctcggacaatctgggacggtgaagagaccgtttactgttttaaagaaaagagtcgtaacgccctgaaagagctgtataagcagaacaggtatccatcccctgcagaaaaacggcacttggccaagatcacaggactgtcccttacccaggtcagtaattggtttaaaaacaggaggcaacgagataggaacccttctgagactcaatctaagtctgagagcgatgggaacccaagtaccgaggatgagagtagcaaaggacacgaagacctcagtcctcaccccctttctagtagctctgacgggatcacgaaccttagtctgtcctcccacatggagcctgtgtatatgcaacagatcggtaatgcgaagatttcgctgtcatcctccggagtgttgttaaatggttcactggtgccagccagcacgtcaccagtattcttaaatggtaacagtttcatccaagggccaagtggagtgatcttgaacggtctcaacgtggggaacacccaagccgtggcgctaaacccgccaaagatgtcctccaacattgtgtccaacggaataagtatgacagacattctggggtccaccagccaagacgtgaaggaattcaaggtccttcagtctagtgctaactctgcaacgacaaccagctatagtcccagtgtccccgtgagctttcctggattgatcccttccacagaagtaaagcgtgaaggaatccagacagtcgcaagccaggatggtggaagcgtagtgaccttcacaacgcctgtccagatcaatcagtatggcatcgtacagattccaaattccggagccaatagtcagttccttaacggatccatagggtttagtcctctccaacttccccccgtgagtgtggctgcttcacagggcaacatttctgtgtcctcatctacctcagatgggtccacgttcacgtcagagtccactacagttcagcaaggaaaagtgtttttgagtagccttgccccgtctgctgtcgtgtacacagtgccgaataccggccagacaatcggttctgtgaagcaggagggccttgagcgcagcctagtctttagccaattaatgcctgtgaaccagaacgctcaggtaaacgctaatctgtcttccgaaaacatctccggctcaggactacacccccttgcctctagcctggtcaatgtcagtcccacccataatttttctctgagcccaagcaccttgctgaaccctaccgaattgaatagagatatcgccgactcccagccaatgtctgcgccggttgccagcaaatcaacagttacgagtgtgtcaaatacaaattacgccaccctgcagaattgcagcctcatcacaggtcaagatttgctgtcagttcccatgacccaggcggcactgggagagattgtacccacagctgaggaccaggttggtcacccctctcccgcggtgcatcaggatttcgtgcaggaacacaggctggtgctgcagagcgtcgcaaacatgaaagagaacttcctttctaactccgaaagcaaggcgacatcttcgttgatgatgctggatagcaaatcgaagtatgtgttagatggcatggtggacaccgtttgcgaggacctagagacagataaaaaggagttggctaagcttcagaccgtacagctggatgaagacatgcaggatctttag

SEQ ID NO: 13742 - DNA, 1392 bp, Artificial Sequence
  Description of Artificial Sequence: Synthetic coding sequence
atgggaaaagaaaaaacacatattaacatcgtggttatcggccacgtggatagcggtaagtccaccaccaccgggcacttgatttacaagtgcggcggaatcgataagcgaacgatagagaaattcgagaaggaagctgctgaaatgggtaaaggctccttcaaatatgcctgggttctggataaactgaaagctgagcgcgaacgtggcataacaattgatatctctctctggaaattcgagactaccaagtactacattactatcatcgatgccccggggcatcgtgactttattaaaaatatgattacaggaaccagtcaagcggattgtgcggtgctcattgtggctgctggtgttggagagtttgaggccggcatctccaagaatggccagacaagagagcacgctttgctcgcctacacactgggagtcaagcagcttatcgtgggtgtgaacaagatggattccaccgagcctgcgtactctgagaaaaggtatgacgaaatagtcaaggaggtttccgcatacataaagaaaattggatacaatcccgctacggttccctttgtgcctatcagcgggtggcatggtgataacatgctggaaccttctccaaacatgccctggtttaaaggatggaaggtcgaaagaaaggagggcaacgccagtggagtgtccctcttagaagcactggacaccatcctgccccctacccgtccgaccgacaaacctctgagactgcccttgcaggacgtttataagatagggggcattggaacagtgccggtggggcgcgtcgaaacaggaattttacggccgggcatggtggtcacctttgcaccagtgaatattactacggaagtcaagtctgtggaaatgcatcacgaagcactctctgaggcgctgcccggggataatgtgggattcaacgtgaaaaatgtatcggtgaaagatatccgaagggggaacgtgtgtggcgacagtaagtcagaccctccgcaggaggccgcacagtttacaagccaggtgataatattgaatcatccaggccagatatctgccgggtactcacctgttatcgattgccacacagcccacatcgcttgcaaattcgctgagcttaaagaaaaaatcgataggcggagtgggaagaagctggaggataaccccaagagccttaagtcaggggatgcggccattgttgaaatggtgccagggaaaccgatgtgtgtggaatcttttagccaataccccccccttggacgcttcgccgtccgcgacatgaggcagacggtggctgtcggtgttatcaaaaacgttgaaaagaaatccggaggagccggcaaagtgaccaaaagcgcccagaaagcacagaaggctggcaaatag

SEQ ID NO: 13743 - DNA, 600 bp, Artificial Sequence
  Description of Artificial Sequence: Synthetic coding sequence
atggctgctgccaacaaggggaaatgtctaccgggcgtcgtgggtctggcccaggccctcccagtggggcctggtagacgcgctatcgctgcgggcaacaaaccgagggtccgatcgattcgcttcgcggccggccacgacgccgagggatcgcattcacatgtgcatttcgacgagaaacttcatgactccgtggtgatggtgactcaggagtccgacagtagcttccttgtgaaggtgggctttcttaaaatcctgcatcgctatgaaattacctttaccttgccgcccgtgcacagactgagcaaggacgtgcgggaagctccggtccctagcttgcatctaaaactactatccgtggtacctgtccctgaaggttactccgtcaaatgtgaatactctgcccacaaggagggtgttctgaaggaagagatcctccttgcatgcgagggtgggacggggacctgtgtaagagtaacggtgcaggctagggtgatggatagacatcacggtacgcccatgctgcttgacggtgtgaaatgtgtgggtgcggagctagaatatgatagtgaacattctgactggcacggtttcgattag

SEQ ID NO: 13744 - DNA, 270 bp, Artificial Sequence
  Description of Artificial Sequence: Synthetic coding sequence
atgcaactgcaggcaagtctatcattcctgcttattctgacactgtgccttgagctccgctctgagctcgcccgcgataccatcaaggacctgttacccaacgtgtgcgcattcccgatggagaaggggccctgtcaaacctacatgacccggtggttcttcaatttcgagaccggcgagtgtgagctgttcgcctatggtgggtgtggaggtaactccaacaactttcttcgcaaagaaaagtgtgaaaaattttgcaagttcacgtag

SEQ ID NO: 13745 - DNA, 1251 bp, Artificial Sequence
  Description of Artificial Sequence: Synthetic coding sequence
atgtcggaggcagacggacttcgtcagagacgccctttgcgtccacaggtagtcactgatgacgatggccaggctcccgaagccaaggacggctccagcttttccggacgcgtctttcgcgtcaccttccttatgctggccgtgagcctgacagtgccactgctgggagccatgatgttgctggagtctcccattgatccccagccactcagtttcaaagaaccacccttgctgctgggggttctacaccctaacaccaaactgcgacaggccgagcggctcttcgaaaaccagctcgtgggtcccgaaagcatcgcgcacataggcgacgtaatgttcaccggtaccgctgacgggcgcgttgtgaaacttgagaacggtgagatcgagacaattgcaaggtttgggtccggaccctgcaaaacacgggacgatgagccggtgtgcggaaggcctctggggatccgcgccgggcccaatgggactctctttgtggcagatgcatacaagggcctctttgaggtaaatccctggaagcgcgaagtcaaactcctattaagcagtgagacgcctatcgaggggaagaatatgtcttttgtgaacgatttgaccgttacacaggacgggcgaaagatctatttcacggactcttcatccaaatggcagagaagggactacctcttacttgttatggaggggaccgacgatggaaggctcctggagtatgacactgttactagagaggtgaaggtcctgttggatcaattaaggtttcctaacggagtacaactaagtccagctgaagacttcgtgctcgtggcagaaacaacgatggcccgcattaggagggtttatgtcagtgggctgatgaagggaggggcggatctgttcgtagaaaatatgccaggttttccagacaatatccggccatcctcttctggtggttactgggtaggaatgagtacaatacggccaaacccagggttctctatgttagattttctgagtgagagaccctggattaagcgcatgatcttcaagctcttttcacaggagactgtcatgaagtttgtcccacgctacagccttgttctcgagctgagcgacagcggtgcatttcgcagatctcttcatgaccccgatgggctagtagcaacctacattagcgaggtgcacgaacacgacggccatctgtaccttggcagttttcgatccccgttcctgtgcaggttaagcctgcaggcagtgtag

SEQ ID NO: 13746 - DNA, 870 bp, Artificial Sequence
  Description of Artificial Sequence: Synthetic coding sequence
atggtgggggtcaaacctgtcggctctgatcccgactttcaacctgagttgagcggagccgggagccggctagccgtcgtcaagttcacaatgcgaggatgtggaccgtgcttgagaattgcccccgctttctcctcaatgtccaataaatacccacaggccgtttttctggaagtcgatgtccatcagtgccagggaacagctgccaccaacaacatttcagctactcccacgttcttgttcttccgcaacaaggtcaggattgatcagtaccagggagcagacgccgtgggcctagaggaaaaaatcaaacagcacctggaaaacgaccccgggagcaacgaagataccgatatacctaagggttacatggacctcatgccttttatcaataaagctggctgtgagtgccttaatgaatcagacgagcacggattcgacaattgccttcgaaaggatacaaccttccttgagagtgactgcgatgagcagctcctaatcacagtggcttttaaccagccagtcaagctctattcgatgaagtttcagggccctgataacggtcaggggcctaaatacgtgaaaatttttatcaatcttccacggtcaatggattttgaggaggctgagcggagtgagccaacacaagccctggaacttaccgaagacgacattaaggaagatggcattgtgcccctgcgatatgtgaagttccagaacgtgaatagcgttacaatttttgtgcagtctaatcagggtgaagaggagactacacgcatctcgtactttaccttcatcggaacacccgtgcaggcaactaatatgaatgattttaaacgggtcgtcggcaagaaaggcgagtcccactag

SEQ ID NO: 13747 - DNA, 1164 bp, Artificial Sequence
  Description of Artificial Sequence: Synthetic coding sequence
atggtgtttgctttctggaaggttttcttaattttgagttgtctagcaggacaagttagcgttgtacaggtgaccattccagacggctttgtgaacgtgaccgttggatctaacgtcacattgatctgtatctacaccacgactgtcgccagccgggagcagctgagcatccaatggtctttcttccacaaaaaagagatggaaccgatctcaatctacttcagccaaggcggacaggctgtcgccataggccaattcaaagacaggatcactggaagtaacgatcccggaaatgcctccataaccatctcccatatgcagcctgcagattcaggcatttatatctgtgacgtgaataaccccccagactttctggggcagaatcagggcattctcaatgtgtcagttctggtgaagcctagtaagcccctgtgtagtgtgcaaggacgccctgagactgggcacactattagtctctcctgcctgtcagcgttgggcactcctagtcctgtgtactattggcacaagctggaagggagagatatcgtccctgtgaaggagaactttaacccaacaaccgggattctggtgattggaaatcttacaaactttgaacaagggtactatcagtgcacagctattaataggctgggaaacagctcgtgtgaaatagatttgacttcttctcaccctgaagttggcatcattgttggagccctcatcggttctctggttggtgcggcaatcatcattagtgttgtttgtttcgcgaggaataaagccaaggcaaaggcaaaggagaggaacagtaaaacaatcgccgagttggagccaatgactaagatcaaccctagaggagaatctgaagccatgccaagagaagatgcaacacaacttgaagtcacacttccttcctcaattcacgagacaggacctgatacaatccaagaacccgattacgagcccaagccaacgcaggaaccggcccctgaacctgctccaggttctgagccaatggccgtgccagaccttgatatcgaactcgagctggaacccgagacccagagtgagttagagccagagcctgagccagaacccgaatccgagcccggggttgtcgtggagcccctctccgaggatgagaaaggggttgtgaaggcatag

SEQ ID NO: 13748 - DNA, 1821 bp, Artificial Sequence
  Description of Artificial Sequence: Synthetic coding sequence
atgagcgatacatcggagagtggcgccggcctgaccagatttcaggctgaagccagtgaaaaggattcttcctctatgatgcagacactgcttaccgtgactcagaacgtggaggtcccggagacacctaaggcttcaaaagctctggaagtctcggaagacgttaaggtgtcaaaagcaagtggtgtaagtaaagccacggaagtctccaaaaccccagaggcacgggaagctcctgcaactcaagcctcctctacgactcagctcaccgatacccaggtgcttgccgcggagaacaagtcactcgccgccgacactaagaaacagaatgctgatcctcaagcggtaacaatgcccgccacggaaactaagaaggtgtcgcacgtggcggacacaaaagtcaatacaaaagcccaggagaccgaggccgcaccctcccaggccccggcagatgagcctgagcctgaatccgcagcagcccaatcccaggaaaatcaggataccagaccaaaggtcaaagccaagaaggcacgcaaggtcaagcacctggatggggaagaagacggaagttctgaccaaagccaggcaagcggaactacagggggccgaagggtttcaaaggccctcatggcatctatggcccggcgggcttctaggggtcccattgctttttgggctaggcgggcaagccgcaccaggctcgcggcctgggccaggagagctttactcagcctgaggtctcccaaggcgagaagagggaaggcacggaggagggctgcgaaacttcaatcaagccaggagcctgaagcccctcctcctcgggacgttgccttactccagggacgcgctaatgatctcgttaagtacctgttggccaaggaccagaccaagatccctatcaaaagatctgatatgctcaaggacatcatcaaagaatacaccgatgtttatccagagataatcgaacgggccggttattcactcgaaaaggtcttcggaatacagctgaaggagattgacaaaaatgaccacctctatatattgctgagcacgcttgaacccacagatgctggcattctgggcaccaccaaggactcgcccaagttggggctgctcatggtattgctgagcattattttcatgaacggaaaccgctcgagtgaggccgtgatctgggaagtgctcagaaaactgggactacggcccggtattcaccacagccttttcggcgatgtaaaaaagctcatcaccgatgaatttgtcaagcaaaaatatctcgactacgctagagtccccaactcaaatccccccgaatatgagtttttctggggacttcgcagctattacgaaacctccaaaatgaaggtactgaagtttgcatgcaaagtccagaagaaggatcccaaagagtgggccgcgcaatacagggaggcaatggaagcagacctcaaagccgcagcggaggctgctgccgaagctaaggcgagagctgagatcagagcccgcatggggatcgggctgggaagcgagaacgccgcaggaccctgtaattgggacgaggctgacattggtccatgggccaaggcaaggattcaggctggtgcagaggccaaggccaaagctcaggagagcggatctgcttctaccggagccagcacctcgaccaacaatagcgcatctgccagtgcctctactagcggtggcttctcagccggcgcctcgctaaccgcgacactgacttttggtctgttcgccggacttgggggagctggcgcaagtacctccggcagttcaggagcttgcggcttctcttataaatag

SEQ ID NO: 13749 - DNA, 369 bp, Artificial Sequence
  Description of Artificial Sequence: Synthetic coding sequence
atgactacggctacaagacaggaagtgctggggctatatcgtagcatttttcggctggcgaggaagtggcaggctacctcgggacaaatggaagataccatcaaagaaaagcagtatatcctaaacgaagctcggactctctttagaaaaaataaaaatcttactgatacagacctgattaagcagtgcattgacgaatgcaccgctagaattgagattgggttgcactacaaaattccatatccccgtcccatccatctcccgcccatgggactgaccccactcagaggccgtggattgaggtctcaggaaaagctgcgcaagctctcaaagcccgtctatctccggagccatgacgaagttagctag

SEQ ID NO: 13750 - DNA, 582 bp, Artificial Sequence
  Description of Artificial Sequence: Synthetic coding sequence
atgctgggagttcttgagctgctcctcctgggggcagcttggctggccggccctgcccgggggcagaacgagaccgagcctatagtacttgagggtaaatgtctcgtggtctgcgacagcaatcctacctccgatcccactggaactgctttaggcatttcggtccggagtggatccgccaaagtggccttttctgcaattcgctccacaaatcacgagcctagcgagatgagcaatcgtactatgatcatctacttcgaccaggtactggttaatatcggcaacaatttcgactccgagcgatccacttttattgcgccacgaaagggtatctactctttcaactttcacgtagtcaaggtttacaaccggcaaaccattcaggtgtcacttatgctgaacggctggcccgtcataagcgcttttgccggggatcaagacgtcactcgggaggccgcctctaacggggtcctgattcagatggaaaaaggggaccgggcctatctgaaactggagagagggaacttgatgggcgggtggaagtactccactttctcaggtttcttggtgtttcctttgtag

SEQ ID NO: 13751 - DNA, 1578 bp, Artificial Sequence
  Description of Artificial Sequence: Synthetic coding sequence
atgtcgcgacagctgctacctgttctgttgcttctgttgcttcgcgcatcttgcccatggggtcaagagcagggtgctagatcacctagcgaggagcccccagaggaagaaattcctaaggaagacggaattttggtcctgtctcgccacactctgggtcttgctttgcgggagcatcccgcactgctggtggaattttatgccccctggtgtggccactgtcaggccttggctcctgaatacagcaaagccgccgctgtgttggccgctgagtctatggttgtgacactggccaaggtggacggcccagcacagcgagagctggccgaagagttcggcgtgactgagtatcccaccctaaagttctttcgcaatggtaaccgcacacaccctgaggagtatacgggcccacgtgatgccgagggcatcgccgaatggttgcgcagacgggttgggccgtccgccatgcgactggaggatgaagccgctgcccaagcccttatcggcgggcgggatctcgttgtgataggcttcttccaggacctgcaggatgaagacgtggccaccttcctcgccttggcacaggacgctttggatatgacattcgggctgactgacaggccacgactcttccagcaatttgggcttacgaaggacactgtggttcttttcaaaaaattcgacgagggtagggccgactttccggtagacgaagagcttgggctggatctgggcgacttgagccgctttctagtaactcactcgatgcgtctcgtgaccgagttcaattcacaaacgtcggccaagatattcgctgcccggatcctcaaccacctgttgctgttcgttaatcaaacattagcagcccatagagagctgcttgccggtttcggcgaggctgctcctcggttccgggggcaggtgttattcgtggtggtggacgtggccgctgacaacgagcacgtacttcaatattttggcctaaaagctgaggctgcgcctacactccgtctggtgaatcttgagactactaagaagtatgctcctgttgacggggggccagtaaccgccgcttctattaccgccttttgccacgcggttttaaatggccaggttaagccttacctgctctctcaagaaattcctcccgattgggatcagagacctgttaaaacccttgtcggaaagaatttcgaacaggttgcgttcgatgagactaaaaatgtgttcgtgaagttttacgctccgtggtgcacccattgtaaagagatggccccagcctgggaggcccttgccgaaaagtatcaggatcatgaagacatcattattgctgagcttgacgcaacggctaatgagctggatgccttcgccgttcacggcttccctactctgaagtactttccagctgggccaggccgcaaagtgatcgagtataagtccacccgtgatctggagacattcagcaagttcctggacaatggtggagtgcttcctacagaagagcctccagaggagccggccgcaccattccctgagcccccggcaaatagtacgatgggcagcaaagaagagctgtag

SEQ ID NO: 13752 - DNA, 2262 bp, Artificial Sequence
  Description of Artificial Sequence: Synthetic coding sequence
atggcagacaagcgcaagctgcaaggggagatcgataggtgccttaagaaggtgagtgaaggcgttgaacagttcgaagacatctggcagaagctccataacgccgctaacgccaatcaaaaagagaagtacgaagctgatcttaagaaggaaattaagaagctgcagagactgcgggatcaaatcaagacttgggtggcctcaaatgagataaaggacaaaaggcagttgatcgataaccggaaactcatcgaaacgcagatggaaagatttaaggtagtggaaagagagaccaaaactaaagcctatagcaaggaaggcttggggctggctcagaaagttgaccctgcacagaaggagaaagaagaagtggggcaatggcttacaaacactatcgataccctgaacatgcaagtggaccagtttgaatctgaagtggaaagcttatcggtgcagactcgaaagaagaagggggacaaggacaagcaagaccgcattgagggactcaaacgacatatcgagaaacatagataccacgtgcgcatgctcgagacaatcctgagaatgctggataatgactcaatactggtcgacgcaattagaaagattaaagacgacgttgagtattatgtggatagctcgcaggatcctgattttgaggagaacgagttcctgtacgacgatcttgatctcgaggacataccacaggcactggtcgcaactagcccgccaagccactctcatatggaggatgagatcttcaatcaatcaagctctacccccacctctaccacaagtagctcccccattccacctagccccgctaattgcactactgaaaactctgaagatgacaagaagcgcggccgatccaccgattccgaagtgtcacaatcgcctgctaagaacgggagtaagcccgtacatagcaatcagcacccccagagcccagccgttccacccacctaccccagcgggccaccacccgccgcctccgcattatccactacgccggggaacaacggtgtgcctgcacccgccgcacctccaagtgccctggggcccaaagcatcacccgcaccttcccataattcggggactccagcaccctacgctcaggctgtggcccctcctgccccatctgggccttccaccactcaacctcggcctccctcagtacaaccctccggcggcggcggaggaggaagcggcgggggtggctcctcatccagcagtaactcatctgcaggcggcggagcgggcaaacaaaatggcgctacatcatacagctctgtggttgcagactccccagcggaggtcgctctgtcttcttccggaggcaataacgcctcttcgcaggcactcgggccgccttccgggccccacaacccccccccatctacctcaaaagagcctagcgctgcggcacccactggggcaggcggtgttgcgcccgggagcggaaataacagcggcggaccttccctgctggtccccctcccggtcaacccacccagttcccccacaccctcattttccgatgccaaagccgcaggagccctcctgaacgggcccccccagttctcgacggcacccgagattaaagccccagaaccattatcaagcctgaagagtatggcggagcgggcggcaatctcatctggcatcgaagacccagttcccacactccaccttacagaacgggacatcattcttagttccaccagtgcaccaccagctagcgcgcagccccctcttcaattgagcgaggtgaacataccgctgtctctgggagtttgccctctcggcccagtacccctgacaaaagagcaactgtatcagcaggctatggaggaggccgcctggcaccatatgccccatccttctgactctgagcgaattcggcaatacctgccaagaaatccgtgcccaacgcctccctatcaccaccagatgcctcccccacatagcgataccgttgaattttatcaacggctgagtaccgagactttatttttcatcttctattacctggaaggcaccaaggctcagtatctggcagctaaagctctgaagaagcagtcctggcgcttccacacaaaatacatgatgtggttccagcgccacgaggagcctaagaccattacagatgaattcgagcaggggacctatatctacttcgactacgaaaaatggggccagcggaagaaggagggtttcacatttgaatataggtatctagaggatagagatctgcaatag

SEQ ID NO: 13753 - DNA, 1146 bp, Artificial Sequence
  Description of Artificial Sequence: Synthetic coding sequence
atgcccttcggaaatacccataacaaatttaaactgaactacaaaccagaagaggagtaccctgacctgagcaaacacaacaaccacatggctaaggtgctaacacttgagctgtacaaaaagctgagggacaaagagacacccagcgggttcaccgtggacgatgttatccaaaccggtgttgacaatccgggtcacccatttataatgactgtgggctgcgtcgctggagacgaggaatcctatgaggtgtttaaggaactgtttgatcccatcatttcagacagacatgggggctataagccaacagacaaacacaagacagacctcaatcacgagaacctgaagggaggagacgatcttgatcctaactatgttctgagttctagagtgagaaccggccgcagcataaagggttacacactcccacctcattgttcacgaggggaaaggagagctgtggagaagctatcagttgaagcactgaactccttgaccggcgaattcaaagggaaatattacccattaaagtccatgacagagaaagagcagcagcagctcatagatgaccatttcctgtttgacaagcccgtgtcccctctactcttagcttctgggatggcacgcgattggcccgacgcacgcgggatctggcataacgataacaaatcatttctagtgtgggtcaatgaagaagatcatctcagggtaatttctatggagaaggggggcaatatgaaagaggtatttaggaggttctgcgtcggtctgcagaagattgaagagatcttcaagaaagcaggtcatcccttcatgtggaatcagcacctcggatacgtcctgacttgtccaagcaacctggggaccggactccgcggtggggtccatgtgaagctcgctcatctgtcaaaacatcctaagtttgaggaaatccttaccaggctcagattacagaaaagaggcaccggaggagtcgacaccgcggcagtggggagcgtattcgacgtaagcaatgctgaccgactgggatctagcgaggtcgagcaggttcaattggtagtcgatggcgtgaaactgatggtggaaatggaaaaaaaactcgaaaagggacagagtatagatgatatgattcccgcacagaaatag

SEQ ID NO: 13754 - DNA, 300 bp, Artificial Sequence
  Description of Artificial Sequence: Synthetic coding sequence
atggcccagggccagagaaaatttcaggctcataaaccggccaagtctaaaaccgccgctgccgcctcagaaaaaaatcggggtcccagaaaagggggcagggtcatcgccccgaaaaaggctagggtagtgcaacaacaaaagcttaagaagaacttggaagtgggcattagaaaaaaaattgaacacgacgttgttatgaaggcttcctcctccttgcctaagaagctggcactacttaaagctcccgccaagaaaaaaggcgcagccgcagccacttccagcaagacccccagttag

SEQ ID NO: 13755 - DNA, 1491 bp, Artificial Sequence
  Description of Artificial Sequence: Synthetic coding sequence
atggacgatgtgcccgcgccaacacctgccccagcaccaccggcggcagcggccccaagggtgccctttcattgcagtgagtgtgggaaaagctttaggtaccggagtgaccttcggcgccatttcgccagacacacggcgttgaagccccacgcctgtccccggtgcggcaaaggcttcaaacatagtttcaacctggctaaccacctgaggagtcatacgggcgaaagaccttatcggtgcagcgcctgtcctaaggggttccgggactcaactgggcttcttcaccaccaagtggtccacactggcgagaagccatattgctgccttgtgtgtgaactgaggttttcttcccgtagttccctcgggcgccatctgaaaaggcaacataggggtgtccttccctctcctttgcaacctgggccgggattacccgctctgtccgctccttgctcggtgtgctgcaatgtgggtccctgtagcgtgtgcggaggctctggcgccggtgggggagaggggcccgagggagcaggggcaggcttaggaagctggggtctggccgaagccgccgccgctgctgccgcctctctgcctcccttcgcctgtggggcttgcgcaagacgattcgaccacggtagggaactggccgcccactgggcggcacacaccgatgtaaaacctttcaaatgccctcgctgtgagcgggattttaatgcccctgcccttctagaacggcacaaactcacccacgatcttcaaggtccgggtgctccccccgcgcaggcttgggcagccggaccaggcgcgggaccagaaacagctggcgaggggactgccgcagaggctggcgatgcgccactcgcgagtgacaggcggctgcttcttggcccggcggggggtggtgtgccaaagctaggtggactgcttcccgaaggcggtggggaggccccagccccggccgctgcagccgagccgtccgaggatacattataccagtgtgattgcggaactttctttgcctccgctgctgcactggcgtctcacctggaagcccattctgggccggccacctatggctgtggtcattgtggcgccctgtatgcggctctggccgcacttgaggaacacaggcgagtgtcacacggcgagggggggggtgaggaggcagccacagctgctagggagcgggaacctgcttctggcgagcctccctccggctcaggaagaggcaagaagatcttcggatgtagtgagtgcgagaaattgtttaggtccccccgagacttggagaggcatgtactcgtacataccggggaaaagccctttccatgtctggagtgtggcaagttcttccgtcatgagtgctacctgaagcgccaccggctccttcatggcacagagaggccatttccatgtcacatttgtggtaaaggatttattaccttgagcaacttgagtcgccacttgaagttacatcgcgggatggactag

SEQ ID NO: 13756 - DNA, 663 bp, Artificial Sequence
  Description of Artificial Sequence: Synthetic coding sequence
atgaaaagcgtaatctaccacgcactgtcccagaaagaggcaaatgacagcgatgtgcagcctagcggcgctcagcgggcagaggcgtttgtgcgagcattcctgaaaaggagcactccaaggatgtcccctcaagcccgcgaagatcagctgcagagaaaggccgtggttctagagtacttcaccagacataaaaggaaagaaaagaagaaaaaagctaaaggcctgagcgcacggcaacgcagggagttaagattgttcgatatcaagcccgaacagcagcgatatagtttatttctcccccttcacgagctgtggaaacagtacattagagatctgtgctctggattaaagccagacacacaacctcagatgattcaagctaagttgctgaaagccgacttgcacggtgcaataatttctgtgaccaaatcaaagtgtccatcctacgtgggcatcacaggaatcttactgcaggaaaccaagcatatcttcaagataatcacaaaggaagacaggctcaaggttatcccgaagttgaactgcgtgtttactgttgaaactgacggttttatcagttacatctatggctccaaatttcagcttagaagcagtgagcgcagcgccaagaaattcaaggctaagggaaccatcgatctttag

SEQ ID NO: 13757 - DNA, 768 bp, Artificial Sequence
  Description of Artificial Sequence: Synthetic coding sequence
atggctcgagcgaaagcactgctgggaggtccaggcgaagagctagaagccgatacagagtacttagacccgttcgatgcccagccacaccctgccccaccagacgacggctacatggaaccatacgacgcacagtgggtcatgtctgaacttcccggccgcggtgtccagctttatgacacaccttacgaagagcaagatccagagacagcggacgggccccccagcggtcagaagccccgccaatcccgcatgccacaagaggatgaaagacccgccgatgagtatgatcagccatgggaatggaaaaaagaccacatcagccgcgccttcgctgtgcagttcgacagccccgaatgggagaggacacccgggtcagccaaggagctgaggaggccacctccgcgttctccacaacctgcagagagggtggatcccgctctacccctcgaaaagcagccttggttccatggacccttgaacagagcagatgccgaatcattactaagtctatgtaaagagggatcgtacttagtgaggttgtccgagactaatccccaagactgcagcctgtctctgcgctcatctcagggttttttacaccttaaattcgctcgcacacgtgagaatcaagtggtgctggggcagcactcaggcccattcccctccgtcccagagctggtcctgcattattccagtcgccccctgcctgttcagggggccgagcacctggctctcctttatccagttgtgactcagaccccctag

SEQ ID NO: 13758 - DNA, 858 bp, Artificial Sequence
  Description of Artificial Sequence: Synthetic coding sequence
atgagtgacgatttcctttggttcgagggaatcgcctttcccactatggggttccgcagtgagacgttacgcaaggtaagagatgagtttgtcatccgggacgaagacgtgattatactgacataccccaagtctggtaccaactggctcgccgagatcctttgtctgatgcattcgaagggagacgccaagtggattcagtccgtacctatttgggagcgatccccttgggtggagtctgagattgggtacaccgccttgagcgaaactgagtctccccgactattttcttcccacctgcctatccagctgtttccgaaaagctttttttcctcaaaagccaaagtcatatacctcatgcggaacccgcgggacgtgttagtatcaggctattttttctggaagaatatgaagttcataaagaaacccaagtcgtgggaggaatactttgaatggttctgccagggaaccgttctttatggcagctggttcgatcacatacatgggtggatgccaatgcgtgaggaaaagaatttccttctgcttagctacgaggagctcaagcaagatacaggtagaacaatagagaagatctgccagtttcttgggaagacactggaacccgaagaattaaatcttatccttaaaaacagctctttccaatctatgaaagagaataagatgagcaattacagccttctgagtgttgactatgtagtggacaaggcccagttgctgcgaaagggcgtgtctggagactggaagaatcactttaccgttgcccaagcggaggatttcgacaagctgttccaggagaaaatggctgatcttccccgtgagcttttcccatgggaatag

SEQ ID NO: 13759 - DNA, 1647 bp, Artificial Sequence
  Description of Artificial Sequence: Synthetic coding sequence
atgaaaaccccagcggacacagggttcgcatttcccgattgggcttacaagccagaatccagcccaggcagcagacagatacaactttggcacttcattctggagcttcttcgaaaggaggaatatcagggcgtcattgcttggcaaggtgactatggcgaattcgtgatcaaagaccccgatgaggtcgcccgcctctggggtgtgagaaaatgtaagccgcaaatgaattacgacaaattgtctagggctttgagatactactacaataagaggatcctgcacaaaacaaagggcaaaagattcacttataaattcaattttaacaaactagttctcgttaactatccatttattgacgtgggcctcgccggaggtgcagtccctcagtccgcccctccagttccgagcggggggtctcactttaggttcccaccctctacaccatccgaggtattgagcccaaccgaggatccgcgctccccgccggcctgctcatcttcgtcgtcgtcactcttcagtgccgtcgtggcgaggcggttgggacgggggtccgtttccgattgcagcgatggaacctctgagctcgaggaacccctcggcgaagacccgcgtgcccggccccccggcccaccggatctgggagctttcaggggacctcctttagcaaggctgccacacgaccctggcgtcttccgggtctacccgcggccacgagggggccccgaacccctctccccctttcctgtgagccctttggctggccctggctcattgctgcccccccagctctctcctgcactgcccatgactcctacccatctggcctacacccctagccccactttgagccctatgtatccctccgggggcggtggcccttcgggaagcggcggtgggagccatttctcttttagtccggaggatatgaagcgctacctgcaggcgcacactcagtctgtgtacaattatcatctgagcccacgggctttcctacactacccaggactggttgttccgcagccgcagcggccggacaagtgtccgcttcccccgatggcccccgaaacccctccggtgccctcgtctgcatcctctagctccagctccagcagtagtccattcaagtttaagcttcagccaccacctctcgggagacggcaaagggctgctggcgaaaaggccgtggccggcgcggacaagagtggaggatctgctggaggactggctgaaggggccggagcactcgcacccccgcctccgccaccccagatcaaagttgaaccaatatcagaaggcgaaagcgaagaagtcgaggtgaccgatatcagcgatgaagacgaggaggatggcgaggtgttcaaaacacccagggcgccgccagctcctccaaaaccagagcctggcgaagcccctggtgcctcccaatgcatgcccttgaagctacggtttaagagacgctggagtgaggactgcaggttggaaggtgggggtggaccagccggaggcttcgaggacgaaggtgaggacaagaaagtgcggggtgaagggcccggggaagccggcggcccgctgaccccgagacgggtgtcctcagatctgcagcacgccaccgcccaactgtccttggagcaccgagactcttag

SEQ ID NO: 13760 - DNA, 1530 bp, Artificial Sequence
  Description of Artificial Sequence: Synthetic coding sequence
atgggagttctcaagtttaaacatatctttttccgaagcttcgtgaaaagcagcggggtctcgcagattgtattcacatttctactcataccctgctgtctgactctgaattttcgcgcccccccagtgatccccaatgttccttttctgtgggcctggaacgctccctccgagttttgcttgggtaagtttgatgagccactcgacatgagccttttttcttttattgggtcccctaggattaatgccactgggcagggggtgacaatcttttacgtagaccgtctggggtattacccttatatcgacagcatcacaggcgtgactgttaacggggggatcccgcagaagattagcttacaggaccacctggacaaagccaaaaaggacatcacattctacatgcccgtggacaatctgggcatggcagtcatagattgggaagagtggagacctacttgggcccggaactggaaaccgaaagacgtatacaaaaaccgctccatcgagcttgtacaacaacagaacgtccagctcagtcttacagaggctacagaaaaagctaaacaagagtttgaaaaggcagggaaggacttcctagttgagactatcaagttgggcaagctgctgcgccccaatcatctctggggctactacctgttccccgactgttacaaccatcactataagaaaccaggttacaatggcagctgcttcaatgtcgaaatcaagaggaatgatgacctgagttggctatggaacgagtcgaccgccctttacccctccatttacctgaacacacagcagtctcccgtggccgccacgctttacgtgagaaaccgagtgagggaagcaataagggtcagtaaaataccggatgccaagtcccctctgcccgttttcgcatacacacgcattgtattcaccgaccaggtgttgaaattcttgagccaggacgagttggtgtacacctttggcgaaacggtggcgcttggcgcctccggaatcgtgatctgggggacactgtctataatgcgaagtatgaaaagctgcctcctgcttgataactatatggagactatccttaatccctacataatcaatgtcactctggccgccaagatgtgcagtcaggtcctatgtcaggagcagggagtatgcatcagaaaaaattggaactcgtccgactacctgcacttgaaccctgacaattttgccatccaactggagaagggaggcaagtttactgtccgagggaaacctaccctcgaggatcttgagcaatttagcgagaaattctactgctcatgttactccactctcagttgcaaggaaaaagccgatgtgaaggacacagatgctgtcgacgtgtgcattgccgacggtgtctgtatcgacgcattcctcaagccgccaatggaaacagaggagccccagatcttttataacgcctcgccctctacattatctgccacaatgttcatcgtgtctattctgtttctgatcatcagtagcgtggccagtttgtag

SEQ ID NO: 13761 - DNA, 1041 bp, Artificial Sequence
  Description of Artificial Sequence: Synthetic coding sequence
atggagacacagttgtcaaacggcccaacatgtaacaacacagcaaacgggcctactactatcaataacaattgctcgagtccggttgattctgggaacactgaggatagcaagaccaatctaatcgtcaactatctgccgcagaatatgacgcaggaagagctcaagtccctcttcggaagcatcggcgagatcgagtcctgcaaactggtgcgcgataaaataacaggacagagtctgggatatgggtttgttaactatatcgatcctaaagatgctgagaaggccattaataccctaaatgggctgcgcctgcagactaagactatcaaagtttcctacgctcgtccttcctcagccagtatccgcgacgcaaacctttacgttagcgggctcccgaaaaccatgacccagaaggaactcgagcagctcttcagccagtacggtaggatcattacaagccggatcctggtagatcaggtgactgggatctctcgcggggtaggattcattcggttcgataaaaggatagaagcagaggaggctatcaagggactcaacggccagaagcctcctggcgcaactgaacctataaccgtgaagtttgcaaacaatcctagccagaaaaccaatcaggctattctttcccagttatatcagagtcctaatagacgttacccaggccctctagctcagcaggcacaaaggttccgtttctctcccatgaccattgacggcatgacgagcttagccgggattaacatccctgggcatcctggaaccggttggtgtatcttcgtgtataatcttgccccagacgctgatgaatcaatcctgtggcagatgttcggcccatttggcgctgtcaccaatgtgaaggtgatacgcgactttaatacaaacaagtgcaaaggattcggttttgtgactatgaccaattatgacgaggccgcgatggcgatcgcttccctaaacggctaccggctcggcgacagagtactccaggtatctttcaagactaacaagacgcacaaagcttag

SEQ ID NO: 13762 - DNA, 1437 bp, Artificial Sequence
  Description of Artificial Sequence: Synthetic coding sequence
atggcccatgtgcctgctagaacttcccccggcccaggacctcagcttctgttgctcttgctcccgctatttttactgctccttcgggacgtagccggttcccaccgagcaccggcctggagcgccctgcccgccgcagctgatggcctgcagggcgatcgagacttacagcgtcatcccggagatgcggcggccacactgggcccctctgcacaggacatggttgccgttcacatgcatcgcctatacgagaagtactcccggcaaggggcacgccccggtggcggcaacaccgtaagatctttccgagccagattagaagtcgtggaccaaaaagccgtgtacttttttaacctgacaagcatgcaggactctgaaatgatcctaacggccacatttcatttctactccgagccccccaggtggcctcgggctctcgaagtgttgtgcaagccgcgggcaaaaaatgcgtccgggcgacctctccccctgggcccacccacacgtcagcacttgctgtttcgctccctgtctcagaataccgcaacccagggattactcagaggtgcaatggcacttgcaccacctccaagagggctgtggcaggccaaggatatcagcccgatcgtgaaggctgcgcgccgcgacggcgagctgttgctgagtgcccaactcgactccgaggaaagggacccgggggtaccgagacctagcccttacgctccttatatactggtctatgcgaatgacctggcaatctcggagcccaactctgtcgctgtcaccctccagagatatgatcctttcccggcgggtgatcctgaaccgagagcggccccaaacaactccgcggaccctagagtaagacgcgccgcacaggctacaggcccacttcaggataacgagctgcctgggcttgatgagcgcccaccgcgcgcacacgcacagcacttccacaaacaccaactgtggccctcaccattccgcgctttgaagccacgaccagggcgaaaagaccgtcggaagaagggccaggaagtgtttatggctgcctcccaagtgctggacttcgacgaaaaaactatgcaaaaggcacggcgtaaacagtgggatgagccccgcgtgtgcagcagacggtacctcaaggtggactttgctgacatcggctggaacgagtggatcatctctcctaagtccttcgacgcctattactgtgctggagcatgtgagttccccatgccaaaaatcgtgcgcccatccaatcatgcaaccattcagagcattgtgcgggccgtgggtatcatccccggcattcccgagccatgctgtgtgcccgataagatgaactccttgggtgtcctgttcctagacgaaaaccgaaatgtcgtactgaaggtttaccccaacatgtctgtagatacctgcgcgtgtcgatag

SEQ ID NO: 13763 - DNA, 978 bp, Artificial Sequence
  Description of Artificial Sequence: Synthetic coding sequence
atggaatccaaaatgggtgagcttccacttgatattaatattcaggagccaagatgggaccagtcgacatttttaggaagggctagacatttttttacggtgaccgacccgcggaacctgctgttgtcgggggcccagctggaggccagccgcaacatagtccaaaattaccgcgctggggtggtgacccctggtattaccgaagaccagctgtggcgggcaaaatacgtctatgatagcgcattccacccagacaccggggagaaagtggtactgatcgggagaatgagcgctcaagttcctatgaacatgactattacaggttgtatgctgactttttatcgcaaaactcccacggttgtgttttggcagtgggtaaatcaatcatttaacgcaattgtcaactacagcaataggagtggagacacccctataaccgtgaggcagttgggcaccgcctatgtcagcgcaactacaggcgccgtggcaacggccctcggactgaagagtcttaccaaacatctccccccgcttgtggggcggttcgtacccttcgccgccgtggctgccgccaactgcatcaacatcccacttatgcggcagagggagctccaggtcggaataccggtagcagacgaagccggacagcgcctcggctacagtgtgacggctgctaagcagggcatcttccaagtggtcatcagccggatttgcatggcaattccagcgatggcaatcccgccgttaatcatggacacactggaaaagaaggacttcctgaaacgccggccttggctcggggcacccttacaggttggcttggttggcttttgccttgtgtttgccacacccctctgctgtgccctcttccctcagaagagttctatccacattagcaatcttgaacccgagctgcgggctcaaatccatgaacagaacccttctgttgaggtggtctattacaacaaaggcctatag

SEQ ID NO: 13764 - DNA, 1068 bp, Artificial Sequence
  Description of Artificial Sequence: Synthetic coding sequence
atggaacctcacctgctgggactgttactgggcttgctactgggcggcactcgcgtacttgccggctaccccatttggtggtcacttgcactcgggcaacaatataccagcctgggtagtcagcccctgctgtgcggctcaatccctgggctcgtccctaagcagttgagattctgccgaaattacatcgagattatgccgtctgtggcagagggcgtcaagttggggattcaggagtgccaacatcagttcaggggaaggcgctggaactgcaccaccatcgacgatagccttgccatctttggcccagtactggacaaagctaccagggagagtgccttcgtgcacgctattgcaagcgctggggtggcctttgcggtgactcgttcctgcgctgagggaacctctaccatctgtggatgcgattcacatcataagggccctccaggcgaaggctggaagtggggaggctgtagcgaagatgctgattttggggtgctcgtgtcacgggagtttgcagatgctagagagaaccgcccagacgcgcgaagtgcaatgaataagcacaacaatgaggctggaagaacaaccatccttgatcacatgcaccttaaatgtaaatgccatggactgtctggtagctgtgaggtcaaaacttgctggtgggcccaaccagacttcagagcaatcggcgattttctgaaagataagtacgactccgcttctgagatggttgttgagaaacatcgagaatccagaggctgggttgaaaccctccgcgccaagtattccctgttcaagccccctaccgagcgggatctagtgtactatgaaaatagcccgaacttttgcgaaccaaatcctgagacgggttcctttggcacacgagaccggacctgcaacgtgacctcacacgggatagatgggtgtgacttgctctgttgcggccggggccataacacacgcacagaaaagcgcaaagaaaagtgtcactgcatcttccattggtgttgttacgtctcatgtcaggaatgcatccggatctacgatgtgcacacctgcaagtag

SEQ ID NO: 13765 - DNA, 1437 bp, Artificial Sequence
  Description of Artificial Sequence: Synthetic coding sequence
atggctgccaggcccattacactgggaatcgatctcggaacaacatctgttaaagcagctcttctgcgggccgccccggatgacccgtccggattcgcagtgctggcatcttgtgcccgcgccgcacgggccgaagctgctgtggagtctgcagttgcgggcccgcagggccgggagcaggatgtgagtcggatcctgcaggcactgcacgaatgtcttgccgctctgcctagacctcagctccgatctgtagtgggcattggagtgtctggccaaatgcacggcgttgtcttctggaagacgggtcaagggtgtgaatggactgagggggggatcacacccgtatttgaacctcgtgccgtctcccatctggtcacttggcaggacgggcgctgcagttctgaattcctggcgtccctacctcagcctaagtctcacctgtcagtggcaactggatttgggtgcgcaaccattttttggctgttgaagtacagaccagagtttctgaaatcttacgacgctgcggggactattcacgattatgtggtagctatgctgtgcggcctgcctcggccactgatgtccgaccagaacgccgcgtcatgggggtacttcaatacacagtctcagtcgtggaatgtggaaaccctccgcagtagtggcttccctgtacatttgctgcctgacatagccgaacctggttcggtcgccggcagaaccagccacatgtggtttgagatcccgaagggaactcaagtaggggtcgcccttggagacctgcaggccagtgtatacagttgtatggcccagcggacagacgctgtcttgaacatttccaccagtgtgcaattggccgcttcgatgccatccggattccaacccgcacagacgcctgaccccacagcccctgtggcttactttccctattttaatcggacctacttaggggtggctgcttccttgaatggcggcaatgtcctcgcaacatttgtgcacatgctcgtccaatggatggctgatctgggcctggaggtcgaggagtctacagtttattccaggatgatccaggctgccgtgcagcaacgagacacccatttgactataacaccaacagtattgggggaaaggcacctcccggaccagctggctagcgtgacacggatctcctcctctgatcttagcctgggccacgtgacacgagctctgtgcagaggcattgtgcagaatttgcattccatgctccctatccagcagttgcaggattggggagtggagcgagtgatggggtccggctccgcgttaagtcggaatgacgtgttgaagcaggaagtacagcgagctttcccccttcctatgtcctttggacaggacgtcgacgcagctgtcggggctgcgctggtgatgttgcgacgacacttaaatcagaaagagtcatag

SEQ ID NO: 13766 - DNA, 1578 bp, Artificial Sequence
  Description of Artificial Sequence: Synthetic coding sequence
atgaggcgccggaggcgacgcgacgggttctacccagctcctgacttccgagaccgagaagccgaggacatggccggagtgttcgacatcgatctcgaccagcccgaagatgcaggctcagaagacgaactagaggagggcggccagctcaacgagagcatggaccacgggggggtgggcccctatgagcttgggatggagcattgtgagaaattcgaaataagtgagactagcgtaaacagggggcctgagaaaattagacccgagtgtttcgaactgctgcgggtgctcggcaaaggtggatacggcaaggtgtttcaggtaaggaaggttaccggggccaatactggcaagatctttgccatgaaagtgctcaagaaggctatgatagtgcggaacgcaaaggatacggcgcacacaaaggcagagcggaacattctcgaggaggttaagcatcctttcattgtagatttgatctacgcatttcaaaccggggggaaactttatctgatcctagagtacctcagtggtggggagctttttatgcagctggaacgcgagggaatcttcatggaagatactgcatgtttctacttagctgaaatttctatggctctcggccatctgcaccaaaaaggcatcatttacagagaccttaaaccagagaacatcatgttgaatcatcaggggcatgtaaagctgacagactttggcctttgcaaagaaagcattcacgacggaacagttacccataccttctgcgggaccatcgagtatatggcaccagagatcctgatgcggagtggccataacagagctgtggactggtggagcttaggtgctctcatgtacgacatgctcacaggggctccgccattcaccggcgaaaaccgtaagaagactatcgacaagattctgaaatgcaaattgaatttaccaccctatcttacccaagaggccagggatctactgaaaaaattgctgaagcggaacgccgcaagcagactgggcgccgggcccggcgatgcaggggaggtgcaggctcatccattctttagacatatcaactgggaagagctgctggcgcgcaaggttgaaccaccttttaaacccctgctccaaagcgaagaggatgtgtctcagttcgactcgaagttcaccagacaaacccccgtagattccccggacgattccacgctctctgagtctgccaatcaggtttttcttggatttacctacgtagcccccagcgttttagaatcggttaaagaaaagttcagtttcgaaccaaagatccgcagcccaaggagatttatcggcagtccaagaacacctgtctcaccagtcaagttttcccccggcgacttttgggggcgtggtgcgagcgctagtaccgccaacccccagacccctgttgagtatcccatggagacctctgggattgagcagatggacgtgacaatgagcggggaagcgagcgctccgttacctattaggcagcccaattcaggcccgtataaaaagcaggccttcccaatgatttctaagcgcccagaacacctcagaatgaacctttag

SEQ ID NO: 13767 - DNA, 987 bp, Artificial Sequence
  Description of Artificial Sequence: Synthetic coding sequence
atggcccgtacagtggttctaataacaggttgctccagcggcatagggctgcatctggccgtaaggctggcctctgacccctctcagtcttttaaagtctacgctacactgagagacctgaagacacaaggtcgcctgtgggaagctgcccgagccttagcttgtccgccaggatccctggagactttgcagctcgatgtcagagactcaaaatccgtggctgcagccagggagcgggttaccgagggaagagtcgacgtcctggtatgtaatgctggccttggcctgctgggaccactggaagcactcggagaggatgctgtggctagcgtactggatgtcaacgtggttggaaccgttcggatgctgcaggccttcctgccagacatgaagcgccggggctcaggcagggtcttagtgaccgggagtgtcggcggcctgatgggtctgccctttaacgacgtctactgcgccagcaaatttgctcttgaagggctctgtgaatctctggccgttttactcctcccatttggcgtgcacctatcattgatcgaatgtgggcctgtccataccgcattcatggagaaggttctggggtctccagaggaggtgttagataggaccgacattcacacattccacagattctatcagtacctggcccactcaaagcaggtttttcgagaagcagctcagaaccccgaagaagtcgcagaggtctttctgacagcactgcgagctcccaaacccaccctccggtatttcaccacagagagattcctgcccctcctgcgcatgaggctagatgacccgtctggaagtaattatgtgacagctatgcatagggaggtgttcggtgacgttcctgccaaggccgaggctggcgctgaggcaggtggaggcgccggtccgggcgccgaggatgaggcagggcggggagcagtgggcgatccagagcttggagacccgcccgctgccccccagtag

SEQ ID NO: 13768 - DNA, 1626 bp, Artificial Sequence
  Description of Artificial Sequence: Synthetic coding sequence
atgcccggcctgagacgggaccgcctgctgaccctgctgcttctgggggcactgctctccgccgacttatattttcacctgtggcctcaggtgcagcgtcaactaaggcctcgtgagaggccacggggatgtccctgcaccgggcgtgcgtcctccctggcgagagatagtgcagcagctgcatcagatcctgggacaatcgtgcacaattttagcagaaccgagccccgcaccgaacccgccggcggaagtcatagtggatcttcttctaagcttcaggccctctttgctcacccgttatacaatgttcccgaagagccacccctcctgggggctgaggactcccttcttgcaagccaggaagctctgaggtactaccgtcgaaaggtcgcccggtggaacagacgacacaaaatgtatcgggagcagatgaacctgaccagcctcgatcctccactgcagcttaggctcgaagcgtcatgggtgcagtttcacttaggcattaataggcacggactgtactctaggagctcaccggtggtgagtaagctgctgcaggacatgcggcatttcccaaccatcagtgctgattacagccaagacgagaaagctctgttgggtgcatgtgactgcacccagattgtgaaaccatcaggcgttcatctaaagcttgtactcagattcagtgatttcggcaaggctatgtttaagcctatgcgccagcagcgtgacgaggagacaccagtggactttttctatttcattgactttcagagacacaatgcagagattgcagcctttcacttggacagaatccttgacttccgtcgtgtaccaccaacagttgggcgcatcgttaacgttaccaaagagatcctcgaagtcacaaagaatgagatactgcaatccgttttttttgtgagcccagctagcaacgtgtgttttttcgcaaaatgcccttatatgtgcaaaactgagtacgccgtgtgcggcaatcctcacctgttggaagggagtctttccgctttcctcccaagcttgaatctggctccccgcctgagcgtacctaacccctggataagatcctataccctcgcagggaaggaagaatgggaggttaacccactgtactgcgacacagtgaaacagatctatccttacaacaacagccagaggctgctgaatgtaattgacatggccattttcgactttttgatagggaatatggacaggcatcattacgagatgttcacaaagttcggagacgatggatttctcattcatctggataatgcccgaggcttcggacgtcatagtcacgatgagataagtatattgtcacccctgagccagtgctgcatgattaaaaaaaagacactacttcatttacagctgttggcgcaggcagactaccggctgtcggatgtgatgagagagtcactgttggaggaccaattatcacctgtgctgacagaacctcaccttttggccctcgatagacgcttgcagactattttgcggacagtggaaggctgcatcgtcgctcacgggcagcaatccgttatcgttgacggaccggtggaacaactggcgcctgattccggccaggcaaaccttaccagttag

SEQ ID NO: 13769 - DNA, 954 bp, Artificial Sequence
  Description of Artificial Sequence: Synthetic coding sequence
atgaaaacggccttaatactgctcagcattcttggtatggcctgtgcgttcagtatgaagaatttgcatcgccgcgtcaaaattgaagatagcgaggagaatggtgtgtttaagtaccgcccccgttattacttatacaaacacgcatacttttatccccacttgaagagattccccgttcaagggagttcggactccagtgaagagaacggtgatgacagttctgaagaagaggaggaagaggaggaaacctctaatgaaggcgagaacaacgaggagagcaatgaggacgaggacagcgaggcagaaaacacaacactctccgccactactttaggctacggggaggatgccaccccagggactgggtacacaggacttgccgctattcaacttcctaaaaaggcaggggacattacaaacaaagcaaccaaggaaaaagaaagcgacgaggaggaggaggaagaggaggagggcaacgagaacgaggaaagcgaggcagaggttgacgaaaacgagcaaggaattaacggaacttccaccaatagtacagaggccgagaacggaaacgggtcatctggcggcgataatggtgaggagggagaagaagagtcagtaaccggggccaacgccgaagatacaactgaaactgggaggcagggcaaaggaacgtccaaaacaacgacctcgcctaacggtggcttcgagccaacaaccccacctcaagtgtaccggactacctctccccctttcggcaagactacaactgtggagtacgagggggaatatgagtacactggtgctaatgagtatgacaatggttacgaaatttacgagagtgagaatggagaaccgagaggtgataactaccgggcttacgaggatgagtactcttacttcaaaggccagggttatgatggctatgacgggcagaattactaccaccaccagtag

SEQ ID NO: 13770 - DNA, 345 bp, Artificial Sequence
  Description of Artificial Sequence: Synthetic coding sequence
atgtctctccctagctctcgggccgccagagtgcctggacccagcggcagcctgtgcgcgctcctcgccctccttttgttgctgaccccccctggcccgctggcgagcgccggtcctgtctcagctgttctgaccgagctgagatgcacttgtttacgagtcacattgagagtcaaccccaaaactattggtaagctccaagtgtttcccgcgggcccccagtgttccaaggtggaggttgtcgccagccttaaaaacggcaagcaggtgtgcctggacccagaagccccttttctcaaaaaagtcatacagaagatactggacagcgggaataaaaaaaattag

SEQ ID NO: 13771 - DNA, 2100 bp, Artificial Sequence
  Description of Artificial Sequence: Synthetic coding sequence
atgccaagtctgtggcgcgagattttactggagagcttactgggctgtgttagttggtcactttaccacgacttggggcctatgatttattattttcccctccagacccttgaactaactgggctcgaaggtttttccattgcctttctctccccgatttttttgacaatcacaccgttctggaaactggtcaataaaaagtggatgctgacgttgctgagaattattaccatcggttcaatagcgtccttccaagccccaaacgctaaactgcgactgatggtgctcgccttaggcgtgtcaagctccctcatagtacaggccgtgacctggtggtcaggatcacatttgcaacggtatctgaggatttggggcttcatcttgggtcagatcgtcctcgtagtgctgagaatctggtacactagcttaaatccaatttggtcataccagatgtccaacaaagtgatcctgaccctcagtgcaatcgcgactctggaccggatcggaacagacggcgactgtagcaagcctgaagaaaaaaagactggagaggtggcaacgggaatggcttctcgtccgaattggctgctcgctggcgccgctttcggctctctggtgttcctcacccactgggtcttcggagaggtgtccctggtgtcgcggtgggcggtgagcggacatcctcaccccggccctgaccctaatccatttggcggagctgtgctgctgtgtctggccagtggcctcatgctgccttcctgtctgtggtttcggggcaccgggctcatttggtgggtgaccggcacggctagcgccgccgggctgctgtatctccacacatgggcggctgccgtgtccggatgcgttttcgcaatcttcacagccagtatgtggcctcagaccttggggcacctgataaactctggaacgaatccaggaaaaaccatgactatagcgatgatcttctacctcttagagatcttcttctgtgcgtggtgcacagcattcaagtttgtgcccggcggtgtgtacgcacgcgagagatctgacgtactgttaggcacaatgatgctgattatcggcctcaatatgctgttcggacctaaaaagaatctcgatctactgctgcagaccaagaactccagtaaggtcctgttccgcaaatctgagaagtatatgaagctgtttctgtggctgctggtgggagtaggtctgttgggtctcggcctgcgacacaaagcctatgagagaaaactcggaaaagtcgccccaacaaaggaggtctctgctgctatctggccattcagattcggatatgataacgagggttggtcatccttagagagaagcgcccatcttctgaatgaaacgggcgcggactttattaccatcctggaaagcgatgccagcaaaccatacatgggcaacaatgatctcactatgtggctcggagaaaaattaggattctataccgactttggtccctctacaagataccacacctggggaatcatggctctgagtcgttatcctattgtaaagtctgagcatcacctcttaccttcaccagagggagagatcgctcctgctattacactgacagttaatatttcaggtaagctagttgatttcgtggtgactcactttggcaatcatgaagatgatctggacaggaaattgcaggccatcgcagtaagtaaactgcttaaatcatcttccaatcaggtgatttttctcggttacataacttctgcccccggtagccgggattacctccagttaaccgagcacgggaacgtcaaggacatcgacagtaccgaccacgaccggtggtgcgaatacatcatgtatcggggcctgattcgcctcgggtatgctaggatttcacatgcagagctctcagattctgaaattcagatggccaaatttcggatacccgacgatcccacgaactaccgcgacaatcagaaggttgtaatcgatcaccgcgaggtctctgagaagatccattttaatcctagattcggaagctacaaggagggacacaactacgagaataaccatcacttccacatgaatacccccaagtatttcttgtag

SEQ ID NO: 13772 - DNA, 1449 bp, Artificial Sequence
  Description of Artificial Sequence: Synthetic coding sequence
atgctgttcgagggaaaggtcaacccacaaacgcagagcctcctcgccgagtgtggagagtggacaaggaggagcttgcacctgcgcgtgctgggccgccagctcatccttcccacagacaaaggcgttcagcatttccagggcagcacccccgcgagcgcagttcataggccaccactgtcggcctgtggccactcaagcaatatccgagagctatgcatttctggcagccagattgtgcctgcagctcttagtgctagcgcactgcctgggcccgatgacacgggggttgccgatttgaccgctaggagttccctcgaagaggaggtgtaccatgtggatggaaagatagaggagtatttcgccttcgatcgaaaagaagacgatgatgaatgtctcgaacagaaacccgcgcagccaggccgtaagtggaggaagctaggcttgccacctgttagccccagagattgtgtgaaggatgccgtggctgctgaagtgtttgaccatgtatggaccaatatggttgagcttcttgaagagttgatccgtaaacattgggagacaaccctgacagagggcaagaaacagagagagacactgaaagtcgcaggtaacagatttccgcacgtgctcgtcccccacgcccacgcagatggggcaagtggccctccttcagggcatgcagaagcacacggaatctctctcgcctctagactcaaccctccccaaattcaccacttctccagctctttttatagtgatatgaacggagtgatgacaatccaggccaaaccgttgcagcggcgtccagcctacttcgccgatcgcacacagaacgaaaaagaagataaggctagcggtgggggagctggcgctctctcctctgcgcctcatcgactgggtagagcctctgacacacacggcctcagtccatccgccaaaaaaactccggttccatggcggctccccagcttggcgagcgactcccagcggcttaaaacacccaacatttacagcgacgaagtcctccggggcacaaaattacctactggggtggaccatatggccagtcccctcgtgcaaacctcaaggtcccgttttccacccctcgttacagaaacacgcggccagaatacagccgtacccggatgtcgtctggttagttaccggggccggcacctccagaaccgtgttctttcagctatgccggatggaacagaaaggtcccgtctcagggagaggaccgcaacactcgagcgactgtcacgtcccagtacaactcatacatttagacagagcgacactccccggaagtcatcactaacccagatggagttcgccgctcacacctggacagggcaaagtatcctcactgggtctcagtatgtgccaaaatccttccagaggacgaccctcacgtttaaaaggcgctttcaagtaaccagctag

SEQ ID NO: 13773 - DNA, 1392 bp, Artificial Sequence
  Description of Artificial Sequence: Synthetic coding sequence
atgggtgctggtccctctctgctgctcgctgcgctgctgttgttgcttagcggtgatggcgccgtgcgctgcgacacgccagccaactgcacatatctcgacctcctggggacttgggtgttccaggtcggatcatcaggcagtcagcgcgacgtcaactgttctgttatgggaccccaggaaaagaaggttgtggtgtatctgcaaaaacttgataccgcctatgatgatctcggcaacagtggacattttacaatcatttacaaccagggtttcgaaattgtgctgaatgattataagtggtttgccttttttaagtataaagaggaggggtcaaaagtcaccacctactgcaatgaaactatgactggatgggttcacgacgtcctgggtagaaactgggcatgttttacaggcaaaaaggtcgggaccgccagtgagaacgtgtacgtcaacatagcccacctaaaaaatagtcaggagaaatactctaataggctgtacaagtacgatcataacttcgtcaaggcaattaatgctattcagaagtcatggaccgccaccacatacatggagtacgagactctgaccttgggcgatatgatccggagaagtggaggacatagtcggaaaatccctcgtcctaaaccagcccccctaactgcagaaatccagcagaagatattgcacctgccaacgtcctgggactggcgaaatgtccatggcatcaacttcgttagcccagtgaggaaccaggcgtcatgtggatcttgctactcctttgcctccatgggcatgctagaggcgcgaatccgtatcttgacaaacaactcacaaacaccaatactgagtccacaggaagtagtttcctgtagccagtatgcccagggttgcgaaggcgggtttccctacctgattgctggcaagtacgcccaggatttcggtctcgtggaagaagcctgctttccttataccggcaccgactccccctgtaaaatgaaagaagactgttttcggtactacagttcagagtatcactatgttggcggcttctatggagggtgcaatgaagctctgatgaaattggaactggtgcaccacggcccaatggctgtcgcttttgaggtgtacgatgattttctgcactacaaaaagggaatttaccatcacactgggcttcgcgacccttttaatccttttgaactcacaaaccacgccgttttgctggtcgggtacgggaccgacagcgcctccgggatggactattggatcgttaagaacagctggggtactggttggggagagaatggatactttcgcattagaaggggaaccgacgagtgcgccattgaaagcattgcagtcgctgcaaccccaatcccaaagctttag

SEQ ID NO: 13774 - DNA, 1941 bp, Artificial Sequence
  Description of Artificial Sequence: Synthetic coding sequence
atgagcaagggacccgcagtgggcattgatctcggaactacatactcctgtgtgggggtgttccagcacggaaaagttgaaatcattgctaatgaccagggcaaccgcacgactccatcctacgtggcatttacagatactgagcgacttattggggatgctgctaagaaccaggtggccatgaatccgaccaacacagtgttcgacgcaaagcggctcatcggtcggcgattcgacgacgccgtagtgcagtctgacatgaagcattggccattcatggtggtgaatgatgctggaagacctaaagttcaggtagagtataagggagagacgaaaagcttctatcctgaggaagtttcctcgatggtgttgactaagatgaaggagatcgcagaggcctacctcggaaaaactgtcaccaacgctgtggtgactgtgccagcatacttcaacgatagccagcggcaggccacgaaagacgcagggacaattgcaggtctgaacgtgcttagaatcatcaacgagcccaccgcagcagctatagcttacggacttgataaaaaggttggagcagagcggaatgtcctgattttcgacctgggagggggcacctttgacgtgtcaattcttacaatagaggacgggatatttgaagttaaatctacagcgggcgacacgcacctgggcggagaggattttgataaccggatggtgaatcactttattgctgaatttaagagaaagcataaaaaagatatctctgagaacaagcgagcggtcagaaggttgagaacagcttgtgaacgggctaaaagaacgctgagctctagcacccaagctagcatcgaaatcgattctctttacgagggtatagatttttacacaagcatcacaagggctcgattcgaggagctcaacgctgaccttttccgcggtacccttgatccagtggagaaagctcttagggatgcaaagctggacaagtcgcagatccacgacatcgttctggtcggggggtccaccagaatcccaaagatccagaaacttctgcaggattttttcaacgggaaggaactgaacaagagcatcaatccagacgaggcagtcgcttatggtgccgcggtacaggccgctatcctgtctggagataaatcagagaatgtacaggatctcctcctgttggacgtcaccccactgtctctggggatagagacagccggcggggtgatgaccgttcttattaaacgaaataccacaataccaacaaagcagactcagacgttcacaacttatagcgacaaccagcccggagtcctgatccaggtctatgaaggagagcgcgccatgactaaagacaataatctcctgggcaagttcgaactgactgggatccctcccgccccacggggtgttccacagatcgaagtcacctttgacatcgatgctaacggaattttaaatgtgtcagcagttgacaaaagtacaggcaaggagaataaaattacaatcactaacgacaagggccgactttccaaggaggatatcgagaggatggtgcaggaagccgagaagtataaagccgaagacgaaaagcagagagacaaggtttctagtaaaaattcgttagaatcatatgccttcaacatgaaagcgaccgtggaggatgaaaagctgcaggggaaaattaatgatgaagataaacaaaaaattctagacaagtgtaatgaaataataaattggctggacaaaaaccagaccgccgaaaaggaggaatttgagcaccagcagaaggaattggagaaagtgtgtaaccctatcattacaaagttataccagtcagctggcggcatgcccggcggcatgccaggaggcttccctggcggaggcgcgcccccttcgggtggagcttcttcagggccaactatcgaggaggtcgactag

SEQ ID NO: 13775 - DNA, 1017 bp, Artificial Sequence
  Description of Artificial Sequence: Synthetic coding sequence
atgtgggaagctaatccagagatgtttcacaaggcagaagagttgttctctaaaactaccaataatgaggtcgatgatatggataccagtgacactcagtgggggtggttctatttggccgagtgcggaaagtggcatatgtttcagccggacaccaattcgcagtgtagcgtgtcaagcgaggatatcgagaaatcttttaaaactaatccgtgcgggtctatctcgtttactacctccaagttctcttacaagatcgacttcgccgaaatgaaacagatgaatttaaccaccggcaaacagcgcttgatcaagcgcgcaccattctctattagtgccttttcctatatttgcgaaaacgaagcgatacccatgcccccgcactgggaaaacgtgaatactcaggtcccatatcagcttattcccctacataatcagacacacgaatacaatgaagtggccaatctgttcggaaagactatggatcggaacagaattaaaagaattcaaaggatccaaaacttagatctctgggagttcttctgcaggaaaaaagcacagctgaagaagaagcggggagtgccccagattaatgaacaaatgctgttccacggaacttcttctgagttcgtcgaggctatctgcattcataattttgactggagaattaacggcatccacggcgcagtgttcggaaaaggtacttattttgcccgcgatgctgcatactctagccgtttctgcaaggatgacattaagcacggcaataccttccagattcatggcgtttctttacaacagcggcacttatttcggacttataagagcatgtttttagcccgcgtgttaatcggcgactacatcaatggagacagcaagtacatgcgccctccctcaaaggatggtagttatgtgaacctgtacgactcttgtgtcgacgacacttggaaccccaagatattcgtagtctttgacgctaaccagatttaccccgaatacctgatcgattttcactag

SEQ ID NO: 13776 - DNA, 1059 bp, Artificial Sequence
  Description of Artificial Sequence: Synthetic coding sequence
atggtccgccccgtgcggcataaaaaacccgtgaactacagtcagttcgaccactccgatagtgatgatgactttgtgtcagctaccgttcctctgaacaagaagtcacggactgcccccaaggaactgaagcaggacaaacccaagcctaatctcaacaacttacgcaaagaagagattccagtccaagaaaagacccctaagaaaaggcttccagagggaacattctcgattcctgcctctgcagtgccctgcacaaagatggccctggacgataaactctaccagagggacctggaagttgctctggcgctgtctgttaaggagctccctactgtgacaaccaacgtacagaattcacaggacaagtctatcgagaagcatgggtcctctaaaattgaaacaatgaataaaagcccacacatttcgaattgcagtgtcgcaagcgactatcttgacttggacaagataaccgttgaagacgacgtggggggagtgcagggtaagcgaaaagcggcctccaaggccgccgcccagcagaggaaaatcctgctggagggaagcgacggagactccgccaatgacacggaacctgacttcgccccgggcgaggacagcgaggacgatagcgacttttgcgagtccgaggacaatgacgaagacttctctatgcgcaagagcaaggtaaaggaaattaaaaaaaaggaggtgaaagtgaagtcgcccgtggagaagaaggagaaaaaatccaaatccaaatgcaatgccctcgttacaagcgtggattccgcacccgccgcagttaaatccgaatcccagtcccttccaaagaaagtatcactgtcatccgatacaacccgaaagccgctagaaatcaggtctccaagcgccgaaagcaaaaaacccaaatgggtacccccggctgcttcaggtggaagtagatcaagcagctctcccttagtggtcgtgtccgtgaagtcccccaatcagtctctaaggcttggattgtctaggcttgcccgcgtgaaacctctccatcctaatgccacaagcacatag

SEQ ID NO: 13777 - DNA, 1488 bp, Artificial Sequence
  Description of Artificial Sequence: Synthetic coding sequence
atgaccgtgatgagcggggagaatgtcgacgaagctagcgcagctcccgggcatccccaggatgggtcatacccccgccaggctgaccatgacgatcatgaatgctgcgagagagtggttataaatatatctggactgaggttcgaaacccagctgaagactcttgcgcagtttcccaataccctgttgggcaatccgaagaaaagaatgcgctactttgacccactcaggaacgagtacttcttcgaccgcaaccgaccaagtttcgatgctatcctatactactaccaaagtgggggccggctgcggcgtcctgtaaacgtcccactcgacatgtttagtgaagaaatcaagttttacgagcttggcgaggaggctatggaaaaattcagggaagacgagggcttcatcaaagaagaggagcggcctctccccgaaaaagaatatcagcgacaagtatggctccttttcgagtaccccgaaagctccggcccagcccgtgtcatcgcaattgtctcagtgatggtaatcctcatcagcattgtgattttttgtttggagactctgccagagctgaaagatgacaaggactttacaggaaccgtccatcggatcgacaatacaactgtaatctataattccaatatcttcacggatccatttttcatcgtggagacgctgtgcataatttggttctctttcgaattagtcgttcggtttttcgcctgtccatctaagacagacttttttaagaatattatgaactttatagatatcgtggccataatcccctattttatcacgcttgggaccgagattgctgagcaggagggcaaccaaaaaggcgaacaagcaaccagcctcgccattctcagggtaatacgactcgtgcgggtgttcaggatcttcaaactgtcccgccacagtaaagggctgcaaattcttggacaaactttgaaggcgagtatgcgcgaattgggactgttaattttttttctgttcattggcgtgatccttttctccagcgcagtgtatttcgccgaggccgaggaggccgaaagtcacttctcaagtatccccgatgcgttttggtgggctgtggtgtccatgactacagtgggctacggcgacatgtacccggtgactatcggaggtaagattgtggggagtctgtgtgccatcgctggagtgttgactatagccttgccagtccccgtgatcgtgagcaactttaattatttttaccacagagagaccgagggcgaggaacaggcgcagctgctccatgtgtcctccccgaacttggcttccgattctgacctgtctcggagatcctcgagtaccatgagcaaatctgagtatatggagatagaggaagacatgaacaactcaattgctcattatcgacaggtgaatattcgcacagccaattgtactaccgcaaatcaaaattgcgtgaataaaagtaagctgctgacagacgtgtag

SEQ ID NO: 13778 - DNA, 1632 bp, Artificial Sequence
  Description of Artificial Sequence: Synthetic coding sequence
atgagaaaacccgcggccggatttctgccctctctccttaaagttctccttctacccctggcccctgcagccgctcaggacagcacgcaggctagtactcccggatcacctttatctcctaccgaatacgagaggttttttgccctgttgacccctacctggaaggctgaaactacttgtagactgcgagcaacccatggatgcagaaaccccacactggtccagctggaccaatacgagaatcatgggcttgtgccggatggtgccgtctgtagtaacttgccctacgcaagctggttcgagtccttttgccagttcacccattatcggtgctccaatcatgtgtattatgccaagagagtcctctgtagtcagccagtttccatactttcaccaaacactctgaaagaaatcgaagcctccgccgaggtgagtcccaccaccatgacctcacccatctcacctcactttacagtgaccgagagacagacctttcagccatggcccgaaaggttgtcgaacaatgttgaagagttgctccaaagtagcctgagcctcggcggccaagaacaggcacctgaacacaaacaggaacagggtgtcgaacatcgtcaggagcccacccaggaacacaagcaggaggagggtcagaagcaggaagaacaggaagaagaacaggaggaagaaggaaagcaagaagaagggcaggggacaaaggagggacgggaggctgtgagccagcttcagaccgactctgagccaaagtttcacagcgagagcttgagcagcaatccgtctagtttcgctccgcgggtcagggaggttgagagtacccccatgattatggagaatatccaggaattgattagaagtgcgcaggagatcgacgagatgaacgagatctacgatgagaatagctactggagaaatcagaatcctggaagcctcttgcaactacctcacacagaagctctgctcgtcctctgctattccatagtggagaatacatgcatcatcaccccaactgctaaagcctggaagtatatggaagaggagattctcggttttggaaaaagcgtctgcgactccctcggccggcgtcacatgtctacgtgtgctctgtgcgacttctgtagcctgaagttggagcagtgtcactcagaagcttccctgcagcggcagcaatgtgacaccagtcataagaccccctttgttagccctttgctagcatcccagagcctcagcatcggaaatcaagttgggtcacccgagtctggacggttctacggactggacctttacggtgggctccacatggatttctggtgtgcgaggttggccactaagggctgcgaggatgtccgcgttagcggctggctccagacagagttcctctcattccaggatggggacttcccaaccaagatctgtgataccgactatatccagtacccaaactattgcagctttaagtcccagcagtgcctaatgagaaaccgcaaccgcaaagtctcccgcatgagatgtctacagaacgaaacgtactcagctctgagtcccggaaaaagtgaagatgtggtgttacgatggtctcaggaatttagcaccctgaccctggggcaatttggttag

SEQ ID NO: 13779 - DNA, 666 bp, Artificial Sequence
  Description of Artificial Sequence: Synthetic coding sequence
atgagcggatgggctgatgagcgggggggagagggcgacggacgcatatacgtcggaaatctccctacggatgtgcgcgaaaaagatctcgaagacctcttttacaagtacggccgcatccgggagatagagctgaagaacagacacgggctggtgccatttgccttcgtgcggtttgaggaccccagggacgccgaagatgccatctatggaaggaacggctatgactatggccagtgcagactgagagttgaattcccccggacatacggaggcagaggtgggtggccaagaggaggacgcaacggtcccccaacccgacgcagtgatttcagagtcctggtatccgggcttccgccaagcggttcatggcaggacttaaaggaccatatgagggaagccggggacgtttgctatgccgacgttcagaaagacggcgtggggatggtggagtacctgcgtaaggaggacatggaatacgccctgagaaaactggacgataccaagtttcgctcccacgagggtgagacgtcttacatcagagtgtaccccgagcgctcgacttcctacgggtactccagaagccgatccggaagccggggcagagactccccatatcaatcgcgcgggtctcctcattacttttcacccttccgtccttattag

SEQ ID NO: 13780 - DNA, 2523 bp, Artificial Sequence
  Description of Artificial Sequence: Synthetic coding sequence
atgtcggcctttcgactctggccgggactgctaataatgctcggcagcttgtgtcaccgagggagcccgtgtggtctgagcacgcatgtcgagatcggacaccgggccctggagtttctacaactgcacaacggcagggttaattatcgggagttgctgctggaacaccaggatgcttaccaagctggtatcgtcttcccagattgtttttatccatctatttgcaagggaggtaagtttcatgatgtgagcgagtcaactcactggacacccttcctcaatgcttctgtgcactacattcgcgagaactatcctctaccctgggaaaaagacaccgagaagctggtcgcctttctctttgggatcacaagccatatggccgctgacgtgtcctggcactctctcggcctagaacagggatttctgaggactatgggggccatcgacttccacgggtcttattcagaagctcattccgctggcgactttggcggagacgtcttatcacagtttgaattcaattttaattatctggctagaaggtggtacgtgcctgtgaaagatctgctcggcatatacgagaagctttacggtaggaaagtgattacggagaatgtgattgtggactgctcccacattcaattcctcgagatgtatggagaaatgctggcggtcagtaagctgtatcctacatatagtactaaatccccatttctggtggagcagttccaagaatatttcttgggcggcttggatgatatggctttttggtccaccaatatctaccacctgacttcctttatgcttgagaatggaaccagtgactgtaaccttccagaaaaccccctgttcatcgcctgcggtggacagcagaaccatacacagggatccaagatgcagaaaaatgacttccatcgcaatctgaccacctcactgactgagtctgtcgaccggaatatcaactatactgagcgaggcgttttcttttctgtgaacagctggacaccagattcgatgagcttcatttacaaggccctggagagaaacatacggaccatgtttattggtggcagccaattgtcacagaaacatgtctcttctccattagcttcctactttctgtcatttccctatgcacgactgggctgggccatgacttccgccgatctgaaccaggacggccacggagatcttgttgtcggggcccccggctatagtaggcctggccatatccatatcggccgggtataccttatatatggaaacgatctcggccttccacccgtggaccttgatcttgataaggaagcgcatcggatcctggaaggttttcagccctccgggcgatttgggagcgccttggccgtgctcgacttcaacgtggatggcgtccccgacctggcagtcggagccccctcagtcggctccgagcagctgacatataagggagcggtatacgtctatttcgggagcaagcagggaggtatgtcatcctcacccaacatcacaatatcatgccaagatatttattgcaatcttggatggacactccttgccgctgatgtcaatggggatagcgagccggacctcgtgatagggtcacccttcgctccaggggggggcaagcagaaagggatcgttgccgcgttctattcgggcccctctctgtctgacaaggagaaattaaacgtggaagccgccaattggactgtgagaggagaagaggatttcagctggttcggctactccctgcacggggtgacagtagataatcgtacattactgctggtcgggagcccaacttggaaaaatgccagtcgcctgggccacctactgcatatccgggacgaaaagaaatccctgggcagagtgtatgggtattttcctccgaacggacaatcctggttcaccatcagtggtgataaagctatgggcaaactaggcacctctcttagctccgggcacgttctgatgaacggcacactcaagcaggtacttctggttggggcccccacatatgatgatgtgagcaaagtcgccttcctgacagttacacttcaccaggggggcgccacccgtatgtacgctctcacgtccgatgctcagccgttactgctgtccacattcagcggagataggagattttctcgatttggcggggttctgcacctgtcagacctagatgacgatggtctagacgagatcatcatggccgcccccctccgcatcgctgatgtgacatctggcttaattgggggagaggacggtagggtgtatgtctataacggtaaagagaccactcttggcgatatgaccggcaaatgcaagagctggattactccctgccctgaggagaaagctcagtacgtgctgattagcccggaagcatcaagcagattcgggagtagtttaattactgtgcgtagcaaggctaagaatcaagtggtgatcgccgccgggagatcttcactcggagcaaggctgagcggtgccctccacgtttattcccttggctctgactag

SEQ ID NO: 13781 - DNA, 972 bp, Artificial Sequence
  Description of Artificial Sequence: Synthetic coding sequence
atgaagtctgctttgtttactcgattttttatactgctgccttggatcctgatcgtgataatcatgctggatgtggacacccgaagaccagtcccccctctaacccctagaccctacttttccccttacgccgtgggtagaggcggcgcccggctgccgttgagacgaggcggaccagcacacggcactcaaaagcggaaccagagcaggcctcagccccaacctgaaccgcagctgccgacaatctacgctatcacaccaacttattctaggcccgtgcagaaggctgagcttactcgcctggctaatacttttaggcaagtcgcacagctgcactggatactcgtggaagacgccgctgcgagatccgaactggtgtcccgatttctggcgcgggccggtctcccatcaactcacctgcacgtgcctactcccaggagatacaaacgtcccggtttacccagggctaccgaacaacggaatgccggactggcgtggcttcgccagcggcatcagcaccaacgcgctcaaccaggtgtactgttttttgccgacgatgataatacttactcgctcgagttgtttcaggaaatgaggaccactcggaaagtgtctgtctggcccgtagggctggttgggggccggagatatgaacgccccctcgtcgaaaacggcaaggtcgtaggctggtacacaggttggcgggctgatcggccgtttgctatcgatatggccggttttgccgtttccttgcaggtgatactctcaaaccctaaagctgtgttcaagaggcgcggaagtcaaccaggaatgcaggagagtgacttcctgaaacaaattaccactgtcgaggagctggaacctaaggcgaataattgtacaaaagtgttggtttggcatacaaggacggagaaagtcaatctcgccaacgagccaaaataccacctcgacactgtgaaaatcgaagtgtag

SEQ ID NO: 13782 - DNA, 3213 bp, Artificial Sequence
  Description of Artificial Sequence: Synthetic coding sequence
atgggggcagcaaggggtagccctgccaggccaagaaggttgccactactctctgtccttctgctgccccttcttggcgggactcagacagcgattgtcttcataaaacagccaagttctcaggacgccttacaaggacgccgggccctgctccgctgcgaggtggaggcccccggtccggtccatgtctactggttactcgacggtgctcctgttcaggacaccgaaagacgatttgcccagggttcaagcctgtctttcgctgccgttgatcgtttgcaagattctggaacctttcaatgtgtcgccagagatgatgtcactggcgaggaggccaggtctgccaatgcaagcttcaacatcaaatggatcgaggctgggcccgtggtcctcaagcaccctgcaagcgaggcagagattcagccccagactcaggtgacgctgcgttgtcatatcgacggtcacccccgaccaacataccaatggttcagagacggcactccgttgagtgatggccagagtaaccacaccgttagttctaaagaaaggaatctgacactgaggccagccgggccggagcactctggattatatagttgctgcgcccattccgcgttcggtcaggcgtgctcctcacaaaatttcactctcagcatcgcggatgagagcttcgcccgcgtggtcctcgctccccaagatgtagtggtggcccggtacgaggaggctatgtttcattgccagttctctgctcagccccccccttcattacagtggttgttcgaggatgagaccccgatcacaaataggtcccgcccccctcaccttcgaagggccaccgtcttcgcaaatgggtcattactcctgactcaggtgcgaccaaggaatgccggaatttatagatgtattgggcagggccagaggggtcctccaatcatactggaagccacgctgcatttggccgagattgaggatatgcccctgttcgaaccacgggtttttaccgccgggagcgaggagcgagttacatgcctaccccccaaagggctgcctgaaccctcggtttggtgggaacatgctggtgtcagactccccacacatgggcgcgtttaccaaaagggccacgagctggtgttggctaatatcgcagagtcggatgcaggcgtgtacacctgtcatgcagccaacctggccgggcagagacgccaggatgtgaacatcacagtcgccaccgtacccagctggctcaagaagccccaagatagccagttagaggaaggcaaaccaggctacctcgactgcttgacccaggcgactcctaagcccacggtagtttggtaccggaaccagatgttaatttctgaagacagccggtttgaggtctttaagaatggaacgctgcgaatcaattctgtcgaagtgtacgatggcacctggtaccgttgcatgtccagcacccctgccggttccatcgaagcccaagcgcgggtgcaagtgttagagaagctgaagttcacacctccacctcagccacagcaatgcatggagtttgacaaagaggcaacagtgccatgcagcgccacggggcgggaaaagccaaccatcaagtgggagagagcagatggcagtagtctccctgaatgggttactgacaacgctgggacccttcactttgcaagggtgacccgtgatgacgcagggaactacacctgtatagccagtaacggccctcagggacagatccgtgcacacgtccagcttactgtagccgttttcatcacatttaaggttgaaccagaaaggaccacagtgtaccagggacatactgcgcttcttcagtgcgaggcccagggtgaccccaaacccctcattcagtggaaagggaaagatcgcatcctcgatcccaccaagctgggaccgagaatgcacattttccaaaacggttccctggttattcatgacgtggcccctgaagattccgggcgatatacatgcatagccgggaattcctgcaatattaagcacacagaggcccccctatacgtggtggataagcctgtgcctgaggaaagtgagggacctgggtcaccccctccctacaagatgatccaaaccattgggttaagtgtgggcgccgccgtggcctacatcattgccgtcttagggttgatgttttactgcaaaaaacggtgcaaagccaagagactccaaaagcaacccgaaggagaagagcccgagatggaatgcctgaatgggggccccttgcagaatgggcaacccagtgcggaaatccaagaagaagtggccctgaccagtctcggttccggccctgctgctactaacaaacgacacagtacctccgataagatgcatttcccccggtcaagcttgcagccaattacgacactggggaagtcagaatttggtgaggtctttttggccaaggcacagggtttagaagagggagtggctgaaacccttgtgctggtgaagtccctgcaatccaaggatgagcaacaacagctagattttcgaagggaactggagatgttcgggaagttgaaccacgcaaacgtggtgcgccttcttggcctatgccgggaggccgagccgcactatatggtcctagagtatgtagaccttggggatctcaagcaatttctacgcatctctaaatctaaagacgaaaaactgaaatctcagcccctgagtactaagcagaaagtagccctgtgtacacaggtcgccttgggaatggaacatctttctaataataggtttgtgcacaaagatctggccgctaggaactgcctcgttagcgctcaacgacaggtgaaagtgtctgcactgggcctatcaaaagatgtctataattctgaatactatcattttagacaagcctgggtgcctttaagatggatgtcccctgaggctattctcgagggagacttttcgacaaaaagtgacgtctgggcgttcggggtactcatgtgggaagtgtttacacacggcgagatgccgcacggtggccaggccgacgatgaggtgctggccgacctccaggccggtaaagccaggctgccacaaccagaagggtgtcccagtaagctgtatcggctcatgcagagatgctgggcgctaagtccaaaggaccgtcccagtttctcagagatagccagcgctctgggcgatagtaccgtggatagcaaaccgtag

SEQ ID NO: 13783 - DNA, 1521 bp, Artificial Sequence
  Description of Artificial Sequence: Synthetic coding sequence
atgcccctcttaggccttctcccacgacgggcttgggcatccctcctgtctcagttgctgcggccaccatgtgccagttgcacaggcgccgtgaggtgccaatctcaggtggcagaggccgtacttactagccagctgaaggcacatcaggagaaaccaaattttattattaagacccccaaaggaaccagggacctatccccccagcacatggtggttcgagaaaaaatcctcgacctcgtcatctcctgttttaaacggcatggcgccaaggggatggacactcctgcctttgaactgaaagagaccctaacagagaagtatggagaagattccgggttgatgtacgatcttaaggaccaaggaggagaattgctttctctgcgctatgatctgactgtgccgtttgccagatatcttgcgatgaacaaagttaaaaaaatgaagaggtaccatgtgggcaaagtctggagacgagaatcgcccactatcgtccagggtaggtatcgcgagttctgccagtgcgatttcgatattgctggacagtttgatcctatgattcccgacgctgagtgcttgaaaatcatgtgcgaaatattgtcagggctgcagctgggcgactttctgataaaagttaacgaccgccgaattgtcgacgggatgtttgccgtgtgtggcgtgcccgagtctaaattcagggctatctgttcttctatcgacaagctcgacaaaatggcttggaaggacgtgcgacatgagatggtggtgaaaaaaggcttagcccccgaggtggccgacagaatcggcgactacgtgcagtgccatggcggtgtttcactggttgaacagatgttccaggaccctcgcctatctcagaacaaacaggcattggagggcctcggggatttaaaactgttgttcgagtatttgacactattcggaattgcagataagatctctttcgacctgagcctagcccgggggctggattactacaccggggtgatttatgaggccgttctcctgcagacaccaacacaagctggagaagaaccgctcaacgtgggtagtgtggcagccggaggacgctatgacggattggtgggcatgttcgatccaaaaggtcacaaggttccctgtgtcggtctgtctataggagtcgagcgaatcttctatatcgtggagcagaggatgaaaacaaaaggcgagaaggtgcggaccaccgaaacccaagtctttgtcgccaccccccaaaaaaactttctccaggagcgactcaagctcatcgcggagctttgggactctgggataaaagcggaaatgctgtataagaataacccgaagctgttgactcagcttcactattgtgagagcaccggaatacccctcgtggtcattattggcgagcaggagttgaaagagggagtgataaaaatacgaagcgtggcctcaagggaggaagtggccatcaaaagagaaaatttcgtggctgaaatccagaaaagactctcagagagctag

SEQ ID NO: 13784 - DNA, 912 bp, Artificial Sequence
  Description of Artificial Sequence: Synthetic coding sequence
atgagagcctggattttttttctactctgcctagcggggcgtgctttggcagccccccagcaggaagcactccccgacgagactgaggtcgtcgaagagacggtcgcagaggttactgaggtgagcgttggggcaaatccagtgcaagtcgaagtgggggagtttgacgatggcgcggaggaaaccgaggaggaggtcgtggcagagaatccttgccagaatcatcattgtaaacacggcaaggtgtgcgaactcgatgagaataataccccaatgtgcgtgtgtcaggaccccacaagttgtccggcccccatcggcgaattcgaaaaggtgtgctcaaacgacaacaaaacatttgactcatcatgtcatttctttgccaccaaatgcacactggagggaactaagaaggggcacaagctgcacctcgactacataggtccctgcaagtacatacctccttgccttgattcagaactgaccgaatttcccctgcggatgagggattggctgaagaatgtcctggtaactctgtacgagcgcgacgaagataataacctcctcactgaaaagcagaagcttcgcgtgaaaaagatccacgaaaacgaaaaaagactggaagcaggcgaccatcccgtggaattgctggcccgcgatttcgagaagaactataacatgtacatctttccagtgcactggcaattcggccagcttgatcaacatccaatcgatggttatctctcacacaccgagctggccccactgagggcccctctcattccaatggagcactgcaccacaagatttttcgagacgtgtgacctagacaacgataagtacattgccctggatgagtgggcaggatgcttcggcattaaacagaaggatattgacaaggacctggtgatctag

SEQ ID NO: 13785 - DNA, 2634 bp, Artificial Sequence
  Description of Artificial Sequence: Synthetic coding sequence
atggctcgtcctagacgagctcgagaacccctgcttgtggctctcctgccactggcctggctagcacaggccggactcgcccgggcagccggaagcgtccgccttgctggtggcctgaccttgggcggcctgtttcccgtgcacgccaggggggcggcaggacgggcttgtggacaactgaaaaaagagcagggtgtccaccgcctggaggcaatgctgtatgcactggaccgcgttaacgccgatccagagcttctccccggagtcaggcttggggcccgtctgctggatacctgcagcagagacacctacgccctcgaacaggcgctctcattcgttcaagccctgattcgcggtcgcggagacggcgacgaagtgggggtgcgttgccccggaggcgtgcctcccctgcgccctgcccctcccgaacgagtggtagccgtcgttggcgcaagcgcgagctctgtttcaatcatggttgccaacgtgcttagactgttcgccatccctcagatcagctatgcttctacagctccggaactttccgactctacacgctatgactttttttccagggttgtaccacccgatagctaccaggcccaagctatggttgatattgttagagccctgggctggaattacgtgtcaaccctggcaagcgaggggaattatggagaaagcggcgtggaagctttcgttcagattagccgcgaagcggggggagtttgtatagcccagagcattaagattccacgggagccaaagcccggagaattttccaaagtgattcgaaggctgatggaaactcccaacgctcgagggatcatcattttcgccaacgaggacgacatcaggcgggtgctggaagcagcaagacaggcgaatctgacgggacattttctttgggtaggctcagactcttggggcgccaagactagtcccatactgtcattagaggatgtggccgtcggggccatcactattctccccaaaagggcatctatagacggatttgatcagtattttatgactcgatccctcgagaacaacaggcgaaatatctggtttgcagaattttgggaggagaatttcaattgtaaactcacttctagtgggactcagtccgacgatagcaccaggaaatgcacaggagaagaacgaatcgggcgagattccacttacgagcaggagggaaaggtccaattcgtgatcgatgctgtctatgcgattgcccatgctctacatagtatgcatcaggctttatgccccggccacacaggcctgtgcccggccatggagccaacagacggaaggatgcttctccagtatatcagagctgtgcgattcaatggctccgctggaactcctgtgatgttcaatgagaatggggatgcgcccggccgctatgatatcttccaatatcaggccaccaatggcagcgcatcttcaggcggctaccaagcagtgggccaatgggccgagaccctccggctcgacgtagaggcactgcagtggtcaggggatccacacgaggtaccctcctctctttgcagcctcccgtgcggtcctggagagcggaaaaaaatggtgaaaggcgtcccctgctgctggcactgcgaagcctgtgacggctatcgctttcaggtcgacgagttcacctgcgaagcctgtcccggcgacatgcgacccacgcccaaccatactggctgtaggccaacgccagtcgtccggctgagctggtcatcaccctgggcagcaccacctctcctcttggccgtgttagggattgtggcaactacgaccgtggtcgccactttcgtcagatacaataacacccccatcgtaagagctagtgggcgggagttgtcatatgtgttgctaactgggatttttctgatttacgctatcaccttcctgatggtggcggagcctggcgcagcagtttgtgcggcccggagactctttcttggactgggcacaacactatcgtattctgcgctgttgactaaaaccaaccgcatctataggatcttcgaacaagggaagcgatctgtgactcctcctcctttcattagcccgacatctcagctggtaattaccttctcacttacatctctgcaagttgtcggcatgatcgcgtggctcggggcacgtcccccacacagcgtgatcgactacgaagaacagagaacagttgatccagagcaggcgagaggtgttctgaaatgcgacatgagtgacctctcattaatcgggtgcctcgggtacagcctcctgctcatggtaacttgtacagtctatgctatcaaggcccgaggggtgcccgagaccttcaacgaagcaaagcctataggattcacgatgtataccacttgcataatttggctggctttcgtcccaatctttttcggcactgctcagtcagccgagaaaatttatattcagaccaccaccttaaccgtatccctgtccctctcagccagcgtttctctcggcatgctctatgtgccaaagacctatgtgatcctgtttcatcccgaacaaaatgttcaaaagaggaaaagaagtctcaaggccacaagcacagtcgccgcccctccaaagggggaggacgctgaggcccacaagtag

SEQ ID NO: 13786 - DNA, 798 bp, Artificial Sequence
  Description of Artificial Sequence: Synthetic coding sequence
atggcagcagcggttccaaagcggatgagaggacctgcgcaggcaaagctgcttcctggcagcgcaatccaagccctggtcggcttggcgaggcccctggtcttggctctgctgctagtcagtgctgccctgtcttctgtcgtatcacggactgactcccctagccccactgtgctgaattcacacatcagtacgcccaacgttaatgccttgacccacgaaaatcaaactaaaccctctatctcccagattagtaccaccctgccacccaccacatccaccaagaagtccggaggcgctagcgtcgtgcctcatccaagccccacaccactgtcacaggaggaagctgataacaacgaagacccatctattgaggaggaggacctcctgatgcttaattcaagcccctcaactgccaaggacacattggataacggtgactatggcgaacccgactacgattggacgacaggacctcgcgatgatgatgaaagcgatgatactctggaagagaatagaggatatatggagattgaacagtctgtcaagagcttcaaaatgccttcctcaaatattgaagaagaagattctcatttctttttccaccttatcatttttgcgttctgtatagccgttgtatatattacataccataacaagcgcaagatttttctcctagttcagtctcggaagtggagggacgggctgtgcagcaaaaccgtcgagtaccaccggctggaccagaatgttaacgaagccatgccttctttaaagattaccaacgactatattttctag

SEQ ID NO: 13787 - DNA, 2349 bp, Artificial Sequence
  Description of Artificial Sequence: Synthetic coding sequence
atggctcccagtgcatgggcgatatgttggctgttgggcgggctacttttacacggaggctcatcaggccccagtcctgggccctctgtccccaggttacgactaagttacagggatctactatctgcgaatagaagcgccatttttctaggccctcaggggtccctgaatttgcaggctatgtatttggacgagtaccgggacagattattcttgggaggacttgatgctctgtattccttaagactcgaccaggcctggcccgatccacgagaagtattgtggccccctcagcccgggcaacgggaggagtgtgtccggaaagggcgcgatcctcttactgaatgtgccaattttgtccgggtgctccaaccacacaataggacccatctgctggcctgcggcacaggcgcctttcagcccacatgtgcattaatcacagttggacatcgaggggagcacgttctccatctggaacccggttctgttgaaagcgggaggggaagatgccctcatgagcctagccgaccgtttgcaagcacattcatagatggcgagttatacactggactaactgccgacttcctcggaagagaagccatgattttcagaagcgggggcccacgcccagctctgcgatcggactcagatcagagcttgctgcacgatcctagattcgtgatggctgcccggattccggagaattccgatcaggacaatgataaggtgtatttttttttctccgaaaccgtgccttctcctgacggggggtcaaaccacgtaaccgtatcaagagtcgggcgggtatgcgtcaacgatgcagggggtcagcgcgtactggtgaataagtggtctacgtttctgaaagcacgacttgtctgttccgtgcctggtcctggcggagctgaaactcacttcgatcagctggaggatgtttttctcttatggcccaaggccggcaaatctctcgaggtctatgctctattctccacagttagcgcggtgtttcagggcttcgctgtgtgcgtataccacatggccgacatttgggaagtgttcaacgggccttttgcccaccgggatgggccacagcatcagtggggtccatacggaggaaaagttccatttccgagaccaggagtatgcccatccaaaatgactgcccaaccaggcagacccttcggtagtactaaggattatcccgacgaggtacttcagtttgcgagggcccatcctctgatgttttggccagtgaggcctagacacgggagaccagttctggtaaagacccaccttgctcagcagcttcaccagatcgtcgttgatcgagtagaggccgaggacggcacctatgatgtcattttcttaggaactgactctggctcagtgctcaaggtaattgcactgcaggccggcgggagcgcggagccagaagaggtggttctggaagagctacaggtgtttaaggttcccacacccattacggagatggaaatctccgtcaagcggcagatgctttatgtgggctcacgtctgggcgtggcccaactgcggctccaccagtgcgaaacatatggaacggcttgtgccgaatgttgtctcgctcgggatccctactgtgcctgggatggcgctagctgcacccactacagacccagcctcggtaaacggcgattcagacggcaggacattcgccacggtaatccggcccttcagtgtttggggcagagccaggaggaagaggcggtaggactcgttgccgcaaccatggtctacggcacagaacacaattccacgtttctggaatgcttgcccaaatcaccccaggctgctgtccggtggcttctccagagaccgggagatgagggaccggaccaggttaagaccgatgagcgcgtgcttcacaccgagaggggattgctgtttaggcgcctcagccgattcgatgccggtacatatacatgcaccacactggagcacggtttcagtcagacggtcgtacgacttgctcttgtggtgatcgtggccagccaactggacaacctgttcccgcccgaaccaaagccagaggagccaccagccaggggaggcttggcctccacccctcctaaagcctggtacaaggatattctgcagcttatcgggtttgctaaccttccacgcgtggacgaatactgcgagcgggtttggtgccggggcaccacagagtgttcagggtgttttaggtcccgatctcgcggaaagcaggccagaggtaagtcctgggccgggctggagctgggtaaaaaaatgaaatcacgggtccatgccgagcacaatagaaccccacgcgaagttgaggcgacctag

SEQ ID NO: 13788 - DNA, 1725 bp, Artificial Sequence
  Description of Artificial Sequence: Synthetic coding sequence
atggttgaggacggagccgaggaactggaggatctggtgcatttttctgtctctgaactaccgtcccgggggtatggtgtgatggaggaaataagacgccaaggaaagctctgtgatgtgaccctcaagattggggatcacaagttcagtgcacaccggatcgttctggccgccagcataccttattttcacgctatgtttaccaacgatatgatggagtgcaagcaagacgaaatcgtgatgcaaggtatggacccctcagccctcgaggctctcatcaactttgcctataacggaaatctcgcaatcgaccagcagaatgttcagtcactgctgatgggcgccagtttcttacagctccagagtattaaggacgcctgctgcacattcctacgcgagcggcttcaccctaaaaattgccttggggtgaggcagtttgctgaaacaatgatgtgtgctgtgctatacgatgcagctaactcttttatacaccagcatttcgtggaggtgtcaatgagcgaggagtttctcgcactcccattggaagatgttctcgagcttgtatctagagatgagcttaacgtgaagtccgaagagcaagtgtttgaggccgcactggcgtgggtgcgctatgacagggaacagagagggccatacttacccgaattgttatcaaatatccgactccctctttgcaggcctcagtttctcagcgatcgggtccaacaggatgacttggtgcggtgctgtcacaagtgtcgcgatcttgtcgatgaggccaaggactatcacctaatgccagagagaaggccccatttgcctgctttcaggaccaggcctcgttgttgcacctccattgccggcttgatctacgcagtggggggactcaacagtgccggtgatagtctgaacgtggtcgaggtattcgatcccattgccaactgctgggagcgttgcaggcctatgaccacggcccggtctcgcgttggagtggccgtagttaatggcctgttgtacgccatcgggggctacgacggacaactgagattatccacagtcgaggcctataaccccgagactgatacttggacaagagtggggagcatgaattctaagagatccgcaatggggaccgtagttttggacggccaaatttacgtgtgtggtggttacgacgggaattccagtctcagcagcgtggaaacgtactcaccggaaactgataagtggacagtggtgacctccatgagcagcaaccggtccgcagccggcgttactgttttcgaagggaggatctacgtcagtggagggcatgatggactacaaatcttcagctcggtagagcattacaatcatcacactgccacctggcacccagcagcagggatgctcaacaagcggtgtagacatggggccgcgtctcttggctccaagatgtttgtatgcgggggctatgatgggtccgggttcttgtccatcgctgaaatgtacagcagtgtcgctgatcagtggtgcctgattgttcctatgcacaccaggcgctccagagtgtcactcgtggcctcctgcgggcgactgtacgccgtgggagggtacgatggtcaaagtaatttatccagcgtagaaatgtatgaccctgagacagactgttggacttttatggcgcctatggcatgtcatgagggaggcgtcggcgtgggctgcatacctttgctcacgatatag

SEQ ID NO: 13789 - DNA, 486 bp, Artificial Sequence
  Description of Artificial Sequence: Synthetic coding sequence
atggctaaggaagagccacagagtatttcacgcgacctgcaggagctccaaaaaaaattgagcctattgattgactcatttcagaacaatagcaaggtggtcgccttcatgaagtccccggtcggccagtacctggatagccatcctttcctggcattcacactgctggtgttcatcgtcatgagcgctgtgccagtgggcttcttcctgctgatcgtcgtgcttaccacattggccgcactactcggcgtgatcattttagagggcctggtgatatcagtaggtggcttttccctcctttgtatcctttgtgggctgggatttgtaagtttggcaatgagcgggatgatgatagcgagctatgtggtggtgagcagcctcatcagttgttggttttctcctaggccactgacgcagcagaacacaagttgtgattttcttcctgccatgaagagcgccgaatttgagggactataccaggagtag

SEQ ID NO: 13790 - DNA, 4503 bp, Artificial Sequence
  Description of Artificial Sequence: Synthetic coding sequence
atgacccggatattgactgcgtttaaagtcgtgagaaccctgaaaaccggctttggatttaccaacgtgaccgctcaccagaaatggaagttttcacggccggggattcggctgctgtctgtcaaagctcagacggcccacatcgtgcttgaagacggcacaaaaatgaaaggatactctttcggacatccgtcttcagtagccggggaggtggtattcaacacagggctgggcgggtaccctgaagcaataactgaccctgcttataagggccagattctcactatggctaaccccattatcggcaacgggggcgccccagacacaaccgctctcgacgagttagggctgtcaaaatatttagagtccaatggaatcaaggtgtccggcctcttagtgctggactacagcaaagattataaccactggttagcaaccaaatccttgggtcaatggctgcaggaggaaaaagtcccagccatctatggggtcgataccagaatgctaactaaaatcatacgcgataaagggactatgctaggcaagattgagtttgagggccaaccggtcgatttcgtcgatcctaataagcaaaatttaatagctgaagtgtctacaaaagacgtgaaggtctatggaaagggcaaccccacaaaggtggtggccgtagactgcggtattaagaacaacgtcataagactgctcgtaaagcggggcgcagaggtgcacttggtcccctggaatcacgatttcactaagatggagtacgatggaatcctgatcgccggggggcctggaaaccctgcacttgcggaacctctcatacagaacgtacggaaaattctggagtccgacagaaaggagcccttgtttggcatctccacaggtaacttgatcacaggacttgcagccggagccaagacttataaaatgtccatggctaacaggggacagaaccagcccgtgctcaatattaccaataaacaggcttttatcacagctcaaaaccatggctatgcactggataataccttacccgctgggtggaagccactctttgtcaacgtcaacgaccagaccaatgagggcataatgcatgagagcaagccgttttttgcagtgcagtttcatccagaggtcacacccggaccaattgataccgaatacctgtttgactcgttttttagtctaattaaaaaagggaaagctactacaattacatccgtgctgcccaaacccgcactggttgcctctagagtcgaggtgagtaaggtgctcatcctcgggagcggcggactcagcatcggtcaggcaggcgaattcgactattctggttcccaagccgtgaaggctatgaaggaagagaacgtgaagaccgtactgatgaaccccaatatagcctcagtacaaacaaacgaggtcggcctcaagcaggccgataccgtgtacttcctccccatcactccacagtttgttactgaagtcattaaagctgagcaacccgacggccttattcttggcatgggtgggcagactgccttgaattgcggcgtggagcttttcaagcgaggcgtcctgaaagagtatggagtcaaagtcctgggcacatcagttgaaagtatcatggctaccgaggaccggcagctcttctctgacaagcttaatgagatcaacgagaagatagccccttcattcgcagtggaatctattgaggatgcccttaaagctgccgacactatcggctacccagttatgataaggagcgcgtacgcactcggcgggttagggagcggtatctgcccaaacagagaaaccctgatggatttaagtaccaaggcttttgcgatgacgaaccagatcctggtcgaaaaatccgtcaccggctggaaagaaattgagtacgaggtggtcagagatgcagacgacaattgtgtgactgtgtgcaatatggaaaatgtggatgctatgggcgttcatacaggcgactccgtcgtggtggcccctgcccaaacacttagcaatgctgagttccagatgctgcggcggactagtataaatgtcgtgaggcacttaggaattgtcggcgagtgtaatatccaattcgccctgcatcccacatccatggaatactgcattatcgaagttaatgcccggctgtctcggtcaagcgccctcgcaagcaaggccacaggttatccattggcgttcattgcagctaagattgcacttgggatccccctgcctgagatcaagaatgtagtttcgggtaaaaccagcgcgtgcttcgagccttccctggattacatggtgaccaagataccaaggtgggacctggatcgtttccatgggacgtctagccgaatcggctcgagcatgaagtcggtaggagaggtgatggccattggtcggactttcgaagagagctttcagaaagcccttagaatgtgccatccttctattgaaggctttactccacggctgcccatgaacaaagagtggccttcaaatctggacctgcggaaggagctgtccgaaccaagttccacccgaatctacgcaattgcaaaagccatagacgacaatatgagtttagacgaaatcgagaaactcacatatattgacaagtggtttctgtacaaaatgcgggacatcctaaatatggaaaaaaccctgaaaggactgaattcagagagtatgacagaggagacactgaagagggctaaggagattgggttctccgataaacagatttccaaatgcctcgggttaacggaagcgcagacgcgggaactgagattgaagaagaacatccacccctgggtaaagcaaattgatacattggctgctgagtaccctagcgttactaattacctgtatgtcacatataatggccaagaacatgatgtgaactttgatgatcacgggatgatggtattagggtgcggtccatatcatattggctcctctgtcgagttcgactggtgcgcagtaagctccattagaaccctcaggcaacttggcaagaaaacagtggtcgtgaattgtaaccctgagactgtttctaccgacttcgatgagtgcgacaagctgtatttcgaagagctgtctctcgaaagaattctcgatatctatcaccaggaggcctgcgggggatgcatcatttcagtgggcgggcagatcccaaataacctggcagtcccactgtataaaaacggggttaaaatcatgggaactagtcctctgcagattgaccgtgcagaagatcgttctatcttcagcgcagtcctggatgagctgaaggtagcgcaggccccatggaaggccgtgaacaccttaaatgaagctctggagtttgccaaatctgttgactatccatgtctgttgcggccatcctatgtgctgagcggatcagccatgaatgtggttttttctgaagatgagatgaaaaaattcctcgaggaggccacacgagtgagtcaggaacatcccgtggttcttacaaaatttgttgagggtgccagagaggtcgagatggacgcagtgggcaaggacggccgggtgatctctcacgcgatcagcgagcacgtcgaggacgccggggtccattccggagatgctacactcatgctgccgacccagaccatctcgcagggagcaatagaaaaggtgaaggacgcaacccgtaaaatagctaaagcgttcgcaatcagcgggccgtttaacgtccagttcctggtgaaggggaatgatgtgcttgttatcgaatgtaacctccgcgcctcaaggtcttttccttttgtatccaagaccctcggtgttgatttcattgatgtggcgacaaaagtgatgattggagaaaatgtagatgagaaacacctcccgactctggaccatcccataatcccagctgactatgtggcgatcaaagcccccatgttctcgtggccgagactgagggatgcagacccaattcttagatgcgagatggcatccacaggcgaggttgcatgtttcggcgaaggtatccatacagcctttctgaaggcaatgctgtccactggattcaagatacctcagaagggaatcctgattggcatccagcagagttttcggcctaggtttctgggcgttgccgaacagttgcataacgaagggtttaagttatttgcaaccgaggcgactagcgattggctaaatgcgaacaacgtgcccgcaactcccgtcgcctggccgagtcaagagggacagaatccttccctctcatccataaggaaactgatccgggacggcagcattgaccttgtgatcaatttgccaaataacaacaccaaatttgtgcacgacaactacgtgatccgcaggactgccgtggactcaggaatcccactccttaccaactttcaggtaaccaaactgttcgccgaggcggttcaaaaatcgagaaaggtggactctaagtctctgttccattacagacagtactccgccgggaaagcggcttag

SEQ ID NO: 13791 - DNA, 846 bp, Artificial Sequence
  Description of Artificial Sequence: Synthetic coding sequence
atggcagtaaatgtttactccacatcagtgacttccgagaacctgtcgaggcatgatatgttagcttgggtgaatgatagtctccacctaaactacactaaaatcgagcaactctgcagtggagccgcctattgccaattcatggacatgctttttcccggatgtgttcatctgcgtaaggtcaagttccaagcgaaactcgagcacgagtatattcataacttcaaggtcctgcaagccgccttcaagaaaatgggggtggataaaattattccggtagagaagctggttaaaggcaagtttcaggataattttgagttcatccagtggttcaaaaaattctttgacgctaattacgatggtaaagattacaatcccctcctcgcgcgtcagggtcaagacgtggccccaccccccaatccaggcgatcagatcttcaataagagcaagaagctgatcggaaccgctgtgccacagcgaacatccccaaccggacccaagaatatgcagacgtctggcagattgagcaacgttgcacccccttgcatcctaagaaaaaacccgcctagtgcccggaacggcgggcacgagaccgacgctcagatactggagctcaatcaacaactagtggatctgaaattaactgtggacgggctggagaaggaacgggacttttactttagcaagctcagggacatcgaacttatttgtcaagagcatgagtctgaaaattcaccggtgatctccggaataattgggattctatacgcaaccgaggaaggatttgctcccccagaagacgacgagatcgaggaacaccagcaggaggatcaggatgaatactag

SEQ ID NO: 13792 - DNA, 531 bp, Artificial Sequence
  Description of Artificial Sequence: Synthetic coding sequence
atggcattgtggcgtgcgtaccagcgagcccttgcagcgcatccttggaaggtgcaggtgctcaccgccggctcactgatgggtctcggggacatcatttctcagcagctggttgaaaggagagggttacaggaacaccagaggggacgtactctcactatggtttcactgggttgtggtttcgtggggcccgtggtggggggctggtacaaagtgcttgatcggttcatccctgggacaacaaaggtggacgcacttaagaaaatgctcctggatcaggggggctttgccccttgtttcctgggatgctttctgcccctcgtgggcgctctgaacgggctgtctgctcaggataactgggctaagctccaacgcgattaccctgatgccctaatcaccaattactacctgtggccagccgtacagctagctaatttttatctggtgcctttacactaccggctcgccgtggtccagtgtgttgccgtcatatggaatagttacctgtcctggaaagctcaccggctttag

SEQ ID NO: 13793 - DNA, 1143 bp, Artificial Sequence
  Description of Artificial Sequence: Synthetic coding sequence
atggcatccctcccggtgctgcaaaaagagagcgtgttccagagtggggcacacgcttatcgcattcccgccctcctgtacttgccgggccagcaatcactgttagcatttgctgaacagagggcgtccaagaaagatgaacacgccgagcttatagtattaagaaggggcgactatgatgctcccacccatcaggtgcagtggcaggcccaagaagtggtggcgcaggccaggctggatggacatcgttctatgaatccatgtcccctgtatgacgcccagaccggcacactgttccttttctttatcgcaatccctggacaggtgacagaacagcagcaactccagacccgggctaacgtgacacgcctatgtcaggttactagtaccgatcacggccgaacatggtcgtcgccgcgggatctaacggacgccgccattgggcccgcctatcgagagtggtccacatttgctgttggccccgggcattgccttcagctgcacgatcgggccaggagcctggtggtgccggcctacgcctatcggaagcttcatcccatccagcggccaattccctccgccttttgttttctgagccatgaccatggccggacatgggcaagaggccacttcgtcgcccaagacacgctagagtgccaggtcgccgaagtagagacaggcgagcagcgggttgtgaccctgaatgcccggtcgcatctgcgcgctagggttcaagcacaatccaccaatgacggtctggacttccaggagtcacaattagtgaagaagttagttgagccacccccccaagggtgtcaggggagcgtgatcagctttccctctcctcgctccggaccagggtcccctgcccagtggttactgtacacacaccctacacattcatggcagagggcagatttaggtgcttacctgaatccgcggccacccgctccagaggcctggtccgaaccagtacttctggccaaagggtcctgtgcctattccgacctgcagtccatgggaacaggtcctgatggctccccgctgttcggatgtctgtatgaggccaacgattatgaggagatcgttttcctgatgtttacacttaaacaggccttccccgccgagtatctcccccagtag

SEQ ID NO: 13794 - DNA, 3165 bp, Artificial Sequence
  Description of Artificial Sequence: Synthetic coding sequence
atggcagccgtgaaggaacctcttgaattccatgcaaagcgcccttggcgccctgaagaggccgtcgaggaccctgatgaggaggacgaggacaatacatccgaggccgagaacggcttcagtcttgaagaggtgctcaggcttggtggaacgaaacaagactacctgatgcttgctaccttggatgaaaacgaggaggtgattgatggaggaaagaagggtgccattgatgaccttcaacagggcgagcttgaggcatttatccagaacctgaacctggctaaatatactaaggcgtcgttagtcgaagaagacgagcctgccgagaaggagaactcgtccaagaaggaggtgaaaatccctaagattaacaacaagaacactgcagaaagccagcggaccagtgtcaacaaggtgaaaaacaagaacaggcctgaaccacactccgatgaaaacggaagcacaaccccaaaagttaagaaggataagcagaacatcttcgagttcttcgagcgtcaaacacttcttctccgcccgggaggaaagtggtatgatctggagtattccaatgagtactcactcaaaccacagcctcaggacgtcgtgtctaagtacaagaccttagctcagaagctctatcagcatgaaattaatctgtttaagtccaagaccaactcccaaaaaggcgcctcttccacatggatgaaggccatagtgagttctggtacactgggtgatcgaatggcagcaatgattctgctgattcaggatgatgccgtgcatacgctccagtttgtagagactttggtgaatctggtgaagaagaaaggaagtaaacaacagtgtcttatggccctggatacctttaaagaactcctgattactgatctacttcccgataaccggaagctgcggattttctctcagcggccctttgataagctagaacagctttccagtggcaacaaagattcccgagataggaggctgattctgtggtattttgaacaccagctgaagcatctagtggccgagttcgtgcaggtactggaaacgctttcccatgataccctggtgacaacaaagaccagagccctgacggtggcccatgagctgctgtgcaacaagccggaggaagaaaaagcactcttagtgcaagtcgtcaataaactaggcgatccgcagaataggatcgccacaaaggcatcccatctgctcgagaccttgctgtgcaagcatccaaacatgaagggggtcgtctccggagaagtggaacgactgctgtttcgtagcaatatcagttcaaaagcccaatattacgcgatctgcttcctgaaccagatggccctcagccacgaggaaagtgaacttgccaataaactcatcactgtgtatttttgcttcttccggacctgcgtgaagaaaaaagacgttgagagcaagatgctgagcgctctgctaactggagtgaatcgcgcatacccatacagtcagaccggggacgataaagtgcgcgagcaaatcgacaccctctttaaggtgctgcacatcgttaacttcaacacttctgtccaagcactcatgctgctgttccaggtaatgaatagccagcaaaccataagtgacaggtactacacagccctgtaccgaaagatgcttgaccccggcctcatgacctgcagcaaacaggccatgtttctaaatctcgtgtataaatccttgaaagcagatattgtcctccggcgcgtgaaggccttcgttaagagactgttacaggtgacctgccagcagatgcccccttttatttgcggcgcattgtatctggtgtccgaaatcctgaaagccaaaccgggactcagatcccagctggatgaccatccagaaagcgatgatgaggaaaactttatagacgccaacgatgatgaggacatggaaaagttcactgacgccgacaaagagaccgagatcgttaagaagttggaaaccgaggagacagtgcccgaaaccgacgtggagacaaagaaacccgaggttgccagctgggtgcatttcgataacctgaaggggggaaagcagctcaataagtacgaccccttctcacgcaaccctctgttctgcggagcagagaatactagtttatgggagctgaagaagcttagcgtacatttccacccatctgtggctctgtttgccaagacgattttgcaaggaaattatatccaatactctggcgatccactgcaggactttaccctgatgaggtttctggatcgctttgtgtatcggaaccctaagccgcataagggaaaggagaataccgattcagtcgttatgcagcccaagcggaagcatttcattaaggatattcggcacctccctgtgaactctaaagagttcctcgcaaaggaagaaagccagattcccgtggatgaagtcttctttcaccgttattacaagaaggttgcggtgaaagagaagcaaaaaagggacgcagatgaagagagcatagaggatgtggacgatgaggagttcgaagaactcattgataccttcgaagatgacaattgtttcagcagcggcaaggatgacatggacttcgctggcaacgtgaagaaacgcacgaagggagctaaggacaacaccctggatgaagactccgaggggagtgatgatgaactggggaatctggatgacgatgaagtgtcactgggatccatggatgacgaagagtttgccgaggtcgacgaggatgggggcacctttatggacgtcctggacgacgaatcggaaagtgtacctgaacttgaggtacacagtaaagtgtccaccaagaagtccaagcgaaaaggcaccgatgacttcgacttcgcaggctccttccagggtccgcggaaaaaaaagaggaacctcaatgatagctccctgttcgtgtccgcagaagagtttggacatcttctcgacgaaaatatgggtagcaagttcgacaacatcggtatgaacgcaatggctaacaaggataatgcttcactcaagcaactccgttgggaagcggagagggatgactggctacacaacagagacgcaaaatcgattattaaaaagaagaagcacttcaaaaagaagcggatcaagaccacccagaaaaccaaaaaacagcggaagtag

SEQ ID NO: 13795 - DNA, 1107 bp, Artificial Sequence
  Description of Artificial Sequence: Synthetic coding sequence
atggaacccggacagcctcgagagcctcaggagccccgggaacctggtcccggggctgagactgctgcagcccccgtatgggaagaggcaaagatcttttatgacaatctggcgccgaagaaaaagcccaagtcgccaaaacctcaaaatgctgtgacaatcgccgtctcctctcgggcactgttccggatggatgaagagcaacaaatttacacggaacagggggtggaggaatatgtgagatatcagctggaacatgagaatgagccattcagccccggcccagccttcccatttgttaaagcattagaggcagtgaatcggcggcttcgcgaactttatccggacagcgaggacgtgtttgacatcgtcctgatgacaaataatcatgcacaggtgggcgtgagactcattaattctattaatcactatgatttgttcattgagcggttttgcatgaccggcggaaattcgccgatttgctatctcaaggcctatcataccaatctctatctgagtgccgacgccgagaaagttcgtgaggctattgatgaggggatcgccgcagctacaatttttagcccttcacgagatgtcgtcgtgtcccagagtcagttgagggtggcattcgatggggatgccgtactgttttcagacgaatctgaaaggatcgttaaagcccatggcctggaccggtttttcgagcacgagaaagcccacgagaacaaacctctggcccagggccctctgaagggctttctggaagccctgggcagactccagaaaaaattttacagtaagggattgcgattggagtgcccaatcagaacgtatcttgtgactgcacggtcagctgcaagttctggggcacgggctctcaagactctcagatcctggggactggagacggatgaagctctgtttctggcgggcgctcctaaagggcccctgctggaaaagattcggccacatattttctttgacgaccagatgttccacgtagccggtgcgcaggagatgggcaccgtagccgcgcatgttccttacggtgtggctcaaacaccgagacgtactgcgcctgctaagcaggcaccctctgcacagtag

SEQ ID NO: 13796 - DNA, 1080 bp, Artificial Sequence
  Description of Artificial Sequence: Synthetic coding sequence
atgctgtctgccgctagtcgagttgtgtctcgagcagctgttcattgcgcactcagaagccccccaccggaagcccgggccctcgcgatgtctcggccgcccccccctagggtcgcctcagtgctgggaacaatggagatgggacgacgtatggatgcgccggcatctgccgctgctgtgcgcgcatttctggagcgcggccacaccgagcttgacacagcattcatgtacagtgacgggcagtctgagactatcctcgggggccttgggttgggcttgggaggcggcgattgccgtgtgaagatagctacaaaggctaacccctgggatggtaaatctctgaagcctgacagcgtgcgatctcaactcgaaacatcacttaagcgtttgcagtgtcctcaggtagacctcttctaccttcacgcccccgaccatggcacccctgtcgaagagacactacatgcctgccagaggctgcaccaggaaggtaaattcgtggaactaggcttatccaactacgcttcctgggaagttgcagaaatctgtactctgtgcaagtcgaacggatggattctgcctaccgtgtatcaaggcatgtacaacgccaccactagacaggtcgaaaccgagctttttccatgtttacggcacttcggcctgcgcttctacgcgtataaccctctggccggtggattgctgactggcaagtacaagtacgaagacaaggacgggaaacagccagtggggcggttcttcgggaacagttgggctgagacatataggaacagattctggaaggagcaccactttgaggccattgccctggtggaaaaagccctgcaggctgcatatggagcatccgcccctagtgtgaccagcgcggccctgagatggatgtatcaccactcccaacttcagggtgctcacggggatgcggtgattctgggcatgagttcattggaacagcttgaacagaacctggctgcaaccgaagagggcccactggagcctgctgtggtggatgcttttaatcaagcctggcatctagtggctcacgaatgtccaaattactttcgctag

SEQ ID NO: 13797 - DNA, 561 bp, Artificial Sequence
  Description of Artificial Sequence: Synthetic coding sequence
atggacgctgactcagatgtggccttagacattctcattacaaatgtcgtgtgtgtgttccggactcgttgtcaccttaatttaaggaaaatcgcccttgagggtgccaacgtgatttataaacgcgacgttggcaaagttctaatgaagctgcgtaagcccaggatcacggccaccatttggtcttcaggaaagatcatatgcactggtgccactagcgaagaagaggcaaaatttggcgctaggaggctagctcgcagcttacaaaagctgggttttcaagtgatctttacagattttaaggtggtgaacgtgctcgccgtgtgcaacatgccgtttgagattcggttaccggagtttaccaagaacaatcggccccacgcatcttatgaaccagaactgcatccagccgtgtgctacaggatcaagtctctccgagccaccctccagatcttctcaactggctctataacagttactgggccaaatgtgaaggcagtcgctaccgctgttgaacagatatatccgttcgtctttgagagccggaaagagattctctag

SEQ ID NO: 13798 - DNA, 537 bp, Artificial Sequence
  Description of Artificial Sequence: Synthetic coding sequence
atggctgcaccactcggtggcatgttttcgggccaacccccagggcccccgcaggcccccccgggccttcctggccaggcttcattactgcaggccgcacctggggcaccaaggccttcatcgagcactcttgtggacgaactggagtccagtttcgaagcttgctttgcaagcctagtgagccaggattacgtgaatggcacggaccaggaggaaattcgcaccggagtggaccaatgcattcagaaattcctggacatcgccaggcagactgaatgtttctttctgcaaaagcggcttcagctttcggtccaaaagcccgaacaggttatcaaagaagacgtcagcgaactccgcaatgaattgcagagaaaagatgctcttgtgcaaaaacaccttacaaagctcaggcactggcagcaggtactggaggacatcaacgtgcaacataagaagcctgctgatatcccccaggggtccctggcctatctcgagcaggcttccgccaacatccccgcacccctgaaacccacttag

SEQ ID NO: 13799 - DNA, 738 bp, Artificial Sequence
  Description of Artificial Sequence: Synthetic coding sequence
atggagaagacagaactcatccagaaggcgaaactcgctgagcaagcggagcggtacgatgacatggccacgtgtatgaaagccgttaccgaacagggagctgaactgtctaacgaagagagaaatctgctctctgttgcctacaagaatgtggttggaggccgccgcagcgcatggcgggttatttcttcgatagagcagaagacggacacttcagataagaagctccaactgattaaagattaccgggaaaaggtggaatctgagcttcggagcatatgcaccactgtgttggaactcttggataagtacctgatcgcaaacgccacgaatcccgaatctaaggtgttctacttgaagatgaaaggagactatttccgctaccttgcggaagtggcatgcggcgacgatcgcaagcagaccatcgataactcgcagggcgcttaccaggaggcgttcgatattagcaaaaaggagatgcaacctacgcacccgattaggttagggctggcacttaatttctccgtcttttactacgagatacttaataacccagagctggcttgtacgcttgccaaaaccgccttcgatgaggctatagccgaacttgacactctgaacgaagattcctacaaagattctacactgattatgcagctccttagggacaacctgaccctttggacaagcgacagcgccggcgaggaatgtgacgccgcagaaggcgccgaaaactag

SEQ ID NO: 13800 - DNA, 534 bp, Artificial Sequence
  Description of Artificial Sequence: Synthetic coding sequence
atgcccggtttaacagcctacttcggattgctggaaatctgcggggtaaagggaggagagaccgtaatggtaaatgctgctgccggagccgtgggatctgtcgtgggccagattgccaagctcaaaggatgtaaggtggtaggtgccgtaggatccgacgaaaaagtcgcctacctgcagaagctggggtttgacgtggttttcaactataagactgtggaatccctggaggaaacattgaaaaaggcgtctcccgatggctacgattgttatttcgacaacgttggcggggagtttagtaataccgtgattggccaaatgaaaaagtttggacgcattgccatctgcggtgcaatcagcacttacaaccggactggtccacttcccccgggtccaccgcctgaaattgtgatctatcaggagctgcgcatggaagcctttgtagtataccgttggcaaggggatgcacggcagaaggcgctcaaagacctgctgaaatgggtactcgaattaccctactttgtcatcgattag

SEQ ID NO: 13801 - DNA, 3660 bp, Artificial Sequence
  Description of Artificial Sequence: Synthetic coding sequence
atgtttggagcgggagacgaggacgacactgactttctttcacctagtggcggagcacgcctcgcttcactcttcgggctggaccaagctgccgctgggcatggaaatgaatttttccagtataccgctcccaaacagcctaaaaagggccagggcactgctgccaccggcaaccaggcaacacccaaaaccgctccagctaccatgagcacccctaccattctggtggctacagctgtgcacgcttatcgatacacaaatggccagtacgtaaagcaaggaaagttcggagctgcggtcctgggaaaccacacagcacgtgaataccggatcttattgtatatttcccagcagcagccagtcactgtggctcgtattcatgttaatttcgaattgatggttaggccaaataactactctactttttacgatgaccagagacagaattggtcaataatgttcgagagtgagaaagctgcagtcgagttcaataagcaggtctgcatcgccaaatgtaactccacgagttccctggacgccgtcctcagccaggacctgattgtggccgatggacctgccgtggaagttggagactcactcgaggtcgcctacacgggatggctttttcagaatcacgtcctggggcaagtgttcgattcgacagccaacaaagacaagctgctgagattaaaactgggttccggtaaggtaatcaagggctgggaagatgggatgctggggatgaagaaaggcggcaagcgtctgctgattgtccccccggcctgcgccgtgggttctgaaggtgttatcgggtggacacaggccacggatagtattttagtgttcgaggtggaggtccggcgggtcaagttcgctagggacagcggtagcgatggccattccgtgtccagcagagacagtgccgctccaagccctatccccggcgccgacaatctcagcgctgaccctgttgtttccccgccgacctccattccctttaagtctggggaacctgccttgcgcaccaagagcaactccctctctgagcagctggccattaacactagccctgacgccgtgaaggctaagcttatctcccggatggccaaaatggggcagcctatgcttccaattttacccccacaattagacagcaatgactctgagatcgaagatgtaaacacactgcagggtggcggccaaccagtggtgaccccgtcagtgcaaccctccctgcatccagctcacccagccctcccccagatgacctcgcaagcgccacaaccaagcgtgacagggctgcaggcaccttcagccgccttgatgcaggtgagttcacttgattcccacagtgccgtttctggaaatgctcagtctttccagccttatgccggaatgcaagcatatgcatatccgcaagcatcagcagtcacgtcccagttacaacctgttaggcctctataccctgcccccttgtcccagcccccccactttcaggggtccggggacatggcgtcctttctgatgacggaggcaaggcagcataataccgaaatccggatggccgtgagcaaggtggctgacaagatggatcacctaatgacgaaggtggaagagctgcaaaaacactcggcaggtaactctatgttgatccccagcatgtcagttactatggagacctccatgatcatgtcgaacatccagcgtattattcaggagaacgaacgactgaagcaggagatcttagaaaagtccaatcgtatcgaggagcagaacgataagatttctgagctaattgaacgcaaccagcggtatgtagagcaaagcaaccttatgatggaaaagcgcaacaacagtttgcagacagccacagaaaacacccaggctcgggttctgcacgctgaacaggagaaagctaaggtcacagaggagctggcagctgctactgcgcaggtttctcacctgcagctcaaaatgaccgctcaccagaagaaagagacggaacttcagatgcagctcacagagtccttgaaggaaacagacctcctgagagggcaactgacgaaggtgcaagccaagctcagtgaactgcaggagacatctgagcaggcccagagcaagttcaagtcggagaaacagaatcgtaagcagttagaactgaaggtgactagcctggaagaagagctcaccgatctcagagtggagaaagaatcactggagaaaaacttgtctgagagaaagaaaaagtcagcccaagaacggtcacaggctgaggaggagatcgacgagatcaggaagtcttaccaagaggaactagacaagttgagacaactgctaaaaaaaacgagggtgtcaaccgaccaggcagccgctgagcagctctccttagtccaagctgagctgcagacccagtgggaagccaaatgcgagcacctcctggccagtgcaaaagatgaacatttgcagcagtaccaagaagtctgtgctcagcgcgacgcttaccaacaaaagttggtccagctgcaggaaaaatgcctcgctctacaagctcagatcacagcactcaccaaacagaacgagcagcacatcaaggaactcgaaaaaaacaagagtcagatgagtggcgtcgaggcagccgcatccgaccccagcgagaaagtcaaaaaaatcatgaaccaggtatttcagtccttacgacgcgagtttgaactcgaagagtcttacaacggtcgcaccatacttggcacgatcatgaacaccattaaaatggtgacactgcagctacttaaccagcaggagcaagaaaaggaggagtctagttctgaggaggaggaagaaaaggctgaggagcgccctagacgcccttcccaggagcaaagcgcctccgcctcctcaggacagcctcaagcacctttgaatcgggaacggccagagagtcccatggtgcctagcgaacaggtggttgaagaagctgtgcccttacctccccaagcgctcaccacgagtcaggatggacaccgcaggaagggagatagcgaagcggaggcgcttagtgaaataaaagatggttcactgcctcccgaactgtcttgtatcccaagtcatcgggtcctagggccaccaacttcaataccccctgaacccctgggcccggtgtcaatggattccgaatgtgaagaaagcttggccgcctccccgatggcagccaaaccagataacccatctggaaaggtttgcgtcagagaggtggcgccggacggcccactgcaggaatcctccacccggctctccctcacgagcgatcccgaggagggagacccactggccctggggcctgagagtccgggtgaaccccagcctccccagctgaaaaaagacgatgtgacttcaagcacaggaccccataaagagctgagctcaactgaagcagggagcaccgtggccggagccgccctacgccctagccaccacagccagcggagcagtcttagcggggacgaggaggatgagctgtttaaaggcgctacactgaaggcattgcgacccaaggcacagcctgaggaggaggatgaggacgaagtcagtatgaagggtagaccgccccctactcccctctttggtgatgacgatgacgacgacgacatcgattggttgggctag

SEQ ID NO: 13802 - DNA, 6978 bp, Artificial Sequence
  Description of Artificial Sequence: Synthetic coding sequence
atgaaaaagggatctcagcagaagattttctccaaggccaagattccttcctctagtcatagtcctattcctagctctatgtccaacatgaggagtagatctctgtcacccctgattggtagcgaaacactgcccttccatagtggagggcagtggtgtgaacaggtcgaaatagcagacgagaacaatatgttgcttgactaccaggatcacaaaggtgctgatagccatgctggtgtgcgttacatcacagaggccctgattaagaagctgacaaaacaagataacctggcactgattaagtccctgaacctgagcttaagtaaggatggcggtaagaagttcaagtatatagaaaaccttgaaaaatgcgttaaattagaggtcttgaacctctcatacaatctgatcggcaagattgaaaaactggacaagttgctgaagctccgggagctgaatctgagctacaataaaatttctaagatagaaggtatagagaacatgtgtaatctccagaaactcaacctggcaggtaatgaaatagaacatataccagtctggctgggcaagaagttaaaatccctgcgggttttgaatttgaagggcaacaaaatcagttctttacaagatatcagcaaacttaaaccattgcaggacctaatttcactgatcctggtcgaaaacccagtcgtgaccctgccacactatctgcaattcactatctttcacctccggtccctagaatctctggagggacagccagttaccacccaggatcgtcaggaggcttttgagcgtttttcactggaggaagtggaacggttggaacgcgatctggaaaaaaagatgatcgaaactgaagaacttaaatccaaacagacccgttttcttgaagaaatcaaaaatcaagataaactgaataagtcacttaaggaagaggccatgctgcaaaaacaatcatgcgaagagcttaaatcagacctgaataccaagaatgagctactgaaacagaagacaatcgaactgacccgcgcctgccagaagcagtacgagttggagcaagaactggctttctacaaaatcgatgccaaatttgagcccctgaactactatccctctgaatatgcagaaattgacaaggcccctgatgaatctccttatattggcaaatcacgctataagaggaatatgttcgccaccgaatcctacatcatcgattctgcacaggcggtgcaaattaaaaagatggaacccgatgaacaactccggaatgaccatatgaatctacggggacacactcctctggatacgcaattagaagataaagagaagaaaatcagcgcagctcagacacgactgagcgagctccacgatgaaatcgagaaagctgagcagcagatcctccgggctacggaggaatttaagcagctggaagaggctatccagttgaagaaaatctccgaagcaggaaaggacttgctctataagcagctgagcggccgactgcagctggtaaacaagctccgccaagaagctctggatctggagctgcagatggagaaacaaaagcaggagattgcagggaaacaaaaagaaatcaaagacctgcagatcgccatcgactcactagattcgaaagatcccaagcattcccatatgaaggcccagaagtctgggaaagaacagcaactagatatcatgaacaaacaatatcagcagctggagagtcggctcgacgaaatactgagtaggattgccaaggaaaccgaagagatcaaagacctggaagagcagctgacagaagggcagattgcagccaacgaagcgttaaagaaagacctcgagggagttatctcgggactgcaggagtacctggggacaattaaagggcaggctacacaggcccagaacgaatgcagaaagctcagagacgagaaggaaaccctgctacagcgcctcacggaagtcgagcaagagcgcgaccagttagagatcgtggcaatggatgctgagaacatgcgcaaagagcttgccgagctcgagtcggccctgcaggaacagcatgaggttaatgcgtcccttcagcagacacaaggcgatctaagcgcctacgaagctgaactggaggccagacttaatcttcgcgacgccgaggccaaccagctaaaagaagaactcgagaaggtgaccagactgactcagttggaacagagcgctttgcaagcggagcttgagaaagagcggcaagccctcaagaatgccctggggaaagctcagtttagtgaggaaaaggaacaagagaactccgagctgcatgcaaagcttaagcacctgcaagacgataataacctgttgaagcagcagctgaaagattttcaaaatcatctgaaccacgttgtcgatggactggtgaggccagaggaggtggctgcaagagtagacgaactgagacggaagctcaagctgggtacgggcgaaatgaatattcattcaccttccgacgtgctgggtaagagtttggctgacctgcagaaacaattctcggagattcttgcacgttccaagtgggaaagagacgaagcccaagtccgtgagcggaaactccaggaagaaatggccctgcaacaggaaaagctggcaaccggtcaagaggagttcagacaagcctgcgaacgtgctctggaggcacgaatgaacttcgacaaacgccagcatgaagctagaatccagcagatggagaatgagattcactatctgcaggaaaatcttaaaagtatggaggagatccaggggctaactgatctgcagctccaggaagccgatgaggaaaaggagcgtatcctggcccagttgcgcgagctcgaaaaaaaaaaaaaattagaagatgccaaaagccaggaacaggtgttcggactggacaaggagctgaagaagttgaagaaggccgttgcaacgtccgacaagctggctacagctgagcttactatcgccaaggaccagctgaaatcactccacggaaccgtaatgaagattaaccaggagcgcgccgaggaactgcaagaggccgagaggttcagcaggaaggctgctcaagcagcgagggatctgacgagagctgaggccgaaattgaactcctgcagaacctgctaagacagaaaggagagcaattcagactagaaatggagaaaacaggggtggggacaggggctaattcacaagttcttgagatcgaaaagttgaatgagaccatggagcgccagcggactgaaatcgcacgtctacagaacgtgctggatctgaccgggagcgataacaagggcggctttgaaaatgttctggaggaaatagcagaattgcgcagggaagtatcctaccagaatgactacatctcaagtatggctgatcccttcaaaagacgggggtattggtatttcatgcctcctcctccttccagcaaagtgtctagccacagttcccaggccactaaagattcgggcgtcgggctgaaatactccgcctctacacctgtgaggaagccccgtccggggcaacaggatggaaaggaggggagccagccccccccagctagcggatactgggtgtacagcccaattcggtccgggctccacaagttgtttccctcccgggatgccgacagtgggggagacagccaggaggagagcgaactagatgatcaggaggaaccgccctttgttcccccccccggctatatgatgtataccgtgctccctgacgggtcaccagttcctcagggcatggcgctttatgcaccgccaccacccttgccgaacaactctcgcccactgacacctggcacggtcgtatatggcccgccaccggccggagcccccatggtctacggccccccaccacccaatttctcaatcccgttcatccccatgggggttctccactgcaacgtcccggaacaccacaatttggagaatgaagttagccgtctggaggacatcatgcagcaccttaaatccaagaagcgcgaggagcggtggatgcgcgccagtaagcgacaatctgagaaggaaatggaagagctgcatcataatatagatgatctgctccaagagaagaagtcactagaatgcgaggtcgaagagctccataggactgtgcagaagagacagcaacagaaggactttattgatgggaacgtagaatcattaatgactgagttagaaatcgaaaagtcactcaaacaccacgaggacatcgtagacgagatagagtgtattgaaaaaaccctcctgaagcgcaggtcagaactcagggaagccgataggctactcgcagaggctgagtccgagttatcgtgcacaaaagagaagacaaagaatgcggtagaaaagtttaccgatgctaagcgaagtctccttcagacagagagtgatgccgaagaattagaacgcagggcacaggagactgccgttaatctggtgaaggccgatcagcagctcagaagcctgcaagcagacgcaaaggacctggaacaacataaaatcaaacaggaggaaattttgaaggaaataaacaagatagttgcagcaaaggacagcgacttccaatgcctgagcaagaaaaaagaaaagctcacagaagagctgcagaagttgcaaaaagacatagagatggctgagcgcaatgaggaccatcacctccaggtgttgaaggaatccgaagtgctgttgcaggccaaacgggccgagcttgaaaagctgaaaagtcaggtgacctcccagcagcaagagatggccgttctggaccggcagctgggacacaaaaaggaagaactgcatcttttgcaaggatcaatggtccaggccaaggcagatttacaggaagctctccggctcggggaaacggaggtgaccgaaaagtgcaatcacatacgggaagtgaaatctcttctggaggagttaagtttccagaaaggggagctaaacgtgcagatcagcgaacggaaaacacaacttactctgatcaaacaggagattgaaaaggaggaggagaacctccaagtagtgctgcggcagatgtccaagcataaaactgaacttaaaaacattttagatatgctgcaactagagaatcatgagctccagggcctgaaactgcagcatgaccagagagtaagcgagttagagaagactcaggttgccgtactcgaagagaagctggagttggaaaatctccaacaaatctcacagcagcaaaagggcgagatcgaatggcagaagcagctgcttgaaagagacaagcgagaaatcgagcggatgaccgctgagagtagagctcttcagagctgtgtggagtgcctcagtaaggaaaaagaggacctgcaagaaaaatgcgacatctgggaaaaaaagctggcacagaccaaaagggtactggctgcagccgaggagaacagcaaaatggaacaaagcaatctggaaaaactcgaacttaatgtccgcaagctgcagcaagagttggaccagctgaatagagacaagttgagcctccataacgacatttcagcaatgcaacagcagctgcaggaaaagcgggaggccgtgaattctttgcaagaagagctggcgaatgtacaagaccatctcaatctcgctaagcaggacttactgcacacgacaaaacaccaggacgtcttgcttagtgaacagaccagactgcagaaagacatctctgaatgggctaacagatttgaggattgccagaaggaggaggagacaaaacaacaacagctccaggttcttcaaaacgagattgaagagaacaaactcaagctggtccagcaagagatgatgttccagcgcctccagaaagagcgggaatcggaggaaagtaaattagagacgagcaaagtgaccctgaaggaacagcagcaccagcttgagaaggagcttacggaccagaaaagtaagttggaccaggtcttgtcaaaggttctggctgccgaggagagggtgcggaccttacaggaagaggaaagatggtgtgaaagccttgagaagacactctcccagacaaaaagacaactgtctgagagagaacagcaattagttgaaaaatctggggaacttctggccctgcagaaggaggccgactcaatgcgcgccgattttagtctgctgaggaatcagtttcttacagaacgtaaaaaagctgagaagcaggtggcctcccttaaggaggcattgaaaattcaaagaagccagttagagaagaacctgctggagcagaagcaggagaacagttgcattcaaaaggaaatggctaccatagagctcgtcgcacaggataaccacgagcgcgctcgaagacttatgaaagaactgaatcagatgcagtacgaatatactgagttaaagaagcagatggctaatcagaaggatctagaacggcgtcaaatggaaatttctgacgctatgaggacattgaagtctgaggtcaaggacgagatccgaacatccctcaagaatctgaatcaattcttgccagaactgcccgctgacctggaggccatcttggagcggaatgagaatctggagggtgagctggagagtctcaaagaaaatctgccatttactatgaatgaaggccctttcgaagaaaaattaaatttctcgcaggtgcacattatggatgagcattggcggggcgaggcccttcgagaaaagttgaggcaccgggaagatcgccttaaggcgcagttgagacattgcatgagtaagcaggctgaagtgcttatcaaaggaaagcgacagacagagggcaccctgcactcgctgcgacggcaggtcgatgctctcggcgaattggtaacctctacatctgcagacagtgctagctccccctcactgtcgcagctggagagttccctgacagaggactctcagctgggtcagaaccaggaaaaaaatgcatcagcgaggtag

SEQ ID NO: 13803 - DNA, 2811 bp, Artificial Sequence
  Description of Artificial Sequence: Synthetic coding sequence
atggagcccgatatcattaggatgtattcatcatctccgccccctttagacaatggcgctgaggacgacgatgacgacgaattcggcgaattcggcggattttctgaagtatctccaagcggagtcggctttgtggactttgacactcccgactacaccaggcctaaggaagaatttgtgcccagcaaccactttatgcccattcatgaattctcagagaacgtagactccctgacctcattcaagtcgataaagaacggcaatgataaggacatcactgccgagctgagtgcccccgtaaaaggccagagcgacgtgttactgtcaaccacatccaaagagattatttcttcagaaatgctagcaacatcaattgatggaatggagcgcccggggaatctcaacaaggtggtagagcaaagacagaatgtcggcacactagaaagcttttctcctggcgacttccgcaccaacatgaatgttgttcaccagaataaacagttagagtcttgcaatggcgaaaaacccccgtgcttggagatcctgactaacggattcgccgtgctggaaaccgtgaatccccaggggacagatgaccttgacaacgtggccgattctaaaggtagaaaaccactttccacccactccacagagtacaatctcgattctgtgcctagtccggccgaggagtttgccgacttcgccacctttagcaaaaaggaaaggatccagctggaagagatcgaatgcgcagtgctcaatgatagggaagctttgacaattagagagaataacaagattaatagggttaacgaactcaacagcgttaaagaggttgctctgggccgatccctggataacaaaggagacactgatggcgaggaccaagtctgcgtttcggaaatctccatcgtgacaaaccgtgggttttcagtggagaaacagggcttgccaacactacaacaggacgaattcctgcagtcaggcgtgcagagtaaagcctggtctcttgtggattccgctgacaattctgaggccatccggagggaacaatgtaaaaccgaggagaaactcgatcttcttactagtaaatgtgctcacttgtgcatggacagtgtgaaaacctctgatgacgaggttggatcaccaaaagaagagtcacggaagttcacaaacttccaatcccctaacatcgatcccacggaggagaacgatctggacgacagccttagtgttaagaatggagatagcagtaacgactttgtgacttgcaacgacataaacgaagacgatttcggtgattttggggactttgggtccgctagcggcagcacacctccgtttgtgacgggcacccaggactccatgtccgatgccacatttgaagaatctagtgaacacttcccacactttagcgagccaggtgatgatttcggggaatttggcgacatcaatgcagtttcatgccaagaagagaccatcctcacaaagtctgatctgaagcagacaagcgacaacctctcagaagagtgtcagctggcacgcaagagctctggcaccgggactgagcctgttgccaaactgaaaaatggtcaagaaggcgaaattggacacttcgattcagtacccaatatccaggacgactgcaatggattccaggacagcgacgattttgccgacttctcctctgccggccccagccaggtggtcgattggaatgctttcgaagacgagcaaaaagattcttgtagttgggccgcatttggggaccagcaggcaacagaatcgcaccaccgcaaggaagcttggcagtcccaccgcaccgatgaaaacatcgacacgccggggactcccaagacccactctgtgcccagcgctacgagtaaaggggccgtcgcgtctggtcacctccaagagagcgccacttctgtgcagacggccttgctgaatcgtctggagcggatttttgaagcatgcttcccatcaatcttggtgccagacgccgaggaagaggtgacaagccttaagcatcttctggagacgtccaccctccccatcaaaaccagagaagctctgccagaaagtggtgagctgctcgacgtttggactgagttacaagacatccatgatgcacacgggctcaggtaccagtggggaggcagccatagcaacaaaaagttactcagctctctgggaatagacacgcgtaatatcctttttacaggtaataaaaagcagcctgtgatcgtgccgatgtacgccgcaggtctcggaatgctggaacccaccaaagagcccctaaagccacttagcgccgctgagaaaatcgcatctataggccaaactgcaacaatgagtccagacatgaacacatgcactagtgaccagtttcaggaatctttaccacccgtccagttcgattggtctagcagcggtctgaccaatcccttggacgcttcgggaggctccacattgttgaatctcgatttctttggcccggtggatgactcctcatctagttcatcaactactataccaggcgttgatcctgagctctatgaactgaccaccagcaaactcgaaatctctacttcctccctgaaggtgacagatgcatttgcccgtctcatgagtactgtcgaaaagacgtctaccagtacccgcaaacctaaacgagaggagcatttgagcgaggaagccattaaagtgatcgcaggacttccagacttaacatttatgcacgctaaggtgttaatgttccccgccacgctgaccccctccaccagttctcaggagaaagcggacgggtag

SEQ ID NO: 13804 - DNA, 2730 bp, Artificial Sequence
  Description of Artificial Sequence: Synthetic coding sequence
atggagcccgatattattaggatgtatagtagttctccaccacctttagacaacggggccgaggacgacgacgatgacgagtttggtgaatttggtggattctcagaggtgagccctagtggagttggcttcgttgattttgacacaccagactacactcggcccaaggaagagttcgtcccttctaatcattttatgcccattcacgaattctcagagaacgtggactcccttaccagcttcaagtctattaagaacggcaacgacaaggacatcactgccgagctcagtgccccagtgaaaggacagtccgacgtgcttctttctaccactagcaaggagatcatttcatctgaaatgttagcaacttccatcgacgggatggagaggccaggaaacctcaataaggtcgtggagcagcgccagaatgtgggcactctggagtctttcagccccggcgacttcaggactaacatgaatgtggtgcaccaaaacaaacaactggagagttgcaacggcgaaaagccaccctgccttgaaattctcacgaacgggttcgccgtcttggagacagtgaatccccagggcactgatgatctggataatgtggctgacagtaagggacgtaaaccattgagcacccactccacagaatacaatttggactctgttccctccccagccgaagaattcgccgattttgctaccttctccaaaaaagaacggatccagctggaggagatagagtgcgccgttcttaacgatagagaggctttgaccattagagaaaacaacaagatcaacagggtgaacgaactgaattccgtaaaagaagttgcactaggacgctccctggataataaaggcgataccgatggcgaagatcaggtgtgtgttagcgaaatatcaatagttaccaacagagggttcagcgtggagaagcagggcctgcccactctccaacaggacgagtttcttcaaagcggtgtccaaagcaaggcatggtctttggtggactcagctgataactccgaggccattcgaagggagcaatgcaagaccgaagaaaagctggatttgctcacgagcaaatgcgcgcatctgtgtatggacagcgtgaaaacctctgatgacgaggtgggatccccaaaggaggaatccaggaagtttaccaatttccagagccctaatatcgatcccactgaagagaatgatctggatgacagcttgtctgtcaagaacggggactccagcaatgacttcgtgacttgcaacgatatcaacgaggacgactttggagattttggcgattttggctccgcgagtggttctactcccccatttgttacaggcacacaagattcaatgtccgatgccactttcgaagagtcaagtgaacacttcccacatttctccgagcccggcgacgatttcggagagttcggcgacattaacgctgtgtcatgccaagaggagaccatactgacaaaaagcgacctgaagcaaacatccgataacctgtctgaagagtgccagcttgccaggaagtccagtggcacaggcaccgagccggtggccaaattgaagaacggacaggagggggaaatcggacactttgattcagttccaaacatccaggacgactgcaatggtttccaggatagcgatgactttgctgatttcagtagcgctgggcctagccaggtggtggattggaatgctttcgaggacgagcagaaggactcttgttcatgggccgcatttggcgaccagcaggcaacagagtcacaccataggaaagaagcctggcagagccatcgaacggatgaaaatattgataccccaggaacacctaaaactcatagcgtgccctcagccacttcaaagggggccgtcgcgtccgggcatttacaagaaagcgccacttcagttcagaccgccctcttgaatcggctcgaaagaattttcgaggcctgctttccttccatcctcgtcccagatgccgaagaggaagtcaccagcctgaagcaccttctcgagacatccaccctgccaattaaaactcgagaggccctacctgagagcggagaactcctcgacgtgtggaccgagctccaggacattcacgacgctcacggtctgcgttatcagtggggcggtagtcactccaataagaagcttttgagttcccttggcattgatacccgcaacattctcttcacaggtaataagaagcaacccgtaatcgtccctatgtatgcagccggactcggtatgctggaaccaacaaaagaacctctgaagcctttatccgcagccgaaaagattgcgtctatagggcaaaccgccacgatgtccccagatatgaatacgtgcacatcagaccagtttcaggagagtctccctccagtgcaattcgactggtcttcctccggtctaaccaacccattggacggtgtcgatccagaactgtacgaactcactactagtaaactggaaatatcaacgtccagcttaaaagtcaccgatgcgttcgctaggctgatgtcgaccgtagaaaagacttcaacaagcacctcacgtaagcctaaacgcgaggaacatctttccgaggaggccatcaaagtaatcgcaggcctcccagatctgaccttcatgcacgccaaagttttgatgttccctgccacactgaccccgtctacctcaagtcaggagaaagccgacggctag

SEQ ID NO: 13805 - DNA, 306 bp, Artificial Sequence
  Description of Artificial Sequence: Synthetic coding sequence
atggtgtgtgagaaatgcgagaaaaaactcggcaccgtgattaccccagacacctggaaggacggggcccgcaacacgacagaatccggtggaagaaagctgaatgaaaataaagccttgacctccaagaaagcacgcttcgacccctacggcaagaataagttttccacatgtaggatctgtaaatcatcagtccaccagcctggaagccactactgtcaaggatgcgcctataaaaagggcatctgcgccatgtgcgggaagaaagtgttggacacaaagaactacaaacagacctccgtgtag

SEQ ID NO: 13806 - DNA, 1467 bp, Artificial Sequence
  Description of Artificial Sequence: Synthetic coding sequence
atgaactttactcccacccacacacccgtgtgtaggaagaggactgtggtgtccaagcgcggagtagctgtgtctggacctacaaaacggcgtgggatggctgacagccttgaatccactcccctaccctcaccagaggatagactagctaagctgcacccttctaaagagctattagagtattatcagaagaagatggctgagtgtgaggcggaaaacgaggacctcctaaagaaactcgagctgtacaaagaagcttgcgagggacagcataaacttgagtgcgaccttcagcagcgtgaggaggaaatcgctgagcttcaaaaggccctatctgacatgcaggtatgcctctttcaggagagagaacacgttctgcggctgtactccgaaaacgaccgactcagaatcagagaactggaggacaagaagaaaatccagaacttgctcgcactggtggggaccgatgccggggaagtcacttacttttgtaaagaaccccctcacaaagttacgatactccagaaaaccattcaggccgtcggcgagtgcgagcagagtgagtcctccgccttcaaagcagatccaaagatcagtaaaaggcgccctagcagggaaagaaaagagtcaagtgagcattatcagcgagacatacagacgctcatcctccaggtcgaggccctgcaagcccagctcggggagcaaactaaattatctcgggagcagatcgagggactcattgaagaccgtcggattcaccttgaagagatccaagtgcagcaccaacgaaaccagaacaagattaaggaacttacaaagaatctgcatcacacacaggaactgttgtatgaatccactaaggatttcttacagttaagaagtgagaaccagaataaagagaagtcctggatgctcgaaaaagacaacctgatgtcaaaaatcaagcagtatagagtccagtgcaaaaagaaagaggataaaatcggaaaggtcctacctgtgatgcacgagtcccatcatgcacagtccgagtacattaagagtctgaaagataagctcgtccaggaaaaaaaactaagcaacatgtaccaggaacagtgcatcagcctggaggaagagcttgctcgaattcgggaagaggagggtatgcgcagagagatttttaaggatcgcactaacaagatgggaaaacgcttgcagattatgaccaaaaggtatgaggccctggagcggcgtcgaatactggaggttgaaggcttcaagacggatattaaggtcctgagacagaagcttaaggacctggaacagatgttatataaggcaaccgtgaatgctagggccaatcaggacctcgcattgctctgcgaggttcgggacagtaaccgacgcgcgcacaaaatccagggagaattaaagaatctaaagagcaaggtgtttgggcttgagaacgagctacgtttatgttag

SEQ ID NO: 13807 - DNA, 258 bp, Artificial Sequence
  Description of Artificial Sequence: Synthetic coding sequence
atgtccaaggttagttttaaaatcacacttacgtccgaccctaggcttccatataaagtgctcagtgtgcctgagagcacccccttcactgccgttcttaaattcgccgccgaggaatttaaagtgcctgctgctacgtctgccattatcaccaacgatggaatcggaattaaccccgctcagactgctggcaatgtctttctgaagcacggatcagaactccgaattattcctagggaccgcgtggggtcttgttag

SEQ ID NO: 13808 - DNA, 585 bp, Artificial Sequence
  Description of Artificial Sequence: Synthetic coding sequence
atggatgaggatggtctccccctgatgggatcaggcatcgatctaaccaaggtccctgctatccagcagaaacggaccgtggcttttctaaaccagtttgtagttcatacagtgcagtttctgaatcggttctccaccgtgtgcgaagaaaaactggccgatctgagtttgcggatccagcagattgagaccacgttaaacatcctcgatgctaagttgagctcgattccaggtctggacgacgtcacggtcgaagtgtcccctcttaacgttaccagtgtgactaacggcgcgcacccggaagctactagcgagcagccacagcagaacagcacccaggattctggcctgcaagaatccgaggtttctgccgaaaatattcttacagttgccaaagatcccaggtatgcccgatacctgaaaatggtacaggtgggcgtaccagtgatggctattaggaacaagatgatctccgaggggctggacccagacctgctggagcgtccagatgcccccgtgccggatggcgagtccgaaaagaccgtcgaggaaagcagtgattcagagtccagtttctctgattag

SEQ ID NO: 13809 - DNA, 2226 bp, Artificial Sequence
  Description of Artificial Sequence: Synthetic coding sequence
atgggccccccgggcccagccctgccagccaccatgaacaattctagcagcgaaacacggggccacccacacagtgcctcctcccctagcgaacgggtttttccaatgccactcccccgtaaggcccctttaaatattcccgggaccccagttcttgaagacttcccgcagaatgatgatgaaaaggagagacttcagaggaggaggtcccgcgtctttgatctgcagttcagtaccgactctcctaggttgcttgccagccccagttcacgttctattgatatttcggccaccatacccaaatttaccaatacacagattactgagcactattccacttgtattaaacttagcacagaaaacaagatcacgacaaaaaatgcatttggtctgcacctgatcgacttcatgagtgaaattctgaaacagaaagacaccgagcctacaaatttcaaggtcgcagcaggcaccctggacgcatctaccaagatatatgccgttcgtgtagatgccgtgcacgccgacgtgtacagggtgttaggtggcctcggaaaagatgcaccctctctggaggaagttgagggtcacgtggcggacgggagtgccactgaaatgggcactactaaaaaagccgtgaaaccaaaaaagaaacacctccacaggactatagagcaaaacatcaacaatctgaacgtgtcagaagctgaccggaagtgtgagatagatcccatgtttcaaaaaacagccgcctctttcgacgagtgcagtacagccggcgtgtttctctcgactttacactgccaggactaccgatctgagctcctgttcccaagtgatgtgcagacccttagcacaggcgagcccttggaattacctgagctggggtgtgtagagatgaccgacctgaaggctccactgcagcagtgtgctgaggatcgccagatctgtccgtcactcgccggattccagtttacacaatgggattctgagacacataacgaatccgtctctgctcttgtggataagttcaaaaaaaacgatcaggtttttgacataaacgctgaagtcgacgagtctgattgcggggactttcccgacgggtctctcggagatgactttgacgcaaatgatgaacctgatcataccgccgtaggtgatcatgaagaatttagaagctggaaggagccctgccaggtgcagagctgtcaagaagagatgatctctttaggcgacggggacatccgcactatgtgtccgcttcttagcatgaaaccaggtgagtatagctatttctcgcctaggactatgtctatgtgggccggcccagaccattggcggttccggcccagacgcaaacaggacgctccctctcagtccgagaataagaaaaaatccacaaagaaggatttcgagatcgactttgaagatgatatcgactttgacgtgtatttccggaagacgaaggccgcaaccattttaacaaaatctactttagaaaaccagaactggcgtgcaactacactcccaacggactttaactataacgtggacacattggtgcagcttcacctgaaacctggaacccgactgttaaaaatggcgcagggtcatagagtggagacagagcactatgaagagatcgaagattatgattacaataatccgaacgatacatccaacttctgcccgggtctgcaagccgctgactctgacgacgaggacttggatgatctatttgtgggacctgtcggcaacagcgacttatctccttacccctgtcaccctcccaaaaccgcccaacagaacggggatacaccagaggcccagggcctggacatcactacttacggggagtccaatctggttgccgaaccacaaaaagttaacaagattgagatccattatgccaagaccgccaaaaaaatggacatgaaaaaactgaaacagagtatgtggagcctgctcacagctctatcgggcaaagaagcagacgccgaggctaaccatagagaagctgggaaagaggccgccctggccgaggtggccgacgagaaaatgctgtcaggactcaccaaagacctgcagcgctcccttcctccggtcatggcccagaatttatctatacccctagcgttcgcctgcttattgcacttggccaatgagaagaacttaaagctggaggggacggaggatctatcggacgtgctggttagacaaggtgactag

SEQ ID NO: 13810 - DNA, 510 bp, Artificial Sequence
  Description of Artificial Sequence: Synthetic coding sequence
atgaaagggagtagaatcgagctgggcgatgtaacccctcacaacatcaaacagttgaagcggcttaaccaagtgatcttccctgttagctataacgataaattctataaagacgtcctagaagtgggtgaactcgcgaagcttgcatacttcaacgatatcgccgtcggtgccgtgtgttgtcgagtggaccacagccagaaccagaagaggctgtatattatgactctcggttgcctggccccttaccggcgattaggcattggcacaaagatgctgaatcacgtgctcaacatttgcgagaaggacgggaccttcgacaacatttacctccacgtgcagatctcaaatgaaagcgccattgacttctaccgcaagtttggattcgagatcattgagaccaagaagaattactataagcgcattgagccagccgatgcacatgtgttgcagaagaatctcaaggtgccatccggacagaatgcggatgtgcagaaaaccgataattag

SEQ ID NO: 13811 - DNA, 1245 bp, Artificial Sequence
  Description of Artificial Sequence: Synthetic coding sequence
atggcagcggcccccccttcctattgctttgtcgcttttccacccagagctaaggacggtctggtggtatttggcaaaaatagtgctagaccaagagatgaagtgcaggaggtggtgtattttagtgccgctgatcatgaacctgagtccaaggtggaatgtacttacattagtattgatcaagtccctaggacatacgccatcatgatatctcggcccgcctggctgtggggtgctgagatgggggctaatgagcacggggtgtgtattgcaaatgaagctatcaatacccgcgaaccggctgcagaaatcgaggctttgttgggtatggatctggtacggctgggcctcgagcgtggcgaaacagcaaaggaagccttggacgtcattgtcagcctgctggaagaacatgggcagggcgggaattacttcgaggatgctaattcatgtcacagtttccagtcagcttacctgatagtggaccgggacgaggcctgggtgttagagacgatcggcaaatactgggctgccgagaaggttaccgagggggtccgttgcatctgtagccaactaagtttaacaacgaaaatggacgcagaacaccccgaactccgctcttacgcccaatcccagggctggtggactggagaaggcgaattcaatttttccgaggtgttttcccctgtcgaagatcacttagattgtggggccgggaaggactcattggagaagcaggaagagagcattactgtgcagactatgatgaacactctgagagacaaagcttcgggtgtgtgtatagactccgaatttttcctgacaacagcctcaggcgtttctgtgttacctcagaaccgaagttctccttgcatccactacttcaccggaacccccgatccctctcgctccatctttaaacctttcatttttgtggatgacgtaaaactcgtacctaagactcaatctccgtgtttcggggatgatgaccccgcaaagaaagaaccacggtttcaggagaaaccagaccgtcggcatgagctgtataaagctcacgaatgggcccgagcaattatcgagtcagatcaagagcagggacgcaaattacggagcacgatgctggagctggagaagcagggcttggaggcgatggaggagattctgacttcaagcgagccgttggatcccgccgaagtgggtgacctgttttacgactgtgtggatactgagattaaattctttaagtag

SEQ ID NO: 13812 - DNA, 2031 bp, Artificial Sequence
  Description of Artificial Sequence: Synthetic coding sequence
atgtctgatcagataaagttcattatggattctctgaacaaggagccctttaggaaaaattataatctaattacttttgatagtctcgaacctatgcaactcctccaggtcctctccgatgtgctggctgaaattgaccccaagcaactggtggacattagagaggagatgcccgaacagacagcaaagaggatgctcagtttgctcggtatcctaaaatataagccgagtggcaacgccaccgacatgagtacatttcgtcaaggcctggtgatcggtagcaaaccagtgatctatccggtgctacattggctgctacagcgaaccaatgaactcaagaaacgcgcctatctggcaagatttcttattaagctggaagtgccaagtgaattcctccaggatgaaacagtggccgatactaataagcagtatgaagagctgatggaagccttcaagacactccataaggagtacgaacagctgaaaatatctggattcagcactgctgagattcgcaaggacatatctgccatggaagaagagaaggaccagcttattaaaagggtggagcacttaaagaagcgagtggagacagctcagaaccatcagtggatgctaaagatcgcccggcagttacgggtggagaaagaaagggaagaatatctcgctcaacagaaacaggagcagaagaatcagttgttccacgccgtgcagcgccttcagcgggttcagaatcagttgaaatcaatgagacaggccgctgccgatgccaagcccgaaagcctaatgaaaagacttgaagaagaaatcaagtttaacttatatatggtgactgagaagtttcccaaggaactggaaaacaagaaaaaggaacttcattttctgcagaaagtggtctccgaaccagccatggggcactcagaccttctggagctcgagagtaaaatcaacgagatcaatactgagataaatcaactcatcgagaaaaagatgatgcggaacgagccaattgaaggcaaactgtctctctacagacagcaagcttccatcatctcgcgtaagaaagaggccaaagctgaagaactccaggaggccaaggagaagttagccagtctagagcgcgaggcgtctgtgaagcgtaaccagactcgcgagttcgacggcacggaagtcttgaaaggggacgagttcaagagatacgtgaacaagcttaggagcaaaagtacagtgtttaagaaaaaacatcagatcatcgctgaactgaaagccgagttcgggctcctccagcgcacggaagagctgttgaaacagaggcacgagaacattcaacagcagttgcaaacaatggaggagaaaaaaggcattagtggatattcctatacgcaggaagagttagaacgcgtaagcgctctcaagtcagaagtagatgaaatgaaggggagaacgctggatgacatgtcagaaatggtgaagaaactttattcccttgtgtcagaaaaaaagtccgcgctagccagtgtaattaaggaactacggcagctgaggcagaagtaccaggagctgacacaggagtgtgatgagaagaaaagccagtacgattcatgtgcagcggggctggaaagcaaccggagcaaactggagcaggaggtgagacgcttacgggaagaatgtcttcaggaagaaagtcgctaccactatacaaactgcatgattaaaaacttagaggtgcagctgagaagggctactgacgagatgaaagcttatatctccagcgaccaacaagagaagagaaaggccattagagaacagtatactaaaaacactgctgagcaagagaatcttggaaagaagctgagagaaaagcagaaggtaataagggaaagtcacgggcctaatatgaagcaggccaaaatgtggagggatctcgaacaattgatggagtgtaagaagcagtgttttcttaaacaacaatctcagacttccatcggccaggtaattcaggaaggcggggaggatcggctaattctttag

SEQ ID NO: 13813 - DNA, 948 bp, Artificial Sequence
  Description of Artificial Sequence: Synthetic coding sequence
atggcgttccctgagccaaagcctcggcctcctgaactgccccaaaagagactgaagaccctggactgtgggcaaggagcagtcagggcagttcggtttaatgtcgacggaaattactgcctgacatgcgggtctgacaagactctgaagctgtggaatcctttaagaggaacccttctgcggacctacagtggccatgggtatgaggtgctagatgctgcagggtcgttcgataacagctctctgtgcagtggtgggggcgacaaggcggtagtcctttgggacgtagcatctggacaggttgtgcggaagtttcgggggcacgcgggaaaggtgaataccgttcaattcaatgaggaagccaccgtaatcctctcgggtagcatagactccagtattcggtgctgggactgcagaagccggcgccctgaacccgtgcagaccctcgatgaggcgcgcgacggcgtctcctccgtgaaagtcagcgatcatgaaatacttgctggatcggtggatgggagagtgcgccgctacgacctgaggatgggacagctgttttctgattacgtcgggtctcccataacttgcacgtgcttcagtcgtgacggtcagtgcactctggtatcatccctagattctacgctgaggctcctggataaggatacaggagaactgcttggggagtataaggggcataagaatcaggaatacaaactggactgttgtctgtcagaaagagacacccacgtagtatcatgcagtgaggatgggaaggtcttcttctgggacctggttgaaggagccctggccctcgccttgcctgtgggctctggtgtagttcagtctcttgcctatcatcccaccgaaccgtgcctccttactgctatgggcggctccgtgcagtgctggcgcgaggaagcgtacgaggccgaggatggggctggctag

SEQ ID NO: 13814 - DNA, 1803 bp, Artificial Sequence
  Description of Artificial Sequence: Synthetic coding sequence
atggttctgatcctgggccgaaggcttaaccgtgaggacttaggagtgagggatagccctgccaccaagagaaaggtattcgagatggaccctaagagtctgaccggtcacgagttttttgactttagctccgggagttctcatgcagaaaacatcctccagatttttaatgaatttcgtgactcacgcctgttcactgacgtgatcatttgcgttgagggcaaggaattcccctgccatcgcgccgtacttagcgcctgctcatcatatttccgtgcgatgttctgcaacgatcaccgcgagtctcgagagatgttggtagagattaatggtattcttgcagaggccatggagtgctttctgcagtatgtctataccggaaaagtgaaaatcacaaccgagaacgtccagtatcttttcgaaacctcatcccttttccagattagcgtgcttagagatgcctgcgccaagtttctcgaggaacaattagacccctgcaactgcctagggatacagcgtttcgccgacacacacagtttaaaaacgctgttcactaaatgcaaaaattttgctctgcagacattcgaggacgtcagccagcatgaggagtttctggagctcgataaggacgaattgatcgattacatttgttctgatgaactcgtaatcggaaaggaagagatggtcttcgaggccgtcatgcgctgggtgtacagggctgtcgatctcaggaggccgctgctccatgagttgctaacccacgttaggctgcctctcctccatcctaactactttgttcagaccgttgaagtggatcagctgattcagaacagtcctgaatgctatcaactgctgcacgaagcacgaagatatcatatcctgggtaacgagatgatgtcacctcgtaccaggccgaggaggagtactggatattctgaggtgatcgtggtggtgggcggctgtgaacgggtgggagggttcaatctcccttacaccgagtgctacgatcctgtgacgggcgaatggaaaagtctggccaagttaccagagttcaccaagagcgaatacgccgtatgtgccctccggaacgatatcctggtgagcgggggcagaatcaattcccgggatgtgtggatttacaactcgcaactgaacatttggattagagttgcgtctctgaacaaaggcaggtggcgccacaaaatggccgttctactagggaaggtgtacgtggttggaggatacgacggccagaacaggctgtccagcgtggagtgttatgactctttctccaatcggtggactgaagtagcccccctcaaagaggctgtatcttccccggccgtgacatcctgtgtgggaaaactgttcgtgatcggcggcggccccgacgacaatacctgtagcgataaagttcagagttatgatccagaaacaaacagctggctgctccgagctgccatcccgatcgccaagcggtgtattacagcagtgtccctgaataacttaatctatgtagccggcgggcttaccaaagccatctactgctacgatcctgtagaagactactggatgcatgtgcagaatacattctcccgccaagagaactgtggaatgtcagtatgcaacggcaaaatttacatcttaggagggagaagagaaaacggggaggctaccgatactatactgtgctacgaccccgctacctccattatcaccggagttgccgccatgcctcgccccgtttcctatcacggttgtgtaaccatacacaggtacaatgagaaatgttttaagctgtag

SEQ ID NO: 13815 - DNA, 810 bp, Artificial Sequence
  Description of Artificial Sequence: Synthetic coding sequence
atgaaccaggaagacctcgacccagacagtactacggacgtcggtgatgtgacaaacactgaggaggagttgatacgggaatgcgaagaaatgtggaaagatatggaggagtgccaaaacaaactgtctctgatcggtaccgagaccctcacagattccaatgcccagctgtcgcttctcatcatgcaggttaaatgcctgactgccgaattatcccagtggcagaaaaaaacacccgagactatccctctcaccgaagatgtcctgattacattagggaaggaggagtttcagaaactgcggcaggatctggaaatggtcctcagcacgaaggaatccaagaatgaaaagttgaaagaggacctggagagagaacaaaggtggttggacgaacagcagcaaatcatggagagcttgaatgtcctgcattctgagctgaaaaacaaggtcgaaacgtttagtgaatcacgaatcttcaatgagctgaagacaaagatgctgaacatcaaagagtataaagaaaaactgctctccacactgggagagttcctggaggatcacttccctctgccagacaggtctgtaaagaaaaagaagaaaaatatccaggaatcatcagtgaatcttatcacccttcatgagatgttggaaattctgattaaccggctctttgatgtgcctcacgacccatatgtgaaaatcagcgattccttctggcctccctacgtcgaactccttcttcgcaacgggattgcattgcggcaccccgaggacccaacaaggatccggctagaagcatttcaccaatag

SEQ ID NO: 13816 - DNA, 1041 bp, Artificial Sequence
  Description of Artificial Sequence: Synthetic coding sequence
atgtgcgagggccctagccggatttctggcccgattcctccagacccaactctatgtccggacaactatagacgccccacatctgcgcaagggagacttgaaggaaacgctttaaaactggatcttctgacttccgatcgtgctcttgatactacagccccaagaggcccttgtataggaccaggcgctggcgagatcttggagaggggtcaaagaggcgtcggcgacgtgctgttacagctggagggaatctcgctaggaccaggcgcctccctgaagcgcaaagatccaaaagatcacgagaaggagaacctgcggaggattcgtgagattcagaagcggtttcgcgagcaggagcgctcccgggaacagggtcagccgcgacctttgaaagccttgtggcggtcgccaaagtacgataaagtggaatccagagttaaagcccaactacaagagcccggcccagcttcgggaacagagtccgcccacttcttgagagcacacagtcgctgcggcccgggcctgccgccgccccacgtcagttcaccacagccgaccccacccggccccgaagccaaagagcccggccttggggtcgattttatacgtcataacgccagggctgccaagagggctccgcgcagacactcctgctcactgcaggtgctggcccaggtgttagaacagcagaggcaggctcaggagcactacaacgccacccagaaaggccacgtgcctcactaccttcttgaacgtcgcgacctgtggaggagagaagcagaagcccgaaaacagagccaaccagatccagccatgccaccgggccacacccgaatgcctgagaatcagcgcctagaaacactaactaagctgctgcaaagccaatcccagttgctaagagaactggtgctcctgcctgcgggggcagatagtttgcgggctcagtctcatagagctgaactggaccgcaagctggtgcaggtggaggaggcgattaagatattcagtaggccaaaagtgtttgttaaaatggacgattag

SEQ ID NO: 13817 - DNA, 1824 bp, Artificial Sequence
  Description of Artificial Sequence: Synthetic coding sequence
atggccgccaacgtgttcccctttcgcgacgctcgggccgcccccgacccagtcctggaggctggccccgtggcccacggtcccctgccagtgcccttggtgctggacaatggaagctttcaggttagggcgggctgggcttgcccaggacaggatcccggcccagagcccagacttcagttcagagccgtgtgcgcccgaggcagggggggtgcccggggtgccagcggaccacaggtcgggaacgccctgggatccctagagccgcttaggtggatgctgagatctcccttcgaccgaaatgttcctgtcaatttagaattgcaggagttgctgctagattactcattccagcatctgggggtctcaagccagggatgtgtggaccatccaatagtgctcacagaagccgtgtgtaaccctttgtactcacgccaaatgatgtcagaacttttgttcgaatgctatgggattccaaaggtcgcttatgggattgactcattgttctcgttctatcataataaacctaagaatagtatgtgttccggtttgataatttccagtggctaccagtgtactcacgttcttcccattctcgagggccgattagatgctaagaactgtaaacgaatcaatctgggcgggtcccaagcggccggatacctccagagattgctgcaactgaaatatccgggccacctcgccgcgatcaccctgtcccggatggaggagatactccacgagcactcatacattgccgaggattatgttgaagaactccataagtggaggtgtccagactactatgaaaataacgtgcataagatgcagctgccattctcatctaaactgctcggcagcaccctcacctccgaggaaaagcaggaacggagacagcagcagcttaggcggctgcaggagctgaatgcgagaagacgagaggagaagcttcaattggaccaggaacgcctcgatcggcttctttacgtgcaagaactgctggaggacggtcagatggatcagttccacaaagccttgattgaattgaatatggattctccagaggagctgcagagttacatccagaagctctcaattgcagtggagcaggcgaagcagaaaatcctccaggctgaagtgaacctggaagtcgatgtggtggactctaagccagagacccccgatctggaacaactcgaacccagtctggaggacgtggagtctatgaacgatttcgatcccctgttcagcgaggaaacccccggcgtagagaaacccgttaccacagtgcaaccagtgttcaaccttgctgcctaccatcaactgtttgtaggcaccgaaagaatccgcgcgccagagatcatctttcagccaagtctcattggcgaagaacaggctggcattgctgagaccctccagtacatcttagataggtatcccaaggacattcaggagatgcttgtccagaacgtgtttctgactggaggaaatacaatgtacccaggaatgaaggcccggatggagaaggagctgctggagatgcgaccatttaggagctccttccaagtgcagctggctagtaaccctgtgctggacgcttggtacggtgctcgagactgggcgctcaatcacctggatgataacgaagtgtggattactcgaaaggagtacgaggagaaagggggcgagtacttgaaggaacactgcgcctcaaacatatatgtacctataaggctgcctaagcaggcctcccgatcatctgatgcacaggcctcatctaagggaagtgctgctggaggggggggagcaggcgagcaagcatag

SEQ ID NO: 13818 - DNA, 1383 bp, Artificial Sequence
  Description of Artificial Sequence: Synthetic coding sequence
atggcttcaagagaagaagtgcttgctctgcaggccgaagtggcccagagggaggaggagctgaattcccttaagcaaaagctggcctctgcattgctggctgagcaagagccacaacccgaacgcttagtacccgtgagtcccttgccgccgaaagccgccctctctagggatgagattctgagatactctagacagctggtgctgcccgaactgggagtgcacggccaactgcgcctgggtacggcgtgtgttttaatagtgggctgtgggggcctgggctgtccactcgctcagtacctcgccgctgccggtgtcggacgactcggcctggtcgattacgacgtggttgagatgtctaacttggcacgccaggtcctgcatggggaggctctggctggacaggccaaggcctttagcgccgccgcatccctcagaagacttaacagcgccgtggagtgtgttccatacacacaggccctcactcccgcaacagcgttggacctggtccgaaggtacgatgttgtcgccgactgtagtgataatgtgccaacacggtacctggtaaacgatgcctgtgttctggctggcagaccattagtctcagcctctgcacttcgctttgagggacagatcaccgtgtaccattatgatgggggaccgtgttaccgctgcatcttccctcaaccaccgcccgcggaaacggtgaccaattgtgctgatggcggagtgctcggcgtggtaacaggtgttttgggctgtctgcaggctcttgaagtgctaaaaatcgctgcgggtctaggtccctcatatagcgggagtctattgctattcgatgctctgcgaggacattttagatcaattcgactgcggagtaggcggctggattgtgccgcatgcggtgagcgccctacggtgacagaccttctcgactatgaggcgttttgcggatcaagtgctactgacaagtgtaggtccctgcagcttctgtcacccgaggagcgggtgagtgtgactgattacaagcggttgctagattcgggagcctttcacctgttgcttgatgtgaggccccaggtggaggtggatatctgcagactgccccatgctctccatattccgttgaagcatttggaacgccgagatgctgaatcactgaagctattgaaagaagccatttgggaagaaaaacaagggactcaggagggtgctgcagttccaatctacgtgatctgtaaactgggcaatgactcgcaaaaagccgtgaagatcctccagtcactaagtgctgcgcaggaactggatcctctgaccgtaagagatgttgttggggggttaatggcatgggcggccaaaatcgatggcacatttccccagtactag

SEQ ID NO: 13819 - DNA, 1041 bp, Artificial Sequence
  Description of Artificial Sequence: Synthetic coding sequence
atggaaagcgtctcttgctccgctgcagcggtccgcacaggtgatatggaaagtcagcgcgacctgtctcttgtcccagagagattacaaaggagagagcaagaacgtcaattggaggtcgagcgcagaaaacagaagagacagaatcaggaagtggaaaaagagaattcccattttttcgtagctactttcgtcagagaacgcgcggctgtcgaggagctccttgagagggccgaatcggtggaaaggctggaagaggccgcaagccggttacaaggcttgcagaagctcatcaacgattcagtgttcttcctggccgcctacgatctacggcaaggacaggaggctctggcgcgcctccaggccgccctggctgagcggcggcggggactgcagccaaagaagaggtttgcatttaaaactcgaggaaaagatgcggcctctagcacaaaggtggacgctgctcctggtattccacctgcggtggaatcaatccaagacagccctctccctaagaaggccgagggcgatcttggacccagctgggtgtgcggcttttccaacctagaaagtcaggtcttggagaaacgggcctcagagttgcatcagcgcgatgtgcttctaaccgagctaagcaactgcaccgttagattgtacggtaacccaaatacactccggttgactaaggcccattcctgtaaactgctgtgcggaccggtctcgacatccgtttttcttgaggactgctctgattgcgttttggctgtggcgtgccagcagctccgaatccactcaacaaaggacacaaggatttttctgcaggtcacttctcgggctatcgtggaggactgcagcggaattcagtttgctccctatacctggtcctacccagagatcgacaaggacttcgaatctagtggattggatcgcagcaaaaacaactggaatgacgtcgatgacttcaattggctggcccgagatatggcctcccccaattggagtattcttcccgaagaagagcggaatattcagtgggattag

SEQ ID NO: 13820 - DNA, 747 bp, Artificial Sequence
  Description of Artificial Sequence: Synthetic coding sequence
atgaccccgaagggccccgcaatgtgctcgatgccactaacgtctgccgattgcttctctaacgacatccacaagctggacacgtccactatgacctggactcttatttgcacaaagggaagtcccgcacgctggagggactttcactccgccactatgctgggcagccatatgtacgtttttgggggacgtgctgacaggttcggcccatttcattccaataatgagatctactgcaataggatccgggtgtttgatacaaggacagaggcatggctcgactgtcctcccacacccgtcctgcctgaagggcgccgatcacactccgccttcggatataacggcgagctgtatatcttcggcggttacaatgcacggctcaatagacatttccacgacttgtggaaattcaatccagtcagcttcacttggaaaaaaatcgaaccaaagggaaaagggccctgcccgcggcgcaggcagtgctgctgtatagtcggggacaagatcgtcctgttcggcggcacctcaccaagccccgaggaaggcctgggagatgagtttgacctcatagatcactcagacttgcacatcttggacttctctccatctttgaaaactctgtgtaaactggctgtcattcagtacaacctggaccagtcctgcctgcctcacgatataagatgggagctcaatgccatgaccaccaacagcaacattagcagaccgatcgtgtcttctcatggctag

SEQ ID NO: 13821 - DNA, 1401 bp, Artificial Sequence
  Description of Artificial Sequence: Synthetic coding sequence
atggagtacgagtcttattattttgtgaaattccagaagtatccgaaaattgtgaagaaaagttctgacacagccgagaacaacctgccacaaagaagtcggggaaagacacggaggatgatgaacgatagttgccagaatctgcctaagattaaccaacaacggcctcggtctaagactactgccggtaagactggagatacaaaaagcctgaacaaggagcatccaaaccaggaggtggtagacaacactcgattggagtccgctaactttgggctccatatttctcgcatccggaaggactcaggcgaggagaatgcccacccacggcgtgggcagattatcgactttcagggcctgttgacagacgccataaaaggagccacgtccgaactagcgttgaacacctttgatcataatccagacccgtcagaaaggcttcttaagcctctgtccgcctttatagggatgaattctgagatgagggaactcgctgcagttgtgtctcgtgatatttatttgcacaatccaaacatcaaatggaatgacatcattgggttggacgccgccaaacagctcgtcaaggaagccgtggtataccctataagatacccccagctgttcacaggcatcctctcaccctggaaagggttgctgttgtatggaccacccggcacaggaaagacgctgctggctaaggcagtcgctactgagtgcaagaccaccttttttaacatttcagcctcaaccatcgtatctaaatggcgcggcgatagcgaaaagcttgtccgcgttctttttgagctggcacgttaccatgcaccatccactatcttcctggacgaactggagagcgtgatgagccagagaggtaccgcttctggcggagaacacgaaggaagtttgcggatgaaaactgagttattagtgcagatggatggattggcccgttcagaagatctcgtattcgttctggccgcaagcaatctgccttgggagcttgattgcgccatgctacgacgtctggagaagcggatactagtcgacttacctagtcgcgaggcaaggcaggccatgatataccactggctgcctccagtcagtaaaagtagagccctggaactgcacactgaacttgagtactcagtgctttcacaagaaaccgagggatactccggaagcgatattaagttggtctgccgtgaggcagccatgaggccagtgaggaagatctttgatgccctcgagaaccaccagtccgagtcttccgaccttccaagaatacagctggatatcgtaaccacagccgactttcttgacgtcttgacacacaccaaacctagtgctaagaatctagctcagagatactctgattggcagagggaattcgaaagcgtgtag

SEQ ID NO: 13822 - DNA, 6402 bp, Artificial Sequence
  Description of Artificial Sequence: Synthetic coding sequence
atggacgaggtcgaacaggatcaacatgaagcccgtctcaaagagttatttgattccttcgatactaccggcacaggctctctcggccaggaagagttaaccgatttatgccacatgctcagccttgaggaagtcgcacctgttctgcagcagaccctgctacaagataacctccttggcagggtgcattttgatcaatttaaggaggcattgattctcatcctgtcacgcaccttgtctaatgaggagcatttccaagagcccgattgttccctcgaagcccagccaaaatacgtgcgaggcggcaagcggtacggcaggcggtccctgcctgagttccaggagtccgtcgaggaatttccagaagtgactgtgatcgagccacttgacgaagaggctaggccaagtcacatcccggccggagattgctcagagcactggaagacacagcggtctgaagagtatgaagcggagggacagttacgcttttggaacccggatgacctgaatgcaagccagagtgggagctcgcccccacaggactggatcgaggagaaactgcaggaggtgtgcgaggatttgggaattactagagacggtcacctcaaccgcaaaaagttagtctccatttgcgagcagtacggactccagaacgttgatggcgagatgctagaagaggtgtttcacaacctggacccagacggcactatgtctgttgaggatttcttctacggtttgttcaagaatggaaagtccctgacaccgagcgcatctaccccctataggcagctcaaacggcacctctccatgcaaagttttgacgagagtggaagacggaccactacgtcatccgcaatgaccagtaccataggcttcagagtgttctcatgtctcgatgacggaatgggtcacgcctcagtggagagaatccttgatacgtggcaagaagaaggcattgagaattcccaggagatcctcaaggccctagacttcagtctcgacggtaacataaacctgacagagttaaccttggccctggaaaatgagctgctggtgacgaaaaactccatacatcaggccgcgctggcctcatttaaggccgagatcagacatctcctggagagagtggaccaggtcgtcagagaaaaagagaagttgagatctgacctggataaagccgaaaaacttaagtctctaatggccagcgaagtagatgaccaccatgctgcaatcgagcggagaaacgagtataatttgagaaagctcgatgaggagtacaaggaacggattgcggccttgaagaacgagctacgcaaggagagagaacagatcctgcaacaagcaggcaagcagaggctagagctggagcaggaaatcgagaaggcaaagacagaagagaattacattagagacagactcgctttatcactgaaagagaacagtaggttggaaaacgagctgctcgagaacgcagagaagcttgcagaatacgagaatttgaccaacaagctccagaggaatctagaaaatgttctagcagagaagttcggagatctggatcccagctcggccgaattttttctgcaggaagaacgtctgactcagatgaggaacgaatacgaaagacagtgccgcgtccttcaggatcaagtcgatgagctgcagagcgagcttgaagagtatagggctcaggggcgcgtattgcggctgccactcaagaactccccgagcgaagaagtagaggctaacagtggcgggatcgagcccgaacatggcctgggatccgaggaatgcaaccctctgaacatgtctatcgaagcggagctcgtgattgagcagatgaaggaacagcatcatcgcgacatttgttgtctacgactggagcttgaggacaaggttaggcactacgaaaagcagttggatgagaccgttgtgagctgcaaaaaggcacaagagaacatgaaacagagacacgaaaatgaaacccatactttagagaagcagatctccgacctgaaaaacgaaattgccgaactgcaggggcaggctgctgttctcaaggaagcacatcacgaagccacttgccgacatgaggaggagaagaaacagctgcaggtgaagctcgaagaagaaaagacacacttgcaggagaaactgaggcttcagcacgagatggagctcaaagccaggcttactcaggcacaggcctcatttgaaagagaaagggagggattgcagtcgagtgcctggacggaagagaaagtgcggggtcttacccaagaactggaacagtttcatcaagaacaattaacttcactggttgagaaacataccttagagaaggaagaactgcggaaagagctgctggaaaagcaccagcgggaactgcaagagggcagagagaagatggaaacagaatgcaaccgacgcacaagtcagatcgaggctcaattccagtccgactgtcagaaggtcaccgaaaggtgtgagagcgccctccagagcttggaaggccgatatcgtcaggaactgaaagacttgcaggagcagcagcgcgaagagaaaagccagtgggaattcgagaaggatgagctaactcaggaatgtgctgaagcacaggagctgctcaaggagacactgaaacgagagaaaacaacctccttagtcctgacacaggagagagagatgttagaaaagacatataaggaacacttgaatagcatggtggtggaacggcagcagttactgcaggacctggaggatttgcgaaatgtcagcgagacccaacaatcgctcctgtccgatcagatcctggaactcaaatcttcacacaaacgcgaattaagagagagagaggaagtcctttgccaggcgggcgcctcagagcagctagctagccaacgcctagagcggttggaaatggagcatgaccaagagcgccaggagatgatgtctaaattgctcgctatggagaacatccataaagccacatgcgagactgccgatagagaacgggctgagatgtcaactgagatctctcgcttgcagtccaagattaaggagatgcagcaggcaacctctcctctttctatgctgcaaagcggctgtcaggtgattggagaagaggaggtcgagggcgacggggccctcagcctgcttcagcaaggggagcaacttcttgaggagaatggagacgtgctgttaagtcttcaaagagcgcatgagcaggcagttaaggagaatgtgaagatggctactgagatttctaggctccagcagagactacagaaattagaacctggactagtgatgtcatcttgcctagatgagccagccacagagttttttgggaacaccgccgagcagacggaacagttcttgcagcagaatcgtaccaagcaggtcgagggcgtcacccgaaggcacgtgttatcggacctggaagatgatgaagtgagggacctgggctccactgggacctcgagcgtgcagaggcaagaggtcaagattgaggagtccgaggcctctgtagaaggattctccgagttggagaacagtgaggaaacacgtaccgaaagctgggagttgaaaaatcagatctcacagctgcaggagcaactcatgatgctgtgcgccgactgcgatagagcttctgagaagaagcaggacttacttttcgacgtgagtgttctcaagaaaaaattgaaaatgctagagcgcatccccgaagcctcccctaaatataaactgctctatgaggatgtatccagggaaaatgactgcctccaggaggagctaagaatgatggaaacccggtatgacgaagcactggaaaacaacaaagagttgaccgctgaagtatttcgactgcaggatgagctgaagaaaatggaagaagtgacagagactttcctgtctctggaaaagtcctacgatgaggttaagatcgagaacgaaggactgaacgtgttagtgcttcgcctgcaaggaaagattgaaaaactgcaggaatctgtggtgcagcggtgcgattgctgtctgtgggaagcttctctggaaaatttggagattgaaccagatggtaatatcctgcagttgaaccagaccctggaagagtgtgtacctcgggtgcggagcgtgcatcatgtaatcgaggagtgcaaacaggaaaaccagtacttggagggtaatactcagctgctggagaaggttaaagcccacgagatcgcgtggcttcacggaacaatccagacgcaccaagagcgtccgcgtgtgcagaatcaggtgatactagaggaaaacaccactctcttggggtttcaagacaaacacttccagcaccaggcaacgatcgcggagctggagcttgagaagaccaagctgcaggagctgacaagaaagctcaaagagagggttaccatacttgttaaacagaaggacgtcctttcacacggagagaaggaggaggagctgaaggccatgatgcacgatctgcaaattacctgctcagagatgcagcagaaggtcgagctgctgcggtacgagagcgagaaactacagcaggagaactcaatcttgaggaacgagataaccaccttgaacgaggaagactctatctcgaatctgaaactgggcactctaaatggatcacaggaagaaatgtggcagaagacggaaacagtgaaacaggagaacgctgccgtccagaagatggtggagaatctaaagaagcagattagcgaattaaagatcaagaaccagcaactcgacctggaaaataccgaattgagtcagaaaaattctcaaaatcaagagaaactgcaggagttgaaccagcgcctgaccgagatgctgtgccaaaaggagaaagagccagggaattccgctctcgaggagagggagcaggaaaagtttaatttgaaggaagaactcgaaagatgtaaggtgcagagttccaccctggtttcttcccttgaggccgagttgagcgaggtcaagatccagacccacatcgtccagcaggagaatcatctcctcaaggatgagctcgagaagatgaagcagctccaccggtgtcctgacctatcggattttcagcaaaaaatctccagtgtcctgagctataacgagaagctactgaaggagaaggaggcgttgtctgaggaactgaattcttgtgtggataaacttgctaaatcctcccttctcgagcataggatcgcgactatgaaacaggagcaaaagagctgggagcatcagagcgctagtctgaaatcccagcttgtggcgagccaggagaaagtacagaacctagaggacacagtgcagaatgtcaacttacagatgtcccgtatgaaaagcgaccttcgggtcacccagcaagaaaaagaggccctcaagcaggaggtgatgtcactgcataaacaattgcaaaacgcaggtgggaaaagctgggcaccagaaattgccacccatcccagcggcctgcacaatcaacagaagcgcctgtcttgggataagctcgaccacctgatgaacgaagaacaacagctgctgtggcaggaaaacgagcgccttcaaactatggtacaaaatactaaagcagaactgacacatagccgcgagaaggtgaggcagctggaaagtaacctgctgcccaagcaccagaaacaccttaatccaagcggaacaatgaatcctacggagcaagagaagttgtctttgaagcgggaatgtgaccagttccagaaagagcaatctccagcaaacaggaaggtgtcacaaatgaattcactcgagcaggagctcgaaactatccatctggaaaacgaggggcttaagaaaaaacaggtcaagcttgatgagcaattgatggagatgcagcatctgcgatccactgccacacccagcccgtctccccatgcctgggatctccaacttttgcaacaacaagcctgccctatggtgcctagggagcagttcctgcagctccagcggcaacttttacaggcggagcggatcaaccagcatttacaggaggaactcgaaaatcgtacatcggagacaaacaccccgcagggaaatcaagaacagttggtgacagtgatggaagagagaatgatcgaggtcgaacaaaagttgaagctggtgaagagactgcttcaagagaaagtgaaccagctgaaggagcaactatgtaaaaataccaaggccgatgctatggtgaaagatctttacgtcgaaaacgcccaactcctgaaagctcttgaggttactgagcagcggcagaagactgccgagaagaaaaactacttactggaggagaaaatcgcttcactgtccaatattgtacgtaatcttacacccgcccccctaacctccactcccccgttgcgctcatag

SEQ ID NO: 13823 - DNA, 1713 bp, Artificial Sequence
  Description of Artificial Sequence: Synthetic coding sequence
atggctggcggggctcgggaagtgctgacactgcagcttggacacttcgcgggtttcgttggcgcccattggtggaaccaacaggatgcggcccttggtcgcgcaactgattccaaggagcccccgggggaactttgccctgatgtcttgtatagaactggccggacccttcacgggcaagaaacctatacgccacgtttgattctcatggacttgaaggggtcgctgtccagcctgaaggaggagggcggtctgtatcgggataagcaactggacgcggccattgcttggcaaggaaagctcacaacacacaaggaagaactgtacccaaagaacccgtatctgcaggactttcttagtgccgagggcgtgctcagtagtgacggcgtgtggagggtgaagtcaatcccaaacggcaagggaagttcgccacttcctacggcaacaacacctaaaccgttgattcccacagaggcctccatcagggtctggtccgacttcttgcgcgtgcatctgcatcctaggagtatctgcatgattcaaaagtataatcacgacggcgaggcagggcgtctggaggcttttggtcagggagaatcagttttaaaggaacctaaataccaagaagagctggaggatcgacttcatttttatgtggaagaatgcgattatctccaaggattccagattctgtgcgacctccatgatggctttagcggcgtaggagccaaggcagccgagcttctccaggacgaatatagtggaaggggcatcatcacctggggactcttgccaggaccctatcaccgcggcgaggcgcagaggaatatatatcgcctgctcaatactgctttcgggctcgtgcaccttactgcccactcatccctggtgtgcccacttagcctaggaggaagcctgggcctgaggcctgagccccccgtgagctttccgtacctgcattacgacgcaacactcccatttcattgttcagccattctggctacagccctcgacacagtcaccgtcccctacagattgtgcagtagtccagttagcatggtgcatctggccgacatgctatctttctgcggaaaaaaggtcgttactgctggcgccattattccctttcctttggcaccgggccagtccctgccagattctctgatgcagttcggaggtgcaacgccctggacacccctcagcgcttgcggagagccttctggcacacggtgcttcgctcaatccgtcgtgctgcggggaatcgaccgtgcctgtcatacgtctcaactcaccccgggtaccccccctccaagcgctctccatgcctgtaccactggggaagagatcctggcacaatatctgcagcaacagcaacctggagtgatgtcatcgtcccatcttctgctcacaccgtgtagagtcgcacccccatatcctcatctgttctcgagctgtagccctcccggaatggttctggatgggagccccaagggcgctgccgtagagagcatacccgtgttcggagccctgtgcagctcatctagcctgcaccagactctggaggctttggctagagacctaactaaactggacctgcggagatgggcttcttttatggacgccggagttgagcacgacgacgtggcggagctgctccaggagctgcaaagcctggctcagtgctaccagggaggcgacagcctagtcgattag

SEQ ID NO: 13824 - DNA, 1791 bp, Artificial Sequence
  Description of Artificial Sequence: Synthetic coding sequence
atgaataggacatggccccgcaggatctgggggagtagccaagatgaggctgaactgatccgggaggatattcagggagctctacacaactaccgctctggccgaggggaaagacgggctgctgctctgagagcaacccaggaggagctgcagagagaccgcagccccgcggcagaaacgccccctctgcagaggagacccagtgtgcgggccgtgatttccactgttgagcgcggagcggggcgcggccggccgcaggccaagccaatcccagaggccgaggaggcgcagcgaccggagccagtcggtacttcctctaatgcagacagtgccagccccgatctgggtccacgcggacccgacctggccgtgctgcaagccgagcgcgaggtggacatcctgaaccatgtcttcgacgacgtggagagctttgtgtccaggctgcagaaatctgcagaagcagcccgcgtcctagaacatcgcgagcgcgggaggaggagtcggcgcagagccgccggtgaaggcttgctcacactgcgcgcaaagccaccatccgaggcagagtataccgacgtgctgcagaaaatcaagtacgccttcagtctgttagcccgtctgcgcggcaatatagcagatcctagtagtcctgaattgctgcatttcctctttggaccactgcagatgatcgtcaatacttcagggggacccgaattcgctagttcagtgcggcgccctcacttaacctccgatgctgtggccctgctcagggataacgtgactcccagggaaaacgagctatggacctcgttgggcgatagctggacgcggcctgggctggaattgagccccgaagaggggcccccttacaggcctgagttctttagtgggtgggaaccaccagtcactgacccgcaatcgcgggcttgggaagacccagtggaaaaacagctccagcatgaacggcgcagacggcaacagtcggccccccaggtggccgtgaacggacaccgggacttggagccagagtccgagccccagctggaaagtgagaccgcaggcaaatgggtcctgtgtaattatgattttcaggctcgcaacagctctgagctcagcgttaaacagcgtgacgttctagaggttctggatgatagccgcaagtggtggaaggttcgcgatccggcaggccaggagggctatgtgccctacaatattctaacgccctatccaggtccacgactgcaccactcgcagtctcctgcgcgctcacttaactcaacccccccccccccccccgcacccgcccccgcgccccctccggcccttgcacggccccgctgggacaggcctcgatgggattcctgcgactctttaaacgggctggatccttctgaaaaagaaaagttcagccagatgctcatcgttaatgaggaactacaagcgaggctggcacagggaagatcaggtccaagtagggccgtgccaggtcccagggctccagagcctcagctgtccccgggtagcgatgcctctgaggtgcgagcttggctgcaggccaagggcttttcctcgggaacagtggatgcactcggagtcctcacaggcgctcagctgttctctctgcagaaggaagaattaagagctgtctcacccgaggagggtgcgcgcgtatattcccaggtgacagtgcagcggtcactattggaagacaaggaaaaggtgtccgaactggaagccgtaatggagaagcagaagaagaaggtagagggggaagtggagatggaggtcatctag

SEQ ID NO: 13825 - DNA, 1950 bp, Artificial Sequence
  Description of Artificial Sequence: Synthetic coding sequence
atgtcttcattcggagccggcaaaaccaaggaagttatcttctctgttgaagatggaagtgtgaaaatgttcctgaggggccgcccagttccaatgatgatccctgacgagctcgcacccacttactcactggacacaagatctgaactgccatcttgtcgccttaaattggagtgggtctatgggtaccgtgggcgagattgccgcgccaacctgtacctgctgcccaccggtgaaattgtgtactttgtcgcttccgttgccgtgttgtactcagtggaggagcagcgccaacggcattatctgggccacaatgacgacattaaatgtttggccatccatccagacatggtgaccatcgccaccggccaggtggccggaacaactaaggaaggtaagcccctccctccgcatgtgcgcatctgggactctgtctctttatccacccttcatgtgctgggcctcggcgtgtttgacagagccgtgtgctgcgttggtttcagtaagagtaatgggggcaacctcctctgcgcagtggatgaatccaacgaccacatgctcagcgtgtgggattgggcaaaggagactaaagtcgtggacgtgaaatgctctaacgaggccgtgttagtcgccacttttcatccaaccgatccgaccgtgctgatcacatgcggaaagagccatatctatttttggacactggaggggggttcgttgagcaagaggcaaggactcttcgaaaagcacgagaaaccaaagtacgtcctgtgtgtcacctttctggaggggggtgacgtcgtgacaggggacagcggcggtaacctatatgtgtgggggaaggggggtaacaggatcactcaggccgtcctgggcgcacatgacggaggtgttttcggtttatgcgctctgagagacggcacacttgttagcggcggcgggcgcgacaggcgtgtggtgctctgggggtccgattactcaaaactgcaagaggttgaagtgcccgaggacttcgggcctgtaaggaccgtggccgaggggcatggagacacactgtatgtggggacaaccagaaactcaattttgcagggatctgtgcacactgggttctcccttctggttcaaggtcacgtagaggagttgtgggggcttgccacacacccaagtagagcgcagtttgtgacatgcgggcaggataagctggtgcacctgtggagtagtgactcccaccaaccactatggtctcgcattatcgaagaccctgcccgttctgcaggctttcaccctagcggttcggtgttggctgtgggcacggtgacgggcagatggttgctgcttgatacggagacccatgacctagtcgcgatccacacagatggaaatgagcagatctcggtcgtgtctttttcgcctgacggggcttacctcgccgtcggaagtcatgacaatctagtctacgtctacacagtcgatcaaggcgggaggaaagtgagcaggctggggaaatgctcaggccattcctccttcattacacacttggattgggcacaggacagctcgtgtttcgtgaccaacagtggggactatgagatcctttattgggaccccgctacttgcaaacagatcactagtgccgacgcagtaaggaatatggaatgggccaccgccacatgcgtactcggatttggggtgttcgggatatggtcagaaggcgccgatggaaccgacattaatgctgtggcccgtagtcacgatgggaagttattagctagcgctgacgactttggcaaggtacacttgttttcttatccatgctgtcaaccacgcgcactgtcgcataagtacggagggcattccagccacgtaacgaacgtcgccttcctgtgggatgattctatggcgttgacaacaggcggtaaagatacctccgtccttcagtggagggtggtctag

SEQ ID NO: 13826 - DNA, 792 bp, Artificial Sequence
  Description of Artificial Sequence: Synthetic coding sequence
atggcaggactggaggtgctgtttgcctctgccgcccccgcgatcacatgtagacaggacgccctggtttgttttcttcactgggaagtggtgacccatgggtactttggactcggggtgggtgaccaacctgggcccaacgacaaaaagtcagaactgttgcccgctgggtggaataataataaggatctgtatgtgctgaggtatgagtataaggatggctctcgtaagctcctcgtgaaggcaattactgtcgagtctagcatgatcttgaacgtcctggaatacggcagtcaacaggtggctgacctaaccctcaacctagatgactacatcgatgccgagcatctgggggacttccatcgcacctataaaaattctgaggagctgcgatcacggatagtcagtggcattataacaccaatccacgaacagtgggagaaagctaatgtttcttcgccacacagagaatttccccccgcaacagcacgggaagttgatcctctgcggattccccctcaccacccgcacacatcccgtcagcctccgtggtgcgatcctttggggcctttcgtcgtgggaggggaggaccttgaccctttcggcccaagacgcgggggaatgattgtcgatccactccgttccggctttccccgtgctctcattgatccctcgtctgggctgcctaatcgactacctcctggagcagtgccacctggggcccgatttgaccccttcggacccattggaacttcgccacccgggccacggcccgaccgtcgcggtcaatag

SEQ ID NO: 13827 - DNA, 273 bp, Artificial Sequence
  Description of Artificial Sequence: Synthetic coding sequence
atggacaacatgagcccccgacttcgtgcctttctgtctgagccaatcggcgagaaggatgtgtgttgggtcgacgggatttctcatgaactcgctataaacctggtgaccaagggtattaacaaggcctacatactcctggggcagttcctcctcatgcacaagaatgaggcagaatttcagaggtggctgatctgctgtttcggcgcgactgagtgtgaggctcagcagacctcgcactgcttaaaggagtggtgcgcatgcttcctgtag

SEQ ID NO: 13828 - DNA, 888 bp, Artificial Sequence
  Description of Artificial Sequence: Synthetic coding sequence
atgccggtgcacacattgtctcccggggccccttctgcacctgcactgccttgccgtctgagaactcgggtgcccgggtacctccttcgcggccccgctgacggcggcgctagaaagcccagtgcagtggaaaggctcgaagctgataaggcgaagtacgtgaaaagcctacacgtggccaatacaagacaagaacctgttcaaccattgttgtccaaacagccacttttttcccccgaaactcgtagaaccgttctgacgccctcaagaagggctttaccaggcccctgtcgaagaccacagctcgatttagacatcctgagctcactaatcgacctatgtgattcccccgtgtcgccggcggaggcaagcaggacccccggaagagcggaaggagccggacgccctccacccgccaccccccctagaccaccgccatccaccagcgcagtgagaagagtggacgtccgcccattgcccgcctctcccgccaggccatgcccttcgcccgggcccgccgcagcctcaagtccagcaagacccccagggctgcaaagatctaagagcgacctgagtgagagattctcaagggctgcagccgatcttgagaggttttttaacttctgtgggttggatcccgaagaggctagggggcttggcgtggcccacctagccagggcaagttcagatatcgtgtctctggctggtccatcagcaggacctggatcctccgagggcggttgctcaagacggagctccgtaacggtcgaagaacgggcccgcgagagggtgccgtacggagtcagtgtggtggagcgcaatgccagggtgatcaagtggttatacggactgagacaggcgcgcgagtcgcctgccgctgaaggatag

SEQ ID NO: 13829 - DNA, 582 bp, Artificial Sequence
  Description of Artificial Sequence: Synthetic coding sequence
atgccaactacaagcaggcctgccctcgacgttaaaggcgggacttctcctgcaaaggaagatgccaatcaagagatgtctagcgtggcctactccaacctggccgtcaaagaccgcaaggccgttgcgatcttacattaccccggagtggcctcaaacggcacaaaggcttctggtgcccctaccagttcctccggctcaccaatcgggtcccctacgaccactccacctacaaaaccacctagctttaacttacaccctgcaccgcacttattggctagtatgcaccttcagaagctaaatagtcagtaccaggggatggccgccgccacccccgggcagccaggggaagctggacctctgcagaactgggactttggggcacaagcgggaggagcagagtcattgtcccccagcgcaggagcccagtctccagcaattatcgactccgatccagtagatgaagaagtgctcatgtccctggtcgtggagcttgggctcgaccgcgccaatgaattgcccgaattgtggctcggacagaatgagttcgacttcactgccgattttccgtcctcttgttag

SEQ ID NO: 13830 - DNA, 1077 bp, Artificial Sequence
  Description of Artificial Sequence: Synthetic coding sequence
atggcagctgtcctgaagcccgtcctgctcggcctgagagacgcccctgtccatggatcacccactggcccaggggcttggactgcctcaaaactgggtggcatcccagatgcacttccaaccgtggcagcccctagacctgtctgtcaaaggtgtggtcagcccttggccctggtcgtgcaggtatactgtcccctcgaaggctcccctttccaccgactgcttcatgtcttcgcttgcgcttgcccaggctgtagcactggtggagcccgctcctggaaggttttccggagccagtgtctccaggtacctgagcgggaggcccaggatgctcaaaaacagggcaattccctggcagctgaggattggtgtgagggggcagatgattggggatcagatactgaagaaggaccatcccctcagttcacactggacttcggtaacgatgcctcctcggcaaaggacgtcgactggacagcaagattgcaagacttacgcttgcaggacgctgtgctgggcgctgcacatccggtgccccctggactcccactgttccttccatattacatctgcgtggctgatgaggatgactatcgtgacttcgttaatctggaccatgcccattccctgctccgtgattaccagcagagagagggaatagctatggaccagctgttatcacagagcctgcctaatgatggtgatgaaaagtacgaaaagacaattatcaagagcggtgaccagaccttttacaaattcatgaagcggatcgccgcctgccaagagcagatcctgaggtacagctggtcaggggaaccgttgtttttgacgtgtcccaccagcgaagtgacagagctgccagcctgttcacaatgtggcggacagaggattttcgaatttcagttaatgcccgctcttgtgtccatgcttaagtcagccaatttagggctgtctgttgagttcgggaccatcctggtatacacatgtgaaaaatcttgttggccccccaatcaccagactccaatggaagagttttgcattatccaggaggaccctgatgaactgctcttcaaatag

SEQ ID NO: 13831 - DNA, 1779 bp, Artificial Sequence
  Description of Artificial Sequence: Synthetic coding sequence
atggcgagcgttgtcgtgaagacaatctggcagtccaaagaaatccacgaggcaggggacactccaaccggggtggaatcatgttctcaactggtgcctgaggccccgagaagagtcacatccagagccaaaggcatccccaaaaaaaagaaggcagtctcctttcatggcgttgaaccacaaatgtctcatcaaccaatgcactggtgtttgaacctgaagaggagctctgcttgcactaacgtgagtcttctgaatcttgcagcgatggaaccgacagactcgacgggcacagatagcacggtcgaggacttgtcagggcagctcacactggctggcccacccgcttctcctaccttgccatgggaccccgatgatgccgatatcactgaaatactgtccggcgtgaactctgggttggtgagagccaaggacagtatcacttccctcaaggaaaaaactaatcgagttaaccagcacgtccagagtttacagagcgagtgtagcgtgctctcagaaaatcttgagagacggaggcaggaggccgaggaattagaagggtactgcatccagctcaaggaaaattgttggaaagtgacacgaagcgttgaggacgccgaaatcaagacaaacgttctcaagcagaattccgccctactagaggagaagttgcgctatttgcagcagcagttgcaagacgagacccccaggcgccaagaagctgaattacaggaacccgaagaaaagcaggaaccggaagaaaaacaggagccagaagagaaacaaaagcccgaagcaggactttcctggaactcactagggccagcagccacctcccaaggatgcccaggacctccgggcagcccggataaaccaagtaggccccatgggttagtgcccgctggttgggggatgggaccgcgcgccggcgaggggccatacgttagcgagcaggaactgcagaagttgttcacaggcattgaggagctgcgcagagaggtgagctctctgaccgctagatggcaccaagaggagggcgccgtgcaggaagctctccgactgcttggtggcctgggcggacgcgtcgacggctttcttggccagtgggagagggctcagcgcgaacaggcccagacagctagggacctacaggagcttaggggccgggctgacgagctttgcaccatggtggagaggtcagcagtgtctgtggccagcctgcggtcagagttagagggactgggaccacttaagcccatcctggaggaatttggacgccaatttcagaacagtagacggggacccgatctgtccatgaacctggaccgctctcaccagggaaactgcgcccggtgtgccagtcaggggtcccagctttctaccgagagtctgcagcaacttctggacagggcgttgaccagtcttgtcgatgaagtcaagcaaagaggccttacacctgcttgcccctcatgtcaacggctccacaaaaagatcctggagcttgaacggcaagccttggccaaacacgtgcgcgccgaggccctgagcagcaccctgcgcctcgcccaggacgaggccttaagggccaagaacctgctgctaaccgacaagatgaaaccagaggagaagatggctacactggatcacctgcacctgaaaatgtgttctctgcacgatcatctttccaatctccccctggaagggtccacgggaaccatggggggcggctcctccgccgggaccccccccaagcagggagggtctgcccccgagcagtag

SEQ ID NO: 13832 - DNA, 2541 bp, Artificial Sequence
  Description of Artificial Sequence: Synthetic coding sequence
atgtccagctcccactttgcctccagacaccggaaggacatctcaacagagatgattagaactaaaatcgcacataggaaaagtctcagccagaaagaaaacaggcataaagaatacgagagaaaccgtcacttcggccttaaggacgtaaacatccccaccctcgagggccggatactggtcgagctcgacgagaccagccaggggttagttcccgagaaaaccaacgtgaaaccccgggccatgaaaacgatccttggtgatcagaggaaacagatgctgcagaaatacaaagaggaaaagcaattgcagaagctgaaggagcagagggagaaagcaaaacgaggcattttcaaggtcggacgatacagacccgacatgccctgcttcctgctgtccaatcagaacgctgtgaaggccgaacccaaaaaagccatcccctcaagcgtcaggataacgcgcagtaaggccaaagaccagatggaacaaacaaagatcgataatgaatctgatgtgagagctatccgaccggggcctcgccagacgtcagaaaagaaggtctccgacaaagaaaaaaaggtagttcagcccgtgatgcctaccagtctacggatgaccaggtcagccacgcaggccgctaagcaggttcctagaaccgtaagttcaactactgctcgtaagccagtgacacgagctgccaatgaaaatgagcccgagggaaaagtcccatcaaaggggcgtccagccaagaatgtggagaccaagcccgataaggggatttcatgtaaggtggatagcgaagagaatactctcaatagccagaccaatgctacaagcggcatgaatcctgacggagttcttagcaagatggagaacctaccggagatcaatacagccaagatcaaagggaagaacagcttcgccccaaaagatttcatgtttcagcccctggacggtctgaagacctaccaggtaacccccatgacaccgcgaagcgcaaacgcgtttctgacaccttcttatacatggacaccgctgaagacagaggtagatgagagccaggctacgaaggagattcttgcgcagaagtgtaagacctactctaccaagacgattcaacaagactctaacaaactgccgtgtccattaggaccactcacagtatggcacgaggaacatgttcttaacaagaatgaggccacgacaaaaaacttgaacggtttaccgatcaaggaagtgcctagtttggaacgcaatgagggtaggatagcccagccacaccatggcgtcccatactttcggaatatactgcagtccgagacagagaagcttacttcccactgttttgagtgggaccgcaaactggagctggatattcccgacgatgccaaggacctgatacggacagccgttggacagacaagacttctgatgaaggaaaggttcaagcaatttgaaggcctggttgatgattgtgagtacaaacgagggattaaggagaccacgtgcacagatctggatgggttctgggacatggtaagcttccaaatagaggatgtgattcacaaattcaacaaccttataaaactggaggagtccggttggcaggtgaataacaacatgaaccataatatgaataagaatgtctttcggaaaaaagttgtgtctggtatcgcttctaaaccaaagcaggatgatgccggccgtattgctgctcgcaacagactcgcggcgattaagaatgctatgagggaacgtatcaggcaagaagaatgtgccgagaccgccgtctccgttatccccaaagaggtcgacaaaatcgttttcgatgcaggctttttccgagtggagtcccctgtaaaactgttctccgggctgtcggtcagctctgaaggcccctcgcaacggctgggaaccccgaagtcagttaacaaagccgtctcacaatcccggaacgaaatgggcatacctcaacaaacaacaagcccggaaaatgcaggccctcaaaatacgaagagcgagcatgttaagaaaaccttgttcctatccatcccagagtcacgcagtagtattgaagacgctcagtgccccgggctacccgatctgatcgaggagaatcacgtcgtcaacaaaaccgacctaaaagtggactgtctttcctcagagcgcatgtcactcccactgttggcaggaggagtggccgacgacataaataccaataagaaggaaggcatctccgatgttgtggaagggatggagcttaattcctccatcacgagtcaggatgtgctgatgagtagccccgaaaagaatacagcaagtcagaattcgattctggaagagggtgagacaaaaatctcccagagtgagttgtttgacaataagtccttaacaacagaatgtcatctcttagacagtccaggactgaattgttcaaatccttttacccagctggagaggcgtcatcaagaacacgctcggcacattagctttggagggaatctgattacattttcccctctgcagccgggggagttctag

SEQ ID NO: 13833 - DNA, 1128 bp, Artificial Sequence
  Description of Artificial Sequence: Synthetic coding sequence
atggccagtgccccatggccagagagggtgccccggctattagctccacggctgcctagctatccacccccccctccaacggttggtttgaggtcaatggaacaggaggagacatacctggagttataccttgaccaatgtgccgcccaggacggcctcgccccaccaaggagccccttattctctcccgtggtgccttacgacatgtatattctcaatgcgtccaaccccgacacagcattcaactctaatccagaagtgaaggagacatccggcgattttagttctgtcgacttgtcgttcctaccagatgaggttacacaagagaacaaagaccaaccagtaatctctaagcatgagacagaggagaattccgagagtcagtctccccagtcgcgactcccttctccatccgaacaggatgtgggccttgggctgaactccagtagcctgtccaattctcactcacagctgcaccccggcgataccgatagcgtgcagccatcaccagaaaaaccaaacagcgatagcctgtccctcgcttcgattacccctatgacccccatgacccctatctctgagtgttgtggaatcgtccctcagctgcagaacattgtttcaacagtcaatctggcgtgtaagcttgatctgaagaaaatcgctctccacgcgaagaatgctgaatacaaccctaaaaggtttgctgctgtcatcatgcgaatccgcgagcctcgcaccaccgccttgatcttctctagcggcaagatggtgtgcactggagccaaatccgaggaacagtctcggctagccgctagaaaatacgcacgcgtcgttcagaagctcggcttccccgccagattcctggatttcaagatccagaatatggtcggctcctgtgacgtgcgttttcccatccgtctggaagggctcgtgttgacgcaccagcaattctccagctatgagcccgagctgttcccaggcctgatttatcgtatggtcaagccgagaattgttttgcttatattcgtatcaggaaaggtggtgctgaccggcgccaaggaacggtccgaaatctacgaggcatttgaaaacatatatcctattttgaaaggctttaagaaggcatag

SEQ ID NO: 13834 - DNA, 633 bp, Artificial Sequence
  Description of Artificial Sequence: Synthetic coding sequence
atgcaggctgagggtcagggcaccggcggatctactggcgacgcagacggaccagggggaccggggatccctgacggtccagggggaaacgctggaggcccaggcgaagcaggcgctacaggcggtcgtggcccccggggtgccggtgccgctagagctagtggccctaggggtggagcaccaaggggccctcacgggggcgcagccagcgctcaggatgggagatgtccctgcggcgctcgccgtccagacagccggctgctgcaattgcatattactatgcccttctcaagtcccatggaagccgaacttgtgcgccgtatcctctcacgagatgccgcgcctctccctcggcccggggccgtgttgaaggattttaccgttagtgggaacctgcttttcatgtcagtgcgagaccaggatcgcgaaggtgccggtcgaatgagagttgtgggctggggcctggggtcagcttcccccgagggacagaaggctcgtgacctgaggacccccaagcataaagtctcagagcagaggcccggaacccccggccctccgcctcctgaaggtgcccagggagatgggtgcagaggcgtggcttttaatgtgatgttctccgcaccccatatatag

SEQ ID NO: 13835 - DNA, 582 bp, Artificial Sequence
  Description of Artificial Sequence: Synthetic coding sequence
atggtcgttctgcgagctggcaaaaaaacattcttgccaccgctgtgtcgtgcttttgcctgcagagggtgtcagctggcacccgaaagaggggccgagcgtcgcgataccgcaccatcaggcgtcagcaggttttgtccaccaagaaagagctgccacgattggattgggccacctgataaatacagtaacctgcgtccggtacacttttacataccagaaaatgagagccccctcgagcagaagcttaggaagttacgtcaggagactcaggagtggaaccagcagttttgggcaaaccaaaacttgacattctccaaagaaaaggaagagttcatccactccaggttgaagacgaaaggcttgggtctccgcacagaatctggccagaaggctacattgaatgccgaagagatggctgacttttataaggagttcctgtcaaaaaacttccaaaagcacatgtattataacagggactggtataagcgcaattttgccattacttttttcatgggaaaggtggctcttgagcggatctggaacaagctcaaacaaaagcagaaaaagaggagcaattag

SEQ ID NO: 13836 - DNA, 1383 bp, Artificial Sequence
  Description of Artificial Sequence: Synthetic coding sequence
atggccaatgacccactggagggatttcacgaagtcaacttggcctccccaacgagtccggacctgctgggcgtgtacgaatcaggtacacaggagcagacaacgtccccatccgtcatctatcggccacatccgtcagcactgagtagtgtcccgatacaagctaatgcactcgacgtctcagaactgccaactcagccagtgtatagttcacccaggagactgaattgtgcggagatttcaagtataagttttcatgtcactgacccagccccttgctcgacaagtggagtcaccgccggactaaccaaattgactacacggaaagacaattacaatgccgaacgcgaatttcttcaaggagctaccatcacagaggcttgcgacggaagcgacgatattttcggactttccaccgatagcttatcaagactacggtctccatctgtcctggaagtaagagagaagggctatgagcggctcaaggaggagctcgctaaggctcagcgtgagctgaagctgaaagatgaagagtgtgagcggttgtcgaaggtgcgggaccagctaggccaggaactggaggagctgactgcgtctctatttgaggaagctcataagatggttcgtgaggcaaatatcaagcaggctacagcagagaaacaactaaaagaggcgcaggggaaaatcgacgttctgcaggccgaggttgctgctcttaaaacactggtgctctcctcttcacccacatcgccgacacaggaacccctgcccgggggcaaaacgccattcaagaagggtcacacgagaaataagagcactagttctgccatgtcaggctctcaccaggatctgtctgtcattcaaccaatagtaaaggattgtaaggaggccgacctgtccctgtacaatgaattccggctgtggaaggacgaacctaccatggatcgcacctgtcctttcctggacaagatctaccaggaagacatcttcccttgcctgaccttttccaagtccgagctagcctccgcagtattggaggcagtggaaaacaatacattaagcatagagcccgtcggcctacagcctattaggtttgtgaaggcttctgctgtggaatgcggaggtccaaagaaatgtgccctaacaggccagtccaagtcatgcaagcatcggattaaattgggggattctagtaactattactatatctctcccttttgccgctaccgcattaccagcgtgtgtaattttttcacatacattaggtatatccagcagggcttggtcaagcagcaggatgtggaccagatgttttgggaagtgatgcagctgaggaaagagatgtcactggcaaaactgggatattttaaggaggaactttag

SEQ ID NO: 13837 - DNA, 981 bp, Artificial Sequence
  Description of Artificial Sequence: Synthetic coding sequence
atggcaaccctggttgaactgccagactcagtgctccttgagattttcagttatctgcctgtgcgcgaccgcatcagaatttctagggtgtgtcatcgctggaaacggttagtggatgaccgctggctctggcgccatgtcgacctgaccctgtacactatgcgtccaaaggttatgtggcatctcctaaggcgctatatggcttcgagactgcattcactgcgaatggggggctacttgttcagcggttcccaggccccgcagctcagcccggcattgttacgagcactcggccagaagtgccctaacttgaaacgactttgcctgcacgtggccgacctgtcaatggtacctattacctctttgccgtctaccctgcgcacgcttgagctgcactcatgtgaaataagtatggcatggttgcacaaacagcaggatccaacggtactacccttactcgagtgtatcgtccttgaccgcgtgcccgccttccgagatgagcaccttcagggcttgacgaggtttagagctctgaggtcattagtactgggcggaacctatagagttaccgaaaccggtttggatgctggactccaggaactaagctatctccaaaggttggaagttttagggtgcacattgtccgctgattcgaccctgctggccatctctcgccacctgcgggatgtaagaaagattcgactgacagtccggggtctgagcgcacccggactcgcggtgctggaagggatgccggcccttgaatccctttgcttgcaaggccccttggtcacacccgaaatgccaagccctactgagatattgagcagctgcctcactatgccaaagctccgggtgctggaactgcaagggttgggctgggagggccaggaggcagagaagattttatgtaaaggcctgcctcattgcatggtcattgttcgggcctgccctaaggagagtatggactggtggatgtag

SEQ ID NO: 13838 - DNA, 3090 bp, Artificial Sequence
  Description of Artificial Sequence: Synthetic coding sequence
atggcttccgaagcagtcaaggtggtagtgagatgccgcccaatgaatcagcgagaacgggagttacgctgccagcctgtcgtcacagtggattgtgcgagggctcaatgttgcattcagaatccgggggctgctgatgagcctccgaagcagtttaccttcgacggtgcttatcacgtggatcacgtgacagaacaaatatataacgagattgcttaccccctggtggagggtgtgactgagggatataatgggactatcttcgcttatggccagactggctccgggaaaagcttcaccatgcagggcctacccgaccctccaagtcaacggggtattatcccaagggcatttgagcacgtgttcgaatccgttcagtgcgcagaaaataccaagtttcttgttcgggcttcctacctcgaaatttataacgaggacgtcagggacttgttgggcgcagatacaaaacagaagctggagctaaaggagcaccctgagaagggggtctatgtaaaaggattgagcatgcatactgtgcattctgtcgcccagtgcgagcacatcatggaaaccggctggaagaaccgatcagtcggatatactttgatgaataaggacagctcaaggagccacagtatcttcaccatttcaatcgagatgtcagctgtggacgagcgtggtaaagatcacttgcgggcaggaaaacttaacttagttgatctggccggttctgagagacagtcaaagacaggagccaccggggagcgattgaaagaggccaccaagattaatttatctctgtccgccctgggcaacgtcatttcagcccttgtcgacgggcgttgcaagcatgtgccctatagggattcgaagctgactcgcttattacaggactctctgggtgggaacaccaagacactgatggtagcatgtctgtcaccggctgacaacaattatgacgagacattgtcaactttacggtacgccaacagagcgaaaaatatccgtaataagccccgaattaatgaggaccccaaagatgcgctcttacgcgagtaccaggaggagatcaagaagcttaaagctatactgactcagcagatgagtccttctagcctctccgctctactgtccagacaagtcccacccgaccccgttcaggtggaggagaagctgctgccacagccagtgattcagcacgatgttgaagcagagaaacagctcattagggaggaatacgaggagcggctggcacggctgaaagctgactataaggctgaacaggaatctagagctcgtcttgaggaagacatcacagctatgcgtaatagttacgatgttcgtttatctacactggaagagaacctgcgcaaagagaccgaagccgtgcttcaggtgggcgtgttgtacaaggccgaggttatgtcacgggctgaattcgcgagctccgccgaatacccccccgccttccaatatgagaccgttgtaaagcccaaggtcttttctacgacggacactctgccttccgacgacgtgtctaaaactcaggtgagttccagattcgccgaactcccaaaggtggagccctctaaatctgagattagcctgggatctagcgagagctcaagcttggaagaaacgagcgtctccgaggcattccctggcccagaagaaccatccaacgtggaggttagcatgcctactgaggagtccagatcccggtacttcctggatgagtgcttggggcaagaggcagccggacacctcctgggtgagcagaattacttgccacaggaagagccgcaggaggttcctctccaaggcctcctggggttgcaggacccatttgctgaagtggaagccaaattagcacgcctaagttctacagtcgccagaaccgatgccccacaggctgatgtaccaaaagtgccggtccaggtgccagcccccaccgacctcctcgagccatcggacgctcgcccggaggcagaagcagcagacgacttccctcctcggcccgaagtagacttggctagcgaagtcgccctcgaggtcgtgcgcactgcagagccaggggtctggctcgaggcacaagcgcctgtagcgctagttgcccagccggaacccctgccagctaccgctggagtgaaaagagagagtgtggggatggaggtagcagttctgacagacgaccctctgccagtggtggaccagcagcaggttctggcgaggctgcagctcttagaacagcaggtagttggtggggaacaggcaaagaacaaagatttaaaggaaaaacataaaaggagaaagagatatgctgatgagcgccgcaagcagctggtcgccgctctgcagaactctgacgaggattccggtgactgggtgctcctgaatgtgtacgacagtatccaggaggaggttagggcgaaatcaaagctgctggaaaagatgcagcggaaactgagggccgcagaggttgagatcaaagacttgcagtcggagtttcagctcgagaaaattgactacctggccactatccggcgacaggagcgcgacagtatgctcctccaacagctgctcgagcaagtccaaccactcattaggagagactgtaactatagcaatctggagaagatcctccgagagtcatgctgggacgaggacaacggcttctggaagataccccacccagtgataacaaagacgagcctgcctgttgcagtgtctactggaccacaaaacaaacccgcgcgaaagaccagcgccgccgacaacggcgagccgaatatggaggatgacagatataggctcatgctgagtagaagcaattctgagaatatcgcctctaactatttcaggtctaagcgcgcttctcagatcctatctacagacgccagaaaatctctgactcaccacaatagcccacccggtctatcttgccccctgtcaaataactctgctatcccacctacacaggcgccagagatgccacagccccggcccttccgtctggagagtctggacatcccatttacaaaggcaaaacgaaaaaaatctaagtctaacttcggttctgagccactttag

SEQ ID NO: 13839 - DNA, 417 bp, Artificial Sequence
  Description of Artificial Sequence: Synthetic coding sequence
atgatacttcagcagccccttcagcggggaccacaggggggcgcacaacgcttgccccgcgctgccctcggagttacctggggtttggacgcctcgagcccacttagaggagctgtccccatgagcacaaagcgtaggctggaggaagaacaggaaccacttcggaagcagttcctctccgaagagaacatggctacgcatttcagtcaactgtctcttcacaacgaccacccatattgttcgccaccaatgacattttctccagccctgcctcccctaaggtcaccttgtagtgaactgctgttgtggcgatatcctggttcccttatcccggaagcgctacgccttcttcggctgggtgacacaccctccccgccttatccagccacgcccgccggtgatattatggaactgtag

SEQ ID NO: 13840 - DNA, 573 bp, Artificial Sequence
  Description of Artificial Sequence: Synthetic coding sequence
atgtttcaggttcctgattccgagggaggcagagctggctcacgtgctatgaaaccccccggcggcgagtcttccaacctgttcggctcccctgaggaggctaccccttctagccggccaaaccggatggcctccaatattttcggacccactgaggaaccacagaatattcctaagagaactaatcccccaggggggaagggaagtgggatatttgacgaatcaactcccgtgcaaactcgacaacatctgaacccgccgggtggtaagaccagcgacattttcggttcgccagtcactgcgacctcacgattggcgcaccccaacaagcccaaagatcatgtttttctctgcgagggggaagaacctaagagtgatctgaaagctgctcgctcgattcccgccggggcagaacccggggagaagggctccgccagaaaggctgggcccgccaaagagcaggagccaatgcctacagtggactcccacgaacctcggctggggcccaggcctcggagccacaacaaggtcttgaaccccccaggtggaaaaagttcgatcagcttttactag

SEQ ID NO: 13841 - DNA, 690 bp, Artificial Sequence
  Description of Artificial Sequence: Synthetic coding sequence
atgacctgctgcagccaggtgcctccccgaagaaggccctcccttgccctgtctcccagactggactgtaacggcctcaacggcgttcctgggagcatctgggatttcgtgtctggaagcttcagtccatcccctagcccaattctgagcgcagggccccctagctcctcatcagcaagccctaatggagccgagctggcacgggtgcgtcgccagctggacgaagcaaagagaaagattcgccagtgggaggaatcatggcagcaggtcaagcaggtgtgtgacgcttggcaacgggaagcgcaggaggctaaggaacgagccagagtcgctgactccgatagacagctggccctgcagaagaaagaggaagtggaggcccaagtgaagcaattgcaggaggagctggaaggtctcggcgtggcctcaaccctgccaggcctacgcggttgcggagatatcggaacgattcccctgcctaagctgcactctctccagagccagctccgactggacctggaagctgtagacggcgtgattttccagttgcgagccaaacaatgcgtggcgtgtagagaacgggcccatggagccgtgctgcggccatgccagcaccatatcctctgtgagccatgtgccgcaactgctccagaatgtccatattgtaaaggtcagccccttcagtggtag

SEQ ID NO: 13842 - DNA, 5460 bp, Artificial Sequence
  Description of Artificial Sequence: Synthetic coding sequence
atggcaagcatcactcagctatttgatgacctttgtgaggcattgctaccggcagccaaaacccacctcggccaaaggagtgtgaaccgcaagcgagccaaaagaagtctgaagaaggtcgcctacaatgccctattcaccaatctgttccaggacgagactcaacagctgcaacccgatatgtcaaagctcccggcccgtaataagatactgatgttgagcttcgatctacgcgtaggcggtttaggaccaaaggccgatagactggaagagctggtggaagagctggaggccgctccttgttgcccactgctggaagtgggcagtgtcctggaccttctggtccagctcgctggatcgggcccacctcaggtgttgcctcggaagcgggattactttttgaacaataagcatgtaggtaggaacgtcccatactccgggtatgattgcgatgatttgagcgtcttcgagatggatgtgcaaagcctgatctccagagaagagtgcctctgccacagtatgattcaggaaacattgcaagtgatggaggcagcccctgggacgggcctgccgactgttggactcttcagctttggagacccatgcggcgacagattcgaacgcgacactcgcgtgtcactcttcggggcgctagttcattcaagaacctacgatatggatgttaggctgggacttccccctgttcctgataacgcggacttgtcaggcctggccattaaggtacccccctcagtagaccagtgggaggacgagggtttccaatccgccagtaatctcactcctgattcccagtccgaaccctcagtgaccccagatgtggatctgtgggaggcagccttgacatacgaagcttccaaacgtaggtgttgggagagggtgggatgtccaccaggtcatagggaagagccgtaccttacagaagccgggagggacgcattcgacaagttttgtcgcctgcaccagggagaattacaactgctggcaggcggggtgctccaggcacctcagcctgtactagtcaaagagtgcgagttggtaaaggacgtgctcaatgtcctgatcggagtggtgtcagcgacattttcgttgtgtcagcctgctcaagccttcgtcgtgaaacgcggagttcacgtatccggcgctagccctgagtcaatttcgtccctgctgagcgaagttgctgaatatgggacctgctacacacgtctgagtcactttagcctgcagccagtccttgattccctgtatagcaaagggcttgtatttcaggcctttacctctggactgaggagatacctccaatactatagggcctgtgtcttgtctacaccacccacccttagcctgctgacaatcggattcctgttcaaaaagctgggaaggcagctgcgctatttggccgaactctgcggagtgggtgcagtgctgcccggcacttgtggtggaggtcccagggcagcatttccaaccggcgtcaaactgctttcctacctataccaggaggctctgcacaattgcagcaacgagcactatccagtactgctgagtttgttaaaaacctcctgtgaaccctatacacgatttattcatgattgggtctactccggagtatttagagacgcatacggcgagtttatgatacaggtgaatcacgagtatttgagctttcgagataagctgtactggactcacggttatgttctcatatccaaggaagtcgaagattgcgtaccagttttcctgaaacacatcgcccatgacatttatgtttgcggaaagaccatcaacctacttaagctgtgctgccctaggcactatctttgctggtccgatgtccctgttcccagaatatcagtgattttcagtttggaagaactgaaagagatagagaaagattgcgccgtgtatgtgggaagaatggagcgagtggccaggcacagctccgtctctaaggaagagaaagaactcaggatggagatcgccaaacaggaactaatcgctcacgcacgtgaggccgcaagcagggtcctgtccgccttatcagatcgccagatgtcagaacggatggcattggacgctaggaagagggagcagtttcagcggctcaaggaacagtttgtgaaggaccaggaacgcagacaagctgcaagacaggaagagcttgacgatgatttttcctacgctcgggagcttcgtgaccgggagcggaggctgaagtctctggaagaagaacttgaaaggaaggccagacaggccctcgttgatcattacagtaagttaagcgccgaggccgcaaggagagaacaaaaagctctgtggcgcatccagcgacacagactcgaaagcgcacggctcagatttctgctggaggatgagaagcacatccaagagatgttaaaggcagtgtcggaggctcaccagccgcaggagccgccggatgtcctgctctcagtgcatcctcaggtaacgtcccctgggccagaacacccagagggaggtcaaggctgcgattcaggttcagctgaacagcactcacctgcgtgggatggttggaatcgacctgggttgctgactcctcagccgctgaagccccttgcagtaggtgccgggggcagaggactccagcaagccgagggcgccagacctttcagtgactccttgagcattggagatttcttacccgttggccccggcgcggaacctagcgtccagacgggcatggttccactgctcgaggtcgcactccagactatcaatcttgacctcccaccctctgctcctggcgaagcccctgctgcagcttccactcagccttcccgccctcaggagtatgacttctctacggttctgcgtccggccgtggcaacgtcccctgctcctggaccccttcaggcagcagagtgtagtcttggcagctctgggctgcagttgtgggaggatagttgtgggaagatggacgcctgtggtagcgcatcaagggagaccctactgccctcccacccaccacgacgagccgccctggaagaaggctcttcccagccgacggaaaggctgtttgggcaggtgagtgggggcggcctgcccaccggcgattatgcttcagaaattgctcctacaaggcctagatggaacacccatggacatgtctccgatgcgtctatcagggttggagaaaacgtgtccgatgtggcccctacccagcctagatggaatacccacggtcatgtcagcaacgcttcaatttccctgggggaaagcgtttccgacgtagcgcccacgaggcccaggtggaatatacacggccacgtgtcaaacgcaagcatcagagtgggagagaatgtcagtgacgtcgcccccactcgccccaggtggaatacacatggccatgtgtcaaatgcgagcattcgcgtgggcgagaacgttagtgacgttgctccaactcggccaagatggaatacacatggtcacgtgagcgatgcctcaatctctcttggtgaatccgtctctgacatggcccccgccagacccagatggaacactcacggccatgtgagtgatgcaagtatcagcctgggcgaatcagtctcagacatggcccctacgagaccaagatggaacacccatggtcacgtgtctgatacgtctatcagggtgggggagaacgtctctgatgtagcccctatacggagccgctgtaatactcatggccatgtgtccgacgcatcaatttctctgggtgaacccgtatccgacgtggtgtccacacgccctagatggaacacacacgtacccatacctcccccccacatggttctgggggccctgtcaccagaggctgagccaaacacaccacgacctcaacaaagtccacccggccatacaagtcagtctgccctctcgctgggtgcccagtcaactgtgctggattgtggcccacgattaccagttgaggttgggccctccttgagctccccatcgtctggctgtggagagggttccatctccgtgggcgaaaacgtgtccgatgtggctccgactcaaccatggtggcctaacacacctggcgactccgtatctgaggaactcggtcctggacggtccggtgatacggaagacttgagccccaactggccgctgaacagtcaggaggatacggcggcacagtcttcaccggggcggggagaggaggccgaagccagtgcagcagaggcacaggggggcgaacaggcataccttgctgggctcgccggtcaataccatcttgagaggtaccccgactcctatgagagtatgagcgagccacccatcgcgcacttgttgagacctgtcctgcctagggcgttcgcattcccagtcgatccacaggtccaatcggcagccgacgaaactgccgtgcagctgagcgagttgcttacactcccagtgcttatgaagcgatcaatcacagcacccttagctgcccacatctccctggttaacaaggctgccgtggactatttcttcgtggagcttcaccttgaagcccactacgaagccctgagacacttcctgttgatggaagacggggagttcgcgcagtctttgtccgacctgttatttgagaaacttggcgccgggcagacccccggcgagctcctgaatccactggtacttaactccgttctgtcaaaggccctgcagtgctccttgcatggggataccccccatgcaagcaatctgtcactggcgttgaaataccttcctgaagtgttcgctcccaatgcccctgatgttttatcctgtctagaactcaggtacaaggttgactggcctctgaacatcgttattactgaaggttgcgttagcaaatatagcggggtgttctcctttctgctgcagttgaagctgatgatgtgggctctgaaagatgtgtgcttccacctcaaacggaccgcactactaagccacatggcaggcagcgtacagtttcgtcaactgcagttgttcaagcatgaaatgcagcattttgtcaaggtgatccaaggttacattgccaatcagattctgcacgtaacatggtgtgagttcagggctcgccttgcaaccgttggggacttagaggagatccagcgtgcgcacgcagagtacctgcataaggccgttttcagagggctcctgaccgagaaggctgcacctgtgatgaatgtgatccatagcatcttttcgttggttttgaaattccgctcacagctgatttctcaggcttggggacctcctggtggtccccgaggagccgaacacccaaatttcgcactgatgcagcagagctacaacactttcaagtactattcgcatttcctgttcaaagtagtgacaaaactggttaaccgggggtatcagccccatcttgaggattttcttctgaggattaactttaataactactaccaggatgcatag

SEQ ID NO: 13843 - DNA, 2250 bp, Artificial Sequence
  Description of Artificial Sequence: Synthetic coding sequence
atgtccggatcccacacgcctgcctgtggcccattctccgcgctgacgccgagtatttggccccaggagatccttgccaagtacacacaaaaggaagaatccgccgagcaacctgaattttactatgacgagtttggatttagagtctacaaagaggagggagacgagccgggttcaagcctcctggccaactcgccactgatggaagacgcgccacaacggctacgttggcaagcccacctcgaattcactcacaaccacgatgtcggcgatctcacgtgggacaaaattgccgtgagccttcctcgcagtgagaaactgaggtcccttgtgttggccggaatccctcatggcatgcggccccagttatggatgaggctgtccggagccctgcagaaaaagcgaaactccgagctctcttaccgggagatcgtcaagaactccagcaatgacgagactatagcagccaagcagatagaaaaggacctcctaagaaccatgccaagcaatgcctgctttgccagtatggggagcatcggagtgcctcggctgcgccgggtgttgcgcgccctcgcctggttgtatcccgagattggctactgtcaaggaacaggcatggtcgcagcatgccttctgctgtttctggaggaggaggacgcattctggatgatgtcagccattatagaagaccttttgccggcatcctacttcagcactaccttgctgggtgttcagaccgaccagcgggtattgagacacctgatagttcagtatcttccacggctcgataagctcttgcaggaacatgacattgaattatcactgattaccctccactggttcctcaccgccttcgcctctgtcgttgatatcaagctattattgaggatatgggatctgtttttttatgagggtagccgagtccttttccagcttaccttgggtatgttgcacctcaaggaggaggagttgatccagtccgaaaatagcgctagtatctttaatacactgtccgatataccatctcagatggaagatgctgagctactgctgggtgtcgcgatgagactcgctggatccctcacagatgttgcagtagagacacagcggaggaaacatctcgcatatctcatcgccgaccagggacagctgctgggggccgggaccctcaccaacctgtctcaagtcgtacggaggcgaactcagagaagaaaatctaccattaccgccctgctcttcggagaggacgatctggaggccctcaaggctaaaaacattaaacagacagagctggtggccgacttacgtgaggccatattaagagtggccagacatttccagtgcacagatccgaaaaattgttccgttgaattaacaccagactattctatggagtcacaccaaagggatcacgagaactacgtcgcctgcagtagatcacaccgccggcgagcaaaggcgttattggactttgaacggcatgatgatgatgagctgggcttccgaaagaatgatattattaccatagtctcccagaaggatgagcattgctgggtgggggaactgaacggactccgtggctggtttccggctaagtttgtcgaggttctcgatgagcgcagcaaggagtatagtatcgccggagacgatagtgtgacagaaggcgtgacagatctggttcgcggaacactgtgtcccgcactgaaagccttgttcgagcacggattgaaaaagccctctctgctcggcggagcttgccatccatggctgttcattgaggaggctgcagggcgagaagtggagcgagacttcgcgtcagtctattcgcgtctggtgctgtgtaaaactttccggcttgacgaggacggcaaggtactgacacctgaggagctgttgtaccgcgccgtccagtcagtgaacgtgacccacgacgcagtccacgctcagatggacgtcaaactccggtctctaatctgtgtgggcctcaacgaacaggtgctacatttatggttagaggttttatgctcctcactcccgactgtagagaagtggtaccagccatggagcttcctgcggtctcccgggtgggtgcagatcaagtgtgaattgagggtgctctgttgtttcgctttcagtttgtcacaggactgggagctcccggcaaaaagggaggctcagcaaccattaaaggaaggagtacgagacatgctggttaaacaccacctcttctcctgggatgtggatggatag

SEQ ID NO: 13844 - DNA, 2097 bp, Artificial Sequence
  Description of Artificial Sequence: Synthetic coding sequence
atgctatcccccaaaatcagacaggcacgccgggctcgatccaaaagcctggtaatgggtgaacagtcacgttccccagggcggatgccatgcccacataggctcggcccggtgttgaaagcaggctggctgaaaaagcagcgttctataatgaagaactggcagcaaaggtggttcgttctgcgaggggatcagttattttactataaagataaagacgaaatcaaaccccaaggcttcatttcactgcagggcactcaggttacagagttgcccccaggccctgaggatcctgggaagcacctgttcgagattagcccaggcggagccggagaaagagagaaagtgcccgcaaaccctgaggctctgctacttatggccagttcccagagagatatggaagactgggtgcaggctatccgtagggtcatctgggcccccctgggaggaggcattttcggccagcgacttgaggagacagttcaccatgaaagaaaatacggccctcgcctggccccactgctggtagagcagtgtgtagatttcattagggagagaggactgactgaggagggattatttcgcatgccaggccaggctaatctggtccgcgacctgcaagattcgtttgattgtggagaaaaacccctgtttgatagtacaacggacgtgcacaccgtggcctcattgctaaaactatacctgagggagttgcccgaaccagtcgtgccgttcgcccgctacgaggacttcctgagttgcgcccaactgctgacaaaggatgaaggcgagggaaccctggaactcgcaaaacaagtgtccaacctcccccaggcaaattataatctgctgcgctacatttgtaagttcctggacgaggtccaggcttattcaaacgtcaataaaatgtccgtacaaaacctggctacagtatttggaccaaatatcctgcggcctcaagtcgaagatcccgttacaatcatggaggggacaagcttagtccagcacctgatgactgtgttgatcagaaagcattctcaactctttaccgccccagtgcctgagggcccaacaagtcctaggggcggccttcagtgtgcagtggggtggggcagcgaggaagtgacccgggattcccagggtgagcctggtggccccgggctgcctgcacacagaacctcttcccttgacggggcggccgtggcagtgctgtcaaggactgccccaaccgggcccggctcgcgttgcagcccaggcaagaaagtccagacactccctagctggaagagctccttccggcagccacggagcctgagcggttcaccgaaaggaggcggatcaagcctggaagtgcctataataagcagcggcggtaactggctgatgaatggattatcatcactgcgaggccatcggcgagcatcctctggggaccgattgaaagactccgggtcagtgcagcgcctgtcgacctatgacaatgtgcctgcgccagggttagtccccggaataccaagcgtcgcctctatggcctggtccggggcatcctctagtgaatcctccgtgggcggatcccttagttcctgcacagcatgccgggcaagcgactctagtgcgagaagtagcttgcataccgactgggctctcgagcctagtccacttccatcgagttccgaagatccaaaaagccttgacctagatcactctatggatgaggcaggtgctggcgcaagcaatagcgagccctctgaaccagactcccccacgagagaacatgcccggaggagcgaagcactgcagggcctcgtgaccgagcttagggccgaactgtgcagacagcgcactgaatatgaacgatccgtgaaaaggattgaggagggttctgctgatctgcgcaaaaggatgtctagactggaggaggaactcgatcaggaaaagaagaagtacattatgcttgagatcaaactgagaaactctgagcgggcacgcgaagacgctgaaaggcgcaaccagctgttgcagagggaaatggaagaattctttagcactctgggttccctgactgtgggagctaaaggagctcgcgctcccaagtag

SEQ ID NO: 13845 - DNA, 180 bp, Artificial Sequence
  Description of Artificial Sequence: Synthetic coding sequence
atgactaggggcaaccaaagagaattggcaagacagaaaaatatgaaaaagcaaagtgactcggtgaaaggcaaacgcagggacgatggcctgagcgcagctgcaagaaaacagcgagatagcgaaataatgcagcagaaacagaaaaaggcgaatgagaaaaaggaggagcccaaatag

SEQ ID NO: 13846 - DNA, 372 bp, Artificial Sequence
  Description of Artificial Sequence: Synthetic coding sequence
atggcccggtatgaagaggtttcagtaagtggctttgaggagttccaccgggccgtggagcaacacaacggcaaaacaattttcgcgtacttcacggggtccaaggacgccggagggaagtcgtggtgtccagactgtgtgcaggcagagcccgttgtcagagaaggcctgaagcatatatccgaaggctgtgtgtttatctactgccaagttggggaaaaaccatactggaaggatcctaacaatgatttccgcaaaaatctgaaagtgaccgcagttccgacgctcctgaagtacgggaccccgcagaaactagttgagagcgagtgcctgcaagctaatcttgttgagatgttgttttctgaggattag

SEQ ID NO: 13847 - DNA, 1401 bp, Artificial Sequence
  Description of Artificial Sequence: Synthetic coding sequence
atgggatggataacagaggatcttatacgcagaaacgctgagcataacgattgcgtgatcttctctctggaggagctttcactgcatcagcaggagattgagagactcgagcacatagataaatggtgcagagacttgaagattctgtatctccagaacaacctgataggcaagatcgaaaacgttagcaaacttaagaagttagagtatctgaatctcgccctgaataacattgaaaaaatcgagaatctggaagggtgcgaggaactggctaaattagaccttaccgtcaatttcatcggcgagttaagcagtatcaagaacctgcagcacaatatccatctgaaggagctcttcctcatggggaacccatgcgcctctttcgaccattacagggaatttgtagtcgccaccctcccacaactcaagtggctcgatggcaaagaaatcgaaccatccgagcgaattaaggctctgcaagactattccgtgatagagccgcagattagggagcaggagaaggaccactgtctgaaaagagccaaactcaaggaagaagcccagcgcaaacatcaagaggaggacaaaaatgaggataaaaggtcaaatgctggatttgacggacgatggtatacagatataaacgcgaccttgtctagtctggagagcaaggaccatcttcaggcccctgatacagaggaacacaatactaagaagctggacaactcggaggatgacctggagttctggaacaagccatgcctgtttaccccagaatcacgactggaaaccttaaggcacatggaaaagcagagaaagaaacaggaaaaactgtcagagaagaagaagaaagtgaagccaccccgaactttaataactgaggatggcaaagctttgaatgtcaacgagcctaaaattgatttttctctgaaggataatgaaaagcaaataatcctggacctcgcagtgtaccgctacatggacacatccctcatcgatgttgatgtccagccaacttacgtgcgggtgatgattaaagggaagcccttccagttagttctgcccgccgaggtcaagccagactctagttccgcaaaaagaagccagacaacaggccacctggtgatctgcatgccaaaggtgggagaggtcattacaggtggccagcgtgcattcaaatcaatgaagacaactagtgaccgctcacgagaacaaacaaacacccgaagcaaacatatggaaaaactcgaagtagacccatctaagcatagctttcccgatgtcactaacatagtgcaggaaaaaaagcacaccccaagaagacgtcccgagccaaagatcataccgtcggaggaggacccaactttcgaagacaatccggaagtccctcctctgatttag

SEQ ID NO: 13848 - DNA, 1050 bp, Artificial Sequence
  Description of Artificial Sequence: Synthetic coding sequence
atggaagatcctcagtctaaagagccggctggagaagccgtggctttggccttattggaatcccctagacccgaaggaggggaagagccgccacgaccgagcccagaagaaacacagcaatgcaagttcgacggccaagaaactaagggatcaaagttcatcacatcatccgcaagcgattttagtgaccctgtgtataaggagatcgccatcacaaacggatgcattaatagaatgtcaaaagaggagctgcgggccaaactgtctgaattcaagcttgagacccgtggagtcaaggacgttcttaaaaaaaggctcaagaactattataaaaaacagaaactcatgctaaaggagtccaacttcgcagatagctactatgattatatatgcatcatcgattttgaggctacatgcgaggaaggaaatccccctgagtttgtgcacgagatcatcgagttccctgtggtcttgctgaatactcatacattggagatcgaagacacttttcagcaatatgttcggcccgagatcaatactcagctaagtgacttctgcatatcccttaccggcattacacaggatcaggtcgatcgagctgacactttcccccaggtgctgaaaaaggtgatcgattggatgaagctgaaagaactgggcacaaagtacaagtacagcctgcttaccgacggatcttgggatatgtctaagtttcttaatattcagtgccaactctccagactgaagtacccaccttttgcaaagaagtggattaacatcagaaaaagctatggaaacttctataaggttcctcggagccagacaaaacttaccatcatgttggaaaaactaggtatggactatgacgggcgccctcactgtgggctggatgattctaaaaacatagcacgcatcgcagttcggatgctgcaggatgggtgcgaattgagaataaacgaaaaaatgcatgccgggcaattgatgtcagtcagtagctctctccctatcgagggcaccccgcccccacagatgccacacttccgaaagtag

SEQ ID NO: 13849 - DNA, 843 bp, Artificial Sequence
  Description of Artificial Sequence: Synthetic coding sequence
atgcttagtgctgtggctcgaggttaccaggggtggttccatccctgcgctagactgtccgtgcgcatgagcagcaccggcatagaccgtaagggagttctcgccaatcgagtggcagtggtgacaggatctacctccggaatcgggtttgcaatagcacgccgcctggcaagggatggcgctcacgtggtgatcagtagccggaagcagcagaacgtggaccgtgcgatggccaagctgcagggcgaagggctatctgtggccgggatcgtgtgccacgtgggaaaggcagaagatcgggagcagttggttgcgaaggctctggagcattgcggtggtgtggattttctggtgtgtagcgccggggtgaatccattggtcgggtccacgctcggtactagcgagcaaatctgggacaaaatcctgagtgtgaacgtgaagagccctgccttgttgctcagccagctgttgccatatatggagaatagaagaggcgcagtgattttagtctcaagtatcgctgcttataaccctgtcgttgctctaggggtgtataatgtttcaaagactgctttgttgggactcacgcgaacattggcgctggagcttgcacccaaagacattagggtgaactgtgttgtcccgggaatcattaagaccgatttctctaaagtgtttcacggaaacgaatcattatggaaaaattttaaggagcatcaccagcttcagcgtattggggagagcgaagactgcgctgggattgtaagctttctgtgtagcccggatgccagctacgtgaacggagaaaatatcgctgttgctggatactccacacgactgtag

SEQ ID NO: 13850 - DNA, 909 bp, Artificial Sequence
  Description of Artificial Sequence: Synthetic coding sequence
atggtgacggaacaggaggtggacgctataggacagacccttgttgaccctaaacagcctttacaggcaagattcagagctcttttcacgctgagaggcctcggcggtcccggcgccatcgcttggatctcccaggcttttgatgacgattcagcattgttaaaacacgaacttgcatactgcctggggcagatgcaggacgctcgcgcaatcccaatgctggttgatgttttgcaggacactcggcaggagccaatggtgcggcatgaggctggtgaggctctgggcgccatcggggaccctgaagtcttagaaatcttgaagcaatacagtagtgaccctgtgatcgaagttgcagagacctgtcagctcgccgttagaagactggagtggctgcagcagcatggaggcgagcccgcagcaggcccatacctgtctgttgaccccgctccaccagcagaagagagagatgtcgggcgcctaagagaggccttactggatgagagtcgccctctgtttgaacggtatcgcgcaatgtttgcactccgaaacgctggaggggaagaagctgctcttgcccttgcagaaggactgcattgtggctccgctttattcagacatgaggtgggatacgttctgggtcagctccagcacgaggccgccgtcccacagctggccgccgcactggcccgttgtaccgagaatcctatggtgcggcatgagtgtgctgaggccctcggtgccatcgcccgtcccgcctgcctcgccgcactgcaggcccatgccgacgacccagaacgcgtggttcgggaaagctgtgaagtggctcttgacatgtacgagcacgagaccggcagggcattccagtacgccgatggtctggagcagctacgcggcgccccaagctag

SEQ ID NO: 13851 - DNA, 3384 bp, Artificial Sequence
  Description of Artificial Sequence: Synthetic coding sequence
atggaggtacaggtgtcacaggcctcgctaggcttcgaactgacatcggttgagaaatcgctccgggaatggagccggctttcgcgggaggtcatagcgtggctgtgtccttctagcccgaacttcatcttgaattttcctccaccacctagcgcatcctccgtcagtatggttcagcttttctcatcccccttcggatatcagtctcccagtggacattccgaggaggagagggagggtaatatgaagtctgcaaaaccacaagtgaatcacagccagcacggtgagtctcagcgcgctttatctcccctgcaatctaccctaagctcagcagcaagtccttcccaagcgtacgaaacttacattgaaaacgggctgatttgcctgaagcacaagattcgcaacattgagaagaagaagttgaaacttgaagactataaggatcgattgaagtccggcgagcacctgaatcccgatcaactggaggctgtcgagaagtatgaagaggtgctgcacaacctggagttcgcaaaggagcttcagaagactttcagtgggttgtccttggacttactcaaggctcagaaaaaagcccagcggcgcgagcacatgttgaagctggaagcggagaagaaaaagttgaggactatcctccaggtgcagtacgtgcttcagaacctgacccaggagcatgtccagaaagacttcaagggcggactgaatggagctgtttacctgcccagcaaggaactcgattacttaattaagttcagcaagctcacatgccctgagcgcaacgagtctttgtccgtggaggatcagatggaacagtctagtctttatttctgggatttgctcgaggggagtgagaaggccgtagtcggcacaacgtacaagcatctgaaagatttactgagcaaactgctcaacagcggttattttgagagcatacccgtacccaagaacgcaaaggaaaaagaggtacccttggaagaggagatgctgattcagagcgagaaaaagacccagctatcgaagacggaatctgtaaaagaatccgaatctttgatggagttcgcccagcctgaaatccagcctcaggagttcctcaatagacggtacatgacagaagttgattacagcaacaaacagggcgaggaacagccatgggaggcagactacgcccgaaagccaaaccttccgaaacgctgggacatgctcaccgagcccgatggccaggagaaaaaacaagagtccttcaagtcatgggaagcctccggcaaacatcaggaggtgagcaagcctgctgtgagtctggagcagcggaagcaggacacaagtaaactgagatccacacttccggaggagcagaagaaacaagagatttcgaaatccaaaccatcccctagccagtggaagcaggatacccctaagagcaaggccgggtatgtccaggaggagcagaaaaaacaggaaacccccaagctctggccggtgcaactgcagaaggagcaggatccgaaaaaacaaactccgaagtcatggacaccgtccatgcagtctgagcagaacaccacaaaatcctggacgactccgatgtgtgaagaacaagattccaaacagcctgagactcccaaatcgtgggagaacaacgtggaatctcagaaacatagcctgacatctcagtcacagatttcacctaaaagttggggggtggctaccgcttctctcatccccaacgaccagctcctacctagaaagctcaataccgagcccaaagatgtccctaaaccggttcaccagccagtgggatccagctccaccctgcccaaggaccccgtgttacgtaaggagaaactgcaggatctaatgacgcaaatccagggcacttgcaatttcatgcaggagagtgtgctggactttgacaagccttcctcagcaatccccacatcacagccaccttcagcaacccctgggagtccagttgccagcaaagaacagaacctcagcagtcagagcgactttctgcaggaacccctacaggcaacatcgtccccagttacttgcagttccaatgcctgtctggtgacgaccgatcaggcatccagtggatccgagacggagttcatgacaagcgagactccggaagctgccatacctcccggcaaacagcccagcagtctggcctcaccaaacccccctatggccaagggctccgagcaagggtttcagtctcccccagcgtctagctccagcgtcaccattaatactgcgccattccaggccatgcaaaccgtatttaacgtcaatgctcctctacctccacggaaggagcaggagatcaaggagagtccttactcacccggatataatcaatcttttacaacagcctccacccagacaccgcctcagtgccagctgccatcaatccatgttgagcagacagttcacagccaggagaccgcagcaaattaccatcctgatgggaccatccaggtgtccaacggtagcttggccttctaccctgcgcaaactaacgtttttccccgaccaacacagccgttcgttaatagccgtggttctgtgcgcggctgcactcgcggagggagactgatcacaaacagctaccgtagccccggaggttataagggtttcgatacgtaccgaggactgccttcgatttcaaacggcaactactctcagttgcagttccaggcccgggagtacagtggagcaccttacagccaacgagataactttcagcagtgctataagcgcgggggtacctccggcggcccaagggccaattcccgcgccggttggtctgactcctctcaggtatcatcccccgaacgggataatgagacattcaatagtggcgacagcggacagggcgactctagatccatgacgcctgtcgatgtgcctgtcactaatccagctgcgacaatcttgccagttcacgtctaccccttacctcaacaaatgcgcgtggcattctcagctgccaggacttctaacttagcccccgggaccttggatcagccaatcgtgttcgacctgttactgaataacctgggcgagacttttgacctgcagctgggccgattcaattgtccggtgaacggcacctatgtgtttatcttccatatgcttaagctggccgtgaacgttcccctgtatgtgaatttgatgaaaaacgaggaggtgcttgtgagcgcctacgccaacgatggagcccccgaccacgagacagcttcaaatcacgcaatcctccagctctttcaaggagatcagatttggttgcgcctgcacaggggcgccatttatggctcatcatggaagtattcgacgttctcaggctatctgctctaccaagactag

SEQ ID NO: 13852 - DNA, 2448 bp, Artificial Sequence
  Description of Artificial Sequence: Synthetic coding sequence
atggaggtgcgggccagtcttcagaaggtatctggaagtagtgactccgttgcgactatgaactctgaggagtttgttctagtgcctcaatacgccgatgacaacagcacgaagcacgaagagaagccgcagttgaagatagtgtcaaacggggacgagcaattagagaaagcgatggaagagattttacgggattcagagaagcggccgtcatccttgctagtcgactgtcagtcaagcagtgaaatctcggatcattcgttcggcgatatcccggccagtcagaccaataagcccagcctgcagcttatcctggatccttcgaacactgaaatcagcacacctcggccctctagtcccggaggattgccggaagaggactccgtactgttcaataagctgacctaccttggatgcatgaaagtgagtagtcccaggaatgaggttgaagccttacgggctatggccactatgaaatcaagcagccagtatccattccctgtgaccctctatgtccctaacgtgcccgaggggagtgtgcgtatcatcgaccagtcaagcaatgtcgagatcgctagctttccaatttataaagtgctgttttgtgcccgaggacatgatggcactaccgagtcgaattgcttcgcattcacagaaagctcccacgggagcgaggagttccagattcatgtattttcctgtgagatcaaggaagccgtctcgcgaatactgtattctttctgcactgcttttaaacggtcaagccggcaggtgtccgatgtgaaggactctgttattcccactcctgacagcgacgttttcacgttctctgtttcactggaggtgaaagaggacgacggaaaggggaatttcagcccggtgcccaaagaccgtgataagttctatttcaagcttaaacaaggaatcgagaaaaaggtcgtaataaccgtgcagcagctttcaaacaaggagctggccatagaacgctgcttcgggatgttgctttcacccggacgcaacgtgaagaattccgacatgcacctgcttgacatggaatcgatgggaaagtcatacgatggccgggcctatgtcataaccggaatgtggaatcccaacgctcctgttttcttagctctgaacgaggaaactccaaaagataaacaggtgtatatgacagtcgccgtggacatggtagtgaccgaagtcgtcgaacccgttcgtttcctcctcgaaaccgttgtccgtgtgtatccggccaacgagaggttttggtacttctcacgaaagactttcacagagaccttctttatgcggctgaagcagagcgaagggaaagggcatacgaatgcgggagacgccatatatgaagtggtcagcctccagcgggagtctgacaaagaggagcccgtcactccaacttccggcggaggaccaatgagtcctcaggacgacgaggcagaagaggagtccgataacgaactgagcagcggcactggagatgtgagcaaggactgtcccgagaaaatcttgtactcctggggtgaactgttggggaaatggcactcaaaccttggagcgcgaccaaagggtcttagcacattggtgaagtccggggttcctgaagcgctgcgcgccgaggtgtggcagttgctggccggatgtcacgacaatcaggcaatgctggacagataccggatattgatcaccaaggacagtgcccaggagtccgtcattacccgcgacattcacagaactttccctgcccatgactactttaaggacacaggaggagatggccaggaaagtttatataagatctgcaaagcgtactctgtatacgacgaggacattgggtactgtcagggacagagtttcctggccgcggtgctgctgttgcatatgccagaggagcaagccttctgcgtccttgttaagattatgtatgactatggcctgcgtgacctgtatcggaataacttcgaggacttgcattgcaagttctaccagctcgagcgcctaatgcaggaacagctgcccgatctgcacagtcattttagtgatctgaatctggaagctcacatgtacgcgagccagtggttcctgacactctttacagctaagtttccattgtgcatggtgtttcatatcatcgacctgctcctatgtgaaggtctcaacattatctttcatgtcgctcttgctctgctgaagacctccaaggaggatcttctgcaggccgactttgagggcgctctgaaatttttccgagtgcaactccccaagaggtatagggccgaggagaatgctaggcgcctgatggaacaagcgtgcaatatcaaagtgcccacaaagaaactgaagaagtatgagaaagagtatcagactatgcgggagtcccagctgcagcaggaagaccccatggacagatataagtttgtgtacctgtag

SEQ ID NO: 13853 - DNA, 639 bp, Artificial Sequence
  Description of Artificial Sequence: Synthetic coding sequence
atggcccaaaccgataaacccacttgcattcctcccgaactccccaaaatgcttaaggagtttgctaaggctgccatccgcgctcagccacaggacctgatacagtggggcgccgactacttcgaggctttgtcacgcggcgagaccccacctgttcgagaacgtagcgagagagttgctttatgcaactgggcagagctcaccccagaactcctgaagatcctccacagccaggtcgcaggccgactaatcattcgcgctgaagagctagctcagatgtggaaggtggtgaatttacctacggacctctttaactcagtgatgaatgtaggacgcttcacagaggaaatagagtggctgaaatttctggcactggcttgtagtgccctaggcgtgacaattacaaagaccctgaaaatcgtttgtgaggttctgtcctgtgatcataatggggggctgcctagaatccccttcagcacttttcagttcttgtatacatacattgccgaagtagacggcgagatatgtgctagtcacgtaagtcggatgttgaactacatcgaacaagaggtaataggcccggacggccttatcacagttaacgactttacacagaacccacgggtgtggctggagtag

SEQ ID NO: 13854 - DNA, 1938 bp, Artificial Sequence
  Description of Artificial Sequence: Synthetic coding sequence
atggcctcactgttgcaggatcagctgacaacagatcaggacctgctcctgatgcaagagggtatgcccatgcgcaaggttaggtctaagtcgtggaagaagctgaggtactttcgccttcagaatgacggcatgactgtgtggcacgcccggcaggcccgcgggagcgccaaaccaagctttagcatctccgatgtcgagacaattagaaacgggcacgatagtgaactgctgcggagccttgcagaggagctgcccctggagcaagggtttaccattgtcttccacggacgacgcagcaacctggacttgatggcaaatagtgtcgaggaagcccagatctggatgcgcggactgcagctgctggtggacctggtgacctctatggaccatcaggagaggcttgatcagtggctgagcgattggttccagcgtggggataagaatcaggacgggaaaatgtcgtttcaagaagtgcagcggttattgcatctgatgaatgttgagatggaccaagagtatgctttctccctctttcaggctgccgatacaagtcagtctggaaccttagagggagaagagttcgttcagttttacaaggctttaactaagagagccgaagtgcaagagctgtttgagtccttttctgccgatggccaaaaactcacactgcttgaattcctggacttccttcaggaagagcagaaggaacgagattgcacctctgagcttgccttggagctaatcgatagatatgaaccttccgacagcgggaagctcaggcacgtgttgtccatggatgggttcctgtcatacctatgcagcaaggacggtgatattttcaaccccgcatgccttcctatttaccaggatatgacacagccactaaaccactatttcatctgcagcagccacaatacatatctagtcggggaccagctgtgcggacaatcctctgtcgagggttatattcgtgccctgaagcgtggctgtcgatgtgtggaggtcgacgtttgggacggtccctcgggagaaccagtggtctaccacggtcataccctcaccagcagaatcctattcaaagacgtggtcgcaacggtggcacaatatgccttccagacaagcgattaccctgtgatactatcattggaaacgcactgttcttgggagcagcaacaaacaatggctcggcacctcaccgagatactcggtgagcagctgttgtcaacaactcttgatggtgtcctgcccactcagctgccatcccccgaggagctgagacgaaaaattctggtcaagggaaaaaagttaaccttagaagaggatttagaatatgaggaggaggaagctgaacctgagctggaggagtctgaactcgccctggagtctcagttcgagaccgaaccagagccccaagagcagaatttacagaataaggacaaaaaaaaaaagtccaagcctattctctgccccgcgctgtcttctcttgtgatctatttaaaatcggtatcatttcgaagctttacccattctaaagaacactaccatttttatgagatctcttctttctccgagaccaaggcaaaacggctcattaaagaggccgggaacgaatttgtccagcacaacacctggcagctgtctcgggtttaccctagcggactccggaccgactcgagtaattacaatccccaggaactctggaacgccggatgtcagatggtagccatgaatatgcagactgcagggcttgaaatggacatttgcgacggccattttagacaaaacggcgggtgcggatatgtcctcaagcccgattttcttagagacattcagagctcgtttcacccagagaagcccatttctcccttcaaggctcaaactttgtctattccataccggcacctccaacttatcttccctatcaatagcgtgtag

SEQ ID NO: 13855 - DNA, 7554 bp, Artificial Sequence
  Description of Artificial Sequence: Synthetic coding sequence
atggtgggggagaggcacgccggggacctcatggtgccgctgggacctcgactacaggcttatccagaagagctcatacgccaaagacctgggcatgatggacatccagagtatctgatcaggtggtccgtgctcaagtgcggtgaggtgggaaaagtgggagtggaagagggcaaggccgaacacatactgatgtggctatcagctcctgaagtgtatgccaattgtccagggctcctgggcgagcgcgccttgagcaaaggtctgcagcatgaaccagccggcgtatccggaagtttcccccgggaccccggtggcttagatgaagtcgcaatgggtgagatggaagccgacgtgcaggcgctggtccgcagggccgcccgccagctggccgaaagtggaactccaagccttacggccgccgtgttgcacaccatccatgtcctgagcgcctacgctagcatcggacccctgaccggggtgttccgcgagaccggcgccctggacctgctgatgcacatgctgtgcaaccctgagccgcagatccgccgttcagccgggaaaatgctgcaggccctggctgcccacgacgcagggagccgtgcacacgttcttctgtccctgagccagcaggacggcatcgaacagcacatggactttgattccaggtatacactgttggaactcttcgccgagacaacatcctccgaagagcactgtatggctttcgagggcattcatctgccccagattcccgggaaacttttgttcagcctagtcaagcgttatctttgcgtgacgagtctgttggaccaattgaacagttcccctgagctgggcgccggggaccaatcttcaccttgtgctacccgcgagaaaagccggggccagcgggaattggaattctcgatggcagtagggaatctcatatccgagctggtgcgttccatgggatgggctagaaacctctccgaacagggcatgtccccacctagacccacccgaagtatattccagccatacatctccggcccgagtctgctgcttccaaccatagttacaacccctaggagacagggatgggtgttcagacagcgcagtgaatttagcagccgatctggatatggggaatacgtgcagcagaccttgcagcctgggatgcgtgtgcgcatgcttgacgattatgaggagatttctgctggcgatgagggggaattccgtcagtccaataacgggatacctccggttcaggtcttttggcaaagcacaggcagaacgtattgggtccactggcatatgcttgaaatcttgggcccggaggaggccacggaggacaaggccagcgccgccgtcgaaaagggggccggagctacagttcttggtaccgcattcccttcttgggactggaaccctatggacggcctatacccccttccctacttgcagcccgaaccccagaaaaatgagagggtggggtacttgacgcaggccgagtggtgggaattgctgttttttatcaagaagttagacctgtgtgaacaacagcccatttttcagaatctctggaaaaacctagatgagaccctcggtgagaaggcccttggggaaatctctgtgagcgtggagatggcagagtcccttctgcaggtcctttcctctagatttgaaggatccactctgaacgatctgctgaactcacagatatataccaagtacgggctcctgtctaacgagccctcatcaagctccaccagtagaaatcactcatgtacacccgaccctgaagaggaatccaaatccgaagcctccttctctgaggaggaaacagagagccttaaagccaaggccgaagcaccaaagacagaggccgagcctacaaaaactagaaccgaaacacctatggcccagagcgactcacaattgtttaaccagttgctcgttactgagggaatgacgctgccaaccgaaatgaaagaggcggcgtccgagatggctagggccctgaggggacctggtccccgatcgtcgctggatcagcacgttgccgccgtggtggccaccgtccagatttcgagcctcgacaccaacttgcagttgagtggcctctctgccctgtcccaagctgtcgaggaggtgacagaacgggatcatccgctggttcggccggatagatctctcagagagaaactcgtcaagatgcttgtggaactgttaactaatcaggtaggagaaaaaatggtcgtcgtgcaagctctgcgtctcctctacctgctcatgacaaaacatgagtggcgcccgctctttgcacgtgaaggcggaatttacgccgtgctggtatgtatgcaggagtacaagacctctgtgctggtgcagcaagctggactagccgcattaaagatgctcgccgtagcctcatcctcggaaatacctactttcgtgactggtagggacagtatccacagcctgttcgatgcacagatgacacgggagatcttcgcaagcatcgattccgctacccggcccggctctgagtctctcttacttaccgtgcctgcggccgtgatccttatgcttaataccgagggttgttcctctgccgcccgaaatgggcttctactattaaacctgcttctgtgcaaccaccatacactaggcgaccaaattataacgcaggaactccgggatactctttttaggcactcaggcattgctccaaggacagaacccatgcccacgactcgtacaatcttgatgatgctgctgaaccgttatagcgaaccccctgggtcgccagaacgagccgccctggaaacccctataattcagggacaggatggctcaccagaattactgatccgctcattagttgggggacccagcgcagaactcctgcttgatttagagcgtgtcctgtgcagagaaggtagtccgggcggtgccgtccgcccccttttgaagcggcttcaacaggagacccagcccttcctgctgctgctgcggacactggacgctccaggccccaacaagaccctgttgctttcagtcctgcgggtcatcacccgcctattagattttcctgaggcgatggtgttgccgtggcacgaagtgttggagccatgcctgaactgcctgagcgggccaagctctgattcagagatcgtccaagagctgacttgttttctgcaccgcctggctagcatgcacaaggattacgctgtggtcctatgctgcctcggggccaaagagattctgtccaaagttcttgataaacactctgcacagcttttactcgggtgtgagctgcgtgatttggtcaccgagtgtgaaaagtatgctcagctctactccaacctaacatctagcatcctcgctgggtgcattcagatggtgctgggccagattgaggaccatcgtcgtactcaccagccaatcaatattccctttttcgacgtttttctccggcacctttgccagggcagctctgtggaagttaaggaggataagtgctgggaaaaggtggaggtgtcctccaacccccatcgagcaagcaagctaactgaccataatccgaagacatactgggagtctaacgggagcaccggatcacactatattacccttcacatgcacaggggcgtgctggtgcgccagctgacacttctggtggcttcagaagattcgtcttacatgcccgctcgggtggttgtctttggcggggactcaacaagttgcatcggtactgagctgaataccgtgaacgtgatgccaagtgctagtcgggttatacttctggagaatctcaatagattttggcctattatccaaattcggatcaaaagatgtcagcagggcggcatcgacactcgtgtgcgcggcgtggaggttctcggcccgaagcctaccttttggccgctatttcgggagcagctatgtcgtaggacatgtctcttttatactatccgcgcacaggcatggagccgagacatcgcagaggatcatcgtagactgcttcagctctgtccgcggcttaatcgcgtgctgcgacacgagcagaattttgctgaccgctttctgccagatgatgaggccgctcaggccctgggcaaaacgtgctgggaggcactggtttctcccctcgtgcagaatataacctcgcccgacgcagagggagtgagtgccttggggtggttgctcgaccagtacctggagcaacgggagaccagtcgtaatcccttaagcagagccgcttcttttgcatcacgcgtgcgaaggttgtgtcatctgctggttcacgttgagccaccacctggccctagtcctgaacccagtacacgtccgtttagtaagaattcaaagggccgcgaccgaagcccggcaccgtcaccagtgttgccctccagctccctccggaacatcacgcagtgttggctgagtgtagtgcaagaacaggtcagtcgatttttggcagcggcatggagagcccccgactttgtacctaggtattgcaagttgtacgagcacctgcaaagagccggctccgagctcttcggcccccgcgccgcctttatgctcgcgctgcggagtgggttctccggagctctgctgcagcagtccttcctgactgctgcgcacatgagtgagcagttcgcccgttacatcgaccagcaaatacagggtggactgatcggcggtgccccaggagtagagatgctgggacagttgcagcgccacctggaacccatcatggtgttatcaggactggaattggcaacgacatttgagcatttctaccaacactatatggcagacagactgttgtcttttggctcttcatggctagaaggggccgtgctggaacagatagggctgtgctttccaaacagacttccgcaactaatgttacagtcattatctacttctgaagagctccaaagacagtttcatttgttccagctgcagagactggataagctatttttggagcaggaggatgaggaagaaaaaaggctcgaggaagaagaagaggaagaggaggaggaggaagcagagaaggaattgtttatcgaggacccaagccccgcaattagtatactggtgctgagccccaggtgctggccagtgagccctctttgctacctgtatcaccccaggaagtgcctgccaaccgagttctgcgatgccctggacagatttagttctttttactcccaatcacaaaaccacccagtgctcgatatgggtccccatagacgcctgcagtggacttggctcggcagagcagagctccagttcggcaaacagattctgcacgtatctacagtgcaaatgtggctgctgctcaagttcaaccaaaccgaggaagttagcgtggagacactcttaaaggactccgatctgagtccagaattgctgcttcaggccctcgtgcctctcacgagcggcaatggcccgttgacgctgcacgagggtcaggacttcccgcacggcggagtcctccgattacacgagcctggcccacaaagaagcggcgaggctctctggctgatacccccacaggcttacctgaacgtggaaaaggatgaaggtcgcactctcgagcagaagcgaaacttactgtcatgcttactggtacgcatcttgaaggcacatggcgaaaagggcttgcacattgaccagcttgtgtgtttggtgctggaggcctggcagaagggccccaaccctcccggcactctgggacataccgtcgcagggggagttgcgtgcaccagcaccgacgttctgtcttgcattcttcatctgttaggtcagggatacgtgaagaggagagacgataggccacagatcctgatgtacgctgcgccagagcctatgggaccctgtaggggacaggcagatgtgccattctgtgggagccaatcagagacatctaagccctctcctgaggcagtggctaccctcgcttcactccagctgccggcggggcgcacaatgtctcctcaggaagtcgagggtcttatgaagcagacagtgcgacaggttcaggagacactgaacctggagccggacgtggcccaacatctgcttgcacatagccactggggcgctgagcagctcctgcagagctatagtgaggatcctgaaccgctgctcttagcagcaggtctgtgcgttcatcaggctcaggctgtgcctgtgagacccgaccattgccccgtgtgtgtgagccccctggggtgtgatgatgacctacctagtctctgctgcatgcactactgctgtaaatcctgttggaatgagtatctcacaacacgtatagaacagaacctggtactcaactgtacatgtcccatcgctgactgtcccgcccagcccacaggagcatttataagagcgatagtaagttcaccagaagttatcagtaagtatgaaaaagctttgctccgaggctatgtcgaatcctgttccaaccttacatggtgcacaaacccacagggctgtgataggatcctttgccgccaaggcctggggtgcggcaccacatgttcaaagtgcgggtgggcatcctgctttaattgtagtttccctgaggctcattatccggcatcctgtggtcacatgagccagtgggtggacgatggagggtattatgatggcatgagtgtggaagcacaatccaaacacttagccaaattgatttccaaaaggtgtccgagttgccaggccccgatcgaaaaaaatgaaggatgcctccacatgacatgcgccaagtgtaaccacggtttctgttggaggtgtctgaaatcctggaaacccaatcacaaagattactacaattgtagtgcaatggttagcaaagcggccagacaggaaaaaagatttcaggactataatgagaggtgtaccttccaccatcaggctagagaatttgcagtgaatctccggaatcgagtgtccgcaatacacgaggtcccgcctcccagatctttcaccttcttgaatgacgcgtgccagggactcgagcaggcgaggaaagtattggcctatgcatgcgtttacagcttctattcacaggatgccgaatacatggacgtggtggagcagcagaccgagaacttggagcttcacactaatgcactgcaaattctgcttgaagagaccctcctccgttgtcgcgatctagcttctagtcttcgcctccttcgtgctgactgtctgtcaacgggaatggaacttctgagacgtattcaagagaggctgcttgccatcctgcagcactcggctcaggacttccgggtgggtttacagagccccagcgtagaggcttgggaggcaaaaggccccaatatgcccgggagccagcctcaggcctcctcaggtccagaagcggaagaggaagaggaggatgatgaagatgacgtgcctgagtggcagcaggacgagttcgatgaagagttggacaatgattctttttcctacgacgagagcgagaatttagatcaagagacatttttttttggcgacgaggaagaggatgaagacgaggcctatgactag

SEQ ID NO: 13856 - DNA, 1476 bp, Artificial Sequence
  Description of Artificial Sequence: Synthetic coding sequence
atggaagaaattccggcccaggaggctgccggatcccctagggtccagttccagagcctcgaaacccagtctgagtgtctgtcaccggagcctcagttcgttcaagacaccgatatggagcaaggcctcactggtgatggggagactagagaggaaaataaactgcttatcccaaaacaaaaaatttccgaggaagtccacagctataaggtgagagtgggacggctgaaacatgatatcacacaggtcccggaaacccgcgaagtctacaagtccgaggatcgtttggagagactccaggagatcttgcgcaagttcctctatctggagcgggagttcaggcagatcaccattagtaaggaaacgtttacatcggaaaaaaataacgagtgccacgaacctgagaaatcattcagccttgactcaacgattgacgccgaccaacgcgtgttaagaatccagaatacggatgataacgataaatacgacatgagcttcaaccaaaacagcgccagcggaaaacatgagcacttgaacttgaccgaagactttcagagcagtgaatgtaaggaatccctgatggatctgtcccacctgaataagtgggaatcgatccccaacacagagaaatcctataagtgcgacgtgtgcgggaaaatcttccaccagagctctgccttaactcggcaccagcgaattcatacccgggagaagccgtataagtgcaaggagtgtgaaaagtctttttcccagagctccagtctgtcacggcataagcgaattcatacccgcgagaagccatacaagtgcgaagcatcagataagtcctgcgaagcttctgacaaaagctgtagtccttctagtgggatcatccagcataagaaaatccatacccgcgctaaatcctacaaatgtagttcatgcgagagggtgttttcgagatcagtgcacctcactcagcaccagaaaattcataaagaaatgccctgtaagtgtacagtgtgtggaagtgacttttgtcacacctcttacctcctggagcatcagagagtccatcacgaggaaaaggcctatgagtacgatgagtacggcttagcatacataaaacagcagggcattcatttccgcgaaaaaccatacacctgttccgaatgcggtaaagatttccgtctgaattcccatctaattcaacaccagagaatccataccggggaaaaggcccacgagtgcaatgaatgtggtaaggctttttcccagacctcgtgcttaatccagcaccacaagatgcacaggaaagaaaaaagttacgagtgcaatgaatacgagggttctttctcccacagtagcgacctcatcctgcagcaggaggtgctcacgagacagaaggcattcgactgtgatgtgtgggagaagaatagcagtcagagggctcacttagtgcaacaccaaagcattcatacaaaagagaattcttag

SEQ ID NO: 13857 - DNA, 2709 bp, Artificial Sequence
  Description of Artificial Sequence: Synthetic coding sequence
atgtctgaattccggatccaccacgacgtgaatgaactgttaagtctactgcgcgtgcacggaggggatggggcggaggtgtacatcgatctcctccagaaaaaccgcaccccgtatgtcactaccaccgtgtctgctcattcagcgaaagtgaaaattgccgaatttagtcgcacacccgaggacttccttaagaaatacgatgagctgaagagtaaaaatactagaaacctggatcccctggtgtatctgctgagcaaattaactgaggacaaagagacccttcagtacctgcaacagaatgcaaaggagcgggctgaactagcggccgccgccgtgggctcgtctacaacctctattaatgtcccggcagcagcaagcaagataagcatgcaggaactcgaggagctgagaaaacaactgggatctgtggcaaccggcagcactctgcagcagtctctcgagctgaagcgaaagatgctccgagacaaacagaataagaaaaacagcgggcagcatttgcctatatttccggcgtgggtgtatgagagacctgctcttataggagacttcctcattggcgccgggatcagcacggacacggcactacctatcggtaccctcccgctggcgtcccaggagtccgccgtggttgaagacttgctgtatgtgcttgttggcgtcgacggcaggtatgtttccgcccagccactggctggacgacaatcccggaccttcttagtagacccaaaccttgatctgtccatccgggaactggtgcatagaatcctgccagtcgctgcctcgtatagcgcagtgacaagatttatagaggaaaagagcagcttcgagtacgggcaagtgaatcacgccctggctgcagctatgcgcactctagtgaaggaacaccttatcttagtgtcccaactggaacagctgcacagacaaggactgctaagccttcagaaactttggttctacatacagcccgccatgaggacgatggacattttggcatccctagccacaagtgtcgacaaaggcgagtgcctaggcggcagcacgcttagcctgctgcatgataggtcattcagttacacaggagactctcaggctcaagaactgtgcctttatctcaccaaggcggcgagtgcaccgtactttgaagtgctggagaagtggatctatagagggatcattcacgatccttattcagagtttatggtcgaggagcatgagctccgaaaagagcgaatccaggaggattacaacgataagtactgggatcagcgatacacgattgtccagcagcaaatcccttccttcctgcagaaaatggccgacaagattctctcaaccgggaaatacctgaacgtggtgagagagtgcggccatgacgtgacttgcccggttgccaaggaaatcatttacacattgaaggagagggcctatgtggagcagatcgaaaaggccttcaattacgcttcaaaggtattgctcgattttctgatggaagaaaaagagcttgtagctcatctccgctctattaaaagatacttcctcatggaccaaggggactttttcgttcacttcatggatctggccgaagaagaactgaggaagccagtggaagacataacaccccctcgcttggaggccctcctggagttagctctgaggatgtccacagccaataccgatccctttaaagacgacctgaaaatcgatctgatgccacacgatcttatcacccagctcttaagggtgctggccatcgaaaccaagcaagaaaaggctatggcccacgcagaccccacagaattagcactttcaggactggaggcattttctttcgactatattgtaaagtggccgctctcgcttatcatcaatcgcaaggcactgaccaggtaccaaatgctcttccgacatatgttttactgcaaacacgttgagcgacaactttgtagcgtctggataagcaataaaactgccaagcagcattccctgcacagcgcccaatggtttgcgggcgctttcacattgcggcagcggatgctgaactttgtgcagaatatacagtactatatgatgtttgaagtgatggagcctacctggcatatcctggaaaagaatctgaagagtgcatcaaacatcgatgacgtactggggcatcacactggcttcttggacacctgtttgaaagactgtatgctcacaaacccagagctgttgaaggttttttccaaattgatgagcgtgtgcgtgatgtttaccaactgcatgcagaaatttacgcagagtatgaagctggacggggagctaggcggccagactctggaacacagtacagtgctgggcttgcccgctggagccgaagagcgtgctcggaaagagttggcacggaagcatttggctgagcacgccgatacggtgcagctcgtgtcgggctttgaggccacaatcaataaatttgacaaaaactttagtgctcacctactggatctgctagcacggctgagtatatactcaacgtcagactgcgaacatggtatggcctccgtgatctccaggttggatttcaatggcttctacaccgagcgcttagaaaggctgagtgcagagagatctcagaaagccacacctcaagttcccgtgctcagagggccccctgcaccggcgccaagagtcgccgtgactgcgcagtag

SEQ ID NO: 13858 - DNA, 2289 bp, Artificial Sequence
  Description of Artificial Sequence: Synthetic coding sequence
atggcaatgcaggagaagtaccctacggaagggatcagccacgtgacatcccccagttcagacgtgatccagaagggtagctctctgggaaccgaatggcaaacacctgtgatttctgagcccttcagaagccgtttctcccgctgcagctccgtggcagactccggcgataccgccatcggcacgtcatgttctgacatagccgaggatttctgcagcagcagcggatcaccaccttttcagcccattaagagtcacgtcactattccgactgcccatgtcatgccaagcaccttggggaccagccctgccaaacctaactcaacaccggtcggcccatcgtccagtaagctgcccctctccggccttgccgaaagtgtcgggatgacacgtaacggggacctgggtgccatgaagcactctcctggactatcgcgcgacctgatgtatttcagcggagctaccggagagaatggtattgagcagtcctggttccccgcagttggacacgaacggcaagaagaggcacgcaaattcgatattcccagcatggaaagtaccctcaaccagagcgccatgatggagactctgtactccgatccacatcaccgagtcagattccacaatccacgcacaagtacaagtaaggagttatatcgggtgcttcctgaagccaagaaagcaccggggtccggcgccgtgtttgagagaaacggcccacactctaattcatctggggtactgcccctggggctgcaaccagctccaggactcagcaaaccccttccatctcaagtgtggcaaccatcccccgatacctggcatccacgcgaacagtcctgtgaattaagtacctgtcgacagcagctcgagttaatccggttgcagatggagcagatgcaattgcagaatggagctatctgccaccacccagctgctttcggcccctccctgccaatcttggagccggcacaatggatctctattcttaattccaatgaacatctgttgaaggaaaaagagctgcttatagacaaacagagaaagcatatttctcagctagaacagaaagttcgtgagagtgagttacaggtccatagtgctctgctgggccgaccagccccgtttggagatgtttgtctgctgcggttacaggagcttcaacgtgagaacacgtttctaagggctcaattcgctcagaaaaccgaagcactgtccagagaaaagatagacctggagaagaagctatcagcgagcgaagtggaagtgcagctcattagggagagtttaaaagtggcacttcagaaacatagcgaggaggtgaagaaacaggaggagagggtgaaaggacgcgataaacatataaacaaccttaaaaaaaaatgtcagaaagaatccgaacagaatcgagagaagcaacagcgaatcgaaactcttgagcgctacctggcggacttgcccaccctcgaagaccatcaaaagcagtcacaacaactaaaggattcagagctgaagagtaccgagctgcaggaaaaggtcaccgagcttgagagcctgctggaggagacccaggccatttgtagggagaaggaaatacagctggagagtcttaggcagagagaagctgagttctcctctgctggccattcgttgcaggataaacagtccgtggaggaaaccagtggggagggcccagaggttgagatggagagttggcagaaaaggtacgacagtctgcagaagatcgtggagaagcagcagcagaagatggaccaattaagatcccaggttcaaagcttggagcaagaggtcgctcaggaggaaggaacttcacaggccctccgggaagaagctcaacgaagagacagtgcgctgcagcagctccggacagcagtaaaagaattgtccgtccagaatcaggatcttatcgagaaaaacctcaccttgcaggagcacctccggcaggctcaaccgggctctccacccagcccggacaccgctcagctggccctggagctccaccaagaactcgccagctgcttacaggacctccaggccgtgtgtagcattgttacacagcgggcccagggccatgacccaaatctttctttgctactgggtatccactccgcccaacatcccgaaacccaacttgatttgcagaaacctgacgttatcaaacgaaagctcgaagaggtccaacagttgcgaagagatattgaagatctgcgaaccaccatgtctgacaggtatgcccaggacatgggagagaattgtgtcactcaatag

SEQ ID NO: 13859 - DNA, 1443 bp, Artificial Sequence
  Description of Artificial Sequence: Synthetic coding sequence
atgattgtcgcggactccgaatgtcgcgccgaactgaaggactacttgcggtttgcccccggcggggtaggtgattccggaccaggggaggagcaacgggagtccagagcccggagaggcccccggggaccctcagccttcattcctgttgaagaggttcttagggagggagctgagtcactcgagcagcacctggggctggaagcgttgatgtcctcgggtagggtcgacaacctcgccgtcgtgatgggcctgcaccccgactatttcacttcattttggcgccttcactacctattgttgcatacggatggcccactcgcttcctcgtggagacactacattgcaatcatggccgctgcacggcatcagtgcagttatctggtgggatcacacatggccgagtttttgcagaccgggggcgatcccgaatggctcttggggctgcatagggcccccgagaaacttagaaaactgagtgaaatcaacaaactgctagcacatcgaccttggttgattaccaaggaacacatccaggccttattgaagactggagagcacacatggtcactggccgagctgattcaggcattagtcttgttgacacattgtcactcattgtcttctttcgtgtttggctgtggcattctgcctgaaggagacgctgacgggagtcccgcaccacaagctcctacgcctccatctgaacagtccagccctcccagtcgcgacccactgaacaattccggaggattcgaatctgctcgcgacgtcgaggccctgatggagcgcatgcagcaattgcaggaatccctgctccgggatgagggcacctctcaagaggaaatggaatcgcgctttgaacttgagaagagtgagtctttattggtcacaccgtccgcagacatattggagccctctccccaccccgatatgctgtgcttcgtggaggaccccacttttggctatgaagactttacacgtagaggtgcgcaggccccacctacgttccgggctcaggactatacctgggaggaccacgggtattccctgattcagagattgtaccccgagggcgggcaactgctggacgagaaattccaggctgcctattccctgacctacaacacaatcgcaatgcatagtggagtggatactagcgtgcttagacgcgccatctggaactatattcattgtgttttcggaattcgctacgatgactacgactatggggaggtgaatcagttgctcgagagaaaccttaaagtgtacattaaaaccgtcgcatgttaccccgaaaagactacacggcggatgtataacttgttctggcggcatttcaggcacagtgaaaaagtgcacgtcaatctgctgttactcgaagcaagaatgcaggcagccctcctttatgcgctaagagcgattactaggtacatgacttag

SEQ ID NO: 13860 - DNA, 633 bp, Artificial Sequence
  Description of Artificial Sequence: Synthetic coding sequence
atgccaggagtgaaactcacgacacaggcctactgtaagatggtcctccatggggctaaatatccgcattgcgccgtcaatgggctactcgttgccgagaaacagaagccccgcaaggagcacctgcccctggggggcccaggcgcccaccacaccctcttcgtggactgtatccccctgttccacggtaccctcgccctggcccctatgttggaggtagctctgaccctcattgacagttggtgcaaggatcactcttatgtgattgctggatattatcaagcgaatgagcgcgtcaaagatgcatcaccaaatcaggtcgccgaaaaggtcgcttcaagaatcgccgagggcttttctgatacggcattgataatggtggacaacacaaagttcacgatggactgtgtggcgcctactatccacgtctacgagcatcacgagaaccggtggcggtgtcgcgatccgcaccatgattattgtgaggactggcctgaggcccaacggatttccgccagcctgttggactcaaggtcctacgagaccctcgtggattttgataatcacctggacgatatacgtaatgactggacaaaccctgaaataaataaagcagtcctgcatctttgttag

SEQ ID NO: 13861 - DNA, 1059 bp, Artificial Sequence
  Description of Artificial Sequence: Synthetic coding sequence
atgaccgaggccgggaagctgccactccccttaccccctaggttagactggtttgtacatacacagatgggacagttggcccaggacggagtccctgagtggttccatggagccatcagccgtgaagatgccgagaacctgttggagagtcagccactgggctcgtttctgattcgtgtctctcacagccacgtggggtatacactctcttataaggcccaaagttcatgctgccactttatggttaagttgttggacgacggcaccttcatgattcccggggaaaaggtggcccatacatcgctggacgccctggtgacatttcatcagcagaagcccatagagcctagacgggagttactcacccagccatgccgccagaaggatccagccaacgtggattacgaggacctgtttctctactcaaatgctgtcgccgaggaggccgcatgtcccgtgagcgctcctgaggaggcaagtcctaagcccgtgctgtgccatcaaagtaaagagaggaagcccagcgccgagatgaaccgtattacaactaaggaggcgacaagctcgtgtccgcccaaaagtcctcttggagaaacccgccagaagctctggcgatcattgaaaatgttaccagagaggggccagcgtgtacgccagcagcttaagtcccacttggctactgtgaacttgagttccctattggatgtcagacggagcacagtcatctcgggaccaggaaccggtaagggctcccaggatcatagtggcgatccaacctctggggacaggggatatacagatccctgtgtagcgacctccttgaagtccccttcacagccacaggcaccgaaagatcgcaaggtgccgacccggaaagccgagaggtccgtgtcctgtatagaggtgacccctggtgaccgtagctggcatcagatggtagtcagagccctctcgtcacaggaatctaagcctgaacaccagggacttgccgaacctgagaatgaccagctccccgaagagtaccagcaacctcccccattcgcccctggatattgctag

SEQ ID NO: 13862 - DNA, 480 bp, Artificial Sequence
  Description of Artificial Sequence: Synthetic coding sequence
atgacacactgttgcagcccctgttgccaaccaacctgctgccgcactacgtgctggaagcccaccaccgttactacttgcagctcaacaccgtgctgtcagccaagttgttgtgtgagctcctgttgtcaaccgtgctgtaggcctacctgttgtcagaatacctgttgccagcccatttgtgtgacctcctgttgccaaccctcctgttgtagtactccctgctgtcagccaacctgttgcgggcaaactagctgcgggtcaagctgcggacaaagttccagttgcgctcctgtctactgtagacgtacctgttaccacccgactactgtatgcctgcctggttgcttgaaccagtcctgtggtagcaattgttgccagccatgctgtcgtccagcctgctgcgaaactacttgttgccggaccacttgttttcagcctacatgcgtctcctcttgctgtcagccatcttgctgctag

SEQ ID NO: 13863 - DNA, 615 bp, Artificial Sequence
  Description of Artificial Sequence: Synthetic coding sequence
atggaccccaaagacagaaagaagatccagttcagtgttcctgccccacctagtcaactagatccacgacaggtggaaatgatccgccgacggcgccccacgcctgcaatgctctttcgactcagtgagcattcatcgcccgaagaagaggcctccccacatcaacgtgcatctggggagggccatcatctgaaatccaaacgtcccaacccatgtgcctacaccccaccgagcttgaaggccgtccaaaggatcgccgaatcacatttacagtccatctcaaacctgaacgagaaccaggcttctgaggaagaagatgaactgggggagctgcgggaactgggctaccccagggaggaagatgaggaggaggaagaagatgatgaggaggaggaggaggaagaagatagtcaggctgaggtactcaaagtgatacgtcaatcagccggacagaagacaacctgtggacagggattggaaggaccttgggaaaggcctcctccgctcgacgaaagtgagcgtgacggggggtctgaggatcaggtcgaggacccggctttatcagagccaggggaggagccacagcggccctccccttcagagcctggaacctag

SEQ ID NO: 13864 - DNA, 2061 bp, Artificial Sequence
  Description of Artificial Sequence: Synthetic coding sequence
atgaccgatgccctcctccctgccgccccccagcccctggagaaggaaaatgatgggtattttcggaaaggatgcaaccccctggcccagaccgggcggagtaaactccagaaccagagagccgcacttaaccagcagatccttaaggcagttcgcatgcgcactggagctgagaatctcctgaaggttgccacaaatagcaaggtgcgggagcaggtgcgattagagttatcctttgtaaactccgatctacagatgttgaaggaggagttggaggggttaaatattagtgtgggtgtataccagaatacagaggaggcttttacgattccattgattccactgggattaaaggagaccaaggatgtcgattttgctgtggtcctcaaggattttattctggaacactacagtgaagatggctatttatatgaagatgagatcgcagatctgatggatctaaggcaggcctgtcggacgccatctcgcgatgaggctggcgtggagctgttgatgacatatttcattcaactcggctttgttgagtccagatttttccctcctacgagacagatggggctactcttcacatggtatgactcccttaccggtgtgcctgtgagccaacagaatctgctgctggagaaggcatcagttcttttcaacactggggcactgtacacgcaaattggcaccaggtgtgaccgccagacacaggcaggcctagagtcagccattgatgcatttcagcgggctgctggcgtcctgaactacctgaaggataccttcacacacactccttcttacgatatgagcccggccatgcttagtgtgctggtcaaaatgatgcttgcccaggctcaggaatccgtcttcgagaagatctccttacctggaatccgcaacgagttcttcatgttggtgaaagtcgcccaggaggccgctaaggtcggtgaggtgtaccagcagctccatgccgcaatgtcccaggcacccgtcaaggaaaatatcccctatagctgggcgtcactcgcctgcgtcaaagctcaccactacgcagcgcttgcgcattacttcactgcaattctgctgatagaccaccaagttaaacccggcactgatttggatcaccaggaaaaatgccttagccagctctacgatcacatgccagagggactgactccgttggccacactgaagaacgaccagcagagaaggcagctcggcaagtcacatttgcgaagagctatggcacaccacgaagagtctgtgcgagaagcctcactctgtaagaagcttagatctatcgaggtccttcagaaagtgctgtgcgcagcacaagagcggtcaaggctcacatatgctcagcatcaggaggaggacgacctgcttaatctcattgacgcgccatcagtggttgcaaagacagaacaagaagttgatattatactcccccaattcagcaagttgaccgttacggacttttttcagaagctcggacctctgtcggtgtttagcgccaacaagaggtggacaccacctcgcagcatcagattcacggcagaagaaggggacttgggctttactctgcgaggaaatgctcccgtccaggttcactttctggatccctattgtagcgcctctgtcgccggtgccagagaaggagattacattgtgagcatccagctggtggactgtaaatggttaacactttccgaagtcatgaagctgctgaagtcttttggggaggacgaaatcgagatgaaagtcgtgagtctgttggatagtaccagcagcatgcataacaaaagtgccacatactccgttggtatgcagaagacctacagcatgatctgccttgctattgatgacgacgacaagacagacaaaactaaaaagattagcaagaaactaagcttcctcagttggggcacaaacaagaaccggcagaagagtgcaagtacactatgtctcccctctgtgggggccgctaggccacaggtgaagaagaagctgccttcgccattttccttactgaattctgattcaagctggtattag

SEQ ID NO: 13865 - DNA, 1254 bp, Artificial Sequence
  Description of Artificial Sequence: Synthetic coding sequence
atgcccctgtatgagggccttggctccggaggggagaagaccgctgtggtgatcgacctgggcgaagctttcaccaaatgtggcttcgcgggagagactggccctcgttgcataatacccagcgtgatcaagcgtgctggcatgcccaaacccgtgcgtgtggtccagtataacatcaacacggaggagttgtattcctatctaaaggagtttatccacatcctgtatttccggcaccttctggtaaatcctagggacaggcgcgtcgtgattatcgagtccgtgctgtgtcccagccattttcgagagacgcttacacgggtgctgttcaagtactttgaggtgccctcagtactgctcgcgccatcacacctgatggcgcttttaacactcgggatcaactccgcaatggtgctggattgcggatatagggagagtctggtgttgccaatttatgaagggattcctgtgctgaattgctggggtgccctgcctctgggcggtaaagccctacacaaagaactggaaactcaactactggagcagtgtactgtcgatacttctgtggcgaaagagcagagtttgcccagtgtcatggggagcgtgccagaaggggttctagaggatatcaaggctagaacctgtttcgtcagtgatctaaagcgcggcctgaaaatccaggcagctaaatttaatatagacgggaataacgaacgaccgtccccccctccaaacgtggattatcccctggacggagaaaagattctgcacatcctgggaagcatccgggattccgtcgttgagatactgttcgaacaggataatgaagaacaatctgtggccactctcatcctggattcacttatccaatgccccatagacacgcgcaaacaacttgccgaaaacctggttgtgatcggaggtacctctatgctgcctggttttctccacaggttgctggctgaaatacgatacctggtggagaagccaaagtacaagaaagccttagggacgaagactttccggattcacactccccccgctaaagctaattgtgtggcatggcttgggggagccatcttcggcgcgctccaggacatactggggagtaggtccgtaagcaaagaatactacaaccaaacaggccggatccccgattggtgtagccttaacaacccacctctggagatgatgtttgacgtggggaagacgcagccccctttgatgaaacgagcctttagcaccgagaagtag

SEQ ID NO: 13866 - DNA, 2643 bp, Artificial Sequence
  Description of Artificial Sequence: Synthetic coding sequence
atgtctcaacctgcagggggtcggcgcaagccaagaacactcgggccacctgtgtgctcgattagaccctttaagagctcagagcagtatctcgaggcgatgaaggaagacctcgccgaatggctaagagatctgtacggacttgatatagacgccgcaaactttctgcaggtcttggagacaggattggtgctctgtcaacacgccaatgtggttactgacgcggccttggcatttctcgcggaagcaccggctcaagctcaaaagatcccgatgcctagggtgggagtgagctgcaatggtgccgcccagcctggcacctttcaggcccgcgataacgtcagcaatttcattcagtggtgccggaaggaaatgggaatccaggaagtcttaatgtttgaaaccgaagacctcgttttgcgcaaaaacgtgaaaaatgtggtcctgtgcctgttggaactaggccgtcgggcctggcggttcggcgtagctgctccaactctggtgcagctagaggaagagattgaagaggaagtccgaagagagctggcattgccaccccctgaccccagccccccagccccgcccaggagacagccctgccattttcggaacctcgaccagatggtccaatcactggtgtctcattgcacctgccctgtgcagttctcaatggttaaagtctccgaggggaagtatagggtgggggatagtaacactttgatctttatccgtatcctgaggaatcacgtgatggtgagagtagggggaggctgggatacactaggacattacttagataaacatgacccttgtaggtgtacctccctcagccacaagccaggatctttcctgaagcccccagcgcccccagtgcagcatgaagtaagggtgcaagacggtccgtctcagacccaaccaacaatgacaattagtcgcagtcaaagccccccaccacctgtcgactggaagacctatacctcttcagaccgacgcctgagaccacccactccttcgtcccccagacctagaagggagcggggggccggtactggcgcctccagggagatggcaccctttttgcgctgtcaggagcgaagcctaatcccaagttggaggcagcccacagccggagacagccctccttctcctcaatcaagcagtactcaaaaggggagagaccctcagtgcacctcctctggcaagagggaggaacgctacccacctgagctgccgagagggcgcatccccaccagttgggtgcatgaagaaaccgattcctggggtacagatgctgggaatcccacaccccagcgcctgcgagcaattgaggcaaccacaaagggcatttctgcacgggggccaagtccactccctaggtcctttggaccagcggagtgtcttggcttgcgcttgcccttacgcgacgaagccaaaggcgctttttttcaatttagagagccggagagcgtcaggagcccaacccctgtgcagggcctgactaagatacccataaggctaccccctgcaaggccaccaacccctggaaggagtttccctggcgcaacctctggcagcccaaggacagagcttggacgtgatcctatcccacttcgcgctgttactgtcgatctggcaggcagcacccatggcgactgttctgttgaggtgcggcaagaggatcagcagcttgacatacaggtcatggccgaagcacgggagagttgggacctcggcttgcaggagcaggagggcaggtatacccctctacccctcggaggaaacaaagagcaagctatctactgtagcctggaggaggaaatcctggggaacatgaagcttcttgaggttcggagcgcatgtcctcagggcacacgatcaggggtaatcccccgttctggtgtgtatattccccgtcttgcaggccagtggcctgagccaggcggaccatatgataaagcaatccaggaactggcacagggctctccatcccttctcaaagttgacctggaggcctggaaggctgctcctaccggctcccctaagcccgccgtgacgcccggacccggatccctgaaaggaaaattgggcgcaaggcagagcgggcctcggaccaaagcgtccctgtcagccaagggcacacacatgagaaaggtgcctcctcagggcggccaggactgtagcgcctccacagtttcagccagtcccgaagctcctaccccttccccccttgaccccaattctgacaaagctaaggcatgcttgtcaaaagggagacgaacactgcgcaagccaaagagagtgcccagtatctataagctgaaactgcgcccaaggattcgcccacggcgtgaccaccgacctgagaagcaaccaagcaggattcctagacctctggcctacgtgtttctgggaccagctcgccagccacctaaagaccgactcctgagagcggtgctgggatctaaaggaggcgaagcctctagggtggacggggcttccgtaggtgaggaggaagaagagggaaaggaagagaaagagcccgcagcccccctagagagcagcccacagccccccgagggactgcagccacactggctgaaccaggctccactccctcctgaggaagaaagctgggtctag

SEQ ID NO: 13867 - DNA, 14262 bp, Artificial Sequence
  Description of Artificial Sequence: Synthetic coding sequence
atggtgccggaggaacgaagggtcggcctgtcgagcgatgaaacctcttctgactccctgaaatcatggcattctatctgcgtgctggattccaaagagcaacctctggcttgtcagcagaaacaaaggcaatttgtcaagcctgtgaccgagtccgaacagcctactgtacttgagctgctgttagctgagcttcgcactcttttctccgccgttctgcaggacagttctcccgcagcctggcggtacctgcacgccgttctgggactactgcctccttaccgagaactcctggtgggccatctggacctgcttccctttttggagcaactctattgttgggcaccctgggtacagacccatctgcatctcgatctgctcggcgccatagtacaggcgttccctccagactctagtctgttggattcagcctctcacgcagattgttgcccacagaaacgaaggttacaccatcggcctccttgccctgcatgtcccttcgtgcaagcccaatggtcaaggcagcaggtaaaggaggagctggcaacgtggctgagaccattgacgcttccagagctgcagcgctgtctcgggatcgtgggagcccaagtggcacttgaggaagcagtatggctggatggtttgagtttgctaccattagctctggccgccgatattccagtgaggtacgagtcttcagacaccgacaatgcagaggtggagccagtgggccgtaaagaaacaaggtcccagctggactatgaggtgccaagggagaaagcattccaaaagtcttcaacggggttcagtccagagacaagcttcctagattcacaggtgatgacggccctgaagatggagagatacctaaagaagatccactttctgtacttgaatgtggcccctagtagatattttagaccttacagtttgatggtggtgcctcccgacaaagtgaatccggagcactatattttcagtccctttggaatcctacacgtgcatccagtcgagggatcggagactatgacattgggaacttggcaccaccactgcgtattatggcaacagttacagtttatcccttttttcaagtactgcctgcttcgcaaaagttttacgtgttggaaaaaaaacgtgagactgcagggccttcatagattgcagaagttcctcgaaaaccatttactgctggcagtgcctcatttcggagcagggttgcttcacatttcccgccttttgcaagaattgcattcggtctcttggctgccacaggagctggatagatgttacgagttgttagatttgcagacagcgctggctgaggaaaagcacaaggccttgagactgctccaccggtgccttaacctttgcacgagtatactaagacttgttcacgaagatacctatcatatgcagcagtgtctccaggaaagagtccaaaattgtgacaggattcgtacgggccagggatccatctatctacagagggtgcagcataaacagctcgaacagaagctcaaacaggctgaggcctggtggctgcagctgggaaagtttgcgcggcttgtggactatatgatctgccagtcgctgattagcgtgttagaagagcagattacttcctttgtggctaacatcctacaagcccccagacagaagccatttcttagctcacagctggtgttcgatgaccatggccagctgtctcacgtcccatgtgtggagaacatgatccagaccctcactggcggcctccagtccgtcaaaacaagtgccttgcaggtggtacagagcgccgatttgaagacttccagcgattcactgtactctgaagaggaagatgaggaggaggattcaaaagacgaattccttatgcccaaattccaaggccaacctagtgatgctgtctctattttctgtggcccaaacgtggggctcgtttggccgtggaagtcgcaccccattgcaggtatcctcgaggtcagaggttgtaggctgagagggcagtatttcccacacaactataagcaattggaggaggatctagacaataatccaaaaatccagcaggcactgaacattcagcaggtgttgctagaaggtgtgctctgcaaggtacaggagttttgtcgtgagcatcactggataactggaatctacgaatttctgcagagttggggaccacagaagctggaagacatgagagggggccccatcaaaaattacgtgacgctggtgtcaaggctcaatgtttggcaggcaagagtgtccagcatgccaattgagctgctcacaaaagggggccttctcctgctgtcgtgtcacgacgtgcaggcggaaatggagtccaaactgaatagcatccggaaagacatactggctcatgtgcaaaacgagtgctggaacttgtcccagcagttgatgacggagctcacagatttcatgcacatcttccggacaattaactctgacattcacgctatcgctcagtgtacacagaagctgaacgaggccaatgaacagtatgtggagttagaagagagaatggagtacgtccgggcactccatgaactcatccgtaaccacttttcccttttctcagccgaaaacgaagccttagatatctcagtccgccgccaatttggcgagagccctatacctccctgtccaccacccccccaaccccacctcctgcactgcccacttctggcccctcagctgctcgacatgtgggaagcattccaatttgagaagtctcaggcctctgaatttcttttgtccaagcgtcacgctattatgccaaagctgcagcagttgatggccgcagccctggccgaattagagggactgctggcgaaagccctttctggaccttttatggacccaacacaggaccagcgcagcaccgaacaccagcttgtctcacttgagagacagttccagaacaccgtgagcgatctgtctgagctgcatcatgcatacgctatctttaccgaagacgagactcctgtgcccttaccaatatgcgggacaagaccgatcgtgcagcagcagagaatatggcatctgtacagggtaattagtgagaatatcagtgagtggaagtgcatggccttcgcaaagttttcccctgccatggcccaggagaagacagagggttggctgacggaagccgccaggatgtcaacaacgctggaattacattcacctgttctgcagcattgtatgcgaatcttgggcgaatttcgatcttatctgcctttgctcacaaagctgggcagcttgcatccacagtcactcaactgccaatgtttgctgagggcactcggccttggctccctccagactattgaacttctgacacttggccaactcctgacctatcccttgctagagttcgcggataggataaaccaggtttggcaaaacgagaatgagaggatccatgcacaagagaccattcgacggttgcagagatactgggaggctcgacagctaaggttgctcaacttcatcctccacgtgccttatgaaccccccgcttcagagcgtagtaagcgacaggttctgcgatctccacaatgggaagtggtggacaaagactcaggcactttcatcttatctgactactctaatctccaggactcaatccaagagagcttgcaggtgctatccaaaatcctggccattgagaagtccggtgatcttaataagatagcgttggagtgggtggcgattatgcatggactcggcgcactgttagaggtctggctcacgtttcagcagaagtggatcttccttaataaggtcctgcacgaaatgaagatccaatttcccaatgcagatctaaactccagattcaaggttatggacgaccaataccgcacccttatgaggatttctgtcgccgaccccatggtgctctcactagtggttccatctgcagaaagatcaccctactttcaaggacagcagctccagcagctcttgcaggctggatcggttgaattggaaggtataatcatgtcactcgaatctgtcctctacggagtctgcgcccattttccccggctgttttttttgtccgactctgagttagtggccttactcgctgcgcgactggaatcctgcgaggcccagctttgggtccggaggtgttttcctcacgtgcacgcagtttctttcaggagctgcccaactggcgagaaaaatactgacgattgggaatcgtcgccaaacacacagacccaggttgaggccctcgctgtgttgggcgccgggggtgaggaggtcaagctgcagggcccacttcctctgcatcctgatcttccgaagtggctggctagccttgagaagtgcctgcgcttggctctggtgcatatgttgcagggttgtgtggcagccaggctagcccgcggaccctctctgggggaggcactgaagcagctaccgaaacagaataaactctacctgcagctctacgttcagcactggatcgaccttgtgcaggccttcccttggcagtgtgttctggtggccgaggaagttgtgtggcgtgctgagatggaagaagctctgctcgaatggggcaccttagcaatggtgagtatgcacatgagaaaactggaggtgctggtcaacttcatgagagctcagcgggcttctcaaggtggtcagtcactgccaagtgtccggcagacctccctgctgtcagccctgcttgtaatggccgtgacccaccgtgatattgcccagctgcttgaacagcaccaggtttctgaccttactgatttccactgggtacgccagcttaaatatcacctggggagtccacacataatacccaaatcccccctgcagtcactgaagacaatcgcctccagtgaaccttccctatctcctgccgcctgttggattgacgtcctgggccgtagcttcttatataactacgagtatcttgggccgaggttaggtcccctgccttccctgctgcccgaacgccccgctttagtactcctgctcgccctcgaggaagtcgcgtgcggcacagtgcttggcccaaatggcgttgggaagagggccattgtgaactctctggctcaggcattggggagacagttggtcatgttaccctgttccccacagattgaggcacaatgcctctcgaattatctgaatggggcacttcaggggggtgcgtggctgctattggaaaaggttcatcagctgccgcctgggcttctgtcggctctaggccaacggctgggagagctgcaccacctgtatgcccccctgtatcaggaggcatctcgtaatacatcaaccatcgatccaacgcagccacaactgttgggctcatcttttttcgaaaaacatcacgtgagcgtccgactaggctatggatgcctactcgtgctccgggccttgtcctctgccgtcccggccaatctgcacctactccttcgccctgtagctctggccctccccgaccttcgacaagttgccgaactgaccttgctcggcgctggaatgcgtgatgcgttccagatggccacccggctcagtaagtttttttcactggagcgcgaattagttagtggccccttgccctgtagattgcccttgctcaagcagatcttggaagacacaatccgcacactgaatgtgactaaggaggaaccgaagtgccagaagccgcgcagccttgcagcgatagaggaggccgctttattgcgaagcccattgtttagcattctgaatggtctgcacttgcacaatctgagggggctcctctgcgctctgtttcccagcgctagccaagtgctggctgagccgatgacatacaaacttatgaaacccctggtggtggaggaactgcagcaagtggggctggatccctccccagacatactaggctccctggaacagttgtcacaggccctgtcgagagcaagtggcatcctcttactgggtcccgctggcagtgggaagacaacttgttggcattctttatttaagatccagaaccggttggcagcaatggaagatacatctacccagggttgccagccggtggagattacccatctgtacccgagcggtctatctcctcaggaatttctggggtggctggagggatcatgctggcaccatggcattttccctaaagtgctgcgcgcagcgggccaatgtaacaacatggggcagaagagacaaactgaagaatccatcggaatccagcattggattatctgcgacggtgcctcaaatggggcgtggctcgattctataacgtgcttacttagtgagctcccccagttgtcgttgccttcaggtcagcagatcgcccgccctcccggtacatttcttcttatggaagttgccgacaccactggtataagtcctaccgtcgttggctgttgtgctctggtttggtgcgggggagaacagacttggcagtgtatcctgtccgccctgatggcctctctgccatatgagtaccgcctacaacatcgcacagtcgccgagctgaaccacatggccgaagtactagtccctgccacactgcgctttctcacatgtcagggtgtgtcttccctccttcaggtgcacggtcagcaggcagtatgcgctggagtggccgaggtgacctcaatggctcgcattctgcacagtttactggatctacatctgaggctcaaggaggaaaaggcccctggccccgaagatctctcctactctgacccggttgcgcagtcttttaggtcttctaaaagttcctttcttaaccgaagccaagtggactcagatgacgttcctgacaagtgccgggagcaccttctcgctgttagttcatttctgttcgcgctgatttggggcttcggggcgcacctgcctagccgcttctggcccatctttgataccttcattcgggacagtatttcaaggctgagcaattatccagagcctcccccttctgcccttgtgtttgatctgcatgtgagtccagaggacgggaccttggtgcccttcacaggccagtacctgagcagtcatatcaagggaacactggggaccttccacccatctattcagacagagcggctcttatacgtagtcgatctgctgctgagcggaggccagccagtccttctggcaggagaagctgctaccggtaagtctgcgtttgttgaggtgcttgtagagccccatcacccatatatatactctcccattcacccagcttttagctcctcacatctcagactcctgctgtcccgtggtatccaaggtcagacccaagccagtccgcagcctggacaccaccaggactcaaaaccttcccttctgttccttttagaggatcttcatctggcgacctccgatcccgagaagagctgccaacctgttctcgagacattgaggcaggcaatggacggaactgtctatgcccactccaccctggagctccagacacttcaacccacagtgaactttctggctacagtaactgtgcccggttattgcgagaggccgctatgtcccagacttttcaggttattcactgtgcttgctctggagtccatgacacaagccactctactggaacgtcatgtccccatcatccaggcctggctcgagcgttttccttcagtcgagagggagcgggcactggcacgaggtctcgtgcgcgcttccgtggaggcatgggaagcggtctgtaactgtttcatgccttcacctctgcatccccattatcatttcagtctgcacagcgtatctcacttgttgagctccctccaacttctgcctaacaggacaggatcccgaggcttcgtggattaccccaatcaccaggagcatctccgcagggttagcgggttaagagggacgtgtctcaccgttatgatggccacccgcaatgttgtaagactgtggctgcatgaggcacagaggacattctgcgatcgactggacagccctcgcgagcggagttattgcgccaagctcttgcttgtcgtggctcagtccgtgttctgctgtggcccgggaccgcagcacctgggcaaggaccatcaggagtcggaggaagaggaagaagaggaacgcgtcccagaggtcgagtcagagggcgagcttgctcagtgggaggactttagcaattcaaattcagagaccgaagaggaagaagagccttatggactgcaggtggctagagtgtctaattctcgggatccttctctgacgccctcaatcggtccagtgagtaggggtatgaaggaatccatttcccataagatcagacaggaaaagggtacacgcgcaagtaattatcggctacaggttcggaggagctttaaaacttggtggcagaagaagcctcagatggatctcatatcgcctctgctgctgccggttctcctgttgcaccctcaggagaaacccagtgacctggtgttctcccaggagctcatactgggccctaactcagagaccccaaatctctacctggagcgccagtgggaaaaactggaggaacagctcgccacctctgcagcacagcttaagctgtcgcctcacttggccagatgccatagcatggcccagcacgtcgcacgactggttcgggttttggccaggccaaggcagcacggcctattgctatcgggagcactcgggacagggagacacaccgcgatcaccttggcaagcagcatctgccaagcacactttttccatctgccatctggaagtgaggaggccatcctgcagtgcctacgcgacgcttcttggcacgccggcatgctgtcacagcctgttgctctgctggtgccctcaggcgttgacttgaccactctgcaccgcctgctggcactggctaccagtggatctttccctgggcagtacactgaagcagacctcgatcgcataggggagcacttgcctagagaaaaccttggcgtgaaacaaaatatcaagaaggaaatggtgctccaacggtttcatcaacaagtgtgcagccatctccacctgtttttcctaataggcgataaacaggctcataaacagcttccaagcactctgttcttgcgactcctgcaactggccaccgcgagtattgataggtatgagccttgggaccaggccgccctggccaaggttgcacaacatcatctagagggagcacagtcagtgccactggatgacggctcttggaaatatccagatctgcaagcatcgattccttccgtggccaaagcaatggccttaattcaccttagcgctacacactatcacgagcatctctgcccagcactcccattagtgacgcccaaaactttcctggatttcctggataccttcttgatgctgcagcagcagacaattctgaaaattaagaataaggcccagcgtgtgcaaaacgccctggagaatctgaggatgctgataaaggaacacggaacacacgccaatttgatttttgatctggaacaacagctgaaagattcagggaagagcctctcaatgtttcaacagcagctggagcaatcaaagttgctgtataaacagcagctggaggaatgccggcaccaggaaaatctgatcgagaatctggctagacagcgcgacgctcttcaagcccaacgtgaggcttttcttgagcagatgtccaaggcttttctggaacccctctctcaactgcaagtggctgactttgaggagattaggtcttaccgggctcctcccgagtcagtagtgcgggtgactgacgctatgtgtgatctcttccatcatgaaacagggtgggcctcagctaaacagctcctctgcaccgaagatttttaccaggagctggtttttttcccaaaagaaaaaattactgattctgagcttatcaagctacatctgatcctcaaggccccaggaatggacgatgctgctctgcgagccgtgagtcgccctgccgcttcattagctgcctggctgtgggctgtgcttcattacggtctcgcgcactgccgcggtctgccaacggatttactcctacaacaggttgaggccactttgacccgcgaacaggctagattaggatattaccagtttcaggcgcaggagacccttgagcataatcttgctctagctaagatggttgaagacgctcaagcgagtcacaattgcgtggccaagactctgagtcaggcacagtgtggccagtatcataagtggcccatgaaagccgcacttcttacacccatgagggcctggacaacccagctccaaaagctgaaaggccggtgtatgacagtgtttggagatacgttgctttgctcagccgcaattatttacctaggaccctttccacccctaaggcggcaagagttactggatgagtggctggcgttgtgcaggggttttcaggaggctctcggacctgatgacgttgcccaggccctgaaacgtaaacaaaagtccgtgagtatcccacccaagaatcctctcctcgcaacccacagccccttttcaattctctccctgctgagttctgagtctgagcagtatcagtgggatggcaatctaaaaccccaggccaaatctgcgcaccttgccggcttacttctgcgcagccccacccactattccagttgtcgatggcccctgctcctggacccaagcaacgaggcgcttatctggctggacccactccctctggaagagaataggagcttcgcccctgcactaacagagggcagaggtaaaggtcttatgagaaaccagaaacgcgaatccaaaacggacatgaaagaggaggacgacgaaagtgaagagtctaacgaggccgaagatcagacaaaggagcagaaggcagaagagcggaagaacgaacaggaaaaggagcaagaagagaatgaagagaaggaggaagaaaagacagagagccaggggagcaaaccagcgtatgaaacacagctccccagtctgccttacttgagtgttctgagcggggccgatcccgagcttggctcacaactacaggaagccgctgcctgcggacttcccgtattgcttacaaatgtggaattgggcctcgggtgtgaagaactgcaatggctccttcagagagagcagctgtctccgccacaggtgcagcctgggttttgtctgtatctaagcacaacccttagcctctgcgcaatggagaaagtgctggggtgcgaactgctgaagggcttgaacgttctcgatttaggacttaacatggagatactggaagaacaaatgctgcatgagattttgtgcagggagtatcccgaactagagacccgctggcaagatctcaaaatccgggcgttggatacatgcaaggctgtggaggccgcggaggagcggctcttgacaatgctacttttccaaaacccgaagcggcaaaagccagccaagttcctgcgcaacatcgtcagagctcaagggaaactgtgccagctgcgggcacactgcgaggagttagaggggcaaaagttacaagagatggtgctgtgggcaccctatcggcctgtggtctggcacggcatggccatggtcaaagcactcagccagctgcagaacctgctccccctgttttgcatgtcaccagagaactggttagctgtcacaaagcaagccctggactccatgaagccccgcgagattaatcacggggaggatctggcttctcacttactccagttgagagcccatttgactaggcaactcctcgggtccacagtgactgcattgggattaactcaggtgcccttggtgggcgccctcggcgccctcgcactcctgcaagccactggaaaggcaagcgagctggaacgactcgcactatggccgggactcgcagcttccccatctacagtccactctaagccggtttcggacgttgctcgccccgcctggctgggaccaaaggcctggcatgagtgtgaaatgctcgagttgctacccccatttgtggggctgtgcgcatccctggctgggcattccagtgcctggcaggcatatctgagcctttcttccaccgtgctcgggccggcacccggccccggccctgagccactgtctctactgcaaaaattaatcctgtggcgagtgctcaggcctgagtgccttgccggagcattggcggactttacaactagccttcttggcagaccattggatgagaatacctatgctcctactatgccctttaaacatagccaagcgacgcagcccatgcttattctcttacctccccctggacacccgagcgctactctgcacccactgactgttattcagaaactcgctgcaaaataccagcaagggcagaaacaactgcaggtgattgccctgggtagtgaggcatgggaccctgtgtccgtagtcgttagtaccctttctcaggctatgtatgaaggccactggttggtactcgacaactgccatttgatgccacactggcccaaggagctgctgcagcttctcttggagctcctgggtcgagccaaggttgttgctgaccttgaaagcgaacagctgctggaccagccagaatcccggaatgtttccacagtacaccgcgatttccggctctggttgatcgttcctgctgaatccagcgcttcactcccagccgtcctgacacagcactctatgcctgttttttggaatcaatcactggagctgggtcatgtgcttatcgatagcgtggaattagctcagcaagtactatatatgcagcctccgacccaggccctgcccctgctgctgcttcacggtctgctgcttcataggcaactctacggaacccgcctgcaggcacataggggccggtggagccaggtgacattaacacaggtcctgcagacacaggaccagttatgggccagcctgtctaaccctagagccgcgatgcaggaacttgctgcctccgtgttttatgggggcccgctgggagacactgaggatagagaagccctcatttcactgacgcaggcatgcctgtccccaagcagcggctcctgggtgcagcctcataccccacagtctctattggcaacactgatgcccctgcctgaactcagggagctcgacgctatggcggagtgtaaggcccagatgcaccttctgccatcaccgcctgaacccaggctctgtggcctgtcagagggcccccaggcatggctcctcaggaggcagagccgcgcactgctcagcgccctacagcgcagctctcccgtgtgggtgccggaaagccggcgaggagcccaactcgccgaacggcgactccggcagcgacttgtccaggtaaaccggcgactggagtctctgcaggaccttctgacccatgtgattagacaggatgagtccgatgctccatggagcgttctcgggcccaatgctcgccgcccccttgagggcgtcctagagacagaggccctagagctttctcagctcgtcggcaccttgcaaagggacctcgattgtcttctgcaacagctaaagggggctcctccttgcccctctaggcgatgcgctgccgtggcccacgctctgtggacgggaagactaccactcccctggagaccccatgcgcctgccgggccccagccaccctggcattggttgcgccaactgagcaggaggggacagctgctagtccgctacctcggggtgggcgcggatgccagttctgacgtccctgagcgtgtgtttcatctgtcagccttcaggcacccaaggcggctgcttctggccctgaggggcgaggctgcactcgaccagaatgtcccctcttcaaatttccctggctcaagggggagcgtgtcatctcagttacagtacaagagactggagatgaatagcaatcctctgcacttccgcgtggagaatggccctaaccctactgtccccgagcgtgggctgttactcatcggtctccaggtcttgcatgccgagtgggaccccatcgccggcgctctgcaggatagcccttcatctcagcccagcccacttccacccgtaagtatcagtacccaggcaccagggacctctgacctgcccgctccagccgatctgaccgtctatagctgcccggtctatatgggtggtccgttgggtaccgccaagctgcaatcccggaatatcgtaatgcaccttccgctgcctactaaactgacccccaacacgtgcgtccagagacgggtgcatgtctgtagtcctcccctgtcgtag

SEQ ID NO: 13868 - DNA, 1179 bp, Artificial Sequence
  Description of Artificial Sequence: Synthetic coding sequence
atggatctgtttggcgacctccctgaacctgagaggtctcccaggccagcagccggaaaagaagcccagaaggggcccctactcttcgacgacctaccacccgcgtccagcacagattctggctcaggtggtcctctcctatttgacgatctgccaccagcctcgagtggcgactccgggtctcttgccaccagtatctctcaaatggtgaagactgaaggcaaaggcgccaaacgtaagacctccgaagaagaaaaaaacggatcagaggagctcgtggaaaaaaaggtttgtaaagccagctcggtgatctttggcttaaaaggctacgtggctgaacggaagggcgagcgcgaagaaatgcaggacgcgcacgtcatcctcaatgacatcaccgaagaatgtagacctccttccagtctgattacccgggttagttattttgcagtgtttgatggccatggcgggattcgtgcaagtaagtttgccgcccagaatctgcaccaaaacctgatcaggaaattccctaaaggagatgtgatttccgtcgagaagaccgtcaaacgctgtctgctggatacattcaaacatacagatgaggagttcctgaagcaggcctcctctcagaagccagcctggaaagacggcagcacagcaacttgcgttctggcagtggacaacatcctgtatatcgctaacttgggcgattcacgagcaattttgtgtagatataacgaggagtcacagaagcacgctgcacttagcctgagtaaagaacataatcctacacagtacgaagaaagaatgcgcatccaaaaagcaggcggcaatgtcagagatggccgcgtgctgggggtgctggaggtaagtcgcagtataggcgacgggcaatataagcgttgcggagttacaagcgtaccggatatcagacggtgccagcttactccaaatgaccgcttcatcctgcttgcatgtgatggactgtttaaggttttcacccctgaggaggcggttaactttatcctgtcctgtctagaagatgaaaagatccaaacgagagagggtaagagtgcagccgacgctcggtacgaggcagcctgcaatagattggctaataaagccgtgcagcgcgggagcgccgacaacgttaccgtcatggttgtccgtatcgggcactag

SEQ ID NO: 13869 - DNA, 2193 bp, Artificial Sequence
  Description of Artificial Sequence: Synthetic coding sequence
atgtttggcagaaaaaggtccgtgtccttcggaggatttggatggatcgacaagaccatgcttgcaagtcttaaggtgaagaagcaggaactggctaacagtagtgacgccactttgccagaccgaccgctcagcccacccctaacagcacccccgacaatgaaatccagcgagttttttgagatgctcgaaaagatgcagggaattaaactagaagaacagaagccagggccccagaaaaacaaggatgactacattccctacccgtccatcgatgaggtggtggaaaaaggcgggccatatcctcaagttatcctgcctcagtttggcggctattggatcgaggaccctgaaaacgtgggaactcctactagtctgggcagcagtatttgcgaagaagaagaggaggacaatctctcccctaacacttttggatacaaacttgagtgtaaaggcgaggcccgagcgtatcgcagacattttctgggcaaggatcacctaaatttttactgcaccggctcttctctcggcaacctgattctgtcggttaaatgcgaggaggctgagggtatagaatatctgagagtaattctgagatcaaagctgaagacagtccatgaaagaatccctctcgcaggcctctcaaaactgccctccgtaccacaaatcgcaaaggcattttgcgacgatgccgtgggcctgagattcaaccccgttctataccccaaagctagccaaatgatagtgagctacgatgaacacgaagtcaataacacttttaagtttggtgtcatttaccagaaggcgcgacagacattggaagaagaactgttcgggaacaatgaggagtctcccgctttcaaagaatttctcgatctcctgggcgacaccataacactgcaggactttaaaggcttcagaggaggattggatgtgactcatgggcaaactggggttgagagcgtgtataccacattccgggatcgggagatcatgtttcacgtctctactaaattacctttcaccgacggggatgcccagcaactacagagaaaacgacatattgggaacgacattgtcgcaatcatttttcaagaagagaacacaccgttcgttccagacatgattgcttccaatttcttgcacgcttacattgtagtgcaggtcgagacaccaggtaccgagaccccgtcttacaaggtttctgttacagcccgtgaggacgtcccaaccttcggccctccactgcccagtcctcctgtgttccagaaggggcccgaatttagggagtttctgctcactaagctgaccaacgccgagaatgcatgttgtaaaagcgacaaattcgcgaaactcgaggatcggactcgagccgctctcctggataacttgcatgatgagctgcatgctcacacacaagcaatgctaggtcttggtcccgaggaggataagttcgagaacggggggcatgggggatttttagaatcgttcaaaagagcgatcagagtcaggagtcactcgatggagaccatggtcggcggccaaaagaagtcccactctggcggaatacctggctcactttctggcggcattagccacaatagcatggaagtgaccaagacaacattcagtccccccgtagtggctgctactgtgaaaaaccagagtagaagccccatcaaaaggaggagtgggctttttccccgtcttcacaccggtagtgaaggtcagggagatagtcgcgctagatgtgacagcacctcttcgaccccaaagacacctgacggaggtcacagcagccaggagatcaagtccgagacctcgtccaaccccagcagccctgaaatctgtcccaataaggaaaaaccctttatgaagcttaaggagaatggacgtgccattagtcgcagctcctcttctacatcgtccgtaagcagtactgccggcgagggagaggcaatggaggaaggagactccggtggtagccagccttccaccacgagccctttcaagcaagaggtgtttgtctactccccctctccatcaagcgaaagtccgtccctgggcgcggcagcgacccccattatcatgtctcgctcaccaaccgacgcaaaatcacgtaattctcctcggtctaacctgaagttccgttttgataaactgagccacgcttcatcaggagcagggcactag

SEQ ID NO: 13870 - DNA, 1110 bp, Artificial Sequence
  Description of Artificial Sequence: Synthetic coding sequence
atgtggtccgggagaaagctgggaagcagcggaggatggttcttaagagtgctaggcccaggcgggtgcaatactaaggcagctcggccactcatctcatcggctgtgtatgttaagaaccagttatccggaactctgcaaatcaagcctggcgtgttcaatgagtatagaaccatttggtttaagtcttatcggactatctttagctgtctgaatcgcatcaaatcatttagatatccctgggcacgactgtattccacaagccaaacgactgttgactcgggggaagtcaagacattcctggcactggcccataagtggtgggatgagcagggagtgtacgctccccttcactcaatgaacgacctaagggtgccattcatcagagacaatctccttaagaccataccgaaccatcagcctggaaagccccttctgggtatgaagatacttgacgtaggctgtgggggagggcttctgacagagcctctcgggaggttgggcgcaagcgtaataggaattgatccagtcgatgagaacatcaagacggcccaatgccataagtcatttgatcccgtactggataaacggattgagtatagagtctgttccctcgaggaaattgttgaggaaactgccgaaacttttgatgcagtggtcgccagcgaggtggttgagcacgtaattgacctggaaacttttttgcaatgttgctgtcaggttctgaaacccggcggatctctgttcatcaccaccattaataagacacagttatcatacgctttgggaattgtgttctctgagcagatcgcctccatagtgcccaagggaacccacacctgggagaagtttgtgagcccagagaccctggagtcaatactggagtccaacgggctgtctgtgcagacggttgtgggaatgctgtataatcccttcagtgggtactggcactggtccgaaaatacctcactgaattacgccgcttatgccgtcaagtctagggtccaagagcatcccgctagcgccgaattcgttcttaagggtgaaacagaggaactgcaggcaaacgcttgtacaaaccctgccgtgcacgagaaactgaaaaagtag

SEQ ID NO: 13871 - DNA, 1782 bp, Artificial Sequence
  Description of Artificial Sequence: Synthetic coding sequence
atggaaggctgcatgggagaggagagcttccagatgtgggaactgaatcgaagacttgaggcatatttggctagagtaaaggctcttgaagagcaaaatgaactcctgagcgccgagcttggcggcctccgagcgcagtctgccgatacgtcttggcgagctcacgctgacgacgaactggctgctcttcgtgccctggtggaccagaggtggagagaaaaacacgcagccgaagtggcgagggataatctggcggaggaactagagggagtagcagggcgctgtcagcagctgcgactcgctagagaacgtacaacagaggaggtagccaggaaccgccgtgctgtggaggccgagaagtgtgctcgggcttggctttcctctcaggtagcagaactcgagagggaattggaggctctccgtgtggctcatgaagaggaacgcgtcggattgaacgcgcaggcagcctgcgctccaaggtgtcccgcacccccccgtggccctcctgctccagcccctgaagtcgaagagctcgcaaggcggctgggtgaagcttggcggggcgcggtcagaggctaccaggagcgggtggctcacatggagactagcctggggcaagcaagggaaaggctcggacgtgcagtgcagggcgctcgggaggggcgcctcgagctacagcagcttcaggcagaacggggagggctgttggagaggagagccgcacttgagcagagacttgagggaaggtggcaggagagactacgcgcgaccgaaaagtttcaattggcggttgaagctttagagcaggagaagcagggcctgcagtctcagatcgcacaggtcctggaagggcggcaacagttagcccacctcaagatgtcgctaagcctcgaggtggccacatatcgcactctgctggaagcagaaaactctcggcttcaaacaccagggggaggcagtaagacctctttgagctttcaggaccccaagcttgaactgcagtttcctcgtacgcccgaagggcgacgtctcgggagtcttctgcctgtcctaagccccaccagcctgccctcaccgctgcccgccaccttagagactcctgtgccagctttcctgaagaaccaagaattcttacaggctcgcacgccaacactggcgtctacaccaatcccccctactccccaggccccatcccccgcggtcgacgctgagatacgcgctcaggatgccccgctgtccttacttcagactcaaggcggtcgaaaacaggcccccgagccacttcgcgctgaggcccgggtcgccattccagcaagcgtgctccccggccccgaggaaccagggggacagcgtcaggaggcgagtaccggtcagtcccctgaagaccacgctagtcttgcgcctccactgtcaccagaccactcctccttggaggccaaagacggtgaatctggcgggagtcgggtattcagcatttgccgcggtgaaggagaaggtcaaatctgggggttggtggaaaaggagacagctatcgagggtaaagtggtgagctccttgcaacaggagatctgggaggaagaagacctcaaccgaaaagaaattcaggactcgcaggtccccctagagaaggagacactcaagtcattgggcgaggagattcaggaatccctgaagacattagaaaaccagtcccatgagacactggaacgggagaatcaggagtgtcctcgctcactcgaagaagatctggaaacactcaagtcgctggaaaagaagaagtag

SEQ ID NO: 13872 - DNA, 3456 bp, Artificial Sequence
  Description of Artificial Sequence: Synthetic coding sequence
atgatggcagcagctctgggcccacccgaagtgattgcccagttggagaacgccgcaaaggtgctcatggctccaccctcaatggtgaacaatgaacagcgccagcacgcggaacacatctttctctcgtttagaaaatctaagtcgccttttgccgtgtgcaaacacatccttgagacttcgaaggtcgattacgtactcttccaggcggcaacagccatcatggaggccgtcgtgcgcgagtggattctgttagaaaagggctctatagaaagcttgcgcacattcctactcacttacgttttgcaacggccgaacctgcaaaagtatgtgagggaacagatcctcctggctgtggccgtcatcgtcaagagaggctccctcgacaagtcaatcgactgcaagtcaatttttcatgaggtgtctcaactgatttcaagcggcaacccaactgtgcagacactggcctgctccattcttaccgcactcctgtctgaattctccagctcttcaaaaacaagcaacattggactttccatggagttccatggcaactgcaaaagggtgttccaagaagaagatctcagacagatctttatgttaacggttgaggtgctgcaggaattttcccggcgggagaaccttaatgcccaaatgtccagcgtgtttcagcgctacctggcacttgctaaccaggtcctgtcatggaatttccttccgcccaatctcggacgacactacatagcgatgttcgaaagctcccagaacgtcctgctgaaacctacagagtcctggcgcgagaccctcctcgacagtcgggtgatggaactgttttttactgtccatcgcaaaataagggaggactctgacatggcgcaggattccctgcaatgcctcgcacaattggccagccttcacggaccgatctttccagacgagggcagccaagtcgactatctggctcattttatagaaggcttgcttaatacaatcaacggcatcgaaatagaggactccgaagcagttggcatcagttctattatctcaaatctgatcaccgtatttccaaggaacgtcctcaccgccattcctagcgagctgttctcgtcatttgtgaactgccttacacatctgacttgttcatttggcaggtctgcagcactggaagaggtgctggacaaggacgacatggtctacatggaggcctacgataagctactggagtcttggttaactctcgtacaggatgacaagcactttcataaaggattctttacccagcatgctgtacaggtctttaactcctacatccaatgccatctggcagccccggacggcactaggaatctgacagctaacggcgttgcctctagagaagaggaggagatctcagagctgcaagaggatgaccgggaccagttttccgaccagctggcaagtgttggcatgctcggccgaatcgccgccgagcactgcatcccactgctcaccagccttcttgaagagcgggtcacacgccttcacggtcagctgcagcggcaccagcagcagcttttagcgtctccggggagttcaaccgtcgataacaagatgttggatgacctatatgaagacattcactggctgatcctggtgacaggttacctgttggcagacgacacccaaggagagactcccctcattcccccagagataatggaatattcgataaaacactcttcagaagttgacattaataccaccctgcagatcctggggtcgcccggtgagaaggcctcctctataccggggtataacaggaccgattcagtaatcaggctgttaagcgctatcttacgggtatcggaagtcgagtctagggcgattagagccgatcttactcatctgctttcgccacaaatggggaaggacatcgtgtggtttctcaaacggtgggctaagacttacctgcttgtggatgaaaagctgtacgatcagatatcactgccattttccacagcgttcggcgcggacacggaaggttcccaatggatcatcggatatttactccagaaggtcatcagcaacttatcggtgtggtctagcgagcaggacctggccaacgacactgtgcagctcctggtcactctagtagagcgaagagagagggcaaacctggttatccaatgtgaaaactggtggaatctagctaaacagttcgcctcaagaagcccaccactgaacttcctctctagccctgtgcagcggaccctcatgaaagcgttagtgctggggggatttgcccacatggataccgaaacaaagcaacagtattggacggaagttctgcagccactacagcaaaggtttctcagggtgatcaatcaggagaacttccagcagatgtgccagcaagaagaggtgaaacaggaaataacagcgaccttagaggccctttgcgggattgcggaggcaactcagatcgataatgtagcgattctcttcaattttctgatggactttctcaccaattgtattgggcttatggaggtttataaaaacacgcctgagacggtgaatctgataatagaggtgtttgtggaggtggcccataagcaaatttgctacctgggtgaaagtaaggccatgaacctttacgaagcatgtctaacactgctccaggtctattcaaagaacaatttgggtcgacagaggattgacgtgacggcagaggaggagcagtaccaggacctgctgctgataatggaactgctaactaatctactgtcaaaggaatttattgacttcagcgatacagatgaggtttttcgtggccatgaaccaggtcaagccgccaatcgatccgtcagcgcagctgacgtggtcctctacggagtaaatctcatccttcctctgatgagtcaggacctattgaagtttccaaccctatgtaaccagtactacaagctcattactttcatatgtgagatcttcccggagaaaatacctcagttgcccgaggatctcttcaaatctttaatgtactcactggagctaggtatgacctccatgagctccgaggtttgccagctctgtctggaagcccttacccctctcgccgaacagtgcgcaaaggctcaagagactgactccccactgtttctcgcgacacgacatttccttaaactggtttttgacatgctagtgctgcaaaaacacaataccgaaatgaccaccgctgctggcgaagccttctataccctggtatgccttcatcaagccgaatatagcgagctcgtggagactctcctgagcagccagcaggatccagtaatatatcaaaggctggccgacgccttcaataagttgacggctagcagtactccccctaccctcgacaggaagcagaagatggcctttcttaaatccctggaagaatttatggctaatgtcgggggacttctgtgcgtgaaatag

SEQ ID NO: 13873 - DNA, 1578 bp, Artificial Sequence
  Description of Artificial Sequence: Synthetic coding sequence
atggcagctggcggaagtggaggtagggcctcctgtccaccaggcgtgggcgtgggaccagggacaggcggaagccccggaccttccgccaacgctgccgcaacacccgccccaggaaatgccgcagcggcggcagccgccgctgcagccgctgctgcagccccaggacccacgcctcctgctcctccgggacctggcactgacgcccaggcagcaggagcggagagggccgaggaagccgcggggcctggagctgcagccctgcagcgtgaggcagcctacaattggcaagcaagtaaacccactgtgcaggaaagattcgcttttctgtttaacaacgaggttctgtgcgatgtccattttctcgtgggaaaagggctgtcatcacagagaatacctgctcaccggtttgtcctggcggtaggatcggctgtgttcgatgctatgttcaatgggggaatggccaccacgtccacagaaatcgaactccccgacgtggagccagcagctttcctggctttattaaaattcctctatagcgatgaggtgcagattgggcctgaaacggttatgaccaccctatatacagctaagaaatacgcggttcccgctcttgaagcccattgcgtcgaattcctcaaaaaaaacctgcgtgcggataacgcctttatgcttcttacccaggcacgactttttgatgaaccccaactcgctagcctgtgtcttgaaaacattgataaaaacacggcagacgctatcaccgccgagggctttacggatattgacctggacaccctggtggcagtgctggaacgggacaccctgggcatccgcgaggttcgcttatttaacgctgtcgttcgatggagcgaggccgagtgtcagcgccaacagctacaggtgaccccagaaaaccgtagaaaggttctaggaaaggcccttggtcttattcgctttcccttgatgacaattgaggagtttgctgccggccccgctcaaagtggcattcttgtagatcgggaggtggtcagtctgtttcttcacttcactgtgaatccaaaacctcgggttgaatttattgatagacctcgatgctgtctgagagggaaggagtgcagcataaaccgcttccagcaggttgaaagccgctggggctattcgggtacttccgatcgtattcgttttagcgtgaacaagcgaatatttgttgtcggcttcgggctttatggaagcatccacggccctaccgattaccaagtgaatatccagatcatacataccgattcaaatacagtcctgggccaaaatgacacaggattcagctgcgacggcagcgcctcaaccttcagagtgatgttcaaagaaccagtggaggtcctcccaaatgtcaactacacagcttgtgctaccttgaaggggccggactcccactacgggaccaagggtctgaggaaagtcacacatgaaagccctacaactggggccaagacttgtttcacattttgctatgctgccgggaataataatggaacttcggtcgaggacggccagataccagaagtgatcttttatacttag

SEQ ID NO: 13874 - DNA, 525 bp, Artificial Sequence
  Description of Artificial Sequence: Synthetic coding sequence
atggccaccgtggcggaactaaaggcagtgctgaaagatacactggagaagaagggtgtgcttggccatctgaaggctaggattagggcagaggtgttcaacgctctggatgacgaccgtgaaccgaggccttctctctctcatgagaacctgcttatcaatgaattgatcagagagtacctggagttcaacaagtacaaatatactgcttctgttctgattgctgaatcaggccaacctgtggttccactagatcgacaatttttgattcacgagctgaacgcgtttgaggagtctaaagacaatacaatacccctgttgtacggcatcctcgcacatttcctgcgggggaccaaggatgggattcagaatgcttttctcaaaggaccatccctgcagccttctgacccttccctgggccggcagccatcaagaaggaagccgatggatgaccacctgcgcaaagaagaacaaaagagcacaaacatcgaagatctacatgtgagtcaggctgttaaccgctag

SEQ ID NO: 13875 - DNA, 1257 bp, Artificial Sequence
  Description of Artificial Sequence: Synthetic coding sequence
atggctgggtccttacctccctgcgtcgtggactgcggcactggatacacaaaactcggctatgctggtaatacagagccgcaattcatcatcccctcctgtatcgctattcgggagagcgctaaggtggtagaccaggctcagcgccgggtgctacgcggtgtggacgacctcgacttttttataggggatgaggccatagacaagcctacttacgccaccaaatggccaattcgtcacggtatcatcgaagattgggatctcatggagaggtttatggagcaggtggttttcaaatacctaagggctgaaccagaggaccactatttccttatgacggaaccgccgctcaacactcctgaaaaccgcgaatacctagccgaaatcatgtttgagtccttcaatgtaccaggcctatatatagcagttcaggccgtgctcgctctggccgcctcgtggactagccggcaggtgggggaacgaaccctcacaggcatcgtcatcgattccggtgatggcgttacacatgtcattcctgtggccgaaggttacgtcattggctcttgcatcaaacacatcccgatcgccggcagagacataacgtacttcatacagcagctgctgagagaaagagaagtaggcatccctcccgaacaatctctggaaactgccaaagccatcaaggagaaatactgctacatctgccctgacatcgtgaaggagttcgctaagtacgatgtggatcctcgtaagtggataaagcagtacaccggcatcaatgccataaatcagaagaaatttgtgatcgatgttggctatgagaggttcctcgggccagagatcttcttccaccctgaatttgcaaatcctgactttatggaatctattagtgatgtagttgatgaggtgatccaaaattgtcccatagacgtccgtaggcctttatacaagaatgtcgtcctctcaggaggctccaccatgtttagggactttggaagacgacttcagagggatttgaagagagtggtggacgctcgcctaagactgtccgaagaactttcgggaggacggattaaacctaaacctgtcgaagtgcaagttgtgacccatcacatgcagagatacgcggtgtggtttggagggtctatgttggcctcaactccagaattttttcaggtctgccacaccaagaaggattacgaagagtatggaccctctatctgtagacataatcccgtgttcggcgtgatgagctag

SEQ ID NO: 13876 - DNA, 1044 bp, Artificial Sequence
  Description of Artificial Sequence: Synthetic coding sequence
atggctgcagccgagcctgcaagctctggccagcaggccccagccggccaggggcagggacaacggccgccgccccagccacctcaggctcaagcgccgcaacccccgccccccccacaactaggcggtgccggtggagggtcaagccgtcacgagaaatcgctggggttgctcacaacaaagtttgtgagtctactgcaggaggcaaaagatggggtcctcgatctgaaagccgctgcagataccctggccgtgaggcagaagcggagaatatatgatatcaccaacgtgttggaaggaatcgatcttatcgaaaagaaaagcaagaatagtatccagtggaaaggggtaggggccggatgcaacactaaggaagttattgatcggctgaggtaccttaaagccgagattgaggacctggagctaaaggagcgggaactggaccagcagaagctgtggttgcaacagagcatcaagaatgtgatggatgattctatcaataaccgaaccttcagctacgtcacacatgaagatatttgcaactgtttcaacggcgacacactgctggcgattcaggcgccttccggtacacagctggaggttccaatccccgagatgggacagaacggacaaaaaaaataccagatcaatttgaagtcgcatagcggtcccattcacgtcttgctgatcaacaaagaaagcagctcatcgaagcccgtggtctttccagtgcctcctcccgacgacctgactcagcccagctcacagtccctgactcccgtcactccgcaaaaaagctccatggccacccaaaacctacctgaacagcacgtatcagagaggtctcaggcgcttcaacagacctctgctaccgacattagttcggccgggagtatttctggcgacattattgatgaactgatgagttctgatgtgttccccctcttgcggctgagccctacccccgctgatgactataacttcaacctggatgataacgagggcgtgtgcgacctttttgacgtgcaaatcctgaattattag

SEQ ID NO: 13877 - DNA, 636 bp, Artificial Sequence
  Description of Artificial Sequence: Synthetic coding sequence
atgtgccctggaaattggctgtgggcaagtatgacatttatggcccgcttctcccgttcatcatcgaggtctcctgtgaggacgcgtgggactcttgaagagatgcctaccgtccagcatccatttcttaacgtgtttgagcttgagagactactctatacaggaaaaacagcatgcaaccatgctgatgaggtatggccgggactgtatcttggtgaccaggacatggcgaacaacaggagggaattgcggagattgggaattacccacgttttaaatgcctcgcacagccgttggcgcggaacgcctgaggcttacgagggactgggtattcgttatttaggcgtggaggcccacgatagcccggccttcgatatgagcatccacttccagaccgccgccgatttcatccatagagctttgagccagcccggcgggaaaatcctcgttcattgcgcagtgggagtgtcccggtccgctacacttgtcctggcgtatcttatgctgtaccaccacctgacactcgtggaggccatcaagaaagtgaaggaccataggggcataattccaaatcgtggttttctgaggcaacttctcgctctggacagacggctccggcaaggtcttgaggcttag

SEQ ID NO: 13878 - DNA, 948 bp, Artificial Sequence
  Description of Artificial Sequence: Synthetic coding sequence
atgcctggcttgagctgtcggttttaccaacataaatttccagaagtggaagatgtagtcatggttaatgttaggtccatagccgagatgggcgcatacgtctccctgttagagtacaataacattgaagggatgatactcctgagtgagttatcacgccgtcggatccgatccattaacaagctgatcaggatcgggcgcaacgaatgtgtagttgtaatcagagtcgataaggagaagggttacatagatctctctaagagacgcgtgtcccccgaagaagcaattaaatgcgaagacaagttcaccaagagcaagactgtatatagtattcttcgtcacgtggccgaggtgctggaatacactaaggacgaacagttggaaagcctttttcaacgcaccgcttgggtgtttgacgacaagtacaaaaggccaggctacggagcatatgatgcattcaagcatgctgtctcagatccatccatcctcgattcactggatctgaatgaggacgagcgcgaggtactgatcaacaacataaaccggcggctcacgccccaggccgtcaaaatccgcgccgacatcgaggtggcatgctacgggtacgaggggatcgacgcggtcaaagaggcactgagagccggcctgaactgttccacagagaatatgcccattaagatcaatctgatcgccccaccaagatacgttatgactaccacaaccttagagaggactgagggtttaagcgtactcagtcaagccatggctgtcatcaaagagaagatcgaggaaaagagaggagtgttcaacgtgcagatggagcccaaggttgtgactgataccgacgaaacggagctggcgcgtcaaatggagaggctagagcgagagaacgctgaggttgacggggatgacgacgccgaggaaatggaggccaaagccgaggactag

SEQ ID NO: 13879 - DNA, 318 bp, Artificial Sequence
  Description of Artificial Sequence: Synthetic coding sequence
atggccggacaggaggacccagttcagagggagatccatcaggactgggccaaccgggagtacatcgagattatcacttcttctataaaaaagattgccgatttcctcaattccttcgatatgagctgtcgaagccggttggctactctgaacgagaaactgactgctttggaaaggaggattgagtacatagaagcacgcgtgaccaagggggaaaccctccgtacagtgccttgctgttgctgggaggtcgccctacacaataccggacacatgggcaaagccccagcagcctttagttcgtttttgtctccgtag

SEQ ID NO: 13880 - DNA, 1902 bp, Artificial Sequence
  Description of Artificial Sequence: Synthetic coding sequence
atggcagccgccgctgctgctgccaccactgccgcttgcagttcaggctcggcggggaccgacgcagcaggggccagtggattgcaacagccaccgccccagcctcagccccagcctgctgcagcagcacctgctcaaccacctccggagccaccccgaaagcctcgaatggatccaagaagacggcaagcagcattgtcttttctcacaaatatttcgttggacgggcggctgcctcctcaagacgctgagtgggggggcggagaagagggcggagctgctaagccgggagctgggggggcttgcggagctagaactaggttcagcctccttgcggctgccgaaaggggcggttgcatcgccctagcagcacccggtacccccgctgctggcctggctgctggatctggcccatgtttaccacagccgtcctcacttccccccctgatccccgggggccacgctaccgtttccggccctggcgtcgcacgcggttttgcctctccgctgggggctggtcgcgcttccggcgagcagtggcagccaccgcggcccgccccactcgccgcgtgtgcacagctccagttgttggacggatccggcgccgcaggccaggaagaactcgaggaagatgacgccttcatctccgtacaggtcccggccgcagcctttctcgggtcaggcacccccggtagtggaagcggttctcgtgggagactgaattccttcactcagggaatactgccgatcgcattctcacgacccacttctcaaaactactgcagcctcgagcagcctgggcaggggggctctacttccgcgttcgagcagctgcagcgctctcggaggagactgatatcccagagatcgtcactggaaactctggaggacatcgaggagaacgcccctctccgacgctgcagaacgctttctggatcacccaggcctaagaactttaagaagatccactttatcaagaatatgcgacaacacgacacccgcaatggacgtattgtgcttatctccgggcggcggtccttttgctcaattttctctgtgttgccttaccgcgacagtacccaggtgggagaccttaaactggatggtgggcgccagtcaaccggtgccgtatccctaaaagagataattggactggaaggcgtggagctgggagccgacggaaagacggtaagttacacacagtttttactgccgacaaacgcattcggagcccgacgcaacaccatcgacagcaccagcagctttagccagttccgcaacctctcccacagaagcttgtctatcggcagggccagcgggacacaaggttctcttgacactgggtccgatctgggggacttcatggactatgatcctaatctgctcgatgacccacagtggccgtgtggcaagcataagcgagtgcttatcttcccatcttatatgacaactgtgattgactatgtcaagccaagcgatctgaaaaaggacatgaacgagaccttcaaagagaaattcccccacattaagctcacactcagtaagatacgctcacttaagcgagagatgcgaaagctggcacaggaggattgcggacttgaagagcccaccgtggccatggccttcgtatatttcgagaaactggcactgaagggcaaactgaataagcagaaccgcaagctgtgtgcaggcgcttgtgtattgctcgcagctaaaattggctccgatctgaaaaaacacgaagttaagcacctgatagataaactggaggaaaagttcagactaaatcgaagagaactgatcgcctttgagtttcccgtgctcgtcgcattggagttcgcccttcatttgccagaacatgaagtgatgccccactatcgtaggctggtccagtcttcctag

SEQ ID NO: 13881 - DNA, 3423 bp, Artificial Sequence
  Description of Artificial Sequence: Synthetic coding sequence
atgaccactgcagtggaaagaaaatacataaacataagaaagcgactggatcagttggggtacaggcagacactgacagtcgagtgtctccccctggtggagaaattattcagcgatctcgtacacaccactgaatcattgcgtcaatctaaactaagtgcagtgaaagccgagaaggagtccgccaatttcgatttcgtgcttgaaccgtataaattggagaacgcacgactgtcacgagaaaacaatgaactgtatctcgagctgatgaagcttagagaacactcggatcagcatgtcaaagagctaaagacaagcctgaaaaagtgcgccagggagaccgccgatttgaagttccttaacaatcagtacgcccacaagctcaaactcctcgaaaaagagtccaaggccaagaatgagagaattcagcagttgcaggaaaaaaacctacacgctgtggtccagacccccggagggaaaaagagaagcatcgctttccgccggcagagaatgcagatcgacgaaccagtgccccccagcgaagtctctagctaccctgttccccagcctgacgatccgtacattgctgatctgctgcaggtagccgataaccgcatacaagaattgcaacaggaggttcaccaactccaggagaagcttgctatgatggaaagtggagtcagagattactcaaaacaaatcgaattgcgggagcgggagatcgagcgcctctctgtcgccctggacggcggcagatcacctgacgtcctgagccttgagagccgcaacaaaaccaatgagaaattgatagcgcacctgaatatccaggtcgactttctgcaacaggctaacaaggatctggagaagcggattcgtgaactgatggaaaccaaggagactgtgacgtcagaggtggtgaacttatctaataaaaacgagaagctgtgtcaggagctcacagaaatcgatcagctggctcagcagctggaacggcacaaggaggaggtgctcgagacggccgacaaagagctgggggaagcaaagaaagaaataaaacggaagctcagcgagatgcaggatcttgaagagacaatggccaaactgcagctcgaactgaatttatgccagaaggaaaaggaacgtttgtcagacgaactccttgtgaagtccgatttggagaccgtggtgcatcagctagaacaggaaaagcagaggctctctaagaaggtggaatcatttgccgtgaccgaacggcaattaacactagaagttgaaaggatgagactggagcatgggattaagaggcgggaccggagtccaagtagattggacaccttcttgaagggaatcgaagaggagcgggattattacaagaaagagctggaacgtctgcagcatattattcagagaagaagctgctcaacatcctacagtgcgagggagaaaagttccattttccgaactcccgagaaaggcgactacaacagcgaaatacatcagatcacaagggaacgcgatgaacttcagcgaatgctggaacgtttcgaaaaatatatggaggacatccaatccaatgtaaagcttctgacagctgaacgcgacaagctctctgtgttatacaatgaagcccaggaggagctctctgcactacgaaaagaaagcacccagaccaccgctcctcataacattgtaagtctgatggagaaggagaaggagttggccctctctgacctgcgtcgcatcatggcagagaaggaagctcttcgtgaaaaattggaacacatagaggaagtgtctttgtttgggaaatcagagttggaaaaaactattgaacatttgacatgtgtgaatcatcagctggaatctgagaagtacgagttaaagagcaaagtcctgattatgaaagagactatcgaaagcctggaaaacaaactgaaggtgcaggcccaaaaatttagccacgttgctggagacagctcacatcagaaaaccgaggttaacagcctgagaatagtgaatgaacagcttcagcggtcagtcgatgattaccaacatcgccttagcatcaaaaggggtgagttagagtctgcacaggcccagattaagatcctggaggagaagattgatgagctgaaccttaagatgacatcccaggatgaggaggcccacgttatgaagaagactattggcgtgattgataaggagaaagactttcttcaggagaccgtagatgaaaagaccgaaaagatcgccaaccttcaagagaatctcgcaaataaagaaaaagctgtggcacagatgaaaatcatgattagtgaatgcgaatccagtgtcaatcagctgaaagagacactggtgaatcgcgatcgcgaaattaattcactaaggaggcagctggatgccgcccataaggagctggatgaagtgggtagatcaagagagattgccttcaaagaaaaccgaagacttcaagacgatctggcgacaatggcacgggagaaccaggagatctccctcgaactcgaagcagctgttcaggagaaggaagagatgaagagccgtgtccataaatacatcactgaagttagccgttgggagtcccttatggcggcgaaggaaaaagaaaaccaagatctgctggaccgatttcaaatgctccataacagggctgaggactgggaggttaaggcccaccaagccgagggggagagctctagcgtccgacttgagctgctttccatagacactgagaggcggcatttgagggagcgggtggagctgctagagaaagagatacaggaacatatcaatgcacatcacgcttacgagtcccaaatctcatccatggcaaaggccatgagccgactggaggaggagctgcgacaccaagaggatgaaaaagccacagtattgaatgacttgagtagcttacgtgaactgtgtattaagctggattctgggaaagacatcatgacacagcagctgaactctaagaatttggagtttgagagagttgtggtcgaactcgagaatgtgaagagtgaaagcgacctgctgaagaagcaactatctaacgagcgacacaccgtgaagaatctggagtcccttctggctacaaaccgggataaagaatttcattcacacctgacatctcacgaaaaagacacggaaattcagctgctcaaggagaagttgactctgtcagaaagtaagctcaccagccagtcccgggagaacactatgttgagggccaaagtcgcacagctccagactgactatgatgcgcttaaacgtcagatctccacggagagatacgagagagagcgggcaatccaggagatgcgacggcacggcctcgccactccccccctctcctccactttacgtagcccctcgcactcacctgagcaccgcaatgtctag

SEQ ID NO: 13882 - DNA, 1512 bp, Artificial Sequence
  Description of Artificial Sequence: Synthetic coding sequence
atgccaaacgtggcagagaccgaacggtccaatgatagtggcaacggagaacacaaatccgagaggaagtctccggaggagaatttgcagggcgccgtcaagtcattctgcacctcagctagcggagctcccctgggacccaagggggacggccactatccatggtcctgccccgtgacccacacacgcgaaaaaatttatgctatctgtagcgactatgcatttctcaatcaggcaacgtctatctacaagacacctaatccctctcggtcaccgtgcctgccggattccaccagcctgagtgctggaaataactcaagcaggtacatcggcattccgactagtacctctgaaataatctacaacgaggaaaattctctggaaaacctgtcgaacagcctgggaaaattaccgttggcatgggaaattgataagagtgagtttgatggagtgaccacgaacagcaagcacaagtcggggaacgctaagaaacaggtatccaagagaaaaactagcgacaagaaagggaggtaccagaaagaatgcccgcaacattcccctctcgaggacataaaacagagaaaagtgctagacttgaggaggtggtactgtattagtcgacctcagtacaaaacgagctgcggcatttcttctctgatttcttgctggaacttcttgtattctacaatgggcgcagggaatctccctcccattacccaggaggaggccctgcatatactgggcttccagcccccctttgaagatatcaggttcggcccgttcacagggaatacaacactcatgcgttggttccgccaaatcaacgaccacttccatgtaaagggatgcagctatgtgttgtacaagcctcacggcaaaaataagaccgctggagaaaccgccagtggggctctcagcaaactgacgcgggggttgaaagatgagagccttgcttatatctaccactgccagaatcactatttttgtcctattggttttgaggcaaccccagtgaaggctaacaaagccttcagtagaggacccctttctccacaagaagttgaatattggatcctgataggcgagtcaagccgaaagcatcccgccatccactgtaagaagtgggcggacattgttaccgatctcaacactcagaaccctgagtacctggatatcagacatctcgagcgtgggttgcagtataggaaaaccaagaaggtgggcggcaacctgcactgcatcattgcatttcagagactcaactggcagcgcttcggactttggaacttcccgttcggcaccattagacaggaaagtcagcctcccacccatgcacagggcatagcaaagagcgaatccgaggataacatttccaagaaacagcacgggaggcttggcaggagctttagcgcatcctttcaccaggattctgcgtggaaaaaaatgagcagtattcatgagaggcgaaacagcggctatcagggatacagcgactacgatggtaacgactag

SEQ ID NO: 13883 - DNA, 813 bp, Artificial Sequence
  Description of Artificial Sequence: Synthetic coding sequence
atggaagctgaggaattggagcaggagagagagcagttacgcctgcagctctgggaagcgtattgccaggttaggtatctgtgctcccatctccggggtaatgacagcgccgactccgcggtaagcactgattcatctatggacgagagcagcgagacttctagtgctaaggatgtccccgcagggtctctgcggaccgctctgaatgaactcaaaaggctgatacagtccattgtggacggtatggaacctactggctccagacgattggacgatgacagcctcgaggaacagatccggcaaacatccgaggactccagggctctccgagagctgatggagggcgagaggggtaagctccgacagtcacttgaggaacttcagaggctccacagccaggtgaccctgctctctgtggagatgacggccttgaaggaggagcgggacagactaagagtgacgtccgaagataaagagccaaaagagcagctgcaaaaagcaattagggatcgggacgaagcaatcgccaaaaaaaatgccgtagaactggagttagccaaatgtcggatggacatgatgtctctaaactcccagctgctggatgccatccagcagaagctgaatttatcccagcagctagaggcatggcaagacgatatgcaccgagttatagaccgccaactaatggatacccatcttaaagaacgctctcagcctgccgctgctctttgtcgcggacatagcgccggacgcggtgatgagccttccatcgccgagggcaagcgcctgtttagttttttcagaaagatttag

SEQ ID NO: 13884 - DNA, 2379 bp, Artificial Sequence
  Description of Artificial Sequence: Synthetic coding sequence
atgttaccagccggcgaaatcggagcctccccagccgccccatgttgcagcgagtcgggagatgaaaggaagaacttggaagagaagtcggatatcaatgtaacagtcttaattggaagtaaacaagtctcagaagggacagataacggcgatctgccgtcctacgtcagcgctttcatcgagaaagaagttggaaatgaccttaagtctctcaagaaactggataaactcatagagcagcgtacagtctcaaagatgcagctcgaggagcaagttttaacaatctcgagtgagatcccgaaacgaatcagatcagcccttaagaatgccgaagaaagtaaacaattcctgaaccagtttctggagcaggagacacacctgttctctgcgatcaattcacatctgctgactgctcagccctggatggacgatttaggtactatgatctcccagatcgaggaaattgaaagacacctggcatacctcaagtggataagtcagattgaagagctgtccgataatatccagcagtaccttatgacaaacaatgtgccggaagcggcctctactttggttagcatggctgagctagacattaaactgcaagagtcatcttgtactcacctgctgggcttcatgagggcaaccgtaaaattctggcataaaatcctgaaggataaacttactagcgactttgaagagatcctggctcagctccactggccatttattgctccacctcaatctcagacagttggcctaagccgaccagcgtcagctccagagatatattcctatctcgagactctgttttgtcaactcctgaagctgcaaacaagtgacgaactgctgaccgaacctaagcagttgcctgagaaatactctctgcctgcttcacctagtgtgattctcccaatccaggtgatgctcaccccgctccagaagagatttcgctaccactttcggggtaacagacagaccaatgtcttgtcgaaacccgagtggtatctggcccaggtcctcatgtggataggtaaccacaccgagttcctcgacgagaaaatacagcccatccttgataaggttgggtccctggtcaatgccagacttgaattctctagggggctgatgatgctggttcttgagaagctggccacagacatcccctgtttgctgtacgacgataacctgttctgccatctggtggatgaagtgcttctgtttgagagggagctgcactctgtgcatgggtatccaggaaccttcgcctcctgcatgcatatactgtccgaggagacatgcttccagaggtggcttaccgttgaaagaaagttcgcgcttcagaaaatggattctatgctgtcgagtgaggcggcttgggtcagtcagtataaggatataaccgacgttgacgagatgaaagtaccagactgcgcggaaaccttcatgaccctcctgctcgtaatcacagatagatacaaaaatttacctacagcatcacgaaaactgcagtttcttgaattgcagaaagatctggtggatgatttccgaattcgtctcactcaggttatgaaggaggaaactagggctagcctaggattcagatattgtgcaattcttaacgcagttaattacatctcgactgtactggctgactgggcagacaatgtgttttttctgcagctgcagcaagctgcactggaagtgttcgccgaaaataacactctttccaaactccagctgggccagctcgcaagcatggaaagctccgtttttgatgatatgatcaatctgctggaacggctgaaacatgatatgctaacgaggcaggtagaccatgtattccgcgaggtcaaagacgccgccaagctgtacaaaaaagaaagatggctgtcactgccctcacaatccgagcaggccgtgatgtcattgtcgagcagtgcttgtcctcttctgctgactctgagggaccacctgctgcagctcgaacagcagctgtgcttctcactcttcaaaatcttttggcaaatgctggtggaaaaattggatgtgtacatctatcaagaaatcatactggctaaccacttcaacgaagggggggcagcacagctccagtttgatatgaccagaaatctgttcccgctttttagccattactgcaagcgtccagagaactacttcaagcatattaaggaggcctgcatcgtcctaaatctgaatgtcggttcggccctgctcctgaaagatgtcttacagtccgcaagtggtcagctgccagccactgcagccctgaatgaggtcggcatctacaaactggcccagcaggatgtggagatcttgctgaatcttagaaccaattggcctaacaccggtaaatag

SEQ ID NO: 13885 - DNA, 1068 bp, Artificial Sequence
  Description of Artificial Sequence: Synthetic coding sequence
gtgcgaggtgtccgcgcggccactgcggctgctgtcgctgccaccgcagctagcgggctttctaggagggaagccggaggccgagctggagcagcagccgccgtggtgaggcctccaggtaggaaatgcggcaggtgcagaaggcttgcaaactttccaggccggaaacgtcggcgtcgccgtcggaagggccttggggcaacgactggaggctgcggcgaagcagtgagttctctccatcctgctccacactctccttccagcgtgcgaccagccggacgacgcgccagacgccagagacggggagcgggaagcgcagagcggccaatgtctggggctggtgaggctctcgccccagggcccgttggtccccaaagagtcgctgaggccgggggcgggcagctgggatcaaccgcccaaggcaaatgcgataaggacaataccgaaaaagacatcacccaggcaacaaattcccactttacgcacggcgagatgcaggaccagtcaatctggggaaatccaagcgatggagaactaatcagaacacaaccacaaaggttgccgcagctgcaaaccagcgcacaggtacccagcggggaggagataggcaagattaaaaatggccatactggcctttctaacggcaatggtattcatcacggcgcaaagcacgggagcgccgacaatcggaagttgagcgcgccagtgtcccaaaaaatgcaccgtaagatccagtctagcctgagcgtgaactcagacatctccaagaagtctaaagtaaacgcggtgttttctcagaagaccgggtcctcccctgaggactgctgcgttcattgcatcttggcctgtctcttttgcgaattcttgaccctgtgcaatattgttttgggacaggcttcttgtggcatctgcacaagcgaggcttgctgctgttgctgcggagatgaaatgggcgacgactgtaactgcccgtgtgatatggattgtgggataatggatgcatgttgcgagtcctctgattgtctggagatttgcatggagtgttgcggaatttgctttccatcctag

SEQ ID NO: 13886 - DNA, 378 bp, Artificial Sequence
  Description of Artificial Sequence: Synthetic coding sequence
atgctgtcccgcctacttaaagagcatcaggctaagcagaatgagcggaaagaacttcaagagaaacggcggcgggaggccattactgccgccacttgtctgacagaggccctggtcgatcatttgaatgtaggagttgctcaggcctacatgaatcagaggaagttagatcacgaagtgaagacccttcaagtccaggcagcccagtttgctaaacagactggacagtggatcggtatggtcgaaaacttcaatcaagccttgaaggaaatcggagatgttgaaaactgggcaagaagtattgagctcgacatgcgcaccatcgcaacagccctggagtacgtttataaaggccagctccagagcgcaccatcttag

SEQ ID NO: 13887 - DNA, 2337 bp, Artificial Sequence
  Description of Artificial Sequence: Synthetic coding sequence
atgaccacacggcaggccacaaaggacccattacttagaggagtgtcccccaccccaagtaagattcccgtccgatcacagaagcgcactccctttccaacagtgacatcttgtgccgtcgaccaagagaatcaggatcctcggagatgggtacagaagcctccgctgaatattcagcggccactggtcgacagcgcgggtcctaggcccaaggctcgacaccaggcagagactagccaaaggctggtgggcatcagccaacccagaaatcccctggaggagctgagaccgtctccccgtggccagaacgttggtcccggacctcccgctcaaaccgaggcacctggcactatagagtttgtggccgatcccgcagccctggccaccatactctcaggggagggtgtaaagagttgtcatctaggcagacagccatctctggcaaagagagtgcttgtgcgtggcagccaaggaggcaccacgcagcgggtacagggggttcgcgcctcagcgtacctggctccacggacgcccactcacagactggatccagcacgcgcctcgtgctttagtcgcttagaggggccgggccctaggggtcgtaccctgtgcccccagcgactccaggccctgataagtccgagtggaccctcattccacccatccacaaggcctagttttcaagagctaagacgagaaaccgctgggtcaagccgcacaagcgtgtcccaggcttccggcctgctcttggagactcctgtgcagccagctttcagcctcccaaagggcgagcgtgaagttgttacccacagtgatgaaggaggggtggcctctctgggactggcgcagagggttcccctccgtgaaaatcgtgaaatgtcgcacactcgggattctcatgatagccatttgatgccatctcccgcacccgtcgcccaacccctcccaggacacgtggtgccttgcccctctccctttggaagagctcagcgggtgccctctcccggacctcctaccttgacctcctattccgttttgcggcgcctaacagtgcaacccaagactcgcttcacccccatgccttctacaccaagggtgcaacaagcccaatggctgcggggagtttcaccacagtcctgttctgaggaccctgcgctcccgtgggagcaggtggcagtccgactcttcgatcaggaatcctgcatccgcagtctggaaggatctggcaaaccccctgtggctacgccatcgggcccccacagtaatcgcacccctagcctgcaggaggtgaagattcaacggattggcatcctgcaacagcttcttcgtcaggaagtggaaggcttggtcgggggtcagtgcgtgcctttgaacggaggctcctcactggacatggtcgaactccagccacttctgacagaaatctcgcggaccctgaacgcgaccgagcacaacagcgggacatcccatctccccggcctgttaaaacactctggactgcccaaaccctgtcttccagaagaatgcggtgaacctcagccctgcccccccgccgagcccgggccgcccgaggcattttgtaggtctgagcccgaaattcccgagcccagtcttcaggaacagctggaggttcccgagccctacccaccagctgagccccggcctctcgagagctgttgcaggagcgaacctgagatccccgagtcaagtcggcaggagcagttggaagttcccgagccttgtcctcctgctgaacctcgtccacttgagagctactgcaggatcgaacccgaaataccagagtctagcaggcaagaacagcttgaggtacctgagccatgcccgcccgcagagcccggacccttgcagccctctacccagggtcagtccggtccacccggtccctgcccccgagttgaactgggtgcgagcgagccctgcaccctagagcaccgctcattagaatcaagcttacctccctgctgctcacagtgggcaccagccactactagccttatcttctcatcccagcatcccctctgtgcatcaccccctatctgctctctgcaatccctcagaccacccgctggccaggccgggctgtcaaacctggctcccagaacactcgctctgagagagcggttgaagtcgtgcctgacagccatccactgtttccacgaagctaggctggacgacgagtgcgccttctatacctctagggctccacctagcggacctactcgggtttgtactaacccggtggcaaccctgctggagtggcaagatgcactgtgtttcattccagtgggatctgccgcaccacaagggagcccctag

SEQ ID NO: 13888 - DNA, 1803 bp, Artificial Sequence
  Description of Artificial Sequence: Synthetic coding sequence
atgagctgccggtcctacagggtgtcatccgggcaccgcgttgggaacttctctagttgtagtgccatgaccccccagaacctgaacaggtttagggcgaactccgtgtcatgctggtccgggccaggcttccgtggactcggctcttttggatcgaggtcagtgatcacattcggtagttattccccaaggatcgccgccgttgggtctcgtccaattcactgcggagtgaggtttggagctggatgcgggatgggtttcggcgacggcaggggcgtcggactcgggccccgcgccgattcttgtgttggccttgggtttggtgcaggttccgggatcggctacggattcggagggcctgggttcggctacagggtgggtggcgtcggagtgcctgccgccccctccatcacggctgtaacagttaataaatccttattgactccactcaatttagagattgatcctaatgcccaacgggtgaagaaagacgagaaagaacagatcaaaaccctgaataataagtttgcgtccttcatcgataaggtgagatttctagaacaacagaataaattattagaaacaaaatggtcgttccttcaggaacaaaagtgcatccgcagcaatctggagccacttttcgagtcctatattactaaccttcggcgacagcttgaggtcctggtcagcgatcaagcccggcttcaagctgagagaaaccaccttcaagatgttcttgagggctttaagaagaagtacgaggaagaagtggtttgtagggcaaacgcagaaaacgaatttgtcgccttgaagaaagatgtggacgccgcgtttatgaataagagcgacctagaggccaacgtcgataccctaacgcaggaaattgactttttaaagactttgtatatggaggaaatccaattactccagtcccacatctccgagacatctgtcatcgtgaaaatggataactcacgagatctcaatctggacgggatcatagccgaagtgaaagcacagtatgaagaggtggctcgccgcagccgggccgatgccgaggcatggtaccagactaaatacgaagagatgcaggtgacggccgggcagcactgtgataacctacgaaatatccgcaacgaaattaatgagttaacccgactgattcagcggttgaaggctgagatcgagcacgccaaggcccagcgtgccaaacttgaagccgccgtggcagaagccgaacagcagggagaggccaccctatctgacgctaaatgtaaattggccgatctcgaatgcgccctgcagcaggccaaacaggacatggcgaggcagctttgcgaatatcaggagttgatgaatgcaaagctcgggttggacatcgaaatcgctacctacaggagattgctggaaggagaagaaagtcggctgtgcgagggcgtcggaccagtgaacatttcggtgtcgtcgtctagaggtggtctggtgtgtggacctgaacctctggtcgccggatctaccctgtccagaggaggcgttacattctccggctccagctccgtttgtgcaacatcaggcgtcctggcgagttgtggtccaagtctcgggggcgctcgcgtggcacccgccaccggggacctgcttagcaccggcacacggtcaggatctatgctgatcagcgaagcgtgtgttcccagcgtcccctgtcccctgccaactcagggcgggttctccagctgctcaggaggccggtcgtcatccgtcaggtttgtgtccacaactacatcttgcaggacgaaatactag

SEQ ID NO: 13889 - DNA, 1542 bp, Artificial Sequence
  Description of Artificial Sequence: Synthetic coding sequence
atgtcctaccattcttttcagccgggatcacggtgcggatcccaaagcttctccagctacagtgcagtaatgcctcgaatggtgactcactatgccgtatcaaaggggccatgccgaccaggcggcggtagaggcctcagggcgcttgggtgcttaggctcgcgaagcctatgcaacgtgggctttggccgcccgagagtcgcttccaggtgtggaggcaccttgcccggctttggctatcgcctgggcgccacatgcggcccttcggcttgtattacacccgtaaccatcaacgagtcactattggttcctctcgcactggagattgaccccacggtgcaacgggtgaaaagagatgagaaggaacaaatcaaatgtctaaataatagattcgcatcttttatcaataaggtgcgtttcctggagcaaaaaaacaaactcctggaaactaagtggaacttcatgcagcagcaacgatgttgccagacgaacatcgagccgattttcgaggggtatatctcagctctgaggcggcagctggactgcgtgagtggtgatagggtgaggctggaaagtgaactctgcagtttgcaagctgccctggagggatataaaaaaaaatatgaggaagagctctccctccgcccatgtgtggagaacgaatttgtggctctgaagaaggacgtggatacagccttcctaatgaaagcggatcttgagacaaatgcggaggctttagtccaggagatcgatttcctgaagtcgctgtacgaggaagagatttgcctcctgcagtcacagatcagcgagacttctgtcattgtgaagatggataactcccgcgagctagacgtggatggcattatagcggagattaaagcccaatatgatgacatcgcctcaaggtctaaagccgaggctgaggcctggtaccagtgtcgatacgaagaattgcgcgtgaccgctggcaaccactgtgataatctgcgaaaccgcaaaaacgagattttggagatgaataagctgattcaaagactgcaacaggaaaccgaaaacgtaaaagctcagaggtgcaagcttgaaggcgctatcgccgaagctgaacagcagggagaagcagccctgaacgatgcgaagtgcaaattggctgggctggaggaggctctgcagaaggccaagcaggatatggcatgtctcctgaaggaatatcaggaggtcatgaacagcaaactagggctggacatcgagattgcaacatatagacgcctgcttgagggcgaggagcacagactctgtgaagggattggacctgtgaacatctcagtatctagctcaaaaggggctttcctttatgagccatgcggagtaagcactcccgtgttatcaacaggggtacttaggtctaacggtggttgcagtattgtgggcaccggtgaactgtatgttccatgtgaaccccagggtctgttatcctgcggatcaggaagaaagtccagcatgactcttggcgcaggcggttcgtccccatcccacaagcactag

SEQ ID NO: 13890 - DNA, 1632 bp, Artificial Sequence
  Description of Artificial Sequence: Synthetic coding sequence
atgatgccaacgcccgtgattctcctgaaagaagggacggacagctcacagggaatccctcagctggtgtccaatatcagtgcctgtcaggtgatagcagaggctgttcgtacaacactcgggcccagagggatggacaagctcatagtcgacggaagagggaaggccaccatctctaatgacggcgctacaattcttaagctgttagatgtggtccaccccgcggccaagactttggtagacatcgccaaatcgcaagatgctgaagtgggggatggtacaacttccgtgaccttgctcgcagcagaatttctaaaacaggtgaaaccatatgtcgaggaaggcctccatccacagattatcatccgagcgtttcgcacagcaacccagctcgcggtaaataagattaaggaaattgccgtgaccgttaagaaagctgacaaggtggaacagcgtaagctcctggagaaatgcgctatgaccgctctgtcctctaagctgatttctcaacagaaggcgttctttgctaagatggttgtagacgcagtgatgatgctcgatgacctccttcaactcaaaatgattgggattaagaaagtgcaggggggcgcattagaggattctcagcttgttgccggagttgctttcaagaagacattcagctacgctggcttcgaaatgcagcctaaaaagtaccataatcctaaaatcgccctgctgaatgtggaacttgagcttaaggcggaaaaggacaacgcggaaattagggttcatacagtggaagactaccaagctatagtggatgcagaatggaacattctgtacgataaacttgagaagatccaccactctggggccaaagtggttttatcaaagctcccaatcggtgacgttgccacccaatattttgccgaccgcgacatgttctgcgccggtcgggtgccagaggaggatctcaagagaacgatgatggcgtgcggagggagcatccagaccagtgtaaacgcactgtccgcggacgtgctcgggcgttgccaggtatttgaggagactcagatcggcggggagaggtataacttctttaccggctgtcccaaggccaaaacatgtaccttcatcttacgtgggggtgcagaacagtttatggaggagacggagcgcagtctgcatgacgcgattatgatcgttagaagggccattaagaatgactcagtcgtcgccggcggcggcgctattgagatggaattaagcaaatatcttcgtgattattcccgcacaataccggggaaacagcaactgctgatcggagcatatgcaaaggctctggagattatccctcgccagctgtgcgacaatgctggctttgacgccactaacatattaaataagctgcgcgctcggcacgcacagggaggcacttggtacggtgtcgacataaacaacgaggacattgctgacaattttgaagcttttgtgtgggagccggcaatggtgcgaattaacgcgttgacagcagcttcagaagccgcttgtctgatcgttagtgtcgatgaaacgataaagaaccccaggagcactgtcgatgcccctaccgcagccgggagaggcagaggcagagggaggcctcactag

SEQ ID NO: 13891 - DNA, 1479 bp, Artificial Sequence
  Description of Artificial Sequence: Synthetic coding sequence
atggccccggtcggggttgaaaaaaagcttcttctagggcctaacggcccagccgtggccgccgcgggagatctgacatctgaggaggaggagggacagtccctgtggtctagtatactgagcgaggtgagtactcgggcaaggtctaaactgccgagtggcaaaaatatccttgtgtttggggaagatggatccgggaagaccacgctcatgaccaagctgcagggagccgagcacggtaagaaaggtcgggggcttgaatatctatacttatcagtccacgatgaggatcgcgacgaccatacacgctgtaacgtctggattctggatggagatctgtaccacaagggattattgaaatttgcggttagcgccgaaagcttgcccgagactttggtgatcttcgtcgcagacatgtcccgcccctggactgtgatggagagcttgcagaagtgggcaagtgttctgagggaacacattgataagatgaaaatcccacccgagaagatgcgggagcttgagaggaagttcgtgaaggacttccaggattatatggaacccgaagaaggatgtcagggctctccccagcggcgaggccccttaacctccgggtcagacgaagaaaatgttgccctgccccttggggataacgtgttgacacataacttagggatccctgtactggtagtctgcactaagtgtgacgcagtgagtgtgctcgaaaaggaacacgactatcgggatgaacatctcgatttcatacagtctcacctcagaagattctgcctgcagtacggcgctgcgcttatctacacgagtgtcaaagaggagaagaatctggatctcctctacaaatatatcgtccataagacctacggattccatttcacaacgcccgccctggtcgtggaaaaagatgcagtgttcattcctgcgggatgggacaatgaaaaaaaaattgccatcctgcacgaaaatttcacaactgtaaaaccggaggacgcttatgaggacttcatagtaaagcctcctgtgcggaaattagtgcacgataaagagcttgccgcagaggacgagcaggtatttctcatgaaacaacagtctcttctggctaagcagcccgcaacccctactcgggcctcagagtctcctgcacgcggaccatctggatcccccaggacacagggcagggggggccctgctagcgtgccatcatcgagccctgggaccagtgtaaagaagccagatcctaatattaaaaacaacgccgccagcgagggggtgctggcatcatttttcaactctctgctttctaaaaaaacaggcagccctgggagtccaggtgccggaggtgtccagtcaactgccaagaagtctggacagaaaaccgttctttccaatgtccaggaggagctcgatagaatgacacgaaagcccgatagcatggttacgaattcttcaaccgaaaacgaggcttag

SEQ ID NO: 13892 - DNA, 540 bp, Artificial Sequence
  Description of Artificial Sequence: Synthetic coding sequence
atggacaaagactttgacaagctccatgagttcgtcgagatcatgaaggagatgcagaaagatatggacgaaaaaatggatattctgattaacacccagaaaaactataaactgccacttagaagggcccctaaggagcagcaggagctcaggctgatgggtaaaactcacagggagccccagcttcgacccaagaagatggacggcgcctctggagttaacggtgctccatgtgcattgcacaagaaaaccatggcccctcagaagactaaacagggctccctggaccctctgcaccactgcggcacatgctgtgagaaatgccttctttgtgctttaaaaaacaactataaccgtgcggcgccactgaaagaggcacgccacctgcttactgcaaattccattgatccatccgccgccctggtacttctcattgaatttctgctcttaaccctggtgactggtgccgccgctcccggcttggatgcgtgcggacaccagcgtaatatgagggacgagattaactccgagagaaggtag

SEQ ID NO: 13893 - DNA, 3600 bp, Artificial Sequence
  Description of Artificial Sequence: Synthetic coding sequence
atggcatccgcaggcacccagcactactccatcggtcttaggcagaaaaactcctttaagcagtctggcccttccggcacggtacctgcgacccctccagaaaagccttccgaagggagggtgtggccccaagcacatcagcaggtaaagccaatttggaaattggaaaagaagcaggtagaaaccctgtcggcgggactcggcccagggttgctgggggtcccaccacaacctgcttactttttctgtcccagtactttatgctcatccgggactacggcggtgatagctggccacagttcttcctgctatcttcacagtttgccggatctctttaactccactctgctgtaccgacgcagcagttatagacagaaaccataccagcagttagaaagcttctgtctccgatccagtccatctgaaaaaagccccttctcactgccgcaaaagagtctgccagtaagcctgactgcaaacaaagctacttccagtatggtgttttccatggctcaacccatggccagcagtagcaccgagccttatctgtgcttggccgcagctggtgagaatccttctggcaagtccctggcctccgcaatttcgggcaagatcccatcaccactcagtagctcatacaagccaatgttgaataacaattcttttatgtggccaaactctactcccgtgccgctcctgcagaccacccagggcctgaaaccggtgagcccacctaaaatccagccggtttcctggcaccactccggcggcaccggagattgcgcaccccaaccagtggaccacaaagtgcccaaatctattggcacggtgccagcagacgcttccgcccacattgcgctgtccacggcttcctcgcatgacacttctactacttccgtggcctctagttggtataatcgcaataatttagctatgagagccgaacctctctcctgcgcgctcgacgacagctcggattctcaagatcccacaaaagagataaggtttactgaggccgttcgcaaacttacagcacgaggcttcgaaaaaatgcccaggcagggatgccagctagagcagtcttccttccttaatccttccttccagtggaacgttctgaaccggtccaggagatggaaacctcccgccgtgaatcagcagtttcctcaagaggatgctggctccgtcaggcgagtcctgcctggagcatccgataccctggggctcgataacactgtgttttgtaccaagaggatctccattcatcttttggcctcgcacgcatcgggactgaaccataaccctgcgtgcgaatcggtgatagacagcagtgccttcggagaggggaaagctccaggaccgcctttcccccagaccctggggattgcaaatgtcgctacccgactgagttccattcagttaggccagtccgaaaaggagaggcccgaggaggcccgtgagttggattcgagtgatagagatatctcctcagccacagatctgcagcctgatcaggcagaaacagaagatacagaagaagaactagtagatggtctggaggactgttgcagccgtgacgagaatgaggaggaggagggcgattcagaatgttctagtctgagtgcagtatcgccgagcgagagcgtggcgatgatttctcgcagctgcatggaaatccttactaagcctctttcaaatcacgaaaaggtggtacgcccagctctgatctacagcttgttcccgaacgtgccacccacgatctatttcggcacccgagatgaacgggtcgagaagctcccttgggagcagcggaagttactcaggtggaaaatgtctactgtgaccccaaacatcgtcaagcagacgatcggcaggtctcacttcaagatctctaagcgaaacgacgactggctcggttgctggggacatcacatgaaaagcccctcctttaggtctataagggaacatcagaagttgaaccatttccctggctcctttcagatcgggcgcaaggatcgcctctggaggaacttatcacgtatgcagagccgcttcggtaaaaaggagttctctttcttcccacaaagtttcatcctgcctcaggatgctaagctcctgaggaaagcttgggaatccagttctcggcagaaatggatcgtgaagccaccggcctccgctcgtggcataggcatacaggtcatccacaagtggtcccaactgccaaagcgaagacctctcctggtgcagagatatctgcacaagccttaccttatctcaggaagtaagtttgacttacggatctacgtttacgtaactagctacgacccactgaggatttatctatttagcgatggcctcgtgcggttcgcctcttgtaaatatagcccatccatgaaaagccttgggaataagttcatgcatctcactaactactccgtgaacaagaagaacgcagaatatcaagcaaatgcggatgaaatggcctgccaaggacataaatgggccctgaaggccctgtggaattacttgagtcagaaaggtgtgaactcagacgcaatttgggagaagatcaaggacgtggtcgtaaagaccattatctctagcgaaccctacgtgacctctctgctcaaaatgtatgtccggcgcccgtatagttgccatgagctctttgggtttgatatcatgctggacgagaatttgaaaccctgggttcttgaagtgaacatttcaccctcactgcattcctcaagtcctctggatatatcgatcaagggacagatgatccgcgatcttctgaatctcgcgggctttgtattaccaaacgcagaagacatcattagcagcccgtcctcctgtagcagctccacaaccagcctgccgacttctcctggcgataagtgccgtatggccccagagcatgtcaccgcccagaagatgaagaaagcttactacttaacgcagaaaatccctgaccaggatttctacgccagcgtgctcgacgtattgactccagatgacgtccgaatactggtggagatggaggacgaattttcccggcgaggtcagttcgaaaggatattcccttcgcacatctcctccagatacctcaggtttttcgagcagccgcgctacttcaacatcctgactacacagtgggagcagaaataccatgggaacaagctgaagggggtggacctcctgagaagctggtgctataaaggatttcatatgggtgtggtcagcgattcagccccggtgtggagcctgccaacatccttgctgactattagcaaggacgacgtgatccttaacgcatttagcaagagcgagacatcaaagttaggcaagcagtcctcctgcgaagtcagcctccttctcagtgaggacgggaccacccccaaatctaagaaaactcaggcaggtcttagtccatatccccagaaacctagttcctcgaaagattccgaggatacaagtaaggagccctctctctccacacagactttaccagtaataaagtgctcaggccagacgagcagactctcagcatcgagtacctttcagtcgatcagtgacagtctgctggctgtttctccatag

SEQ ID NO: 13894 - DNA, 2772 bp, Artificial Sequence
  Description of Artificial Sequence: Synthetic coding sequence
atgctgagaaggggtagccaagctttgagacgattttcaacaggccgggtttatttcaaaaataagttaaaactcgctctgattggacagtcgttgttcggccaggaggtgtacagtcacctgagaaaggagggacaccgggtggtcggcgtgttcaccgtccctgataaggatggtaaggcagaccccctggcccttgcggcggagaaggacggtacaccagtcttcaaactgcccaagtggcgggtaaagggtaagacaattaaggaggtggctgaggcttatcgttccgtcggcgctgaacttaacgtactccctttttgcacacaatttatccccatggacataatcgattctcccaaacatggctccataatttatcacccctccatacttccgaggcacagaggcgcgtcggcgatcaattggaccctcattatgggagacaaaaaagcgggattctcggtcttttgggcagatgacggtcttgataccggcccgattctcctgcagcgctcttgcgatgtggaacccaacgatacagtggacgctctttacaaccggtttctcttccccgagggcattaaggcaatggtggaggcagtgcagctcatcgccgacggaaaggcgcctagaattccccagcctgaggagggcgcaacgtacgagggtatccagaagaaggaaaacgccgaaattagctgggaccaaagtgctgaggtgctacacaactggattaggggccatgacaaagttcccggcgcttggacggagattaacggccagatggtgacgttttatggttcaacgctcttaaactccagcgtgcccccgggcgaacctctcgaaattaaaggagctaagaagcccgggctggtgacaaagaatggactggtgctcttcggcaatgacgggaaagctttgacagtgaggaacctgcaattcgaagatggcaaaatgatcccagcctctcagtatttcagcactggcgagaccagcgttgtggagttgacagctgaagaagtcaaagtcgctgagactattaaggtcatctgggccggcatcctctcaaacgtgcccataatcgaggacagtactgactttttcaaatccggagcctcatcaatggacgtcgcgcggcttgtggaggagattcgacagaagtgcggtggcctccaactgcagaatgaggacgtgtacatggcgacaaaatttgaagggttcatccaaaaggtggttagaaagctgcgcggcgaggaccaggaggtggagcttgtcgtggactatattagcaaagaggttaacgaaattatggtgaaaatgccatatcaatgcttcattaatggccaattcacggacgctgatgatggcaagacatacgatacgatcaaccctacagatgggtctacgatctgtaaagttagctacgcttccctggctgatgttgacaaggcagtggccgcagccaaagatgcctttgagaatggtgagtggggccgcatgaatgctagagagcgcggtcggctaatgtaccggctggctgaccttctggaggagaatcaggaagagctggcaaccattgaagcactggattctggtgccgtttataccctggccctgaagacccatataggcatgagcgtgcagacctttaggtattttgccggatggtgcgataaaatacagggttctaccatcccaataaaccaggcccggccaaaccggaatttgacgttcacgaagaaagagccactgggcgtgtgtgccattatcatcccatggaattacccactcatgatgttagcttggaaaagtgctgcttgtctggcagcaggcaacacgttggtccttaagccagcccaggttacgcctcttacggctttaaaatttgccgagctcagcgtaaaagccggattcccgaaaggtgtgatcaatattattccagggagcggaggcatcgcagggcagcggctgtcagaacatcccgacattcgcaagcttgggttcaccgggagcacccccatcggcaaacaaattatgaagtcctgtgcggtgagcaatctgaaaaaggtgagtctagaacttggtggaaagagccctcttatcatattcaatgattgtgaactagataaggcagtacggatgggtatgggagcagtatttttcaacaagggtgagaactgcatcgctgccggccgactctttgtggaagagtccatccacgatgagttcgtcacaagagtggtagaagaaattaaaaaaatgaaaatcggtgaccctctggaccgtagcaccgaccatggcccccaaaatcacaaagcccacctggagaaactactgcagtactgcgaaacaggggtgaaggagggcgccacacttgtgtacggcggaaggcaagtccagcgtcctggcttcttcatggagccaaccgtctttacggacgttgaggactacatgtacttggcaaaggaagagtcgtttggtcctattatggtgatttcaaaatttcagaatggcgacattgacggggtgctgcagcgcgctaatagcaccgagtacggcctggcgtctggtgtattcacacgggacattaataaggccatgtacgtgagtgagaagttggaggccggcactgtcttcatcaacacctataacaagactgacgtggcagctcctttcggcggggtgaagcaatctggttttgggaaggacctgggagaagaggccctgaatgaatatctgaagactaaaacagtcactctcgaatactag

SEQ ID NO: 13895 - DNA, 1323 bp, Artificial Sequence
  Description of Artificial Sequence: Synthetic coding sequence
atggaaggcgtactctacaagtggacaaactacctgtcaggatggcagcctcgctggttcctgctttgcggaggtattctgagctactatgatagccctgaggacgcgtggaaaggttgtaaggggtctattcagatggcagtgtgtgaaatccaggtgcactctgttgataacacccgcatggacctgattattcctggcgagcagtacttctatctaaaggctcgctctgtggctgagcgtcaacgctggctggtggccctggggtccgcaaaggcgtgcctgaccgattctcggactcagaaggaaaaagagtttgcagagaacactgaaaacttgaagacaaagatgagtgagctgaggttgtattgcgatctgttagtccagcaggtggataaaacgaaggaagtgactaccaccggagtgagcaacagcgaagaaggaattgacgtggggacattgttaaaatctacttgcaatacattcctgaagacactcgaagagtgtatgcaaatcgcaaatgcagccttcactagcgaactgctttataggacccctcctggcagtcctcagctggctatgttgaagtctagtaaaatgaagcatcctatcataccaatacacaactccctggaaaggcagatggaattgtccacctgcgagaacggcagtctgaatatggaaatcaatggtgaggaagaaattttaatgaaaaataagaacagcctgtacctgaagtctgcagaaatcgactgttcaatttccagtgaggagaatactgatgataatatcaccgttcagggggaaatcaggaaggaggatggaatggaaaacctgaagaatcacgataataacctcacacagagcggatcagatagtagttgttctcccgagtgcctgtgggaggagggtaaagaagtgatccccacgttcttttctacaatgaatacctccttctctgatatagaactgctcgaagacagtggaattcctaccgaagcttttttggcctcctgctacgctgtagttcctgtgctcgacaaattggggcctacagtatttgccccggtgaaaatggacctggtagggaatattaaaaaggtcaaccagaaatacatcaccaataaggaggaattcaccacactgcaaaagattgtcctgcacgaggtggaggctgacgtggcacaagtgcggaattcagcaaccgaggccctcctctggctgaagagggggctgaaattccttaagggcttcttaacggaggtgaagaatggcgagaaagacatccaaactgcattgcgcaatcctaccgagaatacgtag

SEQ ID NO: 13896 - DNA, 1272 bp, Artificial Sequence
  Description of Artificial Sequence: Synthetic coding sequence
atggcgatctgtcagttcttcttacaaggccgctgccgcttcggggataggtgttggaacgagcatcctggcgcccgaggagccggggggggccggcaacagccccaacaacagcctagcgggaataaccgcaggggctggaatactacaagccaaagatacagcaatgttattcagccatcctctttcagcaagtcgaccccttggggcggctcccgcgaccaggaaaaaccctactttagtagcttcgattcgggtgcaagcaccaaccgcaaggagggctttggcttgagtgaaaatccattcgcctccttgtctccagacgagcagaaggatgagaaaaagctgctcgaaggcatcgtgaaagacatggaggtatgggagtcttcaggacagtggatgttctcagtgtattccccagtgaagaagaagccaaatatttctggattcaccgacataagccctgaggagctgcggctggagtaccataacttcctgacctccaacaacctgcaatcatatctgaattccgtccagcgattgataaaccagtggcgtaacagggtcaacgagctgaaatccctgaacatcagtaccaaggtggccctgctgtctgacgtgaaggatggcgttaatcaggccgcaccggcctttggttttggaagcagtcaggcagctactttcatgtcacctggattccccgtgaataactctagttccgataatgctcagaatttctcttttaagactaactccggattcgcggcagcttcctccgggagtcccgccggtttcggctcctcccctgcctttggtgcagcggccagtaccagttctgggatttccacctccgcgcccgcatttgggttcggaaaaccagaggttacctccgctgcctccttctctttcaagtcccccgctgcaagcagctttggctcgcccggtttctctgggctgcccgcatctttggcgactggaccggtccgggctcccgtggctccagctttcggcggggggtccagcgtggctggctttggttcgcctggaagtcactcccacacggcttttagcaagccttcttctgatacgttcggcaatagttccatttccacatctctgtcagcctctagctccattatcgccacggataacgtgctgtttacccctcgtgacaaactaaccgttgaagagttggagcagttccagtccaagaagttcacactagggaagatccctctaaaaccacctccgctggagttgctcaacgtgtag

SEQ ID NO: 13897 - DNA, 1323 bp, Artificial Sequence
  Description of Artificial Sequence: Synthetic coding sequence
atgatggccgatgaagaagaggaagtaaagcctattctccagaaactgcaagaactggtggaccagctgtatagcttccgtgactgctactttgaaactcactcagtggaggacgctggcagaaaacagcaggatgtacagaaggagatggaaaagaccttgcagcagatggaggaagtggtggggtccgttcagggaaaggcccaggtgctgatgttgaccggcaaagcactgaatgtcacacctgactactctcccaaggccgaagaacttttgagtaaggccgtaaaattggaacccgaattagtcgaggcctggaaccagttgggggaagtctattggaaaaagggagatgtcgctgctgcccatacctgcttcagcggagccctcactcactgcagaaacaaagtatctctgcagaacctgtccatggtcttacggcaactgaggacagatacggaggacgaacattcacatcatgtgatggatagcgtgagacaggcaaagctagctgtacagatggacgtacatgacggccgctcatggtatatcctggggaactcttatctcagtctctatttcagcactggtcagaacccaaaaatttcacaacaggcactgagtgcctacgcacaggccgaaaaggtggatagaaaggcgtcttcaaaccctgatctgcatctcaaccgagcaacactgcataagtatgaagagagctacggtgaagctctggaaggcttcagccgagccgccgctctcgaccctgcttggcccgaacctagacaaagggagcagcaattactggaattcttggatcgacttacttcgcttttggagtccaagggcaaggtcaagactaagaaactccagtcgatgcttggatccctcagaccggcacaccttggaccctgcagcgatgggcactatcagtcagcatcagggcaaaaagttactctagaactaaagccgttgagcaccctacagccgggcgtcaattccggtgccgtcatcctggggaaggtggtcttttcactgacaacagaggaaaaggtgccatttacatttggcctcgtggattcagatggcccatgttacgctgtgatggtttacaacattgtgcagtcatggggtgtactgatcggcgacagcgttgctatacctgaaccaaaccttcggctgcacaggatccagcacaaaggaaaggattattctttcagctcagtccgcgtggaaactcccctgctgttggtggtgaacggcaagcctcaagggtctagtagccaggctgtggccacggtggcaagtagaccccagtgcgaatag

SEQ ID NO: 13898 - DNA, 1341 bp, Artificial Sequence
  Description of Artificial Sequence: Synthetic coding sequence
atggaagagaccatcaaggatcctccaactagcgcagtgctcctcgatcattgccacttctcccaagtgatctttaactctgttgagaagttctatatcccggggggagatgtgacttgccattacacattcacccaacacttcattcccaggcgaaaggactggataggcattttcagggtaggctggaaaactaccagggagtactacacttttatgtgggttaccttgccaatcgatttgaataacaaatctgccaagcagcaagaggttcagttcaaggcctactacctacctaaagatgacgaatattatcagttctgctacgtagatgaagatggagtcgtgaggggcgcctctatccccttccagttcagacccgagaatgaggaggatatcctggtggttaccactcagggtgaggttgaggagatcgagcaacacaacaaggagctttgcaaggagaaccaggaactgaaggatagctgcatttccctgcagaaacagaacagtgacatgcaggcggaactgcagaagaagcaggaggaattggagaccctgcaaagcatcaacaaaaaactggagctgaaggtgaaggaacagaaagattactgggaaactgagctattgcagctaaaggagcagaatcaaaaaatgagtagcgagaatgagaaaatgggaataagagtcgatcagctgcaggcgcaacttagcacccaggagaaagagatggagaagctggtgcaaggagatcaagacaagacagagcagctggagcaactgaaaaaagaaaacgaccatctattcctgtccctaacggagcagcggaaagaccagaagaagctggaacaaacagttgagcagatgaaacagaacgaaaccacagcaatgaaaaaacaacaggagctcatggacgaaaatttcgacttgtccaaacgcctgtcagagaatgaaatcatttgcaatgcactccagcgacagaaggagaggctggagggagagaatgacttgctcaagagagagaacagtcggctgctgtcatatatgggcctggatttcaatagcttaccataccaagtgcctacatccgacgagggtggggccaggcagaatcctgggcttgcttatggcaatccctactcagggatccaggaatccagctcgccctccccactctccataaagaaatgccctatttgtaaggctgatgacatatgcgatcatacacttgagcagcagcaaatgcagccactatgttttaactgtcccatctgtgacaaaatatttccagccactgagaaacagatctttgaagaccacgtgttttgtcactcactgtag

SEQ ID NO: 13899 - DNA, 1329 bp, Artificial Sequence
  Description of Artificial Sequence: Synthetic coding sequence
atggctctgcctggtgccagggctcgagggtgggctgccgcggctagagccgcccagcggaggcggcgtgtggaaaacgcaggtggctccccttcgcctgagcccgccggtcggcgagccgccctgtacgtgcactggccttactgcgaaaagagatgctcttactgcaactttaacaagtatataccccgtcgactggaagaggccgctatgcagaagtgtctcgtgactgaggcccagaccctgctcagattgtcaggtgttcaaagggtcgagtcagttttctttggaggggggacacctagcctggctagtcctcacaccgtggcggctgtgcttgaagccgtggcccaggccgcccatttgccggctgatttagaggttactctggaagccaaccccacctcagcacccggcagcagactggcggaattcggcgctgcaggagttaataggctgagcattggattgcaaagcctggacgatacggaacttcgtctgctaggtaggacccatagcgcctgcgatgccctgcgtacattagctgaggcacggaggttatttccaggacgagttagtgtggaccttatgcttggcttgcctgcacaacaggtgggaccttggctggggcagcttcaggaactgctgcaccattgcgatgatcacctctccctctaccagctgagcctcgagcgagggacagcattatttgctcaggtgcagcgtggggctctgcccgccccggaccctgaactcgccgcagagatgtatcagcggggccgagccgtcttacgagaagctggctttcaccaatacgaggtgtccaactttgctaggaatggtgctctgtccacccacaactggacgtactggcagtgcggccagtacctgggggttggacctggagcccatggtcggttcatgcctcagggagccggaggtcacactcgagaggcacgcattcagaccttagagcctgataactggatgaaggaagtcatgctgttcggccacgggactcgcaagcgagtgcccttggggagactcgagctcctcgaagaggtgctggctctaggcctgcggactgacgtcggtattactcatcagcattggcagcagttcgaaccccaattgactctttgggacgtctttggggccaataaagaggttcaggaactgttagaacgaggactccttcagctggaccatcgtggccttaggtgtagttgggagggactcgcagttctagattccctactccttacactattaccacaattgcaagaagcctggcagcagaggacgccgtcaccagtcccaggagggtag

SEQ ID NO: 13900 - DNA, 1278 bp, Artificial Sequence
  Description of Artificial Sequence: Synthetic coding sequence
atggacaagaacataggcgaacaattgaacaaagcttacgaagcttttagacaggcctgtatggaccgggattccgcagtgaaggagctgcagcaaaaaacggaaaattatgaacagcggattcgagagcaacaggagcagttatccttgcagcagactataatcgataagctcaagtcccagctcctgttggtgaacagcacccaggacaataactacgggtgtgttcccctgctcgaggacagcgagacccgcaagaataatcttaccttagatcaacctcaggacaaggtgatcagcgggattgcacgcgagaaattacctaaggtacggcggcaggaggtcagtagtccccggaaagaaacaagcgccagaagcttaggcagccctcttctgcacgagcgtgggaacattgagaagacattttgggacctcaaggaagagttccacaagatatgcatgctggccaaagcacagaaagatcacctttccaagttaaacatcccagatacagctaccgagactcagtgcagtgtccccatccagtgcactgataagacagataagcaggaggctctgttcaaaccgcaggctaaagacgatattaacagaggcgctccgtccattacttccgttacacccagaggactgtgtcgcgatgaggaggatacatcattcgaatccttgtccaagttcaacgttaagtttcctccaatggacaatgacagtacctttctccacagtactcccgagaggcctggcatcttgagtccagccacctcagaagccgtttgccaggagaagtttaatatggagttcagagataacccagggaactttgtgaaaactgaagaaaccctttttgaaatacagggcatcgacccaatagcctcggcgatacagaatttgaaaaccaccgataaaacaaaaccttcaaacttggttaatacatgcattcgcacaacattggacagagctgcctgcctccccccaggcgatcacaatgccctgtatgtaaactcgttccccctgcttgatccctctgatgctccgttcccctccctggactcaccgggtaaagccatccgaggtccccagcagccaatttggaagcctttccctaatcaggacagcgattccgtggtgctgtctggcactgatagtgagctccatatcccccgggtgtgcgaattttgccaggcggtgttccctccaagtatcacctctcgcggcgatttccttaggcaccttaacagtcactttaacggggagacctag

SEQ ID NO: 13901 - DNA, 2055 bp, Artificial Sequence
  Description of Artificial Sequence: Synthetic coding sequence
atggaaaacctgcagacaaacttcagccttgtgcaaggatccaccaagaagctaaatgggatgggggatgacggatccccaccagccaagaagatgatcacggacattcacgctaatggcaaaactattaataaagtgcccacagtcaaaaaagagcacttggacgattatggcgaggctcccgtggagactgacggagagcatgttaagcgcacctgcaccagtgttcctgagactctgcacctgaaccccagtctgaaacacaccctcgcccaattccacctgtcctctcagtccagtttaggcgggccagcggcatttagcgctcgccactcccaagagtcaatgagccccaccgtgtttctgccactgccttcaccccaggtgctgccaggaccccttctaatcccatctgactcatccacagagctcacacagacagtactggagggggagtccatcagttgctttcaggttggcggcgagaaacggctgtgcttgccacaagtgctaaattccgtgctacgggagttcaccctgcaacagataaataccgtctgcgatgagctttacatatattgtagtcgatgtacttcagatcagttacacattcttaaagtactgggcatcctgcctttcaacgccccctcttgcggcctgatcacgctcaccgacgcccagcggctttgtaacgcactgctgcgccccaggaccttcccacagaacggttccgttctgcctgccaagtcaagcctggctcagcttaaggagaccggctccgctttcgaagtcgagcatgaatgtcttggcaagtgccaaggtttatttgcaccccaattttacgtgcagcctgatgccccctgcatacaatgcctcgagtgctgcggaatgttcgcgcctcagacattcgtgatgcatagtcatcgtagcccagataagcgaacgtgtcattggggcttcgaatcagccaaatggcattgctacctgcacgtgaatcaaaaatatctcggcacaccggaggagaagaaattgaagataatactcgaggaaatgaaggagaagtttagtatgagaagcgggaagcgcaatcagtctaagactgacgctccgtccggaatggaacttcagtcatggtaccccgtcatcaagcaggaaggggaccacgtatcccagacacactcatttttgcatccctcctattacctttacatgtgtgataaagtcgtcgctccaaatgttagtctaacaagtgccgtctcccagtcaaaggaattgacaaagactgaggcctccaaatctatttcgagacagtctgagaaggcccattccagcggaaagttacagaagaccgtgagttatccagacgtaagcctggaagaacaggaaaaaatggatcttaaaacttcgcgcgaattgtgctctcgcctggacgccagtatttcgaacaactccactagcaaaagaaaaagtgaaagtgccacctgcaatctggtcagggacatcaataaggttggaatcggcctagtagcggccgccagttcacctctcttagtgaaagacgtcatttgcgaggacgataagggcaagattatggaggaggtcatgaggacatatcttaaacagcaggagaagctaaatttaatccttcaaaaaaagcaacaactgcagatggaagtgaagatgctatcctcttccaagagtatgaaggagctcacagaagagcaacagaacttgcagaaggaactggaatcactgcagaacgagcacgctcagcgcatggaggaattttacgtagaacagaaagatttagagaaaaagctggagcagatcatgaagcagaaatgtacctgcgacagcaacctcgaaaaggataaagaagctgagtatgcagggcagctggccgagttaagacagcggctcgaccatgccgaggcagaccgacaggaattgcaggatgagttgaggcaggagagggaggcacgccaaaaactcgagatgatgatcaaggaactcaaactccaaattctcaagagcagtaagactgcgaaagagtag

SEQ ID NO: 13902 - DNA, 1080 bp, Artificial Sequence
  Description of Artificial Sequence: Synthetic coding sequence
atgtcctaccgcagggaactcgaaaaatatcgggacttagacgaagatgaaattttgggagctctgacagaagaggagctgcggacactcgagaatgaactcgatgaactcgaccctgataacgctttattacccgcaggtctgaggcagaaggaccagactactaaggcacctacgggcccgttcaagagggaagaattgctcgatcatctggaaaaacaggccaaagaattcaaggacagagaggaccttgtcccctatactggcgaaaagcggggcaaggtgtgggtgccaaagcagaaacctttagatccggtgctcgagtctgtgaccttggaacctgaattagaggaggccctggccaacgcctcagacgctgaactatgcgacatagccgccatattgggcatgcacacactgatgtctaatcagcagtactatcaggcgttaagcagcagctctattatgaataaagagggcctaaactccgtgatcaagcctactcagtacaagcctgttccagacgaagaaccaaactctactgatgtagaagaaacactggagcgtatcaaaaataatgaccctaagttagaagaagttaacctgaataatattaggaacattcccatccctactctgaaagcgtatgctgaggctctgaaggaaaatagctatgtcaagaagttttctatcgtgggcacgaggtctaacgacccagtcgcatacgcactggcggaaatgcttaaggaaaacaaagtgttgaaaaccctgaacgtcgagtccaattttattagtggtgccggcatcctcaggctggtggaagccctgccatacaacacaagtctagttgagatgaagattgacaaccaaagccagcctttaggtaacaaagtggagatggaaatcgtgtccatgcttgaaaaaaatgcgactctcctgaaatttgggtaccacttcacacagcaagggccccggcttagagcctctaatgccatgatgaataataatgatttagtcagaaaaaggagattggccgatctcaccggtcctattatccctaagtgcaggtccggcgtgtag

SEQ ID NO: 13903 - DNA, 1941 bp, Artificial Sequence
  Description of Artificial Sequence: Synthetic coding sequence
atggaggagagaggctcgccggacggtgacctggctcgttccctggaacaagggccagaaggccccgagactccaatccaggtggttctgagagtcagacctatgtcggcagcagaattgcgacgaggccagcagtctgtgctacactgttctggaactcggactctgcaggggggccccgaggtagcgtttcgcttcggcgccgttctcgatgcggccagaactcaggaggatgtgttccgtgcctgtggcgtgcgccggctaggggagctggctttgcgcggcttttcatgtacagtgttcacctttggacagaccggttctggcaaaacctatactcttaccggccctcctccccagggtgagggggtgccagtgccccccagcttggccggcatcatgcagcggacgttcgcttggcttctggaccgggtgcagcacctgggtgcccccgtgacgctacgcgcaagttaccttgaaatttataatgaacaggtgagagaccttctgtccttgggcagtccacggcctctgcccgtcaggtggaacaagacccgcggattctatgtggaacagctaagagtggtggaattcgggtcactagaagcactcatggagctgctccaaacgggcctgtccaggcggaggaattcggctcatacattgaaccaggctagttctagaagtcacgctctgcttactctctatatttcgagacagacagctcaacagatgccttctgtggatcctggggaacccccggtcggggggaagctctgttttgttgatctcgccggctcagaaaaagtggcggctaccgggtcccggggggaactgatgctggaggcgaactctatcaatcggtctctactcgccctgggccactgtataagtctgcttctggacccgcagaggaagcagtcccacatcccttttagagactctaaactgaccaaacttctcgccgactcactcggaggacgcggagtcacgctaatggttgcctgcgtaagtcccagcgcccagtgtctgcctgaaacactatcaacactgcgatacgcaagccgggcccagagggtgaccactagaccacaggcccccaagtcaccagtcgccaagcagccccagaggcttgagacagagatgttgcagctgcaggaagagaatcggaggcttcaattccagctcgatcagatggactgcaaggcctccggcctctcaggcgcccgggtggcctgggcccagcggaacctgtatggaatgttgcaggagttcatgttagagaacgagcgactgcgaaaggaaaaatcacagctccaaaacagtcgggatctggctcaaaatgagcaacggatactagctcagcaggtccacgcacttgaaagaaggttattaagtgcttgttatcatcaccagcaggggcccgggcttacccctccatgtccatgtttgatggcacctgccccaccctgtcatgccctgccacctttgtactcctgcccttgttgtcacatttgtccgctttgccgggtgccactagcgcattgggcatgcctaccaggagagcatcacctaccccaggtgctcgacccagaagcatcaggggggagacccccgtcggccaggccgcctccttgggctcccccctgttctcccggcagcgccaagtgcccaagagagcgctctcattctgattggacccagactagggttctcgccgaaatgttaactgaggaggaagtagttccgtccgctcccccactacccgtgagacccccgaaaaccagccccgggctgcggggcggcgcaggagtgcctaacctcgcccaacgcctggaggcattgcgagaccagattgggtcatccctgaggagaggccgctctcagccgccttgtagtgagggtgccagatcacccggccaagtgttgcctcctcactag

SEQ ID NO: 13904 - DNA, 462 bp, Artificial Sequence
  Description of Artificial Sequence: Synthetic coding sequence
atggcacgaaacaccctgagttcgaggttccggcgcgttgacatcgacgagtttgacgaaaataagtttgtggacgaacaggaggaggccgccgctgcggccgcagaaccagggccagatccatcagaggtcgacggcttgctgcggcagggtgatatgctccgcgcttttcacgccgctcttcgaaacagtccggtgaataccaagaaccaggctgtgaaggagcgggcacagggggtggtgttgaaggtgctgacgaactttaaatcctccgagatcgagcaggccgtacaaagcttggatcggaacggcgtcgacctgctcatgaaatacatttacaaaggcttcgagaagccgactgaaaactcttccgccgtcctgctgcagtggcatgagaaagccctggcagtcgggggcctagggtcaattattcgcgtactcacagctagaaagactgtctag

SEQ ID NO: 13905 - DNA, 3318 bp, Artificial Sequence
  Description of Artificial Sequence: Synthetic coding sequence
atggctgcaacggctagcgccggagtacccgccacagtgtccgagaagcaagagttctatcaactgctgaaaaacctgatcaacccaagctgcatggtgaggcgccaggctgaggagatctatgagaatatacccggtctgtgcaagactacttttcttttggatgcagtgcgaaatcgacgggcaggatacgaggtgcggcagatggctgccgctttactccggagactgttgtcttctggtttcgaagaggtatatccgaaccttcctgcagacgtccagcgggacgtaaaaattgaactcattctggcagtgaaactagaaacacacgcctccatgagaaagaaactatgcgacatatttgctgttcttgcaaggaaccttatcgatgaagacgggaccaatcactggcccgaaggtttaaaatttctgatagactcgatctatagcaaaaatgtggtcctgtgggaagtggccctccacgtgttttggcactttccaggtatattcggcacccaagaacggcatgacttggatattatcaagcggctgctggatcagtgtattcaggatcaagagcaccccgccattagaactctgtccgctagagcggctgcagcattcgttctggccaacgagaataacatagcgttatttaaggacttcgcggacctgctgccaggcatccttcaggccgtgaatgactcttgctaccaggatgatgacagcgtgctggaatcactggtcgaaattgctgatacggttcctaagtacctgggaccgtatctggaggacacattgcagctctcactgaagctgtgcggagattcgaggctctcgaacctgcagcgccagctggccctggaggtaattgtgactctgtccgaaaccgccacgccaatgctgaaaaagcacaccaatattatcgcccaggccgtgccgcacatcctggcgatgatggttgacctgcaggacgacgaggactgggtgaacgcggacgagatggaggaggacgatttcgattcaaacgctgtggcagcggaatcagcactcgacagactggcctgtggtttgggaggaaaagttgtgctgccaatgaccaaggagcatattatgcagatgctccagagtccagattggaaatacaggcatgccggcttgatggctttatcagccattggggaaggctgtcatcaacaaatggagtccatcttggacgagacggttaattcagtgctgctcttcctacaggacccccaccccagggtgagagccgcggcgtgtacaaccctgggccagatggccaccgactttgccccaaacttccagaaaaagttccacgagacagtcattgcagcactgctgagaacaatggagaaccaagggaatcagcgggtgcaatcacacgcagcctccgctctcatcatattcatagaggattgtccgaagagcctgctggtcctgtatgtcgactccatggtaaaaaacctccacagcgtgcttgtgatcaaactgcaggaactgatccgcaatggcaccaagcttgccttggagcagctcgtgacgaccatcgcgagcgtggcggatacaatcgaagagaagtttgtaccctactatgacatcttcatgccaagtctgaagcacatcgtcgaattagctgtgcagaaggagctgaaactgctgagggggaagactattgaatgcatctcacacatcggcctggcagttgggaaggagaagttcatgcaagatgcgtcgaacgtgatgcagctgctgttgaaaacccagtcagacctgaataacatggaagacgatgatcctcaaacatcatacatggtcagcgcctgggcacgtatgtgtaagattctgggaaaggacttccaacagtatctgcctctggtcatcgaaccccttattaagactgccagcgccaagccagatgtcgctttgctcgacactcaagacgttgagaacatgtctgatgacgacggatggcagttcgtcaatcttggcgatcagcagtcattcggcatcaagacctctggcttggaagccaaggcgacagcttgccagatgctcgtctactacgcaaaagaactgagggaaggcttcgtggagtacactgaacaagtcgtcaagctcatggtcccactgctaaaattctacttccacgacaacgttcgcgtggccgccgccgaaagcatgccctttcttttagaatgtgcacggatacgagggcctgaatacctagcccagatgtggcaatttatatgcgatccactgataaaagcgatcggcacagagccggacaccgatgtcctgagcgagattatgaattcattcgctaaaagcattgaggttatgggcgacgggtgccttaatgacgagcacctggaggaactgggaggaattctgaaggcaaagttagaaggccacttcaagaaccaggaactaagacaggtcaagcggcaagaggaaaattatgaccagcaagtggagatgtcacttcaggatgaggatgagtgtgacgtttacatcttgactaaagtcagcgacattctgcactcattgttttctacgtacaaagagaagatcctgccttggtttgagcaattactgccgctcattgttaacctgatctgcagctctaggccttggccggacaggcagtggggactttgtatctttgatgatatcattgagcactgtagccctacgagctttaagtacgtggagtacttccggtggcctatgctcctgaacatgagggataacaaccctgaggtgagacaggccgcagcctatggcctgggcgtaatggcccagttcgggggagatgactaccgatccctctgtagtgaggccgttccactgctggttaaagtgatcaagtgtgctaattccaagactaagaagaatgtgatagctactgagaattgtataagcgcaatcggcaaaatactgaagtttaaacctaactgcgtgaacgtggacgaagttctgccccactggctgtcctggctaccgctgcacgaggataaggaggaagctatccaaactctttctttcctatgcgacctcatagagagtaaccaccctgtggtcattgggcctaataactccaaccttccgaagatcatcagcattatcgctgaggggaagatcaacgagaccattaactacgaagacccctgtgcaaagaggctggcgaatgtggttaggcaggtccagacctctgaagacctgtggctcgagtgtgtctcacagctggatgatgagcaacaggaagcgcttcaggaactgctgaacttcgcctag

SEQ ID NO: 13906 - DNA, 1914 bp, Artificial Sequence
  Description of Artificial Sequence: Synthetic coding sequence
atggaggttaccggttttggagtcaccaggcctggcaaagtgcctcaggccaggatgtctggactcgtcctgggacagcgggatgagcctgccggacatcgcttgtcccaggaggagatactggggtctactcggttggtgtctcagggcttggaagctctgaggagcgagcatcaggcagtcctccaatccctgagtcagactattgagtgtctgcaacaggggggtcacgaggaaggcttggtgcacgaaaaagcccgccagctgcgcaggagcatggagaacattgaattgggcctgagcgaggcccaggtgatgctcgctctggctagtcacctatctacagtcgagagcgaaaaacaaaagttgcgcgctcaggtgcgacgtctgtgtcaggagaaccagtggctgagagatgagcttgccggaacccagcaaagactgcagagaagcgagcaggctgtggcccagttagaagaggagaaaaagcatctggagttcctcggacagctgaggcagtatgacgaggacggacacacatccgaggagaaggaaggcgatgctacaaaggatagcttggatgatttatttcctaacgaagaggaggaagacccctccaatggtttgagccgcgggcagggtgcaaccgcggcccagcagggcggttatgaaatcccagcaaggctacggactttgcacaatctggtaatccagtacgccgcccaaggccgttacgaggtagcagtgcccctgtgtaagcaggccttagaggacctagagcggactagcggacggggccatccagatgtggctaccatgctcaacatcctcgcgcttgtctacagagatcagaataagtacaaggaggcagcccaccttctcaacgacgcactgagtattcgggaatcaaccctcgggcctgatcatcccgccgtggcagccaccctgaataacttggctgtcctttacggcaaaaggggcaagtacaaagaggccgaacccctgtgtcaacgggctctggagatacgcgagaaagtgttgggtaccaatcatccggatgtggcaaaacagctcaacaatctggcactgctgtgccaaaatcaaggaaaatatgaagcggtcgagaggtactaccagagggccctcgcaatttacgaggggcagctgggacctgacaacccgaacgttgctcggactaaaaacaacttagctagctgctaccttaagcagggtaaatatgccgaggccgagactctctacaaagagatcctgaccagagctcacgtgcaagaatttgggtctgttgatgacgaccataagcctatctggatgcacgcggaagagcgggaggagatgtccaaatcccggcaccacgagggaggaactccctacgcagagtacggtggatggtacaaagcttgcaaggtttcatctccgacggttaacactactcttcgaaatctgggcgcactttatcgcaggcagggaaaactcgaggctgctgagactctggaagagtgtgcccttagatctaggcggcagggaaccgaccccatttcacagaccaaggtcgccgagctgctcggggagtctgacggacgacgtacatctcaagaaggccctggtgactccgtgaagttcgagggcggagaggatgccagtgtagccgtggaatggagcggcgacggcagcgggactctgcagagatctggtagcctggggaaaatccgggatgttctgagaagaagtagcgaacttctagtgcggaaactgcaggggactgaaccccggcctagctcaagtaacatgaagagagccgcctccctcaactacctcaatcagccttcagccgcgcctctccaggtttctaggggactctcagcatcaacaatggacctgtcatctagttcttag

SEQ ID NO: 13907 - DNA, 3966 bp, Artificial Sequence
  Description of Artificial Sequence: Synthetic coding sequence
atgcagtgcctggctgccgcacttaaagacgagacgaacatgtccggaggaggagaacaggcagatatcttgccagccaactatgtggtaaaagatcgttggaaggtgcttaaaaagataggtggcgggggcttcggggagatttatgaggccatggacctgcttacccgggagaatgtcgcactgaaggtggagagtgcccaacagcccaaacaggtcctcaagatggaagtggccgtactgaaaaagctgcagggcaaggatcacgtgtgtcggttcatagggtgtgggaggaatgaaaagttcaactacgtagtgatgcagcttcaagggcggaacctggctgaccttagacgaagccagcctagagggactttcaccctatctactacgcttcggcttggaaagcagatattagagagtattgaggccatccactcagtcggttttttgcatcgggatattaaaccctcaaactttgccatgggtcgtttgccttctacctaccgcaagtgttacatgctggactttggcctagctcgccagtataccaacactactggcgatgtgcgacccccaagaaacgtggccggttttagagggacagtacgctatgcctctgtcaatgctcataagaatagggaaatgggcaggcacgacgatttgtggagcctgttttacatgctggttgaattcgctgtgggccagttgccgtggcggaagatcaaggacaaagaacaggtggggatgatcaaggaaaagtacgagcaccggatgcttctgaagcacatgcccagtgaatttcacctgttcctagatcatatcgcttccttggactattttaccaaacctgactaccaactgattatgagcgtctttgagaactctatgaaggagcggggaattgcagaaaatgaagcgttcgactgggagaaggctggcactgatgcgctcctctccacaagcaccagcactcccccccaacaaaacaccaggcagaccgctgccatgtttggagtggtgaacgtcacaccagtccccggggatttgcttcgggagaacaccgaagacgtgctgcagggggagcatctgtccgaccaggagaatgctcctccaattcttcctgggcggccaagcgagggattagggcccagtccccacctagttccccacccgggtggaccagaagctgaggtctgggaggagactgacgttaatcggaacaaattgagaatcaatattggcaaatcgccgtgtgtggaagaagagcagtccaggggaatgggagtgccttccagtccagtccgtgcgccacccgactcacctactaccccagtccgctctctgaggtaccgcagagtcaacagccctgagagcgagagactgtcgaccgctgatggacgggtggaactccctgaacgcagatcccgcatggatctgcctggcagtccctcccgtcaggcatgctcatctcaaccggcccagatgctctcagtcgatacaggccacgctgaccgccaggccagcggcaggatggacgtgtccgcatccgtcgaacaggaagccctgtcaaatgccttcaggagtgtgcctttggccgaagaggaggatttcgactccaaggagtgggtcatcattgataaggagacggaattgaaggatttccccccaggagctgaacccagtactagtggcacaaccgacgaggagcccgaggagctgcgtccactccctgaggaaggcgaggagaggcggcggctcggagccgagcccacagtcaggcccaggggtcgctcaatgcaggccctggcagaggaggacctgcagcacctgcccccccagcccctgccaccacagctgagccagggcgatggtaggtccgaaacctcccagcctcctacacccgggagtccctctcatagtccactgcattccgggcccagacctaggcgacgcgagagtgatccaacgggtccccagcgacaggtgtttagcgtcgcacctccttttgaagtgaacggattgcccagggccgtgcctctgagcttaccttaccaggactttaagagggacctaagcgactaccgcgaaagggcacggcttctgaacagagtgcgacgcgtcgggttcagccatatgctgctcactacaccccaggtgcccctcgccccagtccagcctcaggccaacggcaaagaagaagaggaagaggaggaggaagatgaagaggaagaggaagaagacgaagaggaggaagaagaggaggaagaggaggaagaggaagaggaggaggaggaggaagaagaggaagaggctgccgccgccgtggcgctgggggaagtgttgggcccacggtctggatcatccagcgaaggatctgagcgctccacagaccgaagccaggagggcgcccctagcacgctcttggcagacgaccaaaaggagagccgcggacgggcatctatggcagatggagacctggagcccgaggaaggatctaaaaccctggtgctcgtgtccccaggtgacatgaagaaatccccagttaccgcagagctggcccctgatcctgatttgggcactctcgcggcccttacgccgcagcatgaacgtcctcagcctaccgggagccagctggatgtaagcgagccaggcacactttcgtcagttttaaaatctgaacctaagcctccaggtcctggagcggggctcggggcagggacagttacaacaggagtaggcggggtggcagtgaccagctctccgtttactaaggtggaacggacatttgtccacatcgccgaaaaaactcacctgaacgtcatgagtagtggcggacaggcactcagaagcgaggagttctctgccggtggagagctcgggctagagcttgccagtgatgggggcgctgttgaggaaggagctagggccccgctggagaacggcctcgctctctcaggcttgaatggggccgagatcgaaggctcagctctgtccggtgctccccgggagacccctagtgagatggcaaccaactcactccccaacggcccagctctggctgacggtccagcacccgtgtccccgctggagccttcccccgaaaaggtggcaacaatttcccccaggcggcacgctatgcctggcagcagaccacgcagtagaataccagtgctgctgagcgaagaggataccggcagtgagccatccgggagcttaagcgctaaagagcgatggagtaaacgtgcccggcctcagcaggacctggctcggctggtgatggaaaaacggcaaggtagacttctgctccggctggcatcaggggcctccagcagctcttctgaggagcagagacgtgcatccgaaaccctgtctgggacgggctccgaggaagatacgccggcgtcggagccagctgcagctctccctcgtaaatccgggagagcagcagccacacggagtagaattcctcgtcccatcggcttaagaatgcctatgcctgttgctgcccagcagccagcttctcgctctcacggcgccgcgcccgcattagacacggctattacttctagactgcaactgcagaccccgcccgggtcggcaactgcggccgacttgcgtccaaaacagccaccaggcaggggtctcggacccggacgcgcacaggccggcgctcgtccccctgccccacgaagccccaggctgccggcctccaccagcgccgcaaggaacgcttccgcctcccccaggagccagtcattgtctaggcgtgagagcccctccccttcgcatcaggctagaccaggcgtgccacccccacggggcgtcccaccagccagggcccagcccgacggcaccccaagtccgggcggatccaaaaagggcccccgcggcaaactccaggcccagcgggccactactaagggaagggccggcggcgccgaaggcagagcaggagcccgttag

SEQ ID NO: 13908 - DNA, 1818 bp, Artificial Sequence
  Description of Artificial Sequence: Synthetic coding sequence
atgagtcaactgtcctccactttgaagagatatactgagagcgcaagatataccgacgcgcattacgccaaatctggctatggtgcatacaccccatcctcctatggagcgaacttagcagccagcctcctggagaaagaaaaacttggcttcaagccagtccctacttctagcttcctgacacggccacgaacatatggaccttcaagtttgctggattacgatagggggcgtcctctactgagacccgacatcacgggcgggggcaagagggcagaatcccagacgagggggacggagcggcctctggggtcagggctgtctggaggatcagggtttccgtatggggtaaccaataattgtctgtcttacctccctatcaacgcctatgatcaaggtgtaacgctgactcaaaaacttgatagccagtcagatttggctcgcgatttttcttccttaagaaccagtgattcctaccgaattgatccaaggaatctggggcgatcacctatgctcgcccgcacaaggaaggagctctgcacgctgcagggtctgtaccagacagcgtcttgtccagagtatctcgtggactacctggaaaattatggccggaagggcagtgcctctcaggttccctcccaggctccaccttctagggtccccgaaatcatttctccaacgtacaggccaatcggacggtatactctctgggagacaggaaagggccaggcccccgggccctctcgtagttccagccctgggcgcgacgggatgaattcgaaaagcgctcagggactggccggcctgagaaacctaggcaacacttgttttatgaattcaattttgcagtgtttgtctaatactcgggagctgcgggactactgcttgcaacgcctgtacatgcgggatcttcaccacggaagtaatgctcataccgccctggtcgaggaatttgcaaagctgattcagacgatatggacctcctctccgaatgacgtggttagtccctccgaattcaaaacccaaatccaaagatacgccccccggtttgtaggatacaaccagcaggatgcgcaggaatttcttaggttcctccttgatggactgcataacgaggtgaatagggtaactttgagaccaaagtcaaatcctgaaaacctggatcacctgccagacgacgaaaagggtcgccaaatgtggcggaagtatttggaaagggaggactcccggatcggcgatctgttcgtgggccagctgaagtcctctttgacttgtacggactgtgggtattgctcaacagtgtttgatccattctgggacctgagtcttccaatcgctaagcgtggataccccgaagtgactctgatggactgtatgaggttattcaccaaggaagacgtcctcgatggtgacgaaaaaccaacttgctgtcgatgtcgcggcaggaaacggtgtatcaagaagttctccatccaaagatttcccaagattctggtcctgcacctcaagagattctcggaaagccgtatccgcacctcaaaactgaccacctttgttaatttccctctgcgggacctggacctgcgcgagtttgccagcgagaatacaaaccatgcagtgtacaacctttatgcagtgagtaatcactcaggtacaacaatgggaggccactacacagcctattgtcgaagtcccgggacgggtgagtggcatacatttaacgatagctctgtgactccaatgagcagttcacaggtgcgcacatctgacgcatatctgcttttctatgaactcgcctcccccccttctagaatgtag

SEQ ID NO: 13909 - DNA, 1353 bp, Artificial Sequence
  Description of Artificial Sequence: Synthetic coding sequence
atggtgccactcgtggccgttgtcagtggccccagagctcagctattcgcgtgcctgttgaggctcggcacccagcaggtcggccctctccagctgcataccggagcaagccatgccgcaagaaaccattacgaggttctggtgctcggtggaggatcaggcggcataaccatggccgcacggatgaaacggaaggtaggagccgaaaatgtggctatcgtggagccaagtgagcggcatttttaccagccaatttggaccctcgtcggggctggagccaaacagctcagctctagtggtcgtccaacagcaagcgtgatacccagcggagtagaatggattaaggctcgagttacagaactgaatccagacaaaaactgtatacatacagacgacgacgagaaaatttcctaccgctatctgataatcgcactgggcatccagctggactacgagaaaattaaaggattacctgaggggttcgcccatcccaaaatcggctccaattactctgttaagactgttgaaaagacatggaaagcattacaggacttcaaagagggtaacgctatattcacctttcccaacactcctgtgaagtgcgcaggagcaccccaaaagatcatgtatctgtccgaagcctacttccggaagactggcaagcgctcaaaggccaatataatctttaacactagtttgggagccatcttcggagtgaaaaagtatgcagatgccctccaggaaattatacaggagaggaatttaaccgtgaattacaaaaagaatctcattgaagtgagggccgacaagcaggaagctgtgtttgaaaatctggataagcccggcgagacccaggtgatttcctatgagatgcttcacgtaacaccccccatgtctcctccagacgtcctaaagacgtccccggttgcagacgctgccggctgggtcgatgtagacaaggagacccttcaacaccgcagataccctaatgtgttcggcatcggcgactgcaccaacttgccaacttcaaaaacagcagccgcagtagctgcccagtcaggcatcctggacagaacaatttccgtaatcatgaaaaatcagacacccactaagaaatacgacgggtacacctcctgtcccctagtcacgggctacaaccgggtaatcctagccgagtttgactataaggcggagccccttgagaccttccctttcgatcaatcaaaggagcgcctgtctatgtacttgatgaaggcggaccttatgccttttctctattggaacatgatgctgcgcggctactggggcggccccgcatttttgagaaagcttttccaccttggtatgtcctag

SEQ ID NO: 13910 - DNA, 5244 bp, Artificial Sequence
  Description of Artificial Sequence: Synthetic coding sequence
atggacggtgtcagtagcgaagccaacgaggagaatgacaacatcgaaaggccagttcggagacggcactccagtattctcaagcctccacgctcccctttacaggatttgcggggaggcaacgagcgagtgcaggaatcaaatgccctgcgaaataaaaaaaattcccgacgggtgtcgttcgccgatacaataaaggtctttcaaaccgagagccacatgaaaattgtgaggaagagtgaaatggaggagacagagaccggggagaacttgttgctaatccaaaacaaaaagttggaagataactattgcgagattacaggaatgaatacgctcctttctgctcccattcatactcagatgcagcaaaaggaattcagtattattgaacacacccgcgaacggaagcacgccaacgaccaaacagtgatcttcagtgatgaaaaccagatggatctgacttcctcacatactgtcatgattaccaagggactgctggataatccgatctccgagaaatctaccaagatcgatactaccagctttctggcgaatctcaaattacatacagaggacagtagaatgaaaaaagaggtgaatttctccgtagaccaaaacactagcagcgaaaataagattgattttaatgacttcattaaacgtcttaaaaccggtaagtgtagcgcttttccggacgtgccagacaaggagaatttcgagatcccgatttatagcaaggagcctaattccgcctcatccacccaccaaatgcatgtgtcactgaaagaagacgaaaacaattctaatatcacaagactattccgcgaaaaggatgacgggatgaactttactcaatgccacacagctaacatccaaaccctgatcccaacaagtagcgagactaattctcgcgagtcaaaaggcaatgacatcactatatacggaaacgacttcatggacctgacttttaaccatactctgcagatcctccctgcaactggcaacttttcagagatcgagaaccaaacacagaacgccatggacgtcactacaggctatggtacgaaggcaagcggaaacaaaacagtgttcaaatccaagcaaaacaccgcttttcaggacctctccataaactccgcggacaagatccacatcacaaggagtcacatcatgggggcggaaacgcatatcgtcagccagacctgcaaccaagatgccagaatcctggccatgacccccgagtcaatttattctaaccccagcatacagggctgcaaaacagttttctattcttcctgcaatgacgcgatggaaatgacaaagtgcctcagtaatatgcgtgaggagaaaaatcttcttaaacacgactcaaactacgcgaagatgtactgcaatcctgatgcaatgtcctcacttacagagaaaacgatatattctggggaggagaacatggatattaccaagtcacacacggtggccattgataatcaaatcttcaaacaagatcagagcaacgtacagattgcggccgccccaacccccgagaaagaaatgatgctccagaatttgatgacgaccagcgaggatggcaagatgaatgtcaattgcaacagcgtgccacacgtgtctaaggaaagaatccagcaatcactgagcaatccactgagtatatctctcactgaccgcaaaaccgaactcttgagtggtgagaacatggatctgaccgaaagtcacacttccaatctgggttcacaagttccgctggccgcctataacctggcccctgaatctaccagcgagtcccacagccagagtaaatctagctcggacgaatgcgaagaaataaccaaaagccgcaatgagcctttccagcgctcagatattattgccaaaaactcactgacagacacctggaataaagataaggactgggtcctgaagatcctgccatacctggacaaagacagccctcagtcagctgactgtaaccaggagatcgccacctctcacaatatcgtctactgtggaggagtgcttgacaagcagattacaaatcggaatacagtcagctgggagcaaagcctatttagcactacaaaaccgctattctcatcaggacagttttctatgaaaaaccacgacaccgccattagctcacataccgtgaaatctgtcctgggccaaaatagcaaacttgccgagcccttgcggaagtccctgagtaaccctaccccagactactgtcacgacaaaatgattatctgttcagaagaggaacagaacatggatctgactaaatcccatacggtcgtgatcggattcggaccatctgagcttcaagaacttggtaaaacgaacctcgaacacacgacagggcagctgacaaccatgaataggcagatcgccgtgaaggtcgagaaatgtggtaagagcccaattgagaaatcaggagtattaaagagcaattgtattatggacgtactcgaagatgagtcagtgcagaagcccaagtttccaaaagaaaaacagaatgtaaagatatgggggcgcaagtccgtgggagggcctaagatagataagacaatcgtgttttcagaggacgacaaaaatgacatggatatcaccaagtcttacacaatcgagatcaaccatcgcccgttacttgaaaagagggactgtcaccttgtaccgcttgccggtacgtccgagaccatcctgtatacctgcaggcaggacgatatggagattacccggagccacaccaccgctctcgaatgtaagaccgtaagccctgacgagatcacgaccaggccgatggataagactgtggtgttcgtagacaaccatgttgaactagagatgaccgaatcccatactgtcttcattgactaccaggaaaaagagaggaccgacagacctaactttgaactttcccaaaggaagtcccttgggacacctactgtaatttgcactcctactgaagaatcagtgttctttccaggaaacggcgagtctgatagactagtggccaatgattcccagctcacacccctggaggagtggtccaacaatagaggccccgtggaggtcgccgacaatatggaactgtctaagagtgccacttgcaaaaacataaaagatgttcaatcgccaggatttttaaatgagccgttatccagcaaatcccagcgccgcaagagtctcaaactgaaaaatgataagactatcgtgttttcagagaaccacaaaaacgatatggatatcacccaaagttgcatggtggaaattgacaacgagtctgcgttagaggacaaggaagatttccacctcgctggcgcatcgaagactattctgtattcttgcggacaagatgatatggaaattacgcggtcacacacaacggcacttgaatgtaagaccctgctgccaaatgaaattgcaatacgcccaatggataaaacggtactgtttaccgacaactacagcgatctggaagttactgacagccacactgtcttcatcgattgtcaagccacagaaaaaatacttgaggaaaatcctaagttcgggatcgggaagggaaagaatcttggggtgtcattcccgaaagacaattcctgtgtccaggagatcgctgaaaagcaggcgttagctgtggggaacaaaatagtgcttcacaccgagcagaagcaacagctattcgccgctaccaaccgcaccactaatgaaatcataaagtttcatagcgctgccatggatgagaaagtcatcggcaaagttgtcgaccaggcttgcaccttagagaaagcccaggtggagagctgtcagctcaataaccgggaccggaggaacgtagactttaccagcagccatgctaccgcagtctgcggcagtagcgacaactacagttgtttgcctaatgtgatttcatgtacggataacctggagggtagcgcaatgttgctctgcgacaaggatgaggaaaaagccaattactgccccgtgcaaaacgacctggcttacgccaatgatttcgcgagtgagtattatctggaatccgaggggcagcctctctctgccccgtgcccacttcttgaaaaagaagaagtaattcagacctcaaccaaaggtcagcttgactgcgtgatcaccctgcacaaggatcaggatctaataaaggatcctcgcaatttgctagcgaaccaaacactagtgtattcccaggacttgggggagatgacgaagctcaacagtaaacgcgtgtcatttaagctccccaaagatcagatgaaggtttacgtagacgacatttatgttatccctcaaccgcactttagcaccgatcagcccccgctgcctaaaaaggggcaatccagtattaataaggaagaggtgattctatccaaagcaggaaacaaatcgcttaatattattgaaaattcgagtgctcctatctgtgaaaacaagcccaagatcctcaacagtgaggagtggtttgctgccgcgtgcaagaaggagctgaaagaaaatatccaaactacaaactacaacactgctctggacttccacagcaatagtgatgtcacaaaacaggtcatccagacccacgtcaatgctggggaggccccagatccggtgatcacctctaatgtcccgtgcttccattcgattaagccaaatcttaataatctcaatggcaaaaccggcgaattcctggcttttcagaccgtgcacctgcccccactgcctgagcagcttctggagctcggtaacaaggcccataatgatatgcacattgtgcaggccacagagattcacaatatcaacatcatcagttctaatgctaaggattctcgagatgaggaaaacaaaaaatcccacaatggcgcggaaaccacatccctcccccctaagactgtctttaaggataaagtcaggcggtgcagcctcgggatttttctgccacggctgccaaataagcgtaactgtagcgtcacaggcatcgacgacctcgagcagatcccagctgacaccacagacatcaaccacctagaaacacagcccgtcagcagtaaagactccgggattggctcagtagctggaaagctgaacctctccccttcccaatatatcaatgaggagaatcttcccgtctacccagatgaaatcaatagttcagattctataaatatagaaacggaacctaagaaaaacgtcggcacgcggcgccgccggtactcatag

SEQ ID NO: 13911 - DNA, 2061 bp, Artificial Sequence
  Description of Artificial Sequence: Synthetic coding sequence
atgatccccggaaagtatagatccgtatctggccgcgccgcaaacaatgtcaattgtgggttgcatctcgtgattcagacatcgtccctgcctgagaaaaataaggtagagtttaaattgaacaaggatacttcttctttcccaggaagattgctccagcacgatctcgaacgcaactactcatcacgtcagggggaccacatcaacctggtttcgtcatcactcagctctttcccaatcctccagcgcagtagcgaggaaaaaatcctctattctgaccgcctgagcctcgaacggcagaagctgaccgtgtgtcctattattaacggtgaagaccacctcaggttactcaactttcagcacaactttattaccagaattcagaacatatctaacctccagaagctcatctcactggatctgtacgacaaccagattgaagagatttccggcctgtcaacactgcgatgccttcgggttctgttactagggaaaaacagaatcaaaaagatttctaacctggagaacctgaagtctcttgatgtgcttgaccttcacggcaaccagattacaaagatcgagaatatcaatcacctctgtgaactcagggtgctgaatcttgcacgtaacttcctgtctcatgtggataaccttaacggccttgatagtctgacagagctcaacttacgtcataaccagataacattcgttcgggatgtggacaatctaccttgtctgcagcatttgtttttgtcatttaataacattagcagctttgactccgtgtcctgcttggccgactcctcttccttgagcgatattacgtttgacggcaacccaatcgcgcaggagtcatggtacaaacataccgtacttcagaatatgatgcagttgcgccagctcgatatgaaaagaataaccgaggaggagcgcaggatggcttccgtgcttgccaagaaggaggaggaaaagaagagggaaagccacaaacaaagcctgctcaaggaaaagaagaggctgacaatcaataacgtagcaagacagtgggacttacagcagcagcgtgtggctaatatcgctacgaacgaggacaggaaagactcagattccccgcaggatccttgccagatcgatggctccacactatccgcattccctgaggagaccggaccgctcgacagtggtttaaacaatgccctgcagggtctgtccgtaatcgatacctatctggtggaggtcgacggcgacacactctctctgtatggttctggagctctggagtccttggacagaaattggagcgttcaaacggctggtatgatcactacggtgtcatttacctttatcgagttcgatgagattgtgcaagtcttgcctaagctgaaaatcaagtttcccaactccttgcacctcaagtttaaggaaactaacctggtaatgctgcaacaattcaatgccctagcacagttgcgaaggatcgatcagctcacaattgatccacaggggaacccagtggtgaatttcactttgtggaagtactacgttctgttcaggttaagtcacttttctatgcaaaagatcaacgggaccgaggtgacccagaatgatatgatcatggcagagagactgttcggcatcctagctcatgttgcctcgtcagagcttcctcagtatagactgatctccatcctgggtgatgccaggaagaaacagtttcgttacttgctggagtctaagggcaagaagccgggcatcatcaacgaagagaacaacgacagcaagaggctggtcggcgagaataccaaccgggctaccctgaactacaccacaagggatttttataacgaaaaactggaagaaattaaagagaaaaagaagttctgcaagacgtacattgaagatctggtcaaggaagcaaccgagattaatatgaaaaatgaggccctgcagaaactgtggcctcagatgttcattgaactagtgagggacgcagtgatcgaaatcaggaacaaaaacagttatatgaagctgtgcttgcagcagatcaccgaccagaaatag

SEQ ID NO: 13912 - DNA, 255 bp, Artificial Sequence
  Description of Artificial Sequence: Synthetic coding sequence
atgccatatcttctgatcagtactcagattcgcatggaagtggggcctactatggtaggagatgagcagagcgacccggagctaatgcagcatttgggcgcatccaagaggcgggccctgggcaacaatttctatgagtactacgttgatgacccacctcggatagtgttggacaaactggaacgcagaggattcagggtcctgagcatgacaggagtgggtcagaccttggtctggtgcttgcataaagagtag

SEQ ID NO: 13913 - DNA, 2664 bp, Artificial Sequence
  Description of Artificial Sequence: Synthetic coding sequence
atgccgtccctcccgcaggagggggtcattcagggccctagtccacttgatcttaatacggagctgccttaccaatcaacgatgaagcgcaaggttcgcaagaagaaaaagaagggtaccatcacagctaacgtggctggcaccaaattcgaaatcgtgagattggtgattgatgagatgggttttatgaagaccccagatgaggacgagacctctaacctgatttggtgcgattccgcggtacagcaggagaaaatctcagagttacagaactaccagcgcataaaccacttcccaggaatgggggaaatctgtcggaaggactttctggcgagaaatatgacaaaaatgattaagtcccggcctctcgactataccttcgtgcctcgtacttggatctttcctgccgagtatactcagtttcagaattacgtcaaagaattgaaaaaaaaacggaaacaaaagacatttatcgttaagcccgcaaacggagcaatgggccacgggataagccttatcaggaatggagacaaactcccctcccaggaccaccttattgttcaagagtatattgagaagccatttctcatggagggctataagtttgacctgagaatatatatccttgtcacctcctgcgatcctcttaagatttttctctaccacgacggtctggtccgaatggggactgaaaaatacatccctccaaacgagtcaaacctgacacagctctacatgcacttgacaaattactcagtgaacaagcataatgagcattttgagagggatgagaccgaaaacaagggctccaagcgcagtattaaatggttcaccgaattcctgcaggccaaccaacacgatgtagccaaattctggagtgacatttcagaattggtcgttaaaacgctgatagtggccgaaccgcatgtcctgcacgcctatcggatgtgtcggccagggcagccccccggctctgagtccgtgtgttttgaggtgctcggattcgatatcttattggaccgcaagctgaagccctggctcttagaaattaaccgcgcgccaagcttcggcactgaccagaaaatcgattacgatgtgaagagaggggtattgctcaacgcattgaagctgctgaacatcagaacaagtgataaacgtcgcaatctggcaaagcagaaagccgaagcccagcgaaggctttacggtcagaactccatcaagaggcttctacctggcagcagcgactgggagcaacagagacaccagctggagcggcgcaaggaggaattaaaggagcggttggctcaggtgaggaagcagatctcacgagaggagcatgaaaacaggcacatgggaaattacaggcgaatttatccccccgaagacaaggccttgctggagaaatacgaaaacctgctcgccgtcgcttttcaaactttcctgagtggacgcgcagcatcgttccagagggagctgaacaaccctttaaagcggatgaaagaagaggatattcttgacttactagagcagtgtgaaatcgatgacgaaaaacttatggggaagactacaaagacacgaggtccgaaaccactctgcagtatgcctgaaagcactgaaattatgaaaagacctaagtattgttcttccgactcctcatacgattcctcgagtagttcctccgaatcggacgaaaacgagaaagaggagtaccaaaataaaaaaagagaaaagcaggttacttataatttaaaaccgagtaaccactataagctaatccagcagccatcgtccatacgtaggtccgtgagttgcccccggagtatctccgcgcagagcccctcaagtggtgatactcgcccattcagcgcccaacaaatgatttccgtctctcgtcctaccagcgcatccaggtctcactctctcaacagggcttcatcatacatgcggcatctgccgcacagcaacgatgcatgcagcactaactctcaggtctccgaatcgttaagacagctgaaaacaaaagagcaggaggacgatctgacgtcccagactctgttcgtgctcaaggacatgaaaatccgattcccaggtaagtctgatgcagagtccgagttgctgatcgaggatataattgacaactggaaataccacaagaccaaagtggcttcatactggctgatcaaactcgatagcgtgaagcagaggaaagtcttggacattgttaagacttccatccgaactgttttgccgcgaatctggaaagtcccagacgtggaggaggtcaatctgtatagaatcttcaatagggtgtttaaccggctgctgtggtccagggggcagggcttgtggaattgcttctgtgattccggaagttcctgggaatctatttttaacaaaagtcctgaagtagtgacccctctccaactgcagtgttgccaaagattagtggaactttgcaaacagtgcctgttggtggtatataaatacgcaactgataagcgcggttccctgagcggcatcggccctgattggggcaactcccgttacttgctcccaggaagtactcagttcttcctccggactcccacatacaacttgaagtataatagtccgggcatgactaggtctaacgtactgtttaccagtaggtacggccatctgtag

SEQ ID NO: 13914 - DNA, 1140 bp, Artificial Sequence
  Description of Artificial Sequence: Synthetic coding sequence
atggcaggccctagggtggaggtggatggttctatcatggaggggggtggacagattctccgggtgtccacagccctctcctgtctgctcggcttaccactcagagtgcagaaaatacgagcgggcaggtctacccccggattgtcgtcaggcggatggaagtccaaaatcaaagtgttgactcgcccgcaacatttaagcgggctagagatgattagagacctgtgcgatggccaactggagggggccgaaatcggctctactgagatcacctttactccagaaaagatcaagggcggaattcacacagctgacacaaaaactgccggaagcgtatgtttgctgatgcaggttagcatgccttgcgtgctcttcgcagcctcaccttcagaattacacctgaaaggcggaactaatgctgaaatggctccccaaatcgattacacagtcatggtgtttaagcctattgtggagaagttcggtttcatttttaactgcgacataaaaactaggggatactaccccaagggggggggcgaggtcattgtgcggatgtcgccagtcaaacagcttaatcccattaacctgacagagcgaggctgcgtgacaaaaatctacggacgggcttttgtcgccggcgtgctgcccttcaaggtggcaaaagatatggctgctgcagccgtgaggtgcatccgcaaagagataagagatttatacgtgaatatccagcccgtccaggaacccaaggaccaagcttttggtaatggtaatggcatcataattattgccgaaaccagcacgggctgcctcttcgccggctctagcctggggaaaaggggcgtcaatgctgacaaggtgggcattgaagcagcagagatgctgctggccaaccttcggcatgggggaactgttgatgaatatttgcaggatcaactcatcgtcttcatggcccttgccaacggagtgagcagaatcaaaactggaccagtgaccttacatactcagacagcaattcatttcgccgagcaaatcgccaaagcaaagttcatagttaagaagtctgaagacgaggaggatgccgcaaaggatacatatatcatcgagtgtcaagggattgggatgactaatcctaacctttag

SEQ ID NO: 13915 - DNA, 1056 bp, Artificial Sequence
  Description of Artificial Sequence: Synthetic coding sequence
atgccttccgagacattgtgggaaatcgctaaggctgaagtagaaaaaagaggcatcaacgggagtgagggagatggggccgagatcgccgagaaattcgtcttctttatcggcagtaagaacggcggtaaaaccacaataatcttgcgctgtctggaccgcgatgagccaccgaagccgacactggccctggaatacacatacggacgtagggccaaaggtcataacacccctaaagacatagcccacttctgggagttgggtggagggacttccctactcgatctcatttctattccaataacgggagacacattgagaacttttagccttgtgctggtactagatctatccaaaccaaatgacctgtggccaactatggagaatctcttacaggctacgaagtcccacgtggacaaagtgattatgaagttgggtaagacaaacgccaaggcggtgtccgagatgcggcaaaaaatttggaataacatgccgaaggatcatccagaccacgaactcatagatccatttcccgtgccccttgttatcattggttcaaagtatgacgtgtttcaggattttgagagtgagaagagaaaagtaatctgcaaaacactgagattcgtggcacactattatggcgcaagtttgatgttcacatccaagtcggaagcactcttgctgaaaatccggggtgtgatcaaccagctggctttcggcatcgacaagtcaaaatccatctgtgttgatcaaaacaagcctctgtttatcacagccggactagacagcttcggtcagattggcagcccccctgtacctgagaacgacatagggaagttacacgcccactctcctatggagttgtggaaaaaggtttacgaaaagttatttcctcctaaatctattaacacattgaaggacattaaagatccagccagggatccgcagtatgccgagaatgaggtcgatgagatgaggatacaaaaagatctggaattagagcagtacaaacgcagcagcagcaagtcttggaagcagattgagctggacagttag

SEQ ID NO: 13916 - DNA, 798 bp, Artificial Sequence
  Description of Artificial Sequence: Synthetic coding sequence
atgtgcacaagcgaaaccttccaagctctggacacatttgaggcgcgacacgacgacatcgtcctcgcctcctaccctaagtgtggatcaaactggattctacatatcgtgtccgagctgatttacgccgtgagtaaaaagaagtacaaatatcccgagttccccgtgctggagtgcggcgactccgaaaaataccaacgcatgaaaggcttcccaagtccccgcattctggcaacacacttgcactacgacaaactgcctggatccatcttcgaaaacaaagccaagatcttggttatatttcgcaacccaaaggacaccgctgtctccttccttcactttcataatgatgtccctgatatcccatcttacggcagctgggatgagttcttcagacagttcatgaaggggcaagtcagctgggggagatacttcgactttgcgatcaactggaacaaacacttagatggcgacaatgtcaaatttatcctgtacgaggacctaaaggagaatctcgctgctggcattaaacagattgccgaatttctcggctttttcctcactggagagcagatccagacaatttctgttcaaagtacttttcaggccatgagggccaagtctcaagatacacatggggctgtaggcccattccttttcaggaagggggaagtcggcgattggaaaaacctgttcagcgagatccaaaaccaggaaatggatgaaaagttcaaggaatgtctggctggaactagtctgggcgccaagctcaagtatgaaagctattgccagggttag

SEQ ID NO: 13917 - DNA, 5343 bp, Artificial Sequence
  Description of Artificial Sequence: Synthetic coding sequence
atggaaagtaacttcaaccaagagggggtcccaagaccaagctacgttttcagtgccgacccaatcgcccgcccttcagaaataaatttcgatggcattaaactggacctgtcccacgagttttccctggtggccccaaacaccgaggccaactcttttgagagtaaggactacctgcaagtatgtttgaggatccgtccctttacccaatccgagaaagaattggaatcggagggatgtgttcacatcctcgatagccaaacggtcgttctgaaagagcctcagtgtattctgggtaggctgtctgagaaatctagcggtcagatggcccagaagttctcattttccaaggtcttcgggcccgccactactcaaaaggaatttttccagggctgtatcatgcagccggtcaaggatctgttaaagggccagagtagattaatcttcacatatggcctcactaatagtggaaagacctatacatttcagggcaccgaagaaaatattggcatcctgccaagaactttaaatgtgctgttcgactcattgcaggagagactctatacaaaaatgaacctcaaacctcaccgcagccgggagtacctccgcctttcctctgagcaagaaaaagaagaaatagcctccaaatcggcattgttgagacagatcaaggaggtcactgttcacaatgatagtgatgatacgctgtacggttcactaaccaattctctcaacatcagcgaattcgaagaatccataaaggactacgagcaagccaatttaaacatggccaattccatcaagttctccgtctgggtaagcttttttgaaatctataatgaatacatttacgacctgttcgtccccgtctccagtaaattccagaagcgcaagatgctgcggctgagtcaggacgttaagggctattccttcatcaaagacctacagtggatccaagtctccgatagcaaagaagcctaccggcttctcaaactgggtattaaacaccaaagtgtagccttcaccaagctgaataacgcttcaagccgcagtcatagcattttcacggtgaagatccttcaaatcgaagactcagagatgagcagagttatcagggtgagcgaactgtctttatgtgatctagcgggcagcgaacgtacaatgaaaactcagaacgaaggcgagagactccgggagacaggcaatataaataccagcctcttaacactcggcaaatgcatcaacgtgttgaagaacagcgagaagtctaagtttcaacagcacgtgccattccgcgagtcaaaacttacgcattattttcagagctttttcaacggaaagggcaagatttgcatgattgtaaatattagtcagtgttacctggcttatgacgaaacgttgaatgtgcttaagtttagtgccatcgctcagaaggtctgtgtgcctgacacactgaacagctcccaggaaaaactattcggcccagtgaaatcctctcaggacgtaagtttggactcgaacagcaactcaaagatcttgaacgtgaaacgggccacaatctcctgggagaatagcctggaggatctgatggaggatgaggatttagtcgaggagctcgaaaatgccgaagaaactcagaatgttgagaccaagcttctcgatgaagacttggataaaacgctggaggagaacaaggcttttatctcgcacgaggagaagagaaaattgctggacctcatcgaggatcttaagaagaaactgatcaacgagaagaaagagaagctgactttggaatttaaaattcgcgaagaagtgacacaggagttcacccagtattgggctcagagagaagccgatttcaaagaaacattattgcaggagcgcgagatcttggaagagaacgcggagcgacgcctcgcaatcttcaaggatctggtcgggaagtgcgacacaagagaggaggcagcgaaggacatttgcgccacaaaagtggagactgaggaggctactgcctgcctcgagttgaaatttaaccaaatcaaggccgagctggccaagacaaagggagagctgataaaaacgaaagaggagctgaagaaacgcgaaaacgagagcgattctctgatccaggagctggaaacatcaaataaaaagattattacacaaaatcaacgcatcaaagagttgatcaacataattgatcagaaggaggatactatcaacgaattccaaaacttgaagtcccacatggagaacaccttcaaatgtaatgataaggcagatactagctctctgataataaacaataaactgatctgtaatgaaactgtcgaggtgcccaaagacagcaagtcgaagatctgttccgaacgcaaaagagtcaatgagaatgagctccagcaagatgagccacctgcaaagaagggcagtatccacgtgagcagcgcgattactgaagaccagaaaaaatcagaggaggtccggcctaacattgccgaaatcgaagacatacgcgttttgcaggagaataacgaagggcttcgagcctttcttctaacaattgaaaacgagctgaagaacgaaaaagaggagaaagcagagctgaataaacagattgtgcatttccagcaggagctgtcacttagtgagaagaagaatctgacactctcaaaagaagttcagcaaattcagagcaattacgacatcgccatcgcggagctgcatgtccagaagtctaaaaatcaagaacaggaggagaaaatcatgaaattaagtaacgagatcgagaccgctacccggagtattactaataatgtaagccaaattaagcttatgcataccaaaatcgatgagctaagaacacttgactccgtcagccagatttctaatatagatctgctaaaccttagggacctctctaacggttcagaagaggataatctgccaaacactcagctggatctactggggaacgattacctcgtatccaagcaggttaaggaataccggattcaggagcccaaccgggaaaacagttttcactccagcattgaggctatttgggaagagtgtaaggaaattgtcaaagcatcgagtaagaagtctcaccagattgaagaattggagcagcaaatagaaaagctccaagctgaggtgaagggctacaaagacgagaataatagactaaaggagaaagagcataagaaccaggacgatctcctgaaagagaaggagactttaattcagcaacttaaggaggagcttcaggaaaagaatgttactctggatgtccagatccagcacgtggtggaggggaagcgagctctgagtgaactcactcagggggtgacatgctataaagcaaaaattaaggaattggagacgattctggagacccagaaggtggaatgtagccactcagcgaagttggaacaggacatcctggaaaaggagtcaattatcctcaaactggaacgtaacctgaaagagtttcaagagcacctgcaggatagcgtcaaaaatacgaaggatttaaacgtgaaggaactgaaactcaaagaggaaatcacccagctgaccaataatcttcaggacatgaagcatctcctccagctcaaagaggaggaggaggaaacaaacagacaggagacggagaaattaaaggaggaattaagcgcttcatctgctagaacacagaacctgaaagcggacctgcaacggaaagaagaagactacgccgatttaaaagagaaattaaccgacgctaaaaaacagatcaagcaggtccagaaggaggtgtctgttatgcgggacgaggataagcttctaaggataaagataaacgagctggaaaagaaaaagaaccagtgctcccaggagctcgacatgaagcagaggactattcagcagctcaaagagcagttgaacaaccaaaaagtagaggaggctatccagcaatacgagcgggcttgtaaggacctgaacgtaaaggagaagataatagaggacatgcgcatgactctcgaagaacaggaacagactcaggtagaacaagaccaggtgcttgaagccaaattagaggaagttgaacgactggcaaccgagctggagaaatggaaagagaagtgtaacgatttagaaacaaagaacaatcagcgcagcaataaggagcacgagaataatacggatgttctaggtaagcttaccaacctgcaggatgaactgcaggagtccgagcagaagtacaatgctgacagaaaaaaatggctggaggaaaaaatgatgctcataacccaggccaaggaagcagaaaacataagaaacaaggaaatgaaaaagtacgcggaggaccgcgagaggttcttcaagcaacagaatgagatggagattctcactgcccaactgactgagaaagactcagatctccaaaagtggagagaggagagggaccagctggtggccgcactggaaatccagcttaaggccctcattagttctaatgtccagaaagacaatgagatagagcagctgaagcgcataatttcggaaacatccaaaattgaaacccagattatggacatcaagcctaaaagaatctcaagtgcagacccagataaactgcagacagaaccgctgtccacgagctttgaaattagtaggaataagattgaagacgggagcgtcgtactcgactcctgcgaagtgtccacagaaaacgatcagagcacaagatttccgaaacccgaactggagatccagtttacccctctgcaaccgaataaaatggctgttaagcacccaggatgcactacccctgtaacagttaaaatccccaaggcccgcaaacgcaagtccaacgagatggaggaagacctggtcaaatgcgaaaataaaaaaaatgccacaccccggacaaatctgaagttcccaattagtgatgatcggaatagctcagtcaaaaaggaacagaaggtggcgatccgcccatcttcaaagaagacttatagtctgcgatcccaagcaagcattataggagtgaaccttgcaactaagaagaaggaagggacactgcagaaattcggggacttcctccagcacagcccctccatcttgcagtctaaggccaagaaaatcatagaaaccatgagcagctccaaattgtctaacgttgaagcctccaaggagaacgtatcacaaccaaaacgcgcaaaacgaaagctgtacaccagcgagatctcaagtcccatcgacatatctgggcaagtgattcttatggatcagaagatgaaggagtcagaccatcaaattatcaagcggcgccttagaacaaagaccgcgaagtag

SEQ ID NO: 13918 - DNA, 1371 bp, Artificial Sequence
  Description of Artificial Sequence: Synthetic coding sequence
atgaatagctcagatgaagaaaagcagcttcagcttattacgtccctgaaagagcaggccatcggtgagtacgaggacctccgagcagaaaaccagaagacgaaggaaaagtgcgataaaattaggcaggagagggatgaggcggtcaagaaactcgaggaattccagaaaattagtcacatggtcatcgaagaggtgaacttcatgcagaaccacctggagatagaaaaaacttgtcgggaaagtgctgaggccttagccaccaaactgaacaaggagaacaaaaccctgaagagaatcagcatgctctatatggctaagctgggccctgacgttatcactgaggaaattaatattgacgacgaagacagcaccaccgatactgatggcgctgcagagacctgcgtgagcgtccagtgtcaaaagcaaattaaggaactgcgagaccagatagtgtctgtgcaggaagagaaaaagattctcgccatagaactagaaaacctcaagtcaaagttggtcgaggtaatcgaggaggtcaataaagtgaagcaggaaaaaacggtcctgaacagtgaggtgctggaacagagaaaagttttagaaaaatgcaatagagtctccatgctcgccgtggaggaatacgaagaaatgcaggtcaacctcgaactcgaaaaagatctgcgaaagaaagccgaaagctttgctcaagaaatgttcatcgagcagaataaactgaagaggcagtctcatctattgctgcagtcctctatcccggaccagcagctcttgaaagcattagatgagaacgctaagctgactcagcagctggaagaagaaaggatacagcatcagcagaaagtcaaggaactggaggagcagctagagaatgaaacactacacaaagaaattcacaatttaaaacagcaactggagctgctggaagaggacaaaaaggagctagagctgaagtaccaaaattccgaggagaaggcacgcaatttgaagcactctgtcgacgagctgcagaagcgggttaaccaaagcgaaaactcagtgcctcctcccccacccccgccccccccacttccacctcccccacctaaccccattaggtccctaatgagcatgattaggaaaaggagtcacccttcagggtcaggcgcgaagaaggagaaagctacccaacccgagacgaccgaggaagtgaccgacttgaagagacaagccgtggaagagatgatggatcggattaagaaaggggtacatctgaggcccgtaaatcagactgccaggccaaaaaccaagcctgagtctagcaaaggatgtgagtccgctgtagatgagctgaaggggatattagcctcgcagtag

SEQ ID NO: 13919 - DNA, 630 bp, Artificial Sequence
  Description of Artificial Sequence: Synthetic coding sequence
atgaagaaagttcgactcaaagaacttgaaagcagactccaacaggtcgatggcttcgaaaaacctaagctcctgctcgaacagtatcctaccaggccacatatagccgcttgcatgctgtacaccattcataatacttatgatgatatcgagaataaagtggtggccgatctcggctgtggctgcggagtgctcagtatcggcacagcgatgctcggtgccggcctatgtgtcggattcgacatcgacgaagatgctctagaaatctttaaccgcaatgcggaggagttcgagctgacaaatatcgatatggtacagtgcgacgtgtgtctactgtccaatcggatgtccaaatctttcgacaccgtgattatgaatccaccatttggaacaaaaaacaacaaaggcactgatatggccttcttgaaaaccgcactcgagatggcaagaacagccgtgtattcgctacacaagagctcaactcgggaacatgtacagaaaaaagcagcagagtggaaaattaaaattgatataatcgcggagctacgatacgaccttccagcttcctacaaatttcataagaagaagagcgtggacatcgaggtggatctcatcaggttttccttctag

SEQ ID NO: 13920 - DNA, 4719 bp, Artificial Sequence
  Description of Artificial Sequence: Synthetic coding sequence
atggctagctctgctcgagaacaccttttgttcgtgcgccgccgcaatccacagatgcgttatactctctccccagaaaacctccagtccctcgcagcccagtcctctatgcccgaaaatatgacactccaaagggccaatagcgacacagacctggtaacatctgagtctcgcagcagtcttacagcctccatgtacgagtacaccttggggcaggcgcagaatctgattatattttgggacattaaggaagaggtggacccaagcgactggataggactgtaccatattgacgaaaatagccctgccaacttttgggactccaagaaccggggggtaaccggaactcagaagggccaaatcgtatggaggatcgaacccggtccatacttcatggaacccgagataaagatttgttttaaatactaccacggtatatctggggcactgcgagcaacgactccatgtatcactgtgaaaaatcccgcagtgatgatgggggccgaaggcatggagggcggtgccagcggcaatttacactcccgtaagctggtgagtttcacactatccgatcttcgggcggtgggtctgaagaaaggcatgttctttaatccagatccctacctgaagatgtcgattcagcctggcaagaaaagtagcttcccaacctgcgcgcatcacggacaggaacggaggagtacaattatcagtaacacaacaaatcctatttggcaccgagagaaatatagcttcttcgcactgttaacggatgttcttgaaatcgagattaaggacaaatttgcaaagtccagaccaattatcaaacgcttcctgggcaagctgactataccagtccagcgcttgctagaacgccaagccataggcgaccaaatgctgtcgtataatcttgggcggaggctgcccgctgaccacgtcagtggttacttgcagttcaaagtggaagtgacctcgtcagtgcacgaagacgcttctcctgaggccgtgggcaccatcctcggagtaaactctgtgaatggcgacttaggaagcccttctgacgacgaagacatgcccgggtcacatcacgattcacaagtgtgtagcaatggaccagtgagcgaggatagtgccgcagacggaacgccaaagcactcgttcagaacgtcctctaccctggaaatagatacagaggagctgacatctacatcaagcagaaccagcccacccaggggaagacaggacagtcttaacgactatctagacgcaattgagcataatggacactcccggccgggtactgcaacatgcagcgagagatctatgggggccagccccaagctgcggtctagtttccccacagacacacgactgaatgcaatgctccatatcgattcggatgaggaggatcacgagtttcaacaggatctgggatacccctcaagtttggaggaggaaggtggtctcatcatgttctcaagggcctcgcgggcggacgatgggtctctgaccagtcagaccaagcttgaggataatccagttgagaacgaagaagcaagcactcacgaagcggcttcgttcgaagacaaacccgagaatctacctgagcttgcggagagcagcctcccagcaggccctgccccggaggaaggggagggcgggcctgagccgcagccgtccgccgaccaggggtcagccgagctttgcggatctcaagaagtcgatcagccaactagcggtgccgacactggaacctccgatgcaagcggaggttctcgacgggctgtcagcgagaccgaatccctggaccagggaagcgagccttcacaggtgagtagtgaaacagagccatctgatcctgcccggacagagtcagtgagcgaagcttctactcgaccggaaggggaaagcgacttagagtgcgccgattccagttgtaacgagagtgttaccactcagcttagctcagtggatactcgttgttcctccctggagagtgctcgttttccagagacacccgcgtttagctctcaagaggaggaagatggggcctgtgcagcagagccaacaagttcgggtccagctgaagggagccaggaatccgtctgcactgccggaagtctaccagtcgtgcaggtgccttcaggcgaggacgaaggaccgggcgctgagagtgctacagtacccgatcaagaggaacttggtgaagtctggcagcggcgcggaagcctcgaaggagccgccgctgccgctgaaagcccgccacaagaggaaggatctgcgggcgaggcgcaggggacttgtgaaggggccacagcccaggaagaaggtgctacaggagggtcacaggctaatggacatcaacccctgcgttctctgccttcagtaagacaggatgtgtctcgctaccaacgcgtcgatgaagccttgccccccaactgggaggcccgcatcgatagccacggaaggattttctatgttgatcatgtgaacaggactacaacctggcagcgacctactgcccctcctgctccccaggtcctgcaaagaagtaacagtatacagcagatggagcagctgaacaggcgataccaatcaatccggcgcaccatgactaatgaaaggccagaggaaaacactaatgccatagacggggctggggaggaggccgatttccaccaggcctccgccgattttcgacgtgagaatattctcccacatagcaccagtaggtctcggattactctgctgctacagagccctccagtgaagttcctaatatctccagaattttttacggtgctgcactctaatccctctgcttatagaatgttcacaaataacacctgcctgaagcatatgatcacaaaggtgcgcagggatacacaccattttgagaggtaccagcataatcgggatttggtgggttttctgaacatgtttgccaacaaacaactcgagctgccccgaggctgggagatgaagcacgaccaccagggaaaggcattcttcgtggatcacaactcgcgaactactacattcatagatccacgacttccactgcagtcttctcggcctacctccgctctggtacataggcagcatcttacccgtcagaggtcacatagtgcaggagaagtgggcgaagactcacgtcatgctggcccacccgtgctgcctagacctagctctaccttcaatactgtgtcccggccccagtaccaggatatggtcccagtagcatacaatgataagattgtggctttcctgcgacaacctaacatttttgaaatcctccaagaacgccaacccgatctgaccaggaatcatagcctccgcgaaaagatccaattcatacggacggaggggacacccggtctcgtgcgactgagcagtgatgctgatttggtgatgctgctgagtttatttgaagaagagattatgtcctacgtgcctcctcacgccctcctccaccccagctactgccagagtccccgagggagtccagtctctagcccgcagaattcccccggtactcagcgagcgaatgcacgcgcgcccgctccctacaagcgggactttgaagcaaaactccggaatttttaccgcaagcttgagacgaaaggatacgggcaaggcccaggtaagctcaaacttattatccgaagagaccatctgttggaggacgcgttcaatcagatcatgggctattcgaggaaggacctccagagaaataaactttatgtgaccttcgttggagaagagggactggactactccggccctagccgggagtttttctttctggtgagtcgcgagctttttaacccatactacggactgttcgagtactctgccaatgacacatacactgtccaaattagtcccatgtcagcctttgtagataaccaccatgagtggtttagatttagcgggagaatcctcggcctggccctcatacaccaatacctcctggatgccttcttcacacggccattttataaagcgctgcttagaattctgtgcgatctcagcgacctggagtacctggatgaggagttccaccagagccttcaatggatgaaagacaatgacatccacgatatacttgatctgacctttaccgtaaacgaggaggtgtttggccagattaccgaaagagagcttaagcctggaggcgccaatattcctgttacggagaaaaacaagaaagagtatatagagaggatggtaaagtggcggatagagcgaggggtcgtccagcagactgagtccctggtgagaggcttctacgaggtagtggatgcccgccttgtctccgtatttgacgccagggagttagagctggtaatcgctgggactgccgaaattgacttgtctgactggaggaacaataccgagtaccgagggggatatcacgacaaccacatcgttatccggtggttctgggccgctgtggaacgttttaacaacgagcagagactgcggttgctgcagtttgtgaccggcacaagcagtatcccctacgagggcttcgcctctttgagggggtctaacggccctcgtaggttctgtgtggagaagtgggggaaaatcacagccctgccaagggcccacacctgttttaaccggttggacttacctccatacccttccttttcaatgctgtacgagaagctgctgactgctgtggaagaaacatcaaccttcggcctggagtag

SEQ ID NO: 13921 - DNA, 1206 bp, Artificial Sequence
  Description of Artificial Sequence: Synthetic coding sequence
atgtcctgtcgctgctggatatctcggcatcctagctacgagggctggaatctccagtctattatctttcacaaacagattagaggagtcgatttggaatcaacttttgtaacaaagttcggcaataactgttccctgcggttaaatgagactgtagacattcacaaggagaaggtggctcgcagagaaatcgggattctgaccaccaacaaaaacacctctcggactcacaaaataatcgcaccggccaatctggaaaggccagtgcgatacatcaggaagccgatcgattatacgattcttgatgatatcggccacggcgtgaaagtgtccacccagaatatgaaaatgggagggctgccaaggacaaccccccccacacagaagccaccttcccctcctatgtctggcaagggcaccctcggccgtcacagtccatataggactctggaaccagtgaggccccccgtcgtgcccaatgattacgtccccagtcccacccgcaatatggccccttctcaacagagccctgtgcggacagcatcagtgaaccagcgaaatagaacgtacagtagcagtgggtccagcgggggaagccatccaagcagccgctcctcttcccgcgaaaatagtggatccgggtcagtgggcgtgccgattgcagttccgaccccgagtccacccagtgtctttcctggacacccagtccagttttattcgatgaaccggccagctagtagacacacccctccaacgataggcggttcccttccataccggcggccaccatctattacctcccaaactagcctgcagaatcagatgaacggaggaccattctactctcagaatcctgttagcgacacgcctccgccccccccacctgtagaggagcctgtgtttgatgagagcccgccccccccccctcctccggaagattatgaggaggaggaggcagccgtggtggagtactccgatccttacgccgaggaggacccaccttgggcgccccgtagctatttagagaaagtggttgcgatttatgactacacaaaggataaggaggacgaattatcattccaagagggagccattatatacgtgattaagaagaatgacgacggttggtacgagggcgtcatgaacggagtcacaggactatttcccggtaactatgttgagagtattatgcactatagcgagtag

SEQ ID NO: 13922 - DNA, 1428 bp, Artificial Sequence
  Description of Artificial Sequence: Synthetic coding sequence
atggctgagctacagatgttactggaggaagagattccaggggggagacgggcacttttcgactcctacaccaatctagaaagggtggccgactactgcgagaataattatatacagagcgctgataaacagcgagcgctggaagagactaaggcttacactacacagagcctggccagcgtggcctacctcatcaacacgctggccaacaacgtcttacaaatgctagacatccaggcaagccaattacgacgtatggagagctcgatcaaccatatcagccagactgtcgatattcataaggagaaggtcgccaggcgcgagatcgggatcttaaccactaacaaaaatactagccgtacccacaaaataattgcacccgccaatcttgagcggccagttcgttacattagaaagcctatcgactacactatcctggatgatattgggcacggagtgaaggtgtccacgcagaacatgaaaatgggaggcctgcctcgcaccacccccccaacccagaaacctcccagtccacctatgagcgggaaaggtaccctcggccgccattcaccgtaccgtacactcgagcccgtcagacctcccgtcgtcccgaatgattacgtgcctagtcctacccggaacatggccccctcccaacagagtcccgtgaggactgcttctgtcaatcagcgaaatcggacttatagctcttcgggctccagcggggggagccaccccagctcacggtcaagctccagggaaaacagtggaagcggatccgtgggagtacccattgccgttccaaccccatctccccctagtgtgtttcctggtcaccctgtgcaattttactccatgaacaggcccgcatcccgccacacccccccaacaattgggggctctctgccatatcgaaggcccccctcaataactagtcaaactagcttgcagaaccagatgaacggaggacccttttattcccagaaccctgtatccctggccccaccccctccatccatactccaggttacccctcagctcccactgatggggttcgtggcccgggtgcaggagaatataagcgacaccccaccgccccccccccctgttgaggagccggtgtttgatgaatccccaccaccacccccaccacctgaggattacgaggaggaagaagctgcagtcgtcgaatacagtgatccatatgcagaggaagaccccccctgggcccccagatcttacctggaaaaggtggtggccatctacgattatactaaagacaaagaggatgagttaagcttccaggagggggccataatctacgtgataaagaagaacgatgatggctggtacgagggagtgatgaatggggtgaccgggctttttcccggcaactatgtggagtccatcatgcattactcagagtag

SEQ ID NO: 13923 - DNA, 900 bp, Artificial Sequence
  Description of Artificial Sequence: Synthetic coding sequence
atgaaaatgggagggctgcccaggacgacacctccgacgcagaagcccccaagcccacccatgtcaggaaagggcaccctcgggagcagtgggtcatcaggcggcagccacccttccagccgctcaagctcaagggagaatagcggaagcggctctgtcggagtgcccattgctgtgccaacacccagtccacccagtgtcttcccagcccccgcagggagcgcggggacacccccactccccgctacaagcgcatctgcaccagccccactggttccggccaccgtgccctccagcaccgcgccagatgccgctgccggaggcgcccagacgctggctgacgggttcacatctcctactcctcccgtggtgtcctcaaccccaccaactgggcacccagtgcaattctattcaatgaatcggcccgcatcgaggcatactccacccacaataggagggtctctgccgtacaggcgacctccttcgataacaagccagacaagtctgcaaaatcagatgaacggcggccctttctactcccagaaccctgtgtccgacactccccccccacctccccctgtggaagaaccagtgttcgatgagagtcctccccctccccccccacctgaggattacgaggaagaagaagctgcagtcgtcgagtattcagatccttatgcggaagaggatcctccatgggccccaaggagttatctggagaaagtggtggccatctatgactataccaaagacaaggaggatgaactgtcattccaggaaggagcaataatttatgtgattaaaaaaaacgacgacggatggtatgagggagtgatgaatggcgtcacaggtctttttcccgggaactacgtagagagtatcatgcactacagtgaatag

SEQ ID NO: 13924 - DNA, 1926 bp, Artificial Sequence
  Description of Artificial Sequence: Synthetic coding sequence
atgggtcgaaggtctactagtagtaccaaaagcggaaagtttatgaatcctaccgatcaggctcggaaagaggccaggaaacgggagctgaaaaagaacaagaagcagagaatgatggtccgagccgccgtgctgaagatgaaggatcctaaacagatcattagggatatggagaagctcgacgaaatggagtttaacccagtgcagcagccgcagctcaacgagaaggtgctcaaagacaaacgcaaaaagctccgtgaaaccttcgagcgaattctgcgtttgtatgagaaagagaatcctgacatctataaagaactcagaaagctcgaagttgagtatgaacagaaaagggcacagctgtctcagtacttcgatgcagtgaaaaacgcacagcacgttgaggtggagtccatcccgcttcccgatatgccccatgctccatctaatatcctaattcaagacatcccactccccggtgcgcagcccccctcgatcctaaagaagaccagcgcctatggccctccgactagggccgtttccattctccctttacttggccatggagtgccacgtctccctcccggaaggaagccaccaggcccccctccaggacctccacctccgcaggtggtccaaatgtacgggcggaaggttggctttgcactcgacctacccccccgccgacgcgatgaggacatgctatattctcccgagctggcgcagcggggtcatgatgacgatgtcagtagcacttccgaggacgacgggtacccagaggacatggaccaagacaaacatgacgactccaccgacgacagcgatacagataaaagcgacggagagtcagacggggatgagttcgtgcaccgggacaacggcgagcgggacaataatgaagaaaaaaaatccggcctgtctgtcaggttcgccgacatgccagggaaatcgcggaaaaaaaaaaaaaatatgaaagagctgaccccattgcaggctatgatgttgcgaatggccgggcaggagatccccgaagagggacgggaagtcgaagagttcagcgaagacgacgacgaagatgactctgatgatagcgaagctgaaaagcagtcccagaagcagcataaggaggaaagccacagcgacggtacttccactgcctcttcacagcagcaagctccaccccagtccgtgcctccctcccaaatccaggcacctcccatgcccggccccccaccgctgggcccaccgccggccccacccctgagacccccgggtcctccaacgggcttgccaccagggcctccacccggggctccccccttcctcagaccaccaggaatgcccggcctgcgcggtccactcccccgtctgctgccaccagggcctccacccgggagaccgcctgggcctccacctggcccacctccagggttaccgcccgggccacccccgagaggcccccctccaaggctgccacccccagccccccccgggatcccaccaccacgccctggcatgatgagaccccccctggtgcccccactgggtccagcccctccaggtctctttcctcccgctccacttcccaacccaggagttttgagcgcacccccaaacctaattcagcgaccaaaggctgatgatacttcagccgcaacaattgagaagaaggccactgccaccattagtgctaaacctcagatcaccaaccccaaagcggagataactcgctttgtccctacggctctcagagtgcggagggagaataaaggagccacagccgcgccacagcggaaatcggaagacgactccgctgtacccctagctaaggcagcaccaaagtccggaccctccgtgcctgtctccgtgcagactaaggatgacgtctacgaggccttcatgaaagagatggaggggctgctttag

SEQ ID NO: 13925 - DNA, 4419 bp, Artificial Sequence
  Description of Artificial Sequence: Synthetic coding sequence
atgaaaggctcagaagtctctctcgaaaagaaaaagaaaattaagatgcccgtcaaacgtctgcgagaggtggtttcacaaaatcatggcgatcacctagttctgctcaaggatgaactgccgtgtgtgcctcctgctctgagcgcgaataagaggctcccagtcgggactggcacctccctcaacggcacctccagaggctcttctgacctcacctccgcccgcaactgctaccaaccacttctggagaatccgatggtgtccgagtctgatttttccaaggatgtcgccgttcaagtgctaccccttgataaaatagaggaaaataataagcaaaaggccaatgacattttcatctctcagtacaccatggggcagaaagacgcgcttcgcacagtactgaagcagaaggcgcagagtatgcctgtgtttaaagaggtgaaggtgcatctgctggaggatgccggaatcgaaaaagatgcagtgacccaagagacgcgaatctcccctagtgggattgactccgctacaactgtggctgctgccacagccgccgcgatagctaccgcagccccactcatcaaagtgcagagcgatcttgaagctaaagtgaactctgtgacagaactcttgtcgaaactgcaggagaccgataaacaccttcagagggttactgagcaacagacgagcatacagagaaaacaggagaagctacattgtcatgatcacgagaaacagatgaatgtatttatggagcagcacatcaggcacttggagaagcttcagcagcagcagatcgacattcagacccacttcattagtgcagccttaaagacttcctccttccaaccagtgtccatgccttccagcagagctgtggagaagtattccgtgaagcccgagcaccccaatttgggctcttgcaatccaagcctgtataacaccttcgcgtcgaagcaggctccactgaaagaggtcgaagacacctcattcgataaacagaagagccctctcgagactcctgccccaaggcgatttgctccagttcccgtaagtagagacgatgaactgagtaagagggaaaaccttctagaagaaaaggaaaatatggaagtctcgtgccatcggggcaatgttagactactggagcagatcctcaataataacgattctttgaccagaaaatccgaaagtagcaataccacttcacttactcgaagcaagattggctggaccccagagaaaacgaaccggtttccatcatgcgaggaactggagaccacaaaggttaccatgcaaaagtccgatgatgtgctgcatgatctgggccagaaagagaaagaaaccaattctatggtgcagccaaaagaatccctgagtatgttaaagctgcctgacttgccgcagaactccgtgaaattgcaaacaacgaataccacacgcagtgtcctcaaagacgctgagaaaatcctccggggcgtgcagaacaacaaaaaggtcctagaagagaacctcgaagctatcatccgcgccaaagatggagccgctatgtacagccttatcaatgcactgtccacgaatcgggaaatgtccgaaaaaattcggatccgcaaaaccgtcgacgaatggattaagacaataagcgccgaaatacaggggctgcttaaggcaacaactgtgattcaggatgaggattacatgttgcaggtgtacggcaagcccgtttatcagggccacaggagcaccctgaaaaaggggccctatttacgttttaacagcccatccccaaagtcacgtccacaaagaccgaaagttattgagagagtaaaaggtactaaagtgaagtccattaggacccagactgacttttacgccactaagcctaagaagatggactccaagatgaagcattccgttcccgtgttgcctcacggcgaccagcagtacttattcagtcctagccgtgaaatgcctaccttttccggaacactggaagggcacttaatccctatggcaatccttctaggtcagacacagagtaatagcgacaccatgcccccagccggcgtaattgtgtctaaacctcaccccgtaacggtcaccacctccatacctccatctagccggaaggtggaaacgggcgtcaagaaacctaatatcgcaattgtcgaaatgaaatctgagaagaaggacccacctcagctgaccgtccaggttctgcccagtgtggacattgactcaatcagtaactcttcagccgacgtgttgtctcccctgagcagccccaaagaggcttcgctgcctccagttcaaacctggatcaaaacgcctgaaataatgaaggtggacgaggaagaggtaaaatttccaggcacgaacttcgatgaaatcattgacgtgatacaggaggaggaaaagtgtgatgagatccccgactccgagcctattctagaattcaatagaagtgtcaaagcagactcaactaagtataatgggcccccgtttcctcccgtggcctctaccttccagcccaccgctgacattctggacaaggtgatcgagcgcaaggagacgctggaaaacagtctgattcaatgggtggagcaggagattatgtccagaatcatttccgggctattcccggtgcaacagcagatcgccccttcgattagcgtgagcgtctcagagactagtgaaccgctgaccagcgacattgtggaggggacttcctccggggcactccagctgttcgtagacgctggcgtgcccgttaattcaaacgtgattaaacatttcgttaacgaggccctggctgaaacaatcgccgtgatgctcggagacagagaagccaagaaacaagggcctgtggcaacaggagtcagcggagacgctagtacgaacgagacctaccttcctgcaagagtatgtaccccactccctacgccccagcctacacctccctgtagtccatccagccccgcgaaggaatgtgtgctcgttaagacgcccgatagctcaccttgtgattcagaccatgacatggcttttccggtcaaagagatatgtgctgaaaagggggatgatatgcccgctattatgctcgtgaacactccaactgtaacaccaacaacaacacctccacccgccgcggccgtgttcaccccaacactgagcgacatcagcattgacaagctcaaagtgtcaagccctgagctgcccaaaccatggggagatggagacttgcctcttgaggaagagaacccaaatagtccacaggaagaactgcacccccgtgccatcgttatgagtgtggctaaggacgaagaacccgaaagcatggacttccctgcccagcctcctccaccggagcctgtgccgttcatgccattccccgcaggaaccaaggccccatctccgtctcagatgcccggttcggacagctctaccctggagtccaccctatctgtgactgttacagagaccgaaaccttggacaagccgatcagcgagggcgaaattctgttctcctgtggccagaagctggcgccaaaaattctggaagatatagggctgtacctaacaaatctgaatgactcactgagctccaccttgcacgacgccgtggaaatggaggacgaccctccgagcgaaggccaagtgataagaatgtcccacaagaagtttcatgcagacgctatcctttcttttgccaaacagaaccaggaatctgcagtgagtcagcaggctgtttatcatagcgaagatctggaaaactctgtaggcgaactctcagaaggccaacggccacagctgacggccgccgccgagaatatccttatgggtcacagcctgtatatgcaaccccctgttacaaatacacagtcactggatcaacaatgtgaccctaagcccctgtcacggcagtttgacaccgtgtccggaagcatttacgaagattcctgtgcctcccacgggcctatgtctctcggggaacttgaactcgaacctaacagtaagttggtcctgcccacaactctcctgacggcacaagagaatgatgtgaacctccccgtcgcggccgaggatttttcacagtaccagctaaaacagaatcaagacgtgaaacaggtcgagcacaagccctcccagagctatctccgggttcgcaataaatccgacattgctccttcgcagcagcaggtgtctccaggagacatggataggacacagatagagttgaacccttacttaacatgtgtgttttccggaggcaaagcagtgccactgtccgccagccagatgccacctgcaaaaatgtccgtgatgctcccctctgtcaatctggaggactgttcacagagcctctctctgagcaccatgcaggaggacatggagtcaagcggcgccgatacattttag

SEQ ID NO: 13926 - DNA, 1986 bp, Artificial Sequence
  Description of Artificial Sequence: Synthetic coding sequence
atggagggggccgccgcccctgtcgctggggatcgtcctgatctgggactcggggcacccggcagccctagggaggcggtagctggcgccaccgcagccctggaacccaggaagccacacggagtgaagaggcatcatcacaagcacaatctcaaacaccgttatgagcttcaggagaccctgggcaagggcacatacggcaaggtaaagcgcgccacagaacgattttccggaagggtggtagcaattaagagtattagaaaagacaagatcaaggacgagcaggacatggtgcatattcgccgcgaaattgaaatcatgagttctctgaatcaccctcacataatatccatctacgaagtgttcgagaataaagataagatagtcatcataatggaatatgccagcaaaggcgaattatacgactacattagtgaaagaagacggttgtctgagcgcgaaaccaggcatttttttaggcagatagtaagcgccgtgcactactgtcacaagaacggcgtggtccacagggacttaaagctggaaaatattcttcttgatgacaactgcaacatcaagatcgctgactttggactatcaaatctgtatcagaaagataagtttctgcagacattctgcggctctcccctttacgcctctccggagattgtcaacggacggccataccggggccctgaagtggactcctgggccctgggagtgctcctgtacactttggtgtacggtactatgcccttcgacggctttgatcacaaaaacctcatccgtcagattagcagcggggaataccgagaacctacccagccgtcagatgctcgtggattaattaggtggatgctgatggttaaccctgacagaagagcgaccattgaggacatcgcgaatcactggtgggtcaactggggctacaagagttctgtctgcgattgcgatgcattacacgattccgaaagccctctacttgcccgtataatcgattggcaccatagatcaaccggactgcaagccgacaccgaggcgaaaatgaagggccttgccaaacctaccactagcgaagtgatgctcgagagacaacgcagcctaaagaaatcgaagaaagagaacgatttcgcccagagcggacaggatgccgttccagagtctccatccaagctttcatccaagaggccaaaaggcatcttaaagaagagatcaaattctgagcaccgttctcattccactggctttatcgaaggcgtggtgggcccagcactcccttctactttcaagatggagcaggatctgtgtagaactggcgtactgctaccgagtagccccgaggctgaagtgcctggcaagttgagtcctaaacaatccgccacaatgcctaagaaaggcattttaaagaagacccagcagcgggagtcaggatactactcttctcctgagagaagtgaatccagtgaactgctggactccaatgacgtcatgggcagtagtatcccttccccctctcctcctgatccagccagggtcacttcacattctctctcctgcaggcgcaagggcatccttaaacattcatccaaatactctgctggaacgatggatcccgccttggtttcacccgaaatgccaactcttgagagccttagcgagccgggcgtgccagcagagggcctttctagaagctattcgaggccgagtagtgtgattagcgatgattctgtcctcagttcagattcttttgacctgttggatcttcaggagaatagaccagcccgccaaaggataagatcatgcgtgtccgcagagaactttctccagattcaggatttcgaaggacttcagaacagaccacgcccacagtaccttaaaagatatcggaataggttggctgattcgtcgttttcactacttactgatatggatgatgtcacccaagtttacaaacaggccctagaaatctgtagcaaactgaactag

SEQ ID NO: 13927 - DNA, 603 bp, Artificial Sequence
  Description of Artificial Sequence: Synthetic coding sequence
atggcgaacatcgctgtgcagcggatcaaaagagagtttaaggaggtcctaaaatcagaggaaacttctaagaaccagataaaagtcgacctggttgatgaaaattttacggaacttaggggagagatcgcaggcccccctgacaccccatatgagggaggaaggtatcagctggagatcaagatccctgagacctacccttttaatccgcctaaagtgagatttatcaccaagatctggcatcccaatatcagctcagttactggagccatttgccttgacattctcaaagaccagtgggctgccgccatgacactccgcactgtgctgttgtctctgcaagcccttctagctgctgctgagcctgatgacccccaggatgccgtggtggcgaatcagtacaagcagaaccccgaaatgttcaaacaaacagctagattgtgggcgcatgtatacgcgggagcccctgtatccagccctgaatacaccaagaagatcgagaacttgtgcgccatgggtttcgaccggaacgccgtgatcgtagcactctcatccaagtcgtgggatgtggaaaccgccacagagttgctgctcagcaactag

SEQ ID NO: 13928 - DNA, 5313 bp, Artificial Sequence
  Description of Artificial Sequence: Synthetic coding sequence
atgccacggcggcgcaagaatttaggtggaaacccatttcgaaagactgcaaatccaaaagaggtcgtggttagcagtgtagcttcacgagaggagcccaccaccactcttccaagcatgggggaaaccaaagttgatcaggaggagctgtttaccagtatctctgaaatatttagcgatctagatcccgacgtcgtgtacctgatgctgagcgagtgtgattttaaggttgaaaatgcaatggactgtctgctggagcttagcgccacagacacaaaaattgaagaaagttctagtcagtctttcgttgccagtgagaatcaggtcggagccgctgaaagcaagataatggagaaacgccctgaggaggaaagtgaggactctaaaatggattcgttccttgacatgcaactgacagaagacctggacagccttattcagaacgctttcgagaaattaaactctagtcctgacgatcaagtgtacagctttttacccagccaggacgttaacagcttcaatgactcttctgagtttataaaccccgactctagtaatatgacgccaatattttccactcaaaatatgaatctgaatggcgagaatctggaaaattctggctctacactgtcactgaatcccctgccaagtcattctgttctgaacgagagcaaatgtttcatcaaagataacaccctggcactggagagtaattacccggaagacagcctacttagctcatctcttaacgtggccagcgattccatcgcaggatgttctagtctgaaccaaaagcagaaagagttattggagtccgagtgcgtggaggcacagttcagcgaagcgcccgtcgacctggacgcatccgagccccaggcttgtctcaacctgccaggattagatctcccaggcactggtggtgatcagaaaagcacccgagtgagcgacgtattcttacctagcgaagggttcaacttcaagcctcataaacacccagaactccctaccaagggtaaagacgtatcttactgccccgttctggcacctctgcctctcttgctgcccccgcctcccccaccgccaatgtggaatcccatgattccggccttcgacctgtttcagggtaaccacggtttcgtggctccagtcgttaccaccgctgcacattggcggtccgtgaactataccttccccccatcagttattagtcatacatctccgaccaaggtctggcgaaacaaagacggaacgtcagcataccaggtccaagaaactccagttagccaagtagttcgcaaaaagacctcctacgtggggctggtcctggtactactccgtggattacccgggagcggaaaaagcttcttggcccgaacactccaggaagataacccgtccggcgtaatcctgtccacggatgattatttctacatcaatggccagtatcagtttgatgtgaaataccttggcgaagcccacgaatggaatcagaacagggcgaaggaagcttttgaaaaaaaaataagccctatcatcatcgacaacactaacttgcaggcttgggagatgaaaccttatgtggccctgagtcagaaacacaagtataaagtcctgtttcgagaaccagacacatggtggaagtttaagcctaaggagctagcccggagaaatatacacggcgtgtctaaggaaaaaattactagaatgcttgaacactatcagcggtttgtgtccgtacccatcatcatgtcttcaagtgttcctgaaaaaattgaacgcattgaactttgcgcctattcgtgtgaagaccggagtacttcccctagggatgacgaggacatcatctctgaaaaagaagagaacattctctctctctcattaaaacatctggagtttactgaggagaagaacttagatgtaaccaaggagactatgctccctgaaaacgtggcctatctgagcaatgccgatcttaataaaagacgcaaagagatttcggatatgaatccttctattcagagtgccctgatcctggagaccccccacatgtacttttccgattctgaaagtaaactgcaagcgaccgacaagtctgagaacgagcagattgagatggtagcagtgaagggatacagcaagacagataccgatagttccatggagcgagtgagtcctagcacatgttgttctgaaaacaatcaggaggattgcgacctggcgaacagcggacctctacagaacgagaaatcaagtcctggtgaaattgtagaagagcgggccacagtaacaaagaaagccttcggcaaacaaaagagcaagtcaactctcgagaaattccccaggcacgaactctccaattttgtgggtgattggcctgtagataagacaattggtcagagaacgaaaagaaaccgtaagacagaaaagacgtcctcagtacagtctgacaaaaagtataactatcctcagagccacaaactggtgaattccgtctccgtcaatacggattgtgttcagcagcgaggcagcccacatgaatccgtcgaggacgggaggaagtctcagtgtgacgacgcttctgaacccttgaacagttataagtacgatgcatacaaaaatattgacaagaactccttcaacattatgggagattggccatcttccgatagtctggcacagcgggagcaccgttcccgaatgccaaaaacgggactgagcgagccgaatcttgaaattggcacgaatgataagatgaacgaaatcagcctgagtaccgcccatgaagcttgctggggcacttcttcgcagaagctgaagacgttaggctcatccaatctagggtcctcagaaatgctgttatccgagatgacctgcgagtcccagacatgtcttagcaaaaaatcacatggccagcacacatccctgccattgacatttaccaatagtgccccaactgtgtccggagtcgtggagccacagaccctggccgagtgccaggaacagatgcccaagcgggatcctggtaaagaggttggcatgtgtacccagacagagcctcaggattttgctctactgtggaaaattgaaaaaaacaagatcagcattagcgacagtattaaggtgctcaccggtcggctggatgggttcaaacctaaagtatttaacattaacactaagtctgacgtccaggaggcaatcccctatcgggttatgtatgacaaaagcacctttgttgaggagtccgagctgacaagtgccgacgaatccgaaaatttgaacattctctgtaagctgttcggcagtttctctttggaagccctgaaggatttatacgagcgctgtaataaggatatcatttgggccacttccctgcttctggatagcgaaacaaaactctgcgaagatactgagttcgaaaacttccagaagtcatgtgacggatcccagattgggcccttctccttgggcctcaatctcaaggaaataattagccagagaggtaccctggaaaatagcaatagtcccgtgccagagttcagtcacggcatcggcatcagcaacgccgattcacagtctacctgcgacgccgaacgaggtaattcggagcaagccgagatgcgcgcagttaccccagaaaaccacgaatctatgacttcgattttcccctcggcagcggtgggcctgaaaaataacaatgatatcctgcccaatagccaagaagagttgctctattcctcaaagcagagctttcccgggatacttaaagccaccacacccaaggacatgtcagaaaccgaaaaaaatctggtggtgaccgaaacaggagataacatccatagtcctagtcactttagcgatatcttcaatttcgtgtcctccacctctaacttagaacttaatgaggagatttactttaccgatagcttggaaattaagcgaaatgaaaactttcctaaagactacgtcaagttcagtgatgaagaggaatttatgaacgaggacgaaaaggagatgaaagagattttgatggctggctcctccctgagcgcaggcgtctcaggcgaggacaaaacagagatactcaatcctaccccagccatggccaagagcctcactatcgactgtctagaactcgcactgcctcctgagctagcctttcaattgaacgagctgtttggacccgttggaattgacagcggctcgctgacggtggaagattgcgttgtgcacatagacttgaacctggcaaaagttattcatgagaaatggaaagaatcagttatggaacgccagagacaggaagaagtgagttgtggaaagttcatgcaggatccatcattggtagggcataccggccttgataaccccgaacagaaaagctcccagaggacaggcaaaaagttactgaaaacattaaccgccagcgagatgttaccgcttcttgaccattggaatactcagaccaagaaagtaagtctgcgagagatcatgtccgaagagatcgcactacaagagaagcacaacctgaaaagggagacacttatgttcgaaaaagactgtgccaccaagctgaaggaaaaacagctttttaagatcttccctgcaatcaaccagaatttcctggtcgacatctttaaagaccataactacagtttggaacatactgtgcagttcttaaattgcgtgctggagggagacccggtgaagactgtggtggcccaggagttcgtacatcagaacgagaacgtaacgtctcataccgggcaaaagtccaaagaaaaaaaaccgaagaagctaaaagaaactgaggaaacgccatcggaattgtcattccaagatttcgagtatccggactacgacgactaccgcgctgaggctttcctgcaccagcagaagcgcatggaatgctatagcaaggctaaggaggcttaccgcattggtaagaaaaatgtcgccaccttttatgcccagcaagggactcttcacgaacagaaaatgaaggaagccaatcacctcgcagccattgaaatctttgaaaaagtgaacgcctccctcctgcctcaaaatgtgctggacttgcatggcctgcacgtggacgaagccctagaacacctaatgcgtgtgctcgaaaagaagaccgaagaattcaagcagaacggagggaagccttacctgagcgtcatcaccggccggggaaatcactcacagggcggcgtggctaggataaagcccgcagttataaaataccttatttctcattcttttcgattctccgaaatcaagcccggatgtcttaaagttatgttaaagtag

SEQ ID NO: 13929 - DNA, 1362 bp, Artificial Sequence
  Description of Artificial Sequence: Synthetic coding sequence
atggactggaaggaggtcctgaggcgacggcttgcaaccccaaatacctgccctaacaagaagaagtcagagcaagaactcaaggacgaggagatggatctgtttaccaagtactattccgaatggaaaggagggagaaagaacaccaacgagttttataagaccatccctcgcttctactatagacttcctgccgaagatgaggtgctcctgcagaaacttagagaagagtcacgcgcagtctttcttcaaagaaagtctagggaactccttgacaatgaggagctccaaaatttatggtttcttctggataagcatcagacccctcctatgatcggcgaagaggccatgattaattacgagaacttcctgaaagttggcgagaaagcgggcgcaaaatgtaagcagttcttcaccgctaaagtgtttgcgaaactccttcacaccgatagctacgggcggatttcaattatgcagttttttaactatgtcatgcggaaagtatggctccatcagaccagaatcggccttagcctgtatgacgttgccggacagggatacctccgcgaaagtgatctcgagaactacattcttgagctcattccaaccctgccacagctcgatggactcgaaaagagcttctactcattctacgtttgcacagctgtgcggaagttcttcttcttcctggaccccctgaggaccggaaaaatcaaaattcaagatatcctggcttgttcattcctggatgacctgctagagctgcgcgacgaggagcttagtaaagagagtcaggagaccaattggttttctgcgccctcagctctgcgggtctacggacagtacctcaatctggacaaggaccataacggtatgctctcgaaggaggaattgtcccgatacggcacagcaaccatgactaacgtgttcttggaccgggtcttccaggaatgcctgacttatgatggcgaaatggactataaaacatatttggattttgtactcgccctagaaaatcggaaagaacctgcagcactccagtacatcttcaaactgctggacatagagaacaaggggtacctgaatgtcttctcccttaattacttcttccgggcaattcaagaactcatgaaaatacacgggcaagaccccgtgagcttccaggatgtgaaggatgaaatcttcgacatggtgaagccaaaagaccccctcaaaatttctcttcaagacctcatcaatagcaatcagggcgacaccgtgaccacaatcctgatcgaccttaacggtttctggacatatgagaacagagaggctttggtggccaacgacagcgagaactctgctgatctggatgacacttag

SEQ ID NO: 13930 - DNA, 3348 bp, Artificial Sequence
  Description of Artificial Sequence: Synthetic coding sequence
atgcccgaagatcaggtaggaaagctagaagccaccgagaacaccatctcagccatggctgctgctgccgcggagcagcagcagttctatctgctgcttgggaatttgctctcaccagacaacgtcgtgcggaagcaggcggaggagacatatgaaaacatccccggccagagcaagatcacattcctcctgcaggctattcggaacacaaccgccgcagaggaggcccgtcagatggccgcagttttgttacgccgactcttatcaagcgcctttgatgaagtgtatccggccctgccctctgatgtccagacagctataaaatctgagctgctgatgattattcaaatggagactcaatcttcgatgaggaagaaggtctgcgacatcgctgccgagttagcccggaatctgatcgatgaagacggtaacaatcagtggcccgagggactgaaatttctatttgactcagtcagcagtcaaaacgtagggctgcgtgaggctgctctccacatcttctggaattttcccgggatctttggcaaccagcagcagcattatctcgatgtaatcaagagaatgttagttcaatgtatgcaggaccaggagcacccttcaatacgcaccctgagcgcgcgggcgacagcagccttcattttggctaatgagcataacgtggctcttttcaagcatttcgcagaccttctcccaggatttctccaggctgtgaacgactcgtgttaccaaaacgatgatagtgtgcttaagagccttgtcgagattgccgatacagtcccgaagtacctaagaccccatcttgaagcaacactgcagttgtccttgaaactctgcggcgacactagtctcaataacatgcagagacaattggcattagaagtgatagtaaccctgtcagagacggctgccgctatgctgcgcaagcacacgaacatcgtcgcacaaacaatccctcaaatgctggcaatgatggtcgatttggaggaggacgaggactgggccaatgctgatgagctggaggacgacgattttgactctaatgcagttgctggtgaaagcgcattggacaggatggcatgcggcctgggtgggaagctggttctcccaatgattaaggagcatattatgcagatgctgcaaaaccctgactggaagtacaggcatgcaggtctgatggcccttagcgccatcggggagggctgccaccagcagatggagggtattctgaatgagatagtgaatttcgttctgctcttcctccaggacccacaccctcgggtgagatatgccgcctgcaatgccgtcggacaaatggcgacggacttcgcccccggctttcaaaagaaatttcatgagaaggtaatagccgcgcttctccagaccatggaagaccagggaaaccagcgggtgcaggcgcacgccgccgcagctctgatcaactttacagaggactgtcccaagtcacttttaatcccttacctggacaacctggtgaagcacttgcacagtatcatggttctcaagctgcaggagctgatccagaagggaactaagctcgtgctggagcaggtggtcacgtcaattgcctccgtggcagatactgccgaagagaaattcgttccttactacgatctgttcatgccctctcttaaacacattgtggaaaatgccgtccagaaagaattgcgcctcctccgcgggaagacaatcgagtgtatttccctcattgggctcgctgtaggaaaggagaaatttatgcaagatgcatccgatgtgatgcagttgctgctaaaaacgcagacggacttcaacgacatggaagacgacgacccccagattagctacatgatttccgcctgggctcgcatgtgtaagatactcggcaaggaattccagcagtacctgccggtggttatggggccacttatgaaaacagcttccattaagcctgaggtcgctttgctggatacccaggatatggaaaatatgtcggatgacgatggatgggagttcgtgaatctgggggaccagcagagctttggcattaagaccgccggcctcgaggagaagtcgactgcctgtcaaatgctagtctgttatgccaaggagcttaaggaagggtttgtggaatacaccgaacaagtagtcaagttgatggtaccccttctcaagttttactttcatgatggggtcagagtggcagccgccgagagcatgcccctgctgctggaatgcgccagggttagaggtccggaatatctgacacagatgtggcacttcatgtgcgacgccctgattaaagccatagggactgagcctgattccgacgtactctcagagattatgcactcgttcgctaagtgtatagaggtcatgggcgacggatgtctcaacaatgaacacttcgaggagcttggggggatactgaaggctaagctagaagagcatttcaagaatcaagaactacggcaggttaaaaggcaagatgaggactatgacgaacaggttgaggaaagtctccaggatgaggatgacaatgatgtatatatcttgaccaaggtaagtgacatattgcactccatctttagctcttataaggaaaaggttctgccctggtttgagcagttgctcccgctcatagttaacctgatctgtccacaccgaccttggccggataggcaatgggggctttgtatattcgacgatgtgatcgagcactgttctccagcaagctttaagtatgccgagtactttctgcgccccatgcttcaatacgtatgtgacaatagcccagaagtccggcaggccgctgcctatggactcggagtcatggcccagtatggaggggacaactacagaccattttgcacagaagccttacccttattggtgagagtgatccagtccgccgattccaaaaccaaggagaacgtaaatgctactgagaactgcatatctgccgttgggaaaataatgaaatttaagccagattgcgtaaacgtggaggaggtactaccgcactggttgtcttggctccctctgcacgaagacaaagaggaagctgtacaaacttttaattatttatgtgacctaatcgaatcgaatcatcctatagtgctcggccccaacaacacaaatcttcccaaaatcttttctattatagctgagggagagatgcatgaggccattaaacatgaagatccttgtgccaagcgcctcgccaacgtggtacgtcaggtgcaaacatcaggcggcctctggaccgagtgcatcgcccagctgtccccagaacagcaggcagccatacaggagctcctcaactcagcttag

SEQ ID NO: 13931 - DNA, 1929 bp, Artificial Sequence
  Description of Artificial Sequence: Synthetic coding sequence
atgaagcggagtagcgtttcctcagggggcgcaggacgcctgagcatgcaagaactgaggagccaggacgtcaataaacaaggtctgtacactcctcagaccaaggagaagcccacatttgggaagctgagtattaacaagcctacgagtgaaaggaaagtctctctcttcggaaaaaggacaagtggccatggttcgcgcaatagccagcttggcatcttctcatcttctgaaaagataaaggatcccaggcccctgaacgacaaggcctttattcagcagtgcataaggcagttatgcgaatttctgactgagaacggctacgcacataacgtctccatgaagtcccttcaagccccatccgttaaagactttttaaaaattttcacatttctctacgggtttctctgcccttcatacgaattgccggacaccaagttcgaggaggaagtgcctcgcatcttcaaagacctgggctatccttttgctctgtctaaaagctccatgtatacagtcggggctcctcacacatggccgcacattgtggcagctttggtgtggttgatcgactgtataaaaattcacactgccatgaaagaaagctcccctctattcgatgatggccagccctggggggaggagacggaggacggcattatgcacaataagctgtttttggactatacaatcaagtgttatgagagctttatgtctggagccgacagcttcgacgaaatgaatgccgagctgcagtccaagttgaaggatttatttaatgtggacgccttcaagctggaatccctggaagccaagaatcgagcactcaacgaacagatcgccaggctggaacaggagagagagaaagagcccaatcggcttgaatcactgcgaaagctaaaggcttccctccagggagacgtgcagaagtatcaagcttacatgtctaatctggagagccacagcgctattctcgatcagaaactcaacgggctgaatgaggaaattgctagagtggaacttgagtgtgagacaattaagcaagagaatacacgcctgcaaaacattatcgataaccagaaatactcagtggccgacatcgagaggatcaaccacgaacgaaacgagctgcagcagactatcaataagctgacaaaagaccttgaagcagagcaacagaaactgtggaacgaagagctgaagtacgcaaggggaaaggaggcgatcgagactcagctagcagagtaccacaaactagccaggaagctgaagctcatccctaaaggggcggagaattccaagggttacgacttcgaaattaagtttaaccctgaggctggcgccaattgcctcgtgaaatatagagctcaggtttatgtaccactgaaggagcttctgaacgaaaccgaggaggaaataaataaagccctcaacaagaagatgggactggaggatacactcgagcagttaaacgctatgatcactgagtccaaacgcagcgtgcggaccctgaaggaggaggttcagaagctggatgacctctatcagcagaaaataaaagaagcagaagaggaagacgagaaatgcgcaagcgagctggagagcctcgagaagcataaacacctgttggagtctacagtgaatcaaggtttatccgaagcaatgaatgagctggacgccgttcagagggaatatcaactcgtggtccaaaccacaactgaggaaaggcgcaaggtgggaaataatctgcagagactattggaaatggtcgcgacccacgtggggtctgttgagaaacatctcgaagagcagatcgcaaaggtggatcgggagtacgaagagtgtatgtctgaggatctgagcgaaaatatcaaggagatcagagacaagtatgaaaagaaggcgactctcatcaaatccagtgaagagtag

SEQ ID NO: 13932 - DNA, 4770 bp, Artificial Sequence
  Description of Artificial Sequence: Synthetic coding sequence
atgtcacttccgttttaccaaaggtgccatcagcattacgatctgtcttaccgcaataaggacgtgcgcagcaccgtgagtcactaccagagagagaagaagcggtccgcggtgtatacacaaggaagcactgcatactcatccaggtccagcgccgcacaccgcagagaaagcgaggccttccggcgggcaagcgcatccagttcacagcagcaagctagccagcacgcccttagcagtgaagtctcacggaaggctgcttcagcctatgattatggatcgtcccatggcttaaccgattcttccctcttgttggacgactattctagcaaactgagcccaaaaccaaaaagggccaaacacagcctgctgtctggagaggaaaaagagaacctgccgtccgactacatggtgccgatcttttccggacgtcagaaacacgtgtcaggaatcactgataccgaagaggagcgaatcaaggaggcagctgcctacatagcccagaggaacctgctcgcttctgaggaggggattacaacgtctaaacagtcaacggctagtaaacagaccacagccagcaagcagtcgactgcatccaaacaaagtaccgcgtccaaacagagcaccgcctcacggcagtccaccgcttctcggcagtctgtcgtgtctaagcaggccacctccgccctgcagcaagaggaaacgtccgaaaagaagagtaggaaagttgtgatccgcgagaaggctgagaggctttccctgcgcaaaaccctggaagaaactgagacttaccacgcaaaattaaacgaagaccatctcctccacgcccctgagtttattatcaaaccacgctctcacacagtctgggagaaggagaacgtgaaactccactgttctatcgcagggtggccggaacccagggtgacttggtataaaaaccaggtgcccatcaacgttcacgctaatcccgggaagtacataatcgagagccgctacggaatgcataccttggagattaatggatgtgatttcgaggacaccgcccagtaccgagcttcggctatgaacgtcaagggcgagctgtctgcctacgccagcgttgttgtaaagaggtataagggggagttcgatgaaactcgttttcacgccggcgcttctactatgccgctgagtttcggagtgaccccatatgggtacgcttcccggtttgagatacattttgatgacaaatttgacgtgagcttcgggagggagggtgaaactatgagtcttgggtgccgggtcgtcatcacacctgagatcaagcacttccaacctgaaattcagtggtacagaaatggtgtgcccctctcaccaagtaagtgggtgcaaacgctctggtccggagagcgtgctacactgacctttagccacttaaacaaggaggatgaagggctgtacaccattcgcgtcagaatgggagaatattacgagcagtatagcgcctacgttttcgttcgcgacgctgatgctgagatcgagggcgctccggcagcacccctggatgtcaaatgcctggaggctaacaaagactacatcatcatttcctggaagcagcctgccgttgatggcggatctcctatcttggggtatttcatcgataagtgtgaggtgggcacagacagttggtcccagtgcaatgacacccctgttaagtttgcccggttccccgtcactgggctcatcgagggccgcagctatatatttagagtcagggccgtgaacaaaatgggcattgggtttccatcccgcgtgtcagagcccgtggccgccctggaccctgcagagaaggcaaggctgaagtcccgtccctcggctccctggaccggccagatcattgtgaccgaagaggaaccttccgaaggcattgtcccaggcccacctaccgatctctcggtcacagaggctactcggtcatatgtagtactgagttggaagcccccaggccagagggggcatgaaggcataatgtatttcgtcgaaaagtgcgaagcagggacagaaaattggcaacgcgtcaacaccgagctgccggtgaagtcacctcgattcgctctgtttgacctggccgagggaaagtcttattgtttcagggttcgctgttcaaattctgcgggggtaggagagcctagtgaagcaacagaagttaccgtggtcggagacaaactggacatccccaaggctcctggcaaaatcattccttcaaggaacacagatacgtccgtggtcgtctcatgggaagaaagtaaagatgctaaggagttggttggctattacattgaggcctctgttgcggggtctggaaagtgggaaccgtgtaacaacaatccggtcaaaggttccagattcacctgccacggacttgttactggccagtcctacatttttagggtacgcgcagtgaatgcggccggcctgagcgaatatagccaggactccgaagcaatcgaggttaaagcagcaatcgcacctccctcccccccctgcgacattacatgcctggaatccttccgagactctatggtgttaggctggaagcagccagacaaaattggtggggctgagattaccgggtactacgttaattacagagaagttattgacggcgttccaggtaaatggagggaggcaaatgtcaaagccgtgagtgaggaggcatataagatcagtaacctgaaagaaaatatggtttaccagtttcaggtggcggccatgaatatggcgggtttgggcgcaccatccgccgtgtctgaatgcttcaagtgcgaggagtggacgatcgctgtgcccgggcctccacatagtctcaagtgctcggaagtgcgcaaagatagcctggtgctccagtggaagccccccgtccacagtggacgtaccccggtgaccgggtactttgtggatctgaaagaagccaaggccaaggaagaccagtggagagggctgaacgaggccgccatcaaaaacgtgtaccttaaagtacggggactgaaggagggggtgagctacgtgtttagggtgcgggcgattaatcaggccggtgtcggcaagcccagcgatctcgccggaccagtggtcgcagagactcgccccggcacaaaggaagtcgtggtgaacgtggacgatgacggggtgatcagccttaatttcgagtgcgacaagatgacaccaaagtctgagtttagttggagcaaagattacgtgtccacagaggattctcctcgcttggaggtagaaagtaaaggcaacaagaccaaaatgacgttcaaagacctgggcatggatgacctagggatctactcgtgtgatgttaccgatactgacggcattgcaagctcatatttaatcgatgaagaggagctgaaacgacttctggccctgtcacatgaacacaagtttcctacagttcccgtcaagtctgaactcgcagtggagatactggaaaagggtcaagtgcgcttttggatgcaggcagagaaactgagtggcaacgcaaaagtgaattacatttttaacgagaaggaaattttcgagggtcctaaatacaagatgcatatcgatagaaatacaggaattattgaaatgtttatggagaagctgcaagatgaggacgagggaacctatacattccaactgcaagatgggaaagctacgaaccactcaaccgtggtgcttgtgggcgacgtctttaagaaactgcagaaagaggccgagtttcagcggcaggaatggatcagaaaacaggggccacactttgttgagtacctcagctgggaggttacaggagagtgcaacgtgctcctcaagtgtaaggtcgctaacattaagaaagaaacacatattgtttggtataaggatgaacgcgaaataagcgttgacgagaaacacgactttaaagacggcatctgtaccctgctcataaccgagttttccaaaaaggacgcaggtatatacgaggtgatcctgaaggacgacaggggaaaggacaagtcaagactgaaactagtggacgaggccttcaaggaactgatgatggaggtgtgcaagaaaatagctctatccgctactgatttaaagatccaatctacggccgagggaatccagttatattcattcgttacttattatgtggaagacttgaaggtgaactggtcacataatggttccgccattcgctacagtgaccgtgtgaagacaggtgtcactggagagcagatctggcttcagattaatgagccgaccccaaacgacaaagggaagtatgtgatggaactctttgatggtaagacaggacaccagaagaccgttgatttaagcggtcaggcctatgatgaagcctatgcagagtttcagcgcctgaaacaggccgccatcgcagagaagaacagggcacgggttctgggcggtttacccgacgttgtgacgattcaggagggaaaggccctaaacctcacctgtaacgtttggggggacccaccccccgaggtttcttggctgaagaatgagaaggcactagctagcgacgaccattgtaaccttaaatttgaagcagggcgcaccgcatattttacaattaatggtgtgtccacagcggacagcggcaaatacggattggtcgtgaagaataagtatggctccgagacatcagactttaccgtgagtgttttcattcctgaagaagaagccaggatggccgcattagagtccctgaagggtggcaaaaaggctaagtag

SEQ ID NO: 13933 - DNA, 546 bp, Artificial Sequence
  Description of Artificial Sequence: Synthetic coding sequence
atgggggggttcttttcaagtattttcagcagcttgtttgggaccagggaaatgagaatcctcattctgggcctggatggcgctgggaagacaacaattctgtaccgcttacaagttggcgaagtggtgacaacgattcctaccatcgggtttaatgtagagacagttacctacaagaatctcaagtttcaagtctgggacctaggcggccagacttctattcgcccatattggcggtgctactacagcaacacagatgcagttatctatgtcgtcgattcttgcgacagggacagaataggaataagcaagagtgagctggtcgccatgttagaagaggaggaattgcgaaaagcgattctcgtggtgtttgctaataaacaggacatggagcaggccatgacatcatccgagatggcaaacagcctgggtctgcctgctctgaaggaccgcaagtggcaaatatttaaaacatctgctaccaaaggaaccggcctcgacgaggccatggagtggcttgtggagactcttaagagcagacagtag

SEQ ID NO: 13934 - DNA, 1269 bp, Artificial Sequence
  Description of Artificial Sequence: Synthetic coding sequence
atggccgccgctgccgtggttgagttccaaagagcacagtcactgcttagtactgaccgtgaagcctctatcgacatactgcatagcattgttaaaagagacatccaagaaaacgatgaagaagctgtccaagtgaaggagcagtccattctggaacttgggagcctgctagctaagaccggtcaggcagccgagttgggaggcctgctgaagtatgttcggccctttctgaacagtatttccaaggcgaaagccgccaggctggtgaggagtttgctggatctgtttttggatatggaggcagccacaggacaggaggtcgagctctgcctggaatgtattgagtgggcgaaatcagaaaagcgaactttcctccggcaggcccttgaagcacggctcgtctccctttacttcgacacgaagcgatatcaggaggctttgcatctgggaagccagctactccgggagctcaagaagatggatgataaagctctgctggttgaggtgcagttgctggaatccaaaacctaccacgctctctctaaccttcccaaggctcgtgccgcgctgaccagtgcaagaaccacagcgaatgctatctattgtccccccaagcttcaggcgactttagacatgcagtccggaatcatccacgctgccgaggagaaggactggaaaaccgcctactcatatttttacgaggcctttgaggggtacgactcaatcgacagtcctaaggcaatcacgtctctgaagtatatgctcctatgtaaaatcatgctgaacactccagaagatgtgcaggccctggtctccggaaaactcgcgctccggtacgctggcaggcagactgaagccctaaaatgcgtggcccaggcgtccaagaatcgttccctggccgattttgagaaagcactgaccgactatagggctgagctgcgggatgaccccatcatcagtactcacttggcaaagttatacgacaacctacttgaacaaaacctcatacgggtgatcgagccgttcagcagagttcagattgagcacatatctagccttatcaagctttccaaggctgacgtggagcggaaattatcccagatgatcctggataaaaaatttcatggaatcttagatcagggggaaggagtgctgatcatcttcgacgagccacctgtggataagacttacgaagccgcactggaaaccatacagaatatgtctaaggtcgtcgattcactgtacaacaaggctaaaaagctcacatag

SEQ ID NO: 13935 - DNA, 1449 bp, Artificial Sequence
  Description of Artificial Sequence: Synthetic coding sequence
atggcctccctggggcctgcagcagccggtgaacaagccagcggcgcagaggcagagccaggccctgctggcccccctcctccaccctcgcctagcagcctgggtcctctgctgccactacagcgggagcccctgtataactggcaggccacaaaggcctcattgaaagagcgcttcgcatttctttttaacagcgagttgttatcggatgtgaggttcgtcctgggtaagggcagaggggccgccgcggccggagggccgcagaggatcccggcgcaccgattcgtgcttgccgccggatccgccgtgtttgatgctatgtttaacggcggaatggcgaccacctctgccgaaattgagctgcccgatgtggagcccgcagcttttttagccctcctcaggtttttgtactctgacgaggtccagatagggccagaaacggtcatgacaactctctatacagcaaaaaagtatgcagttcccgcattggaagctcactgcgtcgaatttctgacaaagcacctaagggcagacaacgcctttatgctgcttacacaggcccggctgttcgacgaaccgcagcttgcatctctttgtctggacactattgacaagagtacaatggatgccatttcggccgagggcttcaccgacatcgacattgataccctctgtgctgtcctcgagagagataccctctctatcagggagtcaaggctgttcggggctgtggtacggtgggccgaagctgaatgccagaggcagcagctgccagtgaccttcggcaacaagcaaaaagtgctgggcaaggctctgagtcttatccggttcccactaatgaccattgaagagttcgccgccgggccggctcagagcggcatcctatccgatcgcgaagtcgtcaatctgttcttgcacttcaccgtcaaccccaaaccacgagttgaatacattgacagacccagatgctgcctgagaggcaaggagtgttgcatcaaccggtttcagcaggtcgagtcacgttggggctacagtggcacatccgatagaatccgattcacagtgaacaggcgaattagcattgtaggctttggtttgtatggaagtatccacgggccaactgactaccaggtcaatatacaaatcatcgagtacgagaagaagcagaccctgggccagaatgataccggctttagctgcgacggtaccgctaacactttccgtgtgatgttcaaagaacccatcgagattctgcccaacgtgtgctataccgcctgtgccactctgaagggccccgattcacactacggtactaagggcttaaaaaaagtggtacatgagacccccgctgcgtccaagaccgtttttttctttttctcttccccagggaataacaatgggacaagcatcgaggacggccagatcccggagattattttttacacctag

SEQ ID NO: 13936 - DNA, 2883 bp, Artificial Sequence
  Description of Artificial Sequence: Synthetic coding sequence
atgtcccgcctcattgtgaaaaaccttcctaacggtatgaaagaagaaagatttcgacagctctttgccgcttttgggactttgactgactgttcactgaagtttactaaagacggaaagtttagaaagtttggttttatcggatttaagtccgaggaggaagcccaaaaggcccagaaacatttcaacaaatcttttatcgatacatctcgcatcacagtggaattttgcaagtctttcggtgacccagcgaagcccagagcttggtccaagcatgcccaaaaaccatcccagccaaagcagccacctaaggatagtaccaccccggaaattaaaaaagacgaaaagaaaaaaaaggttgccgggcagctcgaaaaactgaaagaagacacggagtttcaggagttcctgagtgtacaccagagaagggcccaggccgcaacgtgggccaacgacggtctcgacgccgagcctagcaaaggaaagagcaaacccgcaagtgactatcttaacttcgactcagattccgggcaggaatccgaagaagagggcgcgggagaagacctggaagaagaggcatccctcgagccaaaggcagcggtgcagaaggagctgagtgacatggattacctcaaatccaaaatggtaaaagcaggttctagttcctcatccgaggaggaggaatcagaggacgaggcagtgcattgtgacgaggggtccgaggctgaagaggaggactccagcgccactcccgttcttcaagagcgtgactctaagggagccggacaggagcaaggcatgcccgcagggaaaaagaggccccctgaagctcgggccgagaccgagaaacctgccaatcagaaggagcctaccacatgccacactgtgaaattgcgaggggctcccttcaacgtgactgagaagaacgttatggaattcctagcacccctcaagccagtcgctatcagaatcgtgcgcaacgcccatggcaataaaacggggtacatcttcgtcgatttcagtaacgaggaggaggttaaacaggcacttaaatgtaacagggaatatatgggagggcgctatatagaagtgtttagggagaagaacgtacctacaaccaagggtgcacccaagaacaccacgaaaagttggcagggccgcattctcggagaaaacgaagaagaggaggatctcgctgaatccggccgcctgttcgttagaaacctcccatatacctccacagaggaagatctggagaaacttttcagtaaatacgggcctttgtccgaacttcattatcctattgacagcctaacgaagaagcctaaggggttcgcgttcatcacgttcatgtttcccgagcacgcagttaaagcttactcggaagttgatggtcaagtttttcagggaagaatgttgcacgtcctaccctccacaatcaaaaaggaggctagcgaggatgcctcagctctcggtagctcctcatacaaaaaaaagaaagaggcacaggacaaagctaacagtgcgtcctcgcacaactggaataccctgtttatggggcccaatgccgtggccgacgcaattgctcagaagtacaacgctacgaagtctcaagtgttcgaccacgagaccaaagggagtgtggcagtgcgagtagctctcggagaaacccagctcgtgcaggaggtgcgacggtttctcatagataacggggtgtcccttgacagtttcagccaagctgccgccgaaaggtccaagaccgtgatcctggtgaagaatcttcccgctggcacactggccgcgcagttgcaggaaacgtttggtcatttcggctccttaggtcgtgttttgctccctgaaggaggcattactgccatcgtggagttcctggagcctctcgaagcaagaaaggctttcagacacctggcttactctaaattccatcacgtcccactgtatctggagtgggcacctgtaggggtcttctctagcacagcccctcagaaaaaaaaactgcaggataccccctctgagcccatggaaaaagaccccgcagagcccgaaaccgtaccggatggcgagacacccgaagacgaaaaccccaccgaggagggggccgacaattcttcggcgaagatggaggaagaagaggaggaggaggaagaagaagaagaaagcctccctggctgcacccttttcatcaaaaacctcaatttcgataccactgaggagaagctgaaggaggtgttctccaaggtgggtaccgtgaagtcttgttctattagtaaaaagaagaataaagctggggtgcttttgtcaatgggatttggcttcgtagagtacaggaaaccggaacaggctcaaaaggcactcaaacagcttcaaggacacgtagtcgacggccataaattggaggttagaatttctgaacgtgcaacaaagcctgccgtaacgctggcgcgaaagaagcaagtcccaaggaagcagactacaagtaagattctcgtgcgaaacattccatttcaagcccacagtcgagaaatcagagaattattctccacgttcggagagttaaagactgtccgcctcccaaagaaaatgaccggtacaggaactcaccgagggtttggatttgtggacttcctcactaagcaggacgcgaaacgcgcatttaatgcactgtgccactccactcacttgtatggtcgaagactcgtactcgaatgggccgattccgaggtgactctccaggccctgcgtcggaaaacggcagcacactttcatgagcctcccaagaagaaaagatctgtcgtgttagacgagattcttgagcagctcgagggcagcgactccgatagtgaggagcaaacactgcaattgtag

SEQ ID NO: 13937 - DNA, 2919 bp, Artificial Sequence
  Description of Artificial Sequence: Synthetic coding sequence
atggccacccggggtcatgtccaggatccgaatgacaggcgcttgaggccaatctatgattacctggacaatggaaataataaaatggcaattcaacaggccgacaagttacttaagaagcacaaggacctgcactgcgccaaggtgttgaaagccattggcttgcaaaggaccggtaaacaggaagaggcctttactctggcgcaggaagtagccgccctcgagcctaccgatgataattcactccaggcactcaccatcctgtatcgtgaaatgcaccggccagaactggtgacaaaactgtacgaagcagccgtgaagaaggttcctaacagcgaggagtaccatagccacctgtttatggcgtatgcacgtgtcggggaatacaagaagatgcagcaggctggcatggcactgtacaaaatcgttcccaagaatccctattatttttggtccgtgatgtccctgatcatgcagtccatttcagctcaggatgagaatctgagtaaaactatgttcctcccattagctgagcggatggtggagaagatggttaaggaggacaaaatagaagccgaagctgaagtggagttatactatatgattttagagaggttgggcaagtaccaggaagcactggatgtcatcagaggtaagctcggggaaaagttaacatctgaaatacagagtagggaaaacaagtgtatggcaatgtataagaaactgtccaggtggccagaatgcaacgcattatcccgcaggctgctcctgaaaaattccgatgattggcagttctacctgacctacttcgacagcgttttccggctcatagaggaagcttggtctccccctgctgagggcgaacactcactggaaggcgaagttcactattccgccgagaaggctgtaaagttcatcgaggatcgcatcaccgaagaatcaaagagcagtcgccatttacgaggacctcatttagccaaactggagttgatccgcagattgaggtcacagggctgcaacgatgagtataagcttggcgaccccgaggaacttatgtttcagtactttaaaaagtttggagacaagccctgctgcttcaccgatctgaaagtgtttgtcgacttactgcctgccacacagtgtacaaagttcatcaaccagctccttggggtggtgcctctaagtactccaacagaggataaactggcactgccggctgatatccgtgccctgcagcaacacctctgcgtagtgcagctgacccgactgttaggcctctaccacactatggataagaatcagaagctgtccgtcgttcgggaactcatgctacgatatcagcatggactcgagttcggtaagacctgcttgaaaactgaattacagttcagcgattactattgcttgctagctgtgcatgcactcatcgacgtctggcgggagactggcgatgaaacaacagtgtggcaggccctgacactgctagaagagggtttaacccacagccccagtaacgcacagtttaagctgctcctggtacggatttattgcatgctgggcgcctttgagcccgtggtggacctttattccagcctcgacgcgaagcacattcagcatgacaccatcggctacctcctgactaggtacgctgaaagcctcggtcagtatgccgctgcctcccagtcatgcaatttcgcactacggttctttcatagcaaccagaaggatacatccgagtatattatccaagcctacaaatatggggctttcgaaaaaatacccgaattcattgcattccgcaacagactgaacaacagtctgcactttgcacaggtccgcaccgaacgaatgcttcttgatctgttgctggaggccaacatctccacatcactcgcggagtccatcaagtcgatgaacctccgtcccgaagaggacgacatcccttgggaggacctcagagataaccgtgacctcaacgtctttttcagctgggatcccaaagatcgggatgtgtccgaggagcataaaaaactgtctcttgaggaagaaaccttgtggctgagaatcaggtccctgacgttacgcctcatatcagggctaccttccctgaaccatccggtagaacctaaaaactctgagaagaccgcagagaacggtgtgagcagcagaatagacatcttgcgcttactgttacagcaactcgaggctactttggaaactggtaaaagattcatcgagaaagacatccaatatccattcctgggacctgtgcctacccggatgggcggtttttttaacagcggttgctcccagtgccagatttcttctttttatctcgtcaacgatatttatgagctggacacctccggcctggaggacactatggaaatacaagaacgcatcgagaattcctttaaaagtctgctggatcagctaaaggacgtgttcagcaaatgtaagggggatctgctcgaagttaaggacgggaatctgaaaacgcacccgacactgttggaaaatttggtcttctttgtagagaccatatctgtgatcctgtgggtgtcttcctattgcgagagcgtgctacggccctataaacttaacctccaaaaaaaaaaaaagaaaaagaaagagacatcaatcatcatgccacctgtatttactagcttccaggattacgtcacagggctccagaccctaatctcgaacgtagtggatcacatcaaaggactggaaacgcacttgattgctctgaagctggaggagttaattctggaagatacgtctctgagccctgaggaaaggaagtttagcaagaccgtccagggtaaggtgcagtcctcctatctacactctctgcttgagatgggggagctgttaaagaaacgcctcgagaccacaaagaaacttaaaatttag

SEQ ID NO: 13938 - DNA, 2166 bp, Artificial Sequence
  Description of Artificial Sequence: Synthetic coding sequence
atggctgagaagttcgaaagcttgatgaatattcatgggtttgatctcggcagcaggtacatggatctaaagccactcgggtgtggaggtaacggacttgtgttctcagcagttgacaatgattgtgacaaacgggtggcaataaagaaaattgtcctgactgatccgcagtctgttaaacacgccctaagggagatcaagatcatccgccgcctagaccatgataacatcgtgaaagtgttcgagatcctcggtccctctgggagccagctgacagacgatgtgggtagcctaaccgagttgaattctgtttacattgtccaggaatatatggaaacagacctggccaatgtgttggagcaagggcccctgctagaggaacacgctcgacttttcatgtaccagctgcttagaggtctgaagtacattcactcagctaatgtgctccaccgtgacctgaagccagcaaatcttttcatcaataccgaagacttggtcctcaagattggggatttcggcctggcaaggataatggacccccattactctcacaagggtcatcttagtgagggattagtaaccaaatggtatagatctcccaggctgttgctctcccctaacaactacactaaggctatcgatatgtgggccgcagggtgcatttttgctgagatgctcacgggaaaaaccctcttcgccggggcacacgagctggagcagatgcagctgattctggaatctataccagtagtgcacgaggaggataggcaagagctgctgagcgtgatccctgtctacatcaggaatgatatgaccgagccacataagcccttgacacagctgctgcccgggattagcagggaggccctagacttcctcgaacagattctaacattcagcccgatggataggctcactgcagaggaggctctttcgcacccctacatgtccatctattcttttcctatggacgagcccatctcctcccacccgttccatatcgaggatgaggtggatgatatcctgctgatggacgagacacactcacacatttataactgggagcggtaccacgattgccaattcagtgagcacgactggcctgttcacaataacttcgatattgacgaggtgcagctcgacccgcgggccctgtccgatgtaactgacgaagaagaggtgcaggtggatccaaggaagtatctagacggggatcgcgaaaagtatcttgaagatcctgcgtttgacactaattatagcaccgaaccatgttggcagtacagcgaccaccatgagaacaaatactgcgatctggagtgcagtcatacatgcaactataagacaaggagttcctcctatctggacaacctcgtctggcgcgagagtgaggtcaatcactactacgaaccaaagcttatcatagatctcagcaattggaaggagcaatcaaaggagaagagcgacaagaagggaaagagcaagtgtgagagaaacggactggtgaaggcccagatagccctcgaggaggcttcgcaacagttggccggcaaggaacgcgagaaaaaccaaggatttgactttgattcctttatcgcaggcacgatccagctgagttcacagcatgaaccaaccgacgtcgtggacaagctaaatgacctgaatagtagcgtctctcagttggaactcaagtcacttatcagcaaaagcgtgtctcaggagaaacaggagaagggcatggcaaacctggctcagctggaagcactgtatcagtcctcttgggatagccagttcgtgagtgggggggaggactgcttctttattaatcagttttgtgaggtgcgcaaagatgagcaggtcgagaaggaaaacacatataccagctacctggacaaatttttctcacgtaaagaagatacagaaatgttagaaacagagccagttgaggacggaaagcttggggaacggggtcacgaggaggggttcctgaacaactctggggaattcctcttcaacaagcagttggaatccatcggtatcccacagtttcattcacccgttggatcgcccttaaaatccattcaggctaccttgacccctagcgcaatgaagtcctctccacaaattccacatcagacctacagctcaattctcaaacatttaaattag

SEQ ID NO: 13939 - DNA, 948 bp, Artificial Sequence
  Description of Artificial Sequence: Synthetic coding sequence
atggcagccggcgtgccttgcgctctcgtgacctcatgctcctctgtcttttcaggcgaccaattggtgcagcacatattgggtaccgaggacctcattgtcgaagtgacctctaatgatgcagtcaggttctacccttggacaatcgacaacaagtactacagcgccgatatcaatctttgtgtggtaccgaataaattcctggtaacagctgagatagctgagtccgtgcaggccttcgtcgtctactttgactccacacagaaatctggactcgatagcgtcagctcttggctgcccctcgcgaaagcctggctgcccgaggtgatgatccttgtgtgcgatagggtctcggaagatggaataaatcgccaaaaggctcaggaatggtgtattaagcatggattcgagttggttgagctgtcgccagaagagttgcccgaagaagacgacgatttcccagaatccaccggagtgaagagaattgtacaggccctaaatgcaaatgtttggagcaatgttgtgatgaagaatgacaggaatcagggcttctctctcctgaatagcctcactggtactaaccacagcatcggtagcgccgatccatgccatccagagcagccccacctgcctgccgctgattcgactgagtcactcagtgaccacagaggaggggcgtcaaacacaacagacgcccaagtcgatagcatcgtggaccctatgctcgacctagacatccaggaattggcttctttgacaacaggggggggcgacgtagagaatttcgagcgtctgttctcaaagctgaaggaaatgaaagacaaggctgccacgttgccacatgaacagcggaaagtccacgcagagaaagtggctaaagctttctggatggccatagggggagatcgggacgaaatagagggcttaagctctgatgaggagcattag

SEQ ID NO: 13940 - DNA, 1338 bp, Artificial Sequence
  Description of Artificial Sequence: Synthetic coding sequence
atggccgcaccagaggagcgtgatttgacccaagaacagaccgagaaactgctgcaattccaggatctgacaggcatagagtctatggaccaatgcaggcataccttagagcagcataactggaacatcgaagctgccgttcaggatcgcctgaacgaacaggagggtgtcccatctgtgttcaacccgccacccagtagacctctgcaggtgaacactgctgaccaccgaatatattcatatgtggtgagccggccacagcctagaggcctgctgggttggggttactatctcatcatgttgcccttcagattcacctattacactattctggacattttccggttcgccctgagatttatccggccggatcctagatcccgggtcaccgatcctgtgggggatatagtgtccttcatgcacagctttgaggagaagtatggacgtgcacaccccgtgttctatcagggtacttactcccaggccctgaacgacgcaaagagggagctgaggtttctactcgtttatctgcatggcgatgaccaccaggattctgatgagttttgcaggaataccctgtgtgccccagaagttatttcgctcatcaatacgagaatgctcttctgggcatgcagtacaaacaaaccagaagggtatagagttagccaagcactgcgagaaaatacatacccattcctggccatgatcatgctgaaagatagaaggatgaccgtggtgggccgactggagggcctgatccaacccgacgatctgatcaaccagctgaccttcatcatggatgccaatcagacttacctcgtgagcgaaaggcttgagcgggaagagaggaaccaaacgcaggtgctgaggcagcagcaagacgaagcatatcttgcaagcctgcgcgccgatcaagagaaggagcggaagaagagagaggagcgagagcgaaagaggcggaaggaagaggaggtgcaacagcagaagctcgccgaggagcgcaggagacagaatctgcaggaagaaaaagaaagaaaactggagtgcctgcctcctgagccctcaccagacgatccagaaagcgtgaagattatcttcaagctgcccaatgacagccgggtggagagaaggttccacttttcccagtcactcacagtgatccacgatttcttgttcagcctcaaggagtctccagaaaagtttcagattgaggcaaattttccccggcgggtgttgccgtgtatccccagtgaggaatggcccaacccgcccacattacaagaggcaggtctatcccatacggaggttcttttcgtgcaagacctgactgatgagtag

SEQ ID NO: 13941 - DNA, 2724 bp, Artificial Sequence
  Description of Artificial Sequence: Synthetic coding sequence
atggctacccccgaccaaaagtcacccaatgtcttgctgcaaaacctttgttgtcggatacttggccgcagcgaagccgacgtggcgcagcagttccagtacgctgtgcgggttatcggcagcaatttcgctcccaccgtggagcgcgacgaattcctggttgccgagaagataaaaaaagaactgatacggcaaaggcgggaggctgacgcagccctttttagcgaattgcaccgcaagttacacagtcagggcgtactgaagaacaaatggagtattctatatctcttgctgtccctctctgaggacccccgccggcagcctagcaaggtgtcatcttatgcaactctgtttgcccaggccctcccacgagacgcccactccacaccatattactacgcccgcccgcaaacacttcctctgtcttatcaggaccgctcagcccagtccgcacagtctagtggctccgtcggctcaagcgggatctccagtatcggactgtgcgccctctcagggcctgcgccagccccacagtctctccttcccggtcagtccaaccaggctcctggcgtgggggattgtttgcggcagcagttgggttcacgtctggcctggacgctcactgccaaccagcctagttcacaggccacgacttccaagggagtgccttccgctgtgagccgcaatatgaccaggtccaggagagaaggcgatactggaggcacaatggaaatcacagaagccgcgcttgttagagacattctctacgtgttccaaggcatcgacggcaagaatatcaagatgaacaatactgaaaactgttacaaggtggaaggcaaagcaaatctgtcccgctctctgcgtgacacagccgtgcggctctccgaactgggatggctgcataataaaattcgtcgctacaccgaccaaagatccctcgatcgctcgtttggcctagttggacagtcattctgtgctgccttgcaccaggagctccgggagtattatcgtctgctctccgtcctccattcccaactgcagctggaagatgaccaaggagtgaatctgggcctcgagtcgtcattaactctgcgtcgattgcttgtgtggacctatgatccgaaaattcggctgaaaaccctggccgccctcgtggatcattgtcagggcaggaaaggaggagaactcgcctctgcagttcatgcttacactaagaccggtgatccatacatgcggtctcttgtacagcacatactgtccctggttagtcatcccgtgctatccttcctctatcggtggatctacgatggggagcttgaggacacataccacgagttttttgtggcgtcagatcctaccgttaagacagatagactttggcacgataagtacacactgaggaaaagcatgattccgtcatttatgaccatggatcagtcgagaaaagtcctgcttatcgggaagagcattaatttcttgcaccaagtgtgtcacgatcaaacacccaccactaagatgatcgcagtgactaaatctgccgaaagcccccaggacgccgcagatcttttcaccgatttggaaaatgctttccagggtaaaatagacgcagcatactttgaaacctcgaaatacctgctggatgtgttaaataagaagtattccctacttgaccacatgcaagcaatgcgccggtatcttcttctcggacagggcgactttatccgtcacctgatggatctgctgaagccggagcttgtaaggccagccaccaccctctatcagcacaacttgacaggcatacttgagaccgctgtgagagctaccaacgcacagtttgattcacctgagatcctgcggcggcttgatgttagactccttgaggtgtcccccggggataccggttgggatgtgttctctctggactaccacgtcgacggaccgatagcaaccgtttttacgagggagtgtatgtctcactacttacgagtgtttaatttcctttggagggcaaagcggatggaatatattctgacggatatccgcaaaggccacatgtgtaatgctaagctcctccgtaatatgccggagtttagcggcgtcttacaccagtgtcacatcttggccagtgagatggtccactttattcaccaaatgcagtattatataacatttgaggtgctcgaatgcagctgggatgagctctggaataaggtgcagcaggcccaagatctggatcatattatcgccgctcacgaggtgttcctggacacaataatctcccggtgcttgctcgacagcgattcccgagcactgctgaaccagctcagggctgtgtttgaccagatcatcgagctgcagaacgcgcaagatgcgatttatcgtgccgccctggaagaacttcaacggcgccttcagttcgaagagaagaagaaacagagagagattgaagggcagtggggtgttaccgcagctgaagaagaggaggaaaacaaacgtatcggcgaatttaaagagagtattccaaaaatgtgttcccagctgaggatcctcacgcacttttaccagggcatagtgcagcaattcttggttctgctcaccacctccagcgatgagtcgctccgttttctatcctttcgactggattttaatgaacactacaaagctcgggagcctaggctgagggtctcccttgggaccagaggcagaaggtcctctcacacatag

SEQ ID NO: 13942 - DNA, 1086 bp, Artificial Sequence
  Description of Artificial Sequence: Synthetic coding sequence
atgactggtaaggcaggcgaagcactcagcaagcccaagagtgagaccgtcgcaaaatctacctctgggggtgcccctgcccgctgtactgggtttggtattcaggagatcctgggactgaacaaagagccaccctcgagccatccacgcgctgcgttggatggactggctcctggccacttgctggctgcacgctccgtcctctccccagctggagtcggaggtatggggttactgggtcctggaggactgccaggattttatacccagccgacattcctggaggttctttctgatccacaaagcgttcatcttcaaccgcttggcagggccagcggtccactcgacacatcccaaacagcctcctctgattctgaggatgtgtcttcttccgacaggaaaatgtccaaatccgctctgaaccaaacaaagaagcggaagaagcgacgacatcgaacgatctttactagctaccagctagaggagctcgaaaaggctttcaacgaggctcactaccccgacgtgtacgcacgcgagatgttagctatgaaaaccgaacttcccgaggaccggatacaggtctggtttcagaatcgaagggcaaaatggagaaagcgagagaagtgttggggccggtccagtgtgatggcggaatacggcttgtatggggccatggtgcgccacagcattcctttacctgagagtattcttaagagcgcaaaggatggcatcatggactcctgtgcaccatggctgctcggaatgcacaagaaaagtctcgaggccgcagctgaatcaggcagaaaacctgagggagaaaggcaggctctgccaaaactggataaaatggaacaggacgagagaggccccgatgctcaggctgccatcagccaggaagagctccgggagaacagcatcgccgtccttagggccaaggcccaagaacactctacaaaagtgctcggcaccgtaagcggacctgacagcctcgccagatccaccgagaagccagaggaggaagaagccatggatgaggatcgcccagcggagcgtctctccccgccacagcttgaagatatggcatag

SEQ ID NO: 13943 - DNA, 2073 bp, Artificial Sequence
  Description of Artificial Sequence: Synthetic coding sequence
atggaggagagccctctgtcacgagctcccagccgcggcggtgtgaattttctgaacgtcgctcggacctatattcccaatacaaaggtggaatgtcactacactcttccaccaggcaccatgccatccgcttcagactggatcggcatttttaaagttgaggcagcgtgtgtccgggactatcacaccttcgtgtggtcttcagtgcctgagagtacaactgatggaagccctattcatacaagcgtgcagttccaggccagctacctccccaagcctggcgcccaactgtatcagttcagatatgttaacaggcagggccaagtgtgtggacagtccccacctttccaattcagggagccacgacccatggacgaacttgttactttagaagaagcggacggtgggtccgacattcttttagtggtgccaaaggctaccgtgctgcagaaccagctcgatgaatcccagcaagagcggaacgacctgatgcagctgaaactgcagttagagggtcaagtgacagaactgaggtcaagggtgcaggagttagagcgcgcgcttgctaccgcaagacaagagcacaccgaactgatggagcagtacaaaggaatttcccggagccacggagagattaccgaagagcgagatatactctcacgccagcagggagaccatgtcgcaagaatcctcgaacttgaggacgacatccaaaccatttcggaaaaggtcctcactaaggaggtggagctagacaggcttcgcgacaccgttaaggccttaactagagagcaggaaaagctgcttggacagctgaaggaggtgcaagcagataaagaacaaagcgaagcagaactccaggtcgcacagcaggagaatcatcatttaaatctagacctaaaggaagcgaaaagctggcaggaagaacagagcgcgcaagctcagcgcttaaaggataaagtcgcgcagatgaaggacactcttggacaagcgcagcagagagtcgctgagctagagcccctcaaagagcagctgagaggcgcgcaagagcttgcagccagttcacagcagaaggcaacgctgctcggtgaagaactggcctctgccgctgccgctcgcgaccgtaccatcgccgagctgcatcggtcccgcctggaggtggccgaagtgaacgggcgattggcagaacttggcttgcatctgaaggaggagaagtgtcaatggagcaaggaacgagccgggctgctccagtcagtggaggccgaaaaagataagattctcaaactctcagcagagatcctgagattagagaaagccgtgcaggaggaacggactcagaatcaagtattcaagacagagctggcaagggaaaaggatagtagtctggtgcagctgtcagaaagcaagagagagttgacagaactccgatctgccctcagggttctgcaaaaagagaaggaacaattacaggaagaaaagcaagaactgctcgaatacatgcggaagctggaggccaggttggaaaaggtggccgatgaaaagtggaacgaggatgcgacaaccgaggatgaagaggccgcggttggcctgagctgtcctgctgcactcactgactcagaggatgagtcacccgaagacatgagattaccaccctatggactgtgtgagcgcggggacccaggcagtagtcctgcggggccccgggaggcctctccactggtggtgattagccagccagctcccatttctccacacctgtcgggacccgccgaagactcgagcagcgactcagccgaggatgagaagtccgtgctgatggctgcagttcagtctggaggggaagaagctaatctgctgctgcccgaactgggttcagctttctacgatatggctagcggcttcacagtggggaccctttctgaaacaagcacaggtggcccggctacccccacttggaaggagtgccctatttgcaaggaaagattccccgccgaaagcgataaggatgccctggaagaccatatggatgggcatttcttctttagtacgcaagatccattcacgttcgagtag

SEQ ID NO: 13944 - DNA, 1980 bp, Artificial Sequence
  Description of Artificial Sequence: Synthetic coding sequence
atgagtctgccacccgaaaaggccagcgaactaaagcagttgatccaccaacagctgagcaaaatggatgttcacggaaggataagggagatcctggcagagaccatacgggaggaactcgcaccagatcagcagcatctgagcaccgaggatcttattaaggccttacggaggagaggcatcatcgacgacgtgatgaaggagctgaatttcgtgacagatagcgtggagcaggagttgcccagctcaccaaaacagccaatttgctttgatcgccagtctaccctaaaaaaaacgaatatagaccctacccgcaggtatctttatctgcaggtacttggcggcaaggcattccttgaacatctgcaagaaccggaacccctcccggggcaagtttgcagtacgttcacgctttgcctgcattacagaaatcagagatttaggtctaagcctgtgccctgcgcttgcgagcctgatttccacgatgggtttctactcgaagtccaccgcgagtctcttggcgatggcacccgcatggctgacagtacaaccatgctcagcatcagcgaccccatacacatggtgctcattaagactgacatcttcggcgaaaccacactggtggcttcctattttctggaatggcgctcggtgcttgggtccgagaacggcgtcacatctttaactgtcgaactgatgggggtggggacggagagcaaggtgagcgtgggcattttgaatatcaaactcgagatgtatcccccgcttaaccagacattgagccaggaagtggtgaacacacaactggccctggaaagacaaaagacagctgagaaggagagactatttcttgtgtacgcaaagcagtggtggagagaatacctgcagatcaggcccagccataatagtcggttggtgaaaatctttgctcaggatgagaatgggatcaacaggccagtctgcagttatgtgaagccattacgcgcgggtagactcctcgacacaccccgccaagcagcgcgtttcgtcaacgtgcttggctatgagcgagccccggtgatcggcggaggcggtaaacaggagcaatggtgtactctgttggcattcctgtgccgcaataaaggcgactgcgaggatcacgccaacctcttgtgctctctcttgctcggctatggtcttgaggctttcgtctgcgtgggtaccaaggcaaagggcgtgcctcacgcttgggtgatgacttgcggaaccgacggtgctatcactttctgggaatcgcttaccggccacaggtatattcacaaaccaacaaatcctgacgaacccccagtggccgaacagccaaagcccctgtatccctatcgcactattggatgtgtctttaaccatcagatgtttctggggaattgtcagccgtccgatgccgtcgaaacatgcgtatttgatttaaatgatgagagcaagtggaagccgatgtccgaggaagctattaaaagtgtttgcgcaccaggtgctaccacaagcctgccaccatttccccccctgtgcgcttcgaccattgatgcgtctgttacctctaatgagattgagatgcaacttcgcctgctcgtgagcgagcacaggaaagacttaggtctaaccaccgtgtgggaggaccagctctcctacttactctctcctgcactcgctagctatgagttcgagagaaccaccagtattagcgcgggtaatgaagaattccaggacgccatcagacgtgcagtccccgacgggcacactttcaaaggatttcccatccacttcgtgtacagaaatgctcggcgagccttcgctacctgcctgcggagccctttctgcgaggaaatcatttgttgtagaggcgatcaagtgcgtctggctgttcgagtgagagtatttacttatccagagagcgcctgtgccgtgtggattatgttcgcttgtaagtatcgttccgtgttatag

SEQ ID NO: 13945 - DNA, 1500 bp, Artificial Sequence
  Description of Artificial Sequence: Synthetic coding sequence
atgttagaaaggccacctgctctggccatgcccatgcctacggagggtaccccccctccactttctggcacccccataccagtgccggcctacttccgccacgccgagccaggattttccctcaaaagacccagaggcttgtccaggtctctacctccgccaccgcccgcaaagggctccatccccatatcacgcctcttcccccctcgcacccccggctggcaccagctccagccgagacgcgtaagtttccggggggaagcctccgaaactctccaaagtcctggctacgatcccagtcgtccagagtctttttttcagcagtcattccagaggctctccaggctcggccatgggagttatggcgaggtttttaaagttcggagcaaagaggatggccgcttatacgccgtcaaacgttcgatgtccccttttagaggccccaaagatcgagcccggaagttagctgaagtggggtcgcatgaaaaagtaggtcagcatccatgttgcgtccgcctcgagcaggcttgggaggaaggcggcatcctgtaccttcaaacagaactgtgcggacccagcttacagcaacactgtgaggcctggggcgcatctctccctgaggcacaggtgtgggggtatctgcgagacaccctgttggctctggctcacctgcactcccaaggtcttgttcacctggacgtcaaaccagcgaacattttcctggggccaagggggcggtgcaagctgggagatttcgggctgctagttgaacttgggacggctggagccggcgaagttcaggagggtgatccccggtatatggctcccgaattactgcagggctcctacggtactgcagccgatgtattttcattgggactgactatcctagaagtggcctgcaatatggagctgccacacggcggggagggatggcagcagcttcgccagggttatctgccccccgaattcaccgcaggtttaagctctgaactgagatccgttctcgtaatgatgttggaacccgacccgaaattgcgggccacagcagaggccttgttggcattgcctgttctgcggcaaccccgcgcatggggggtgctgtggtgtatggcagctgaggccctatcacgtggttgggcattgtggcaggcactccttgcactcttgtgctggctctggcatggcttagcccaccccgcttcatggctgcagccgctcggcccgcccgccacccccccgggcagcccaccctgtagccttctgctcgattcctcgctgagtagtaattgggacgacgacagcctcgggcctagtctaagccctgaagcagtgctcgcgagaaccgtgggctccacaagcacgccccgatcacggtgtactccgcgcgatgcactcgatttgagtgatatcaactccgagcctccacgcggatcttttcccagtttcgagccgaggaatttgctgagcttatttgaagacaccctagatccaacatag

SEQ ID NO: 13946 - DNA, 486 bp, Artificial Sequence
  Description of Artificial Sequence: Synthetic coding sequence
atggacgtgtttctgatgatccgccgtcacaaaactaccatctttaccgatgcaaaagagtcttccaccgtgttcgagctcaagaggatcgttgagggaatcttaaagagacctcccgatgagcagcggctttataaagacgaccagctgctggacgatggcaagacgttaggagagtgcggtttcactagtcagaccgccagaccccaggcccctgccaccgtgggtttagcctttcgcgcggatgacacattcgaagccctctgcattgagccattttcgtccccgcccgagctgcccgacgttatgaaacctcaggacagcggttcctctgctaatgaacaggcagtgcacctgcacgttcatagtcagaccatggcaaaaagcagaaacacctcctggtcccagtgccccggcctcacagcatgttctaccagagagccgcaggacggccccacccaggttcatcctcggtgggggctgtag

SEQ ID NO: 13947 - DNA, 1521 bp, Artificial Sequence
  Description of Artificial Sequence: Synthetic coding sequence
atgacaggagagaaaatccgctccctcagaagggatcacaagcccagcaaggaggaaggagatctgctggagcccggggacgaagaagccgctgccgcccttggtggtaccttcactaggtctaggatcgggaagggcgggaaggcctgccataaaatcttcagcaaccaccatcacaggctgcagctaaaggcagcccctgcatccagcaatccgccgggagcaccggctctacccctgcacaactcctccgtcactgccaattcccagtccccggcattgctggctggcacaaaccctgtggccgtggtggcagatggggggtcttgtccagcccactaccccgtgcacgaatgcgtgttcaaaggcgacgtgaggcgcctttcgtcattgataagaacccacaatattggacagaaggacaaccacgggaatacccccttgcatctagccgtgatgctggggaacaaggttacagcgttgctgagaaagttgaagcaacaaagcagagagagcgttgaggaaaagagacctcgactcctgaaagccttaaaggagcttggcgatttttacctggaattacattgggacttccagtcatgggtgccattgctgagtaggatcctgcccagcgacgcgtgtaagatctacaaacaggggatcaatatcaggttggataccactcttatcgacttcaccgacatgaaatgtcaacgcggggacttatcgttcattttcaacggggacgccgccccctcggaaagcttcgttgtgttggataacgagcagaaagtataccaacgaatccaccatgaagagtctgagatggaaactgaagaagaggtcgacattctcatgtcatccgacatctactccgccacgctgtccaccaaatctatctcatttacgcgcgcccagaccggttggctttttcgagaagacaaaacagaacgggtcggtaatttcttagcagacttttatctcgtgaacggcctggttctggaatctcgaaagcgcagagaacacttgtcggaggaagatatcctacggaataaggccattatggagagtctctctaaggggggtaacattatggagcagaacttcgaaccaatacggcgccagtccctcacaccccccccccaaaatacaattacatgggaggagtatatatctgctgagaacggtaaagccccccaccttggtagggaactagtctgcaaagagtccaagaagacttttaaagcgacaattgccatgagtcaggaattccctctggggatcgaactcctcttaaacgtcttggaagtggtagcacccttcaagcacttcaacaagctacgcgagtttgtgcaaatgaaactacccccagggtttcctgtcaagctcgacattcctgttttcccaacaatcacagccactgtgacatttcaggagttcaggtacgatgagtttgatggatccatttttactataccggacgactataaggaggatcccagtagatttccggacctatag

SEQ ID NO: 13948 - DNA, 699 bp, Artificial Sequence
  Description of Artificial Sequence: Synthetic coding sequence
atgcagccgccagcccctccagcagaactagccgctccactcccaagccctctgcccgagcagcccttggactctcccgccgcgccggctctctcaccttccggcctggggctccagcctggcccggagcgtacctcaacaaccaagtctaaggagctgtcaccaggcagtgctcaaaaaggaagtccaggctcaagccaggggaccgcctgcgccggaacgcagcctggagcccagcccggtgcacaaccaggggccagcccctcccccagtcagcccccggctgaccaaagcccacatacccttcgaaaggtatccaagaagcttgcacccatacctccaaaagtgccgttcggccagccaggcgccatggccgaccagagcgccggacagcctagccccgtctctctttcccctacaccaccatccactcccagtccatatgggctgagctacccacagggatattccttggcctcgggccagctctctccagccgcggcaccacctctggcaagtccttctgtcttcacgagtaccctgtccaaatccaggccaacgccgaagccacgtcagcggccaaccctcccgccaccgcaaccacctacggtgaatctcagtgcgtcctcgccacagagcacagaagcgcccatgcttgatgggatgtctccgggcgaaagcatgtcaactgctgtttag

SEQ ID NO: 13949 - DNA, 1221 bp, Artificial Sequence
  Description of Artificial Sequence: Synthetic coding sequence
atgcaccctgccgtgttcctttctttgccagacctgcgctgttccctcttgctattggtgacatgggtgtttacacccgttacgaccgagataacaagtctggacaccgaaaacatcgacgaaatccttaacaacgcagacgtcgccctggtgaacttctatgcggattggtgccgattttcgcagatgttgcacccaatctttgaggaagcttcagacgttatcaaagaagagtttccaaatgaaaaccaggtcgtgttcgcacgggttgactgtgatcagcacagtgatatcgctcagcgttataggattagtaaataccccaccctaaaactgtttcggaatggtatgatgatgaagcgtgaatatagaggccagcgctccgttaaagcactggccgactatatccgccaacagaaaagcgaccctatccaggaaataagggacctggctgagataactactctggacaggtccaagaggaatatcatcggatattttgaacagaaagacagtgacaactatagggtgttcgagagggtcgctaacatactgcatgacgattgcgctttcctctcagccttcggggacgtcagtaagcccgaacggtacagcggagacaatattatctacaagccccccggtcattccgcccctgatatggtctacctaggtgccatgacaaactttgatgttacctataattggatccaagacaaatgtgtcccattggtgagagagataaccttcgaaaatggcgaagaactcaccgaggagggcctcccctttttaattttgttccacatgaaggaagataccgagtcattggagatctttcagaatgaagtggcccggcaactgatctccgagaaaggtaccatcaactttttgcatgctgactgcgataagttccgccatcccctgttgcacattcagaagacccccgccgattgtccagtgattgcaatcgacagttttaggcacatgtatgtctttggtgactttaaggatgtgttaatcccaggaaaactgaaacaatttgtattcgatttgcactccggtaagcttcacagagaattccatcatggacccgaccctaccgacaccgcccctggggagcaagcccaggatgtggcctccagcccacctgagtccagctttcagaagcttgcaccatccgagtacagatatacccttctaagggatcgagatgagctgtag

SEQ ID NO: 13950 - DNA, 5601 bp, Artificial Sequence
  Description of Artificial Sequence: Synthetic coding sequence
atggatcccgtaggcctgcagctgggcaataaaaatctatggtcatgccttgtcaggctgcttaccaaagacccagaatggctcaatgctaagatgaagttcttcttacctaatactgacctggactctcgcaatgaaaccctggaccccgagcaaagagtgatccttcagctcaacaaactgcatgtccagggctccgacacctggcagtctttcattcactgtgtgtgtatgcagctggaggttccacttgacttagaggtgctgcttctaagcaccttcggatacgatgatgggtttacatcacagcttggagctgaaggcaaatcgcagcctgagagtcagctgcaccatggtctgaaacgtccgcaccagtcctgtggtagctccccccgacgcaaacaatgtaagaaacagcagctggaactggctaaaaagtatctgcagctgcttcggacttccgctcagcagaggtaccgctcgcagattcctgggagcggacaaccacatgcattccaccaggtttatgtccctccgattctgcgaagggcaaccgcctctttggacaccccagagggagccatcatgggcgacgtgaaggtcgaagatggcgccgatgtctccatcagcgacttgttcaacaccagagtcaacaaaggaccacgtgtcactgtgttgctggggaaagcaggaatgggcaagaccacactcgctcatcgactgtgtcagaagtgggcagagggccaccttaattgtttccaggcgctgtttctgttcgaatttcggcagttgaatttaatcacccgcttccttacaccgtcagagctcctctttgatttgtacctgtctcctgaaagcgaccatgatacggtcttccagtaccttgagaagaatgccgaccaggtgttactgattttcgatggcctagatgaggcgctgcagcctatggggcccgacggacctgggcctgtactgacactgttctcccacttatgcaacggcactctactgcccggctgtagagtgatggctacatccagacccggaaagctcccggcctgtctacctgctgaggccgccatggttcacatgcttggcttcgatgggccacgtgtggaagaatacgtcaaccatttttttagcgcacagccatctagagaaggggcacttgttgagctacaaactaatggccgtctacgctccctgtgtgcggtgcctgccctgtgtcaggtggcctgtttatgtctgcatcaccttctgcctgaccacgctcctgggcagtctgtcgccctgctccccaacatgactcaactgtatatgcaaatggtgctggccctgagcccccccgggcatttaccaacttcgagcctgctagatctgggcgaagttgccctgagaggcctagagactggaaaggtaatattttatgcaaaggatattgcacctcctcttatcgctttcggcgcgacacactcattgctgaccagtttctgtgtgtgcacagggcctggacatcagcagacaggttacgccttcacgcacctctcgttgcaggagttccttgcagcgctacacctgatggcgtcacctaaggtcaacaaggacaccctgacacaatatgtcacactgcacagtaggtgggtccagagaactaaggcccggttggggttaagtgaccaccttcccactttcctggctggcctggcttcttgcacttgccgcccatttctgtcacatctggcacagggcaacgaagactgtgtgggggcaaaacaagccgccgttgtacaggttctgaaaaaactcgccaccaggaagctcacgggacccaaagtggttgagttatgccactgtgtggatgagacgcaagagccagagttagccagcctcactgcccaatcactcccttaccaacttccctttcataacttcccgctgacttgtacagatcttgctacgctgactaacattttggaacaccgcgaggctccaatccatctcgacttcgacggatgtccccttgaaccacattgccctgaagccctggtcggatgcgggcaaatcgagaacttgtcttttaagagccggaagtgtggagacgccttcgcggaagccctgtctcggtcattgcccactatgggccgccttcagatgctgggactggctggaagcaagatcacggctcgcggcatttcccacctggtaaaggccttgccactgtgcccacagctgaaggaggtatcctttagagataaccagttatccgatcaggtggtgcttaatattgtggaagttctaccccacctacctagactgaggaagctcgatttaagcagcaattccatctgcgtgtctacgctcctttgtcttgctcgcgtggctgtgacgtgtcctaccgttagaatgcttcaggctagagaggccgacctgattttcctgctctctccccctaccgagactactgccgagcttcagcgtgctccagaccttcaggagtcagacgggcaacggaaaggcgctcagtcacggagcctcaccctgaggctgcagaaatgccaactccaggtgcatgacgccgaagctttaattgccctgcttcaagagggccctcaccttgaggaggtcgatctgtccggaaatcagctggaagacgaggggtgcagactaatggccgaagccgcgtcacagctacatatcgcccgcaagctggatctgtccaacaatggcctgtctgtggccggtgttcactgtgtgcttcgcgcagtttcagcttgctggaccctggctgaacttcacatctctctgcagcacaagaccgtcatattcatgtttgcgcaagaaccagaagagcagaaagggcctcaggagcgggctgcgtttctcgactccttgatgctccagatgccctccgagttacctctgagcagtaggaggatgaggttaacacactgcggtctccaagagaagcacttggaacagctatgcaaggctctgggtggctcttgccacctcggccacctccacctggacttttcgggcaatgcacttggcgacgaaggtgctgcccggctcgctcagctgctacctggattgggagccctccagtccttgaatctcagtgagaacgggctttccctcgacgctgtgcttgggttagtccgttgcttctccacactccaatggctgttcaggctcgacatctcgttcgagtcccagcacattctgcttagaggcgacaagaccagccgcgatatgtgggccaccggctccctgcctgactttcctgcggccgcaaaattcttggggtttagacaaaggtgtatcccccggagcctttgcctcagcgaatgcccattagagccgcctagcttgacccgcctgtgcgctaccctcaaagactgtccaggccctttggaacttcagctctcttgtgaattcctctctgatcagtcccttgaaactctgcttgattgcctgccacaactaccacagctgagtctacttcagctcagtcaaaccgggctgagccctaagtcacctttccttcttgccaataccttgagtctgtgcccaagggtgaaaaaagtggacttgaggtccttgcatcatgcgacgctccacttcaggtccaacgaagaggaagagggtgtttgctgcggaaggtttaccggatgtagcctaagtcaggaacatgtggagtccctctgttggttactcagcaagtgcaaggacctttctcaggttgacctttctgccaatcttctaggggatagtggccttcgatgcctgctggaatgcttaccgcaggtgccaatatctggtctgttggacctatcccacaattcaatttcacaggagtcggcgttgtacctcctggaaacactgccaagttgccctcgagtgcgagaggcctctgttaatcttggttctgaacagagttttcggatacacttcagccgcgaggaccaggcgggcaagacactacggttgagcgagtgtagctttcgccctgaacacgtgtctcgtcttgctaccggactctccaaaagcctccaattgacagagttgacattaacccagtgctgcctgggccagaaacagctggccatccttctttccctagttggcaggccagctgggctgttctcgctgagggtgcaggagccttgggccgaccgcgctagagtgttatctcttctggaagtgtgcgcccaggcttccggaagcgtcaccgaaatcagtatctccgaaactcagcagcagctgtgcgtgcagctcgaattcccacggcaggaagaaaacccagaagcagtggccctgaggttggcccactgtgatctcggggcacatcactctctccttgtaggacagctcatggagacttgcgcccgcctgcaacagctgagtctgtcgcaggttaacttgtgtgaggacgatgatgcttcatccctgctattacagagtcttctgttatcccttagcgaactgaagacgtttagactgacgtccagctgcgtgagcacagagggcttagcacacctagcttccgggctggggcactgtcaccatttagaagagctagacctgtctaacaatcagtttgatgaagagggcaccaaggctctgatgagagctctggaaggaaagtggatgctcaagcgtctagatcttagccacctcctgctaaactcatcaaccctggccctgctgacccaccgtctgtctcagatgacatgtcttcagtccctccggctcaatcggaatagtatcggggatgtcggttgctgtcacctgtctgaggccctcagggcggccacatccctggaagagctcgatctttctcacaatcagatcggggatgcaggcgtccagcacttagccaccatccttcccgggctcccagagcttagaaagatcgacttatccggaaacagtataagtagtgccggaggcgtgcagcttgccgagtctcttgtactttgcagaaggctggaggaactcatgttaggttgtaacgcgctcggtgaccccaccgcactggggttagcccaggaactaccccagcatcttagggtacttcacctgccctttagtcatcttggacccggaggagcactgtcgctggcccaggcactggacgggtccccacaccttgaagagatctctttggcagagaacaatcttgcaggaggtgtgcttcgcttctgtatggaactgccactgctccgacagatcgatttagtgtcgtgcaagatcgacaaccaaactgcaaaactcctgacaagtagcttcactagctgtcctgccctggaagtaattctgctgtcctggaacttgttaggagacgaggcagccgccgaactcgctcaagtgctccctcaaatgggcaggctgaaaagagtagatctggaaaaaaatcagataacagctctgggggcctggcttcttgccgaaggccttgcccaaggatcaagtattcaagtgatccggctatggaataatccaattccatgtgatatggcccagcatctcaaatctcaggaaccacgcctggacttcgcattctttgacaatcagccacaggctccctgggggacttag

SEQ ID NO: 13951 - DNA, 897 bp, Artificial Sequence
  Description of Artificial Sequence: Synthetic coding sequence
atgatgaatgtgaatacaagggggacctatcttgctagtaaggcctgcatcccatatctcaaaaagagtaaagttgcccacattctgaacatttcccctccacttaaccttaaccctgtatggttcaaacagcactgtgcctataccattgctaaatacggtatgagcatgtacgtgctaggcatggcggaagagttcaagggagaaatcgctgtaaacgcgctgtggcctaaaactgccattcatacggcggctatggatatgctaggcggcccaggcattgagagccaatgtaggaaagtcgacatcatcgcagatgccgcttattctatatttcaaaaacctaagtcctttacgggcaacttcgtgattgacgagaacattcttaaggaggagggaatcgagaacttcgacgtctatgcaatcaaaccgggacatcccctccaaccagatttcttccttgacgaatatccagaggccgtgagcaagaaagtcgaatccactggagctgtccctgagttcaaggaagagaaactccagttgcagcccaagccgcgctcaggtgcggtggaggaaacttttaggatagtgaaggactcactgagtgatgatgtggtcaaggccacccaagctatttacctctttgagctttcaggcgaagatggggggacatggtttttggaccttaagtctaagggagggaacgtgggctacggcgagccaagcgatcaggcagacgtggttatgtctatgaccaccgatgattttgttaaaatgtttagcggtaagctgaagcctaccatggctttcatgagcggcaagctgaaaattaaaggaaatatggctttggcaattaagcttgaaaagctgatgaatcaaatgaatgcaaggctttag

SEQ ID NO: 13952 - DNA, 4026 bp, Artificial Sequence
  Description of Artificial Sequence: Synthetic coding sequence
atgtggaggaggaagcacccgcggacctccgggggcactaggggcgtgctatccggcaacagaggcgtggaatacggctccgggcgggggcacctcgggacattcgaaggtagatggcgtaaactgcccaagatgcctgaagctgtgggcacagatccaagtacttcgcggaaaatggctgaacttgaggaggtgacgcttgatggtaagcccctgcaagccctgcgtgtgaccgatctaaaggcagccttggagcagcgggggcttgcaaagagtggccagaaatccgcgctagtgaagagactgaaaggcgctttgatgctggagaatttacagaagcattcaactccacacgccgccttccaacccaactctcagataggggaagagatgtcacagaattcctttattaagcagtacctcgaaaagcaacaggagctgctgcgtcagcggcttgaaagggaggcaagagaggccgccgagctcgaggaggcttcagctgagagcgaggacgaaatgattcaccctgagggggtggcctccctgttaccccccgacttccagtcctcccttgaaaggcctgagttggaactatcaagacacagccccaggaaaagctctagcatatcagaggagaagggcgacagcgatgatgagaagcccagaaaaggggagcgaagatctagtcgcgtccggcaggctcgcgccgccaaactgagcgaagggtcacagccggccgaagaagaagaagaccaggagacaccatcacgaaacctcagggtgagggccgacaggaacctgaaaacagaggaggaggaagaagaagaagaagaggaggaggaagacgacgaggaggaagaaggcgacgatgaaggccagaagtcacgggaggctcccatcttgaaagaattcaaagaagaaggggaggaaattcccagggttaagcctgaagagatgatggatgagaggccaaagacgcggtcccaggagcaggaggtgttagaacggggtgggcgtttcacccgcagccaggaagaggcacggaaatcacacttggcccgccaacagcaggaaaaagagatgaaaacaacatctccactggaagaggaggagcgggaaatcaagagctcacaaggcctcaaggaaaaatctaaaagtccttcccctccacgactgacagaggatcgcaaaaaagctagtttggttgcattaccggagcaaaccgccagtgaggaggaaaccccaccaccactgttaactaaagaggcaagcagcccccccccacacccacaactgcactctgaggaagaaattgaacccatggagggacccgcgccagcagtgcttattcaattgagcccgccaaataccgatgctgacaccagggagcttttagtgtctcaacatactgttcagctcgtgggcggcctgtcccccctcagctctccttccgacaccaaagcagagagcccggctgaaaaggttccggaggagagtgtgctgcctctcgtccagaagagtacccttgcagactacagcgcccagaaggatctagagcctgaaagtgacagatcagctcagccgcttcccctgaaaattgaggaattagccctcgctaagggcattactgaggagtgcctgaaacaacctagccttgaacagaaggaaggacggagagcttcacacaccctacttccttctcacagactgaagcagtctgccgactcctccagcagccggtcctccagctcttcttcttcttcgagccgctcccgcagccggtcccctgactcttcaggaagcagatctcattcacctctgcgcagcaagcagcgggatgtggcccaagcaagaacccacgctaaccccagagggcgccccaagatgggctcaagatcaacatccgagtcccggtcccgatccaggtcaaggagtagatcagccagtagtaactcccggaagtcactgtcacccggagtgtctagagactcttcaacctcctacacggagacaaaagacccctcttctgggcaagaggttgccacgcccccggtacctcagctccaggtgtgcgagcctaaggagaggacaagcacctcgtccagttccgtgcaggcacggcgtctgagccagcccgaatctgcagaaaagcacgtaacccagcggctccagcccgaacgaggatcacctaagaaatgtgaggccgaggaagccgaaccacctgccgctacacagccgcagaccagtgaaacacagacttctcatctgccggaatcagaaaggatccatcatactgtggaagagaaggaagaggtgacaatggacacctcagagaaccggcccgagaatgacgtgcccgagcctccaatgccaatcgccgatcaggtgagtaacgatgataggcctgaggggtccgtagaagacgaggaaaagaaggaaagcagcctgcccaagtcattcaagcgaaagatctctgtagtgagcgccacaaagggagtgccagccgggaatagtgacactgaggggggtcagcccggtagaaagcgtcgatggggcgcaagtacagctaccacccagaaaaaaccctccatcagtattacgacggagagtttgaagtccctgatccccgacattaagccgctcgccggccaggaggctgtggtggatcttcacgcagacgactctaggatctccgaggatgaaaccgagcgcaatggagacgacggaactcacgacaaagggcttaaaatatgtaggacggttactcaggtcgtgccagccgaaggccaagaaaatggccaacgggaggaggaggaagaggagaaggagcctgaggccgaaccccccgtaccgccacaagtgagcgttgaggtggcacttccccccccagctgagcacgaggttaagaaggtgaccctcggagataccctgacacggagatctatctcacagcaaaaatcgggggtgagtatcacaatcgatgacccagttcggacagcccaggttcctagcccaccgcgtggcaagatctccaatattgttcatatatccaatcttgtgcggcccttcaccctgggccagctaaaagaattgttaggacggacaggcactctggtcgaagaggcgttttggatcgacaaaattaagtcccactgttttgtcacatactccacggtggaagaggccgtagccaccaggaccgccctgcacggggtgaaatggccgcagtccaaccctaagtttttgtgcgcagactatgccgaacaggatgagctggactatcaccggggcctgctggttgaccggccgagcgaaaccaagaccgaggagcagggcatccctagacctctccatccccctccaccgcctccagttcagccaccccagcacccgcgggccgagcagagggaacaggagcgcgccgtgagagagcagtgggctgagagagagagggagatggagagaagggaaaggacgcgatccgagagagaatgggaccgtgataaagtccgcgaaggcccaagaagtcgaagccgaagcagagaccgacgccgcaaagagcgagctaagtccaaggagaagaagagtgagaaaaaagagaaggctcaagaagagccacctgctaaactacttgatgatctgttccggaagaccaaagccgctccatgtatctattggctgccactcacagactctcagattgtacagaaggaggcagagagggccgagcgcgccaaggaaagagagaaacgacggaaagaacaagaggaagaggagcagaaggaaagagagaaggaggctgagagagagcgcaacaggcagttagaaagagaaaagaggagggagcatagcagagaacgggatcgggagcgtgagagagagcgggagcgggaccgaggcgatagagaccgggatagagaacgggaccgcgagaggggtcgggagcgtgatagacgcgatacaaaaagacacagcaggtcgagatcccgaagtacacctgtgagagacagagggggaagaaggtag

SEQ ID NO: 13953 - DNA, 600 bp, Artificial Sequence
  Description of Artificial Sequence: Synthetic coding sequence
atgagttcgggaaacgccaagattggacacccagcccccaactttaaggcaaccgctgtcatgcccgatggacagttcaaggatatttccctctctgattacaaaggcaagtatgtcgtgttcttcttctatcctctggattttacctttgtgtgtccaacagagatcatcgctttctcggatcgggctgaggaattcaagaaattgaattgtcaggtgattggcgctagtgttgactctcatttttgtcacctggcatgggttaacactcccaagaagcagggaggtctcggccccatgaatattcccctcgtcagcgatcccaagagaacgattgcccaggactatggagtgcttaaagccgacgagggaatttcgttcaggggactgtttatcattgacgataaaggtattctgagacagataaccgtgaacgatttgcccgtgggtcggagcgtagacgagacactgagattggtgcaggctttccagtttacagataagcatggggaagtctgtccagccggatggaagccaggatccgacacaataaagcctgatgtgcagaaatctaaggagtatttcagcaagcagaaatag

SEQ ID NO: 13954 - DNA, 1077 bp, Artificial Sequence
  Description of Artificial Sequence: Synthetic coding sequence
atggagaaaaaaaaaatggtgacgcagggcaaccaggagcctaccaccacccccgatgcgatggtacaaccatttaccacaatcccattccctccccctcctcaaaacggaattcctaccgagtacggcgtgccccacacccaggactatgccggccaaactggagaacacaaccttactctatatgggagcacccaggcacatggcgagcagtctagcaacagtccgtccacccagaacggcagtctgaccactgaaggtggagcccaaaccgacggccagcaatcccagacccaaagttccgagaactccgagagtaaatccacccccaagcggcttcatgtcagcaacatcccgtttaggtttagagatcctgatcttcgccagatgttcggaggatttggctttgtcaccttcgaaaactctgccgacgccgaccgggcccgagagaaactccacggcactgtcgtggagggcaggaagattgaagtgaacaacgctaccgcccgggtcatgaccaacaagaaaatggtcaccccctacgctaatggctggaagctttctcccgttgtgggcgccgtctacggaccagaactgtacgctgcctcctcattccaagccgatgtcagtctcggcaacgatgcagctgtcccactgtccggaagggggggtataaacacttatatcccactgatcatacctggtttcccatatccgacggccgccaccaccgcggcggcattcagaggggcccatttacggggcaggggtcgaaccgtgtacggggctgtgcgagcagtcccccccacagccatcccggcttatcccggagtcgtgtaccaggacggtttctacggcgcagacttgtacgggggctacgccgcatacagatacgcacagccggcaacagcgaccgctgctactgcggctgccgctgctgccgctgcatacagtgacgggtatgggagggtttataccgctgacccctatcatgccctagcaccagccgctagttacggcgtgggcgcagtggcatccttgtacagggggggatactctcggttcgctccctattag

SEQ ID NO: 13955 - DNA, 1596 bp, Artificial Sequence
  Description of Artificial Sequence: Synthetic coding sequence
atgtcctatcccgccgacgattacgagtcggaagccgcgtacgacccctatgcttatccctcagactacgacatgcataccggtgaccctaaacaggatctggcctatgaacgccagtacgagcagcagacctaccaagtgatacccgaagtgatcaaaaactttatccagtattttcacaagactgtctccgacctcatcgaccaaaaagtctacgagttgcaggcctcaagagtcagctctgatgttatagatcagaaagtttacgagatccaggatatttatgaaaatagctggactaaactcacggaaaggttcttcaagaatactccatggcctgaggccgaggcgatagcgccgcaagtggggaacgacgccgtgttcctgattttgtataaaattcttcaagcccatggtcccgcccctttggagctgcccaatcaatggctctgggacattatcgacgaattcatataccaattccagtccttcagccagtatcgatgtaaaaccgccaagaagtcagaagaagagatcgactttctcaggtcaaacccaaagatttggaatgtgcactcagttctaaatgtcctgcactcactagtggataagtcaaatattaaccgccagctggaagtctacacttctggcggggatcccgagagtgtggcaggggaatacggacgacactcactgtacaagatgctgggctacttcagccttgtgggcttgctgcgcttgcatagtttacttggagactactaccaggctatcaaagtcctggagaatatcgaactgaacaagaagagcatgtactctcgcgtccctgaatgccaggtgacaacatactactacgtaggctttgcatacctcatgatgagaaggtaccaggatgcgatccgcgtatttgctaacatccttttgtatatacagaggactaaatccatgtttcaaagaactacttacaagtatgaaatgataaataaacaaaatgaacagatgcacgcactcctcgctatcgccctcacgatgtacccaatgagaatcgacgagtccatccacttacagctccgggagaagtatggagacaagatgctaaggatgcagaaaggcgatccgcaggtgtatgaggaactgtttagttactcatgtcctaaattcctctcaccagtggtacctaattatgataacgttcatccaaattaccacaaggaaccattcctacagcagttgaaagtgttcagcgacgaggtccaacagcaggcccagctgagcaccatacgttcattcctgaagctctacactaccatgcctgttgctaaattggctggcttcttggacctcactgagcaggagtttcggatacagctgctggtttttaagcataaaatgaagaatctagtttggactagtggtatttctgccctcgacggtgagttccaaagcgccagcgaagttgacttctatatcgacaaagacatgatacacatcgctgatactaaagtggcaagaagatacggggatttctttatacgccagattcataagtttgaggagttaaacagaactctcaagaaaatgggacagaggccctag

SEQ ID NO: 13956 - DNA, 5952 bp, Artificial Sequence
  Description of Artificial Sequence: Synthetic coding sequence
atgagtggtaacaaacgaggaagccgggccagctgccctcatcgcggggcggaatgtctcctgccttgggcagcccttaatctgcagggatttcagttgctgctattacacccaagcgctacagcaatgatggatgtgtctgaattgggcgaaagcgcgagatacttgcggcagggctatcaggaaatgactaaggtccatacaattccctgggacggcaagaagagggtgtgggttccagatgagcaagacgcatacgtagaggccgaggttaagtctgaggcaaccggaggccgggtgactgtagagacaaaggaccagaaggttctcatggtacgagaagccgagctccagccaatgaacccacctcgctttgatctgctcgaagatatggcgatgatgacacatctgaacgaggcgtccgtactgcacaatctcagacagcggtatgcccgatggatgatctatacttacagcggactgttttgcgtgaccatcaacccctacaagtggctaccggtgtatacagcatccgtggtggctgcttacaagggcaagcgcaggtcagattcccccccacatatttacgctgtggccgataatgcttataacgatatgctgagaaaccgggataaccagagcatgttgatcactggcgagtcaggagctgggaaaacagtcaacaccaagagggtcattcaatatttcgcaattgtcgccgcattgggggacggacctggaaagaaagcccagttcctggctaccaagactggcggcacactggaggaccagataatcgaggcaaaccctgccatggaggccttcggtaacgccaaaaccctcaggaatgataacagcagccgttttggaaagtttattcggatacacttcgggccatccgggaagctggcctccgcagatatcgactcatatcttctcgagaagtcaagagtgatcttccagctgccaggcgaaaggagctaccacgtgtactatcagattctctccggccggaagcctgagctacaggatatgctcttgttatctatgaacccgtacgactaccacttttgtagtcagggggtcatcactgtcgataacatgaacgatggtgaagaactgatcgccactgaccacgcaatggatatcctgggtttctctgtcgacgagaagtgtgcatgctacaagatcgtgggagccctcttgcatttcggtaacatgaagtttaagcaaaagcagcgagaagagcaggcagaagccgacggtacagaatcagccgataaggccgcatatctcatgggggtctccagcggagatttattaaaaggcctgctgcaccctcgagtgcgggtcggaaacgagtacgtcacaaaaggccaaagtgtggagcaggtcgttttcgctgttggcgctctggccaaggcaacatacgaccgcctgttccgctggctggtctctcggataaaccaaactctcgacacaaagctaccgcgccagttcttcatcggagtcctggacatcgccggcttcgagatatttgaattcaattcgttcgaacaactctgtatcaacttcactaacgagaaattacagcagttttttaaccagcacatgtttgtccttgaacaagaggaatacaagagggagggcatcgattgggtgtttattgattttggcctggatcttcagccctgtattgaccttatagaaaagcccctgggtatcctgtcaatcttggaggaagaatgtatgttccccaaggcgtcagatgcatcctttcgtgctaaattatacgacaaccatgccggtaaatcgcctaacttccaacagcctcgtccagacaagaagaggaaatatcaagcccatttcgaggtggtccattatgcaggtgtcgtcccttatagcattgtgggctggcttgagaaaaacaaggaccccttgaacgagaccgtggttcccatattccagaaaagtcagaaccgcctgctcgctaccctgtatgagaactatgctggttcttgtagtactgagcctcccaagagtggcgtcaaagaaaagagaaagaaggccgctagtttccagaccgtatcccagctgcacaaagaaaatttgaataagctaatgaccaatctgagagcaacacaaccccattttgtgcgttgtattgtaccaaatgaaaacaaaacgcccggcgtcatggacgctttcctcgtgctgcaccagcttaggtgtaacggggtgctggagggtataagaatctgcaggcaaggattcccaaacagattgctctacaccgacttccgacagcgttaccgaatcctgaatccttcagcaatccctgacgatactttcatggatagtcgtaaagctacagagaagcttctgggcagtctcgatctggaccacactcagtaccagttcggacataccaaagtgttcttcaaggcaggcctgttgggggtgctcgaggagctcagagatcaacgcctcgctaaagtgctgacactcttgcaggcgcgttcacgggggagattgatgaggctggagtatcaaaggttactaggaggaagggatgcactgttcaccattcagtggaatatccgtgctttcaatgcggtcaaaaactggtcctggatgaaactttttttcaaaatgaagcccctccttcggtccgcacaggcggaggaagagttagctgccctgcgtgccgagctccggggcctgcgaggagcccttgccgccgcggaagctaagcgtcaggaactggaagagacccatgtctccattacccaggagaagaacgacctggcacttcagctacaggcagagcaggataatttggctgacgcagaagagcggtgccacctattaatcaaatcgaaggtgcagctagaaggcaaggtgaaagagctgtccgagcgcctcgaagatgaagaagaggttaacgcagaccttgccgcacgtcgaaggaagttggaagatgagtgcaccgagttaaagaaggacatcgatgatttaaaactgacgctcgcgaaggcagagaaagaaaaacaagccactgagaataaagtgaaaaatttgaccgaggagatggccgcactggacgaaagcgtggcccgcctcactaaagagaaaaaggcactccaggaggcccaccaacaggctcttggcgatctgcaggcggaagaggatagggtgagcgcgctcacaaaggcgaagcttagactggagcagcaggttgaggatttggagtgctctttggaacaagagaaaaagctcagaatggacacagagcgagccaagaggaagcttgagggcgatcttaagctgactcaggagagtgtcgcagatgcagcgcaagataaacaacagttagaggagaaattaaaaaagaaggattctgagctctcccagctgagcctgagggtcgaagacgagcagctgctgggtgctcagatgcaaaagaaaattaaggagctccaggcacgcgcagaggaactcgaggaggaactggaggctgaacgggccgccagagctagagtagagaagcagagagcggaagctgcacgagagctggaggagctgagcgagcgactggaggaagctggaggcgcttccgcagggcagcgggagggctgtcgcaagagggaagccgagctcgggagactgcgacgggagctggaggaggcagccctgcgccacgaggcaaccgtggctgctctcaggcgcaaacaggccgagggcgcggccgagctgggggagcaggtggacagcctgcagagggtgcggcagaagttggaaaaggaaaaaagtgagctcaggatggaggtcgacgacctggccgcaaatgttgagaccctgactcgcgcaaaagcaagtgctgaaaagctatgccgcacgtacgaggaccagttgtccgaggcaaagatcaaggtggaagaactgcaacgccagctggctgatgctagtactcagaggggacggttgcagactgagtctggagaactgtcaaggcttttagaggagaaagaatgtctaatttctcagctgtcccgtggcaaagcgctcgctgcccagtctctggaggagctgaggcgacagctggaagaagagtctaaggccaagtccgccctcgcgcacgccgttcaggccctccgacatgattgtgatttactgcgagagcagcacgaggaggaagctgaagcacaggctgagttacagcgtctgctctcaaaggcgaacgctgaggtggcccagtggaggagcaaatacgaggcggacgcgatccagcgcaccgaggagcttgaagaagccaagaaaaagctggccctccgcctccaggaggccgaggagggggtagaagccgccaatgccaaatgctcatctctcgagaaagcaaagctaagactccagacagagagcgaggacgtgaccctggaacttgagcgcgcgacatcagccgctgccgctctcgataaaaagcagagacatctggagagagccttggaggagaggcgcaggcaggaagaagaaatgcagcgcgagctggaggccgcacagcgagaatcaaggggcttaggtactgagctattcaggctccgacacgggcatgaggaggcactggaggccttagagactctaaagcgggaaaacaagaatttgcaggaagaaatctctgatctcaccgaccaagttagtctgtcaggcaagtctatacaggagctagagaagaccaaaaaggccctggagggggaaaaaagcgaaattcaggccgcgctggaagaggccgaaggcgcccttgagctcgaggagactaaaaccttgcggatccagctggaactttctcaggtaaaagctgaggtggataggaagctggcggagaaggacgaggagtgcgctaacttaagacgcaatcatcagcgggcagttgaaagcctgcaagcaagcctggatgctgagacacgcgcacgaaacgaggccctccggcttaagaaaaagatggagggcgatctcaatgatttagaactacagctcggccacgccacacgtcaagcaaccgaagcccaggccgccaccagattaatgcaggctcagttaaaagaggagcaggccgggagagatgaggaacagcggctggcagcggaactccatgaacaagcgcaggccttggaaaggagggccagtctgctcgcagctgagctggaagaactgcgcgccgccctcgagcagggcgagagaagccggagattagcagagcaggaactgctggaagctacagaaagattgaacttgctgcactcccagaataccggacttctgaaccaaaagaagaaactcgaagccgaccttgctcaactgtcaggagaggtagaagaggccgcccaggaacggcgtgaagcggaggagaaagccaaaaaagcgatcaccgatgccgccatgatggctgaggagctaaagaaggagcaggacacctcagcccatctcgaaagaatgaagaaaacgttggagcagaccgtccgagaacttcaggccaggctggaggaagctgaacaggctgcgttacggggcggaaagaagcaggtccagaagcttgaagcaaaggtgagggaactggaggcagaactggatgcagaacaaaagaaacatgccgaagcactgaaaggcgtccggaaacacgagcgacgtgttaaggagctcgcttatcaggctgaggaagatcgtaaaaacctggcacgcatgcaggacctggtagacaagttgcagtccaaggtgaagagttacaagcggcaatttgaagaggctgagcagcaggctaataccaatctggccaaatatcgcaaagcacaacacgaactggatgatgctgaggagagggcagacatggcggaaacccaggctaataaactgcgagcacgaaccagggacgctctaggacctaagcataaggaatag

SEQ ID NO: 13957 - DNA, 2730 bp, Artificial Sequence
  Description of Artificial Sequence: Synthetic coding sequence
atggagagggcaatggaacagctgaatcggcttacgcgatccctcaggagggctcggaccgtagagcttccggaagacaacgagacagctgtatacaccctgatgccgatggtaatggcggatcagcatagatctgtctcggagctgctcagtaatagcaagtttgacgttaactacgcgttcgggcgagtcaaacgcagtttactgcacattgccgctaactgtggctctgtcgaatgtctggtactcctcctgaagaagggggctaatccgaattaccaggacatctccggttgtaccccactgcatctggctgctaggaacgggcaaaagaagtgcatgtcgaagctgctcgagtattctgctgatgtgaacatttgcaacaacgaaggtttgaccgccattcactggttagcggtcaatggccgaaccgagctgctgcacgacctggttcagcacgtttccgacgtcgatgtcgaggatgctatgggccagacggccctacacgtggcctgtcagaacgggcataagacaaccgtgcaatgtttgctggatagtggggccgatatcaacaggccaaatgttagtggggcgacccctttgtatttcgcctgctcacatgggcaacgggataccgctcagattctgctgctgagaggcgccaaatacctgcctgacaagaacggtgttacacctctggatctttgtgtccagggaggctatggtgaaacctgtgaggtcctgattcagtatcaccccaggctgttccagaccatcatccagatgacccagaacgaggatctgagggagaacatgttacgccaggtgctggagcatctctcccagcagagtgagtcccagtatctgaagatcctgacatccctagctgaggtggccactacaaatggtcacaaacttctgagcttgagtagcaattacgacgcccaaatgaagtccctgctgcgaattgtgcgaatgttttgtcacgtgttcagaattggcccctctagtcccagcaatggcattgacatggggtacaacggaaataaaactccccgcagtcaagtgttcaaacccctggagcttctgtggcacagcctggacgagtggctggtactgattgctacggagctaatgaaaaacaaacgcgattcgactgagataaccagcattctgctaaaacagaaaggacaagaccaggatgctgccagcattccaccatttgagcccccaggaccaggctcctatgaaaacttgtctacaggaactagagagagcaagcccgacgcactagcgggccggcaggaggcttccgctgattgtcaggatgtgatctccatgacggcaaatagactgtctgcggtgatccaggccttctatatgtgttgctcctgccaaatgcccccgggcatgacttctcctagattcatcgagttcgtgtgcaagcacgacgaggtcctgaaatgtttcgtgaatcggaatcctaaaatcatctttgatcactttcactttcttctggaatgccctgaacttatgagtagattcatgcatatcattaaggcacagcctttcaaagaccgttgcgagtggttttacgagcacctacactctggccaacccgactctgacatggtgcacaggcccgttaatgagaatgatatcttactggtccatcgagacagcatttttcggtcatcctgtgaggttgtttccaaggccaactgtgctaagctcaagcaaggaatcgccgtcaggtttcacggcgaggagggaatggggcagggagtagtgagggagtggttcgacatactgtccaatgagatcgtgaatcccgactacgcattattcacacagtctgctgatggtaccacttttcagcccaattccaactcatatgtgaatcctgatcatctaaattatttccggttcgccggacagatactcgggttagctctgaatcatcgccagcttgttaacatctatttcactaggtctttctacaaacatatattaggaatccctgtgaactaccaggatgtcgcttccattgaccctgaatacgccaaaaatctgcagtggatcctggataatgatatctccgatctgggcttagaactcaccttctccgttgagactgacgtgtttggcgcaatggaggaggtgcccctgaagcctgggggaggctccattcttgtgacacagaacaataaggctgaatatgtgcagctagtcaccgagctaagaatgacccgggctattcagccccagataaacgcatttctccagggttttcacatgttcatcccaccatctcttattcagctgttcgatgagtacgagctggaattgctgctgagtggcatgccagaaatagatgtgtctgactggatcaagaacaccgagtacacctctgggtacgaacgggaagaccctgttatccagtggttttgggaagtggtcgaggatattacccaggaagagcgggtgctgctgctgcaattcgttaccgggtcctcccgggtccctcacggtggcttcgccaatattatgggcggctcaggactgcagaactttaccatcgctgccgtgccttacacacctaacctgctgcccacgagctcgacttgcatcaatatgcttaagctgcctgagtacccctcaaaagagatccttaaggaccgacttctggtcgccttgcattgtggatcttatggttacacaatggcttag

SEQ ID NO: 13958 - DNA, 2679 bp, Artificial Sequence
  Description of Artificial Sequence: Synthetic coding sequence
atgcgcaaagttaaaaaactcagactggacaaagaaaatacaggaagttggcggagtttttctcttaattctgaaggtgctgagaggatggccaccaccggtactcccacagctgatcgcggggatgccgccgctactgacgacccagctgccagattccaagttcaaaagcactcctgggacggcctacgcagcataatacatggtagcaggaaatattcgggcctgatcgtcaataaggcgccgcacgacttccagttcgttcagaagactgatgagtccggaccccactctcaccgcctgtattacttgggtatgccatatggctcccgagagaattcactgctgtatagcgagatcccaaagaaagtgcggaaagaagccctgctgcttctttcttggaagcaaatgcttgaccatttccaagccactcctcatcacggggtgtattcccgggaggaggagctcttacgcgagcgcaaaagattgggtgtctttggcattacatcttacgattttcatagcgagtccggtctattcctattccaggcttccaactctttgttccattgccgagacggaggaaaaaatggattcatggtctctccgatgaagccacttgagattaagacgcagtgttccggcccgcggatggacccaaaaatctgtccggctgatccggcatttttttcctttattaataattctgacctctgggtcgccaatatcgaaactggtgaagagcgcagactaacattttgccatcagggcctgtcaaatgtgttagatgatccaaaatcagcgggcgttgctactttcgtcatacaggaggagttcgatcgctttaccggttactggtggtgtcccacagcatcctgggagggcagtgaggggctaaagacccttcggattctgtacgaggaggtcgatgagtccgaagtagaagtaatccatgttccatctccagccctggaggaacgcaagaccgacagctatcgttacccacgaaccggctctaagaatccaaaaattgctctgaaactcgccgagttccaaacagattctcagggcaagatcgtgagcacccaagaaaaggaactggtgcaaccatttagctccctattccccaaggtcgaatatattgccagggctgggtggactagggacggcaaatacgcctgggcgatgttcttggacagaccgcagcagtggcttcaattggtgttgcttccgccagccctattcatcccaagtactgaaaatgaggagcagaggcttgcatccgcacgggcagtgcctagaaatgtgcagccttacgtcgtatacgaggaagtgaccaacgtgtggattaacgtccacgatatattctatccatttcctcagtctgagggagaggatgagctgtgtttcctccgagctaatgagtgcaaaaccggcttctgccacctgtataaggttactgcggtactgaaatcccaaggatacgattggtctgagccattctcacctggtgaggatgaatttaaatgccccatcaaggaagagattgcgttgacaagcggggagtgggaagtcctagccaggcacggaagcaaaatttgggtaaacgaagaaacaaagctggtgtattttcagggcactaaggatacaccactcgagcaccacctgtatgtcgtaagttacgaagctgcaggtgaaattgtgcgactaacaacaccaggattctctcattcgtgtagcatgagtcagaatttcgatatgttcgtttcacattatagcagcgttagtacacccccatgcgtgcacgtgtataaactgtcgggccctgacgatgaccctctgcacaaacagccgcgattctgggccagcatgatggaggccgccagttgtcctcctgactacgtccctccggagatattccactttcatacgcgcagtgacgtgcgtctgtatgggatgatttacaaaccccacgccctccagccgggcaagaagcaccctacagtactgttcgtgtacggcggtcctcaggtgcagctggtgaataacagcttcaagggcataaagtatctcagactgaacaccctcgcctctctgggatacgcagtggtagtgatagacggccgaggctcatgccagcggggacttagatttgaaggcgcactcaaaaaccagatgggacaagtcgagattgaagatcaggtggagggcctacagtttgtggccgagaagtatggctttatcgaccttagccgagtcgctatccatggctggagctacggtgggtttctgagtcttatgggtctgatccataagccccaggtatttaaagtagcaatagctggcgcgcccgtcacagtatggatggcttacgacaccggctacaccgaacgctacatggacgtgccagagaacaaccaacatggctacgaggctggatcggtggccctgcatgtcgagaagctgcctaatgagccaaaccgactgctaattctgcacgggttcctggacgagaacgtgcacttctttcatactaacttcctcgtgagtcagctgatccgggccggcaagccctaccaacttcagatctacccgaacgaaaggcactctattcggtgtcccgaatccggagaacactacgaagtaacactgttgcatttccttcaggagtacttgtag

SEQ ID NO: 13959 - DNA, 1533 bp, Artificial Sequence
  Description of Artificial Sequence: Synthetic coding sequence
atggccgctgaattagtcgaggctaaaaatatggtgatgtcctttcgtgtgtcagacctgcagatgctgttgggattcgtcggccggtctaaatcaggactcaaacacgaactcgtgacaagggctctacaattggttcagttcgactgttccccagaactgtttaaaaagatcaaggagctttacgagacccgatatgcaaaaaagaactccgagccagcacctcagccacacagaccactggaccccctcacaatgcactccacttacgacagggcaggcgccgtgcctaggacgcctctggcaggccctaatatagactatcctgtcctgtatggcaaatatcttaatggactgggacggcttcccgccaagacattgaaaccggaagtcagattggtgaagctaccgttcttcaatatgcttgacgagctgctgaagccaaccgaactggtgccccagaacaatgaaaagttacaagaatccccatgtatatttgcgttgacccctcggcaagtcgagctcatccggaatagcagggaattgcagcctggcgtgaaagccgtgcaggtagtgttacggatctgctattctgatacatcatgtccacaagaggaccagtatcctcctaatatcgcagttaaggtcaaccacagctactgttccgtgcccggctactatccttctaataaaccaggcgtagaacccaagcgtccttgtaggccgatcaatctcacccacctgatgtacctttcaagcgccaccaatcggattaccgtcacttgggggaactatggcaagtcatacagtgtcgccctctacctggtgagacagctgacctcctccgaactgctgcaaagactgaagactataggagtgaagcatcccgagctgtgcaaagcgctggtgaaggagaagctgagactagacccagatagtgaaattgctactacgggggtacgtgtcagcctcatctgccccctagttaagatgcggctctccgtcccatgtagggctgagacttgtgcccacctccaatgtttcgatgccgtgttttacttgcagatgaatgagaagaaacccacctggatgtgtcctgtctgtgataagcctgccccctatgatcagctgattatcgacggcctgctgagcaagatcttatcggagtgtgaggatgcggatgagatcgaatatctagtggatggcagctggtgcccaattcgggctgagaaggaacgctcgtgcagcccgcagggggctatcttagtgctcgggcctagcgacgccaatgggcttctcccggccccttctgtcaatggctccggcgcactgggcagcactggaggaggcggccccgtaggtagcatggaaaatggaaagcctggagccgacgttgtggatctcacactcgacagctcctccagctcagaagacgaggaagaggaggaagaggaggaggaagacgaggacgaggagggaccgaggcccaagcggagatgcccttttcagaagggcctcgtaccagcatgctag

SEQ ID NO: 13960 - DNA, 684 bp, Artificial Sequence
  Description of Artificial Sequence: Synthetic coding sequence
atggcagcgcaacggcctctgcgcgtattatgcttggcaggtttcagacagagcgaacgagggtttagggaaaagaccggcgccctgcgcaaagccctaaggggacgtgccgaattggtttgcctgagtggtccccacccggtaccggacccaccaggcccagaaggcgctaggtccgactttgggtcctgccctccggaggagcagccacggggatggtggttctcagagcaggaggccgacgtcttttctgctctggaagaacctgctgtttgcaggggtctcgaggaatctcttggcatggtcgctcaagcccttaaccgactgggcccgtttgatgggctgcttggcttcagtcagggggccgctcttgccgccctggtgtgcgccttgggacaagcaggcgatcctaggttcccactcccacggttcattttactagtgtcaggtttttgtccacgcgggattggcttcaaggagagcatcttacagcgacctctgagcctgccatctctgcatgtctttggggacacagataaagtgattccctcacaggaaagcgtgcagctcgcatcacagttccctggggctatcactttaactcactccggcggccacttcattcccgctgctgccccacagcggcaagcatatcttaagtttctcgatcagttcgcagagtag

SEQ ID NO: 13961 - DNA, 1656 bp, Artificial Sequence
  Description of Artificial Sequence: Synthetic coding sequence
atggaagaggccgagttggtgaagggtagattgcaagctatcacagataagcggaagatacaggaagaaatttcccagaagagactgaagatcgaggaggacaagctgaagcatcagcacctgaaaaagaaggccctgagagagaaatggttgttggacggtatcagctccggaaaggagcaagaggaaatgaagaagcagaaccagcaggaccagcatcagatacaggtgctcgaacagtccattctgcgactggaaaaggagatccaagacctcgagaaggccgagcttcagatcagcaccaaggaagaggccatcctgaaaaaactcaaaagtatagagcgaactactgaagatataattaggtcggtgaaggtcgagcgagaagagagagctgaggagtcgatagaggacatttatgctaacatccccgatcttcccaagtcctacataccttcccggttacgaaaggaaattaacgaagaaaaggaggacgacgaacaaaacagaaaggccttatacgcaatggagattaaagtcgagaaagacctgaaaaccggagagtcgaccgtgctgtcaagcattcctctgccctccgatgatttcaaaggcacagggatcaaagtttatgacgatgggcagaaatccgtgtatgctgtaagctcaaaccattccgccgcctacaacggaaccgatggtctagccccagtggaagtggaagaactgctaagacaagcctcggagcgcaatagcaagtccccaactgagtatcatgagccggtgtatgctaacccattctataggcctactacccctcaaagagagactgtcacacctggaccaaactttcaggaacgcataaagatcaagaccaatggcctgggaattggggtgaacgagagcatacacaatatgggtaacggtctaagcgaggagagaggcaataatttcaatcacatcagtcctatccccccggtgccccacccaaggtcagtgatccagcaggccgaggagaagttacataccccccagaagcgcctcatgacaccttgggaggaatctaacgtcatgcaggataaggatgctccttcgccaaaaccccgcctatcccctcgagaaacgattttcggcaaatctgagcaccagaattcgagccccacttgtcaagaagacgaagaagatgttcggtataatatcgtgcactccctcccacctgacatcaatgataccgaacctgtcactatgatctttatgggctatcaacaggccgaggatagcgaagaggacaagaagtttcttacaggttacgacggcataatccacgctgagctcgtggtgatcgacgatgaagaggaggaagacgagggggaagccgagaagccaagctatcatccgatcgctccccactcgcaagtataccaaccagccaaacccacgccgctgccacggaaacgctccgaagcttcccctcatgagaacaccaatcataagagtcctcacaagaactcaatcagtctgaaggagcaagaagagtccctcgggtctcccgttcatcatagcccatttgatgctcagaccaccggggacgggaccgaagatccctcactgaccgccctaaggatgagaatggctaagttagggaaaaaagttatttag

SEQ ID NO: 13962 - DNA, 1701 bp, Artificial Sequence
  Description of Artificial Sequence: Synthetic coding sequence
atgttcgtctccgactttcggaaggagttctatgaggtggtgcagagccagagggtcctactgtttgtggcctccgacgtagatgctctctgtgcctgtaagatactgcaagccctttttcaatgtgaccacgtccaatacacgctcgtgccagtgagtggatggcaggagctggaaaccgcttttctggaacacaaggaacagttccactactttattctcatcaattgcggtgcaaacgtggatcttctggatattctgcagcccgacgaggacactatcttttttgtgtgcgacactcaccgaccagtaaacgtggtgaacgtgtataacgatacccagatcaaactgcttatcaagcaggacgacgatttagaagtcccagcctatgaggacattttccgggacgaagaagaagacgaagagcattctggaaatgatagtgacggatccgaaccctccgaaaaaaggactaggctggaggaagagatcgtcgagcaaactatgagacgtcgccagagacgcgaatgggaagctcgtcgcagagacattcttttcgactacgaacaatacgaatatcacggaacaagttcagctatggtgatgttcgagctggcctggatgctctcaaaagacctgaacgatatgctctggtgggccatcgtgggcctgaccgaccagtgggtgcaagacaaaatcacacagatgaagtacgtgactgacgtcggggtactccagcgccatgttagccgccataatcacaggaacgaggacgaagaaaacaccctgtcggtcgattgcacccgaatctccttcgagtacgatttacgcctggtgctctaccagcactggtctctgcacgattctctgtgtaataccagctacaccgcagccaggtttaagctgtggagtgttcacgggcaaaagcggctgcaggaattcttggcagacatgggtttgcccctgaagcaggtgaaacagaaattccaggcgatggatatttcacttaaggaaaatttaagagagatgatcgaggagtcggctaacaagttcgggatgaaagacatgcgtgtccaaaccttctctattcacttcggctttaagcataaatttcttgccagcgatgttgtgtttgccacaatgtctctgatggagtcaccggagaaagatgggtctggaactgaccatttcatccaggcattggatagtctgtcaagaagcaatctggacaaactctaccatggacttgagcttgctaaaaaacagcttagagcgacgcagcagacgattgccagctgtttatgcacaaatcttgttatatcacaggggcctttcctgtactgcagcctcatggagggtacaccagatgtcatgctcttcagcaggccggccagcctgagtctcctctcgaaacatctcctgaaaagctttgtgtgttccacgaaaaataggcgttgtaaactgctgcccctggtgatggctgcccccttgagcatggaacacggcacggtcacagttgtcggtatcccccccgaaacagatagcagtgacaggaaaaacttctttggacgggctttcgaaaaggctgccgaatctacatcttctaggatgctgcacaatcacttcgatttaagcgtgattgaactcaaagctgaggaccgatcaaagttcctggacgcacttatctcattgttatcttag

SEQ ID NO: 13963 - DNA, 1461 bp, Artificial Sequence
  Description of Artificial Sequence: Synthetic coding sequence
atgtccgtcacttatgacgacagcgtgggtgtggaagtttcaagtgatagcttctgggaggtcggcaactacaaaagaactgtcaagcgaattgatgacggccaccggctgtgttctgacctgatgaattgccttcacgaaagagcgaggatcgaaaaagcatacgctcagcagctaactgaatgggccagaagatggcgtcagctagtagagaagggcccccagtacggcacagtggagaaggcatggatggccttcatgagtgaggccgagcgagtaagcgagctgcatctagaggtgaaggcctcccttatgaacgacgatttcgagaagatcaagaactggcagaaagaggcgtttcataagcagatgatgggcggcttcaaagaaactaaagaggccgaggacggctttagaaaggcccagaaaccgtgggctaagaaactgaaggaggtggaggcagccaagaaagcccaccatgctgcctgtaaggaggaaaagcttgccatctcccgagaagccaactccaaggctgaccccagcctcaatcccgagcagttgaagaagttgcaggataaaatcgaaaaatgtaaacaagacgtgctgaaaacaaaggagaagtacgaaaagtccttgaaggaacttgaccagggcacaccccagtacatggagaatatggagcaggtgttcgaacagtgtcagcaattcgaggaaaagagacttcgcttctttcgcgaagtgctgctggaagtccaaaagcacctcgatctttccaacgtcgccgggtacaaggcaatttatcacgacctggagcagtccatccgcgcggcagatgccgtagaagacctgagatggttccgagccaaccatggccctgggatggccatgaattggccacagtttgaggagtggagtgccgacctcaatcgcaccttaagtagaagagagaagaagaaggccacagacggcgtcacgctaaccgggataaatcaaacaggggatcagtccctacccagcaaaccctcgtcaaccctgaacgtccccagcaaccctgctcagtcagcacagagccaatcctcctataacccgttcgaggatgaggatgacaccggcagcaccgtttccgagaaagatgatacgaaggcgaagaatgtgagctcatatgagaagacacagtcctaccctacggattggagtgacgacgagagtaataaccctttttcgagcacggacgccaacggcgactcaaatccctttgatgatgatgcgacctccggaactgaggtgcgggtccgagcactgtatgactacgaaggccaggagcatgacgaactgtcattcaaggcaggggacgaactcacaaagatggaggacgaagatgagcagggttggtgtaagggaaggctagataacgggcaagttggactctacccagccaactacgttgaagctatccagtag

SEQ ID NO: 13964 - DNA, 2262 bp, Artificial Sequence
  Description of Artificial Sequence: Synthetic coding sequence
atgatggaggagagagccgctgcagcagtcgccgcggccgcctcctcctgtcgtccactagggtcgggggccggcccgggccctacaggagcagctcctgtctcggcgcctgcgccaggccccggcccagcggggaaaggtggtggaggcggtggcagtccaggtccgacagccggcccagaacctttatcactgccaggcatccttcattttattcagcatgagtgggctaggttcgaggcggagaaagcacgctgggaggcagagcgtgctgagttgcaggcccaggtcgcgtttctgcagggcgaacgtaagggccaggaaaatctgaaaactgacctggtgaggaggatcaaaatgttagagtacgccctgaaacaggaacgagctaagtatcacaaattaaagttcggaacagatctgaatcaaggcgagaagaaggctgatgtgtcagagcaggtctccaacggcccagtagaatctgtcaccctcgagaatagccctctcgtgtggaaagaagggagacagcttcttcggcagtacctggaggaggtcggatacacggacaccatcctggatatgagaagcaagagggtcagatctcttttaggcagaagtctcgaactgaatggggctgtggaaccatccgaaggggcccctcgagctcctccaggccccgcaggactgtctggaggggaatccctgttggtgaagcagatagaggagcagattaaaagaaatgcggccggaaaagacggaaaggagcggctcggggggagcgtactcggacagattcccttcttgcagaattgtgaagacgaggactctgacgaggatgatgagttagactctgtgcagcataaaaagcagcgagtcaagttgccgtcaaaagctctcgtgcccgagatggaggacgaggatgaggaagacgactctgaagacgccattaacgagttcgatttcctgggatcgggcgaggacggtgagggtgctcctgacccgcggcggtgtactgtggatggaagcccgcacgagctggaatcccgtcgcgttaaactccaggggatcctagctgacttgcgggatgtcgacggcctcccccccaaagtgacaggccctcctcctggtacacctcagccccgccctcacgaagacgtcttcattatggacaccatcggcgggggcgaggtatcactgggagacctggctgatctaacagtcactaacgataacgatctgagctgtgacttatctgattctaaggatgctttcaagaaaacctggaaccccaaatttacactacgcagtcactatgacggaattaggtccctggccttccaccattcccagtcggcccttctgacggcatctgaggacggcactctgaagttgtggaatctgcaaaaagcagtgacagccaaaaagaacgccgctctcgatgtagaaccaatccacgcttttcgcgcacatcgcgggcctgtgttagccgttgccatggggagcaacagcgaatactgctattctggtggggcagacgcatgtatacactcatggaagatacctgacctgagtatggatccttacgacgggtacgatccgtcggtcctcagccacgttctggaggggcatggagacgctgtgtggggacttgcgttttcaccaacaagccagcgacttgctagctgctccgcagacggaaccgtccgcatctgggacccttcctcctcttcgccagcttgtctgtgcacatttcccactgcctctgaacacggcgtgcctaccagcgttgcattcactagcacagaaccagcccacattgtcgcatctttcagatcgggggacactgtgctttatgatatggaagtgggttccgctctgttaacactggagtcccgaggatcgtccggcccgacacagattaatcaggttgtgagccacccaaatcagcccctcacaatcacagcccatgacgacaggggcatacgctttctggacaaccgaaccggcaagcctgttcatagtatggtggcacatctcgatgccgtgacctgtctggctgtggatccaaacggagctttcctgatgtcagggagtcacgattgctcactgaggctgtggtcattagataataagacctgcgtccaggagataactgcccatcgtaaaaaacatgaggaagctatccacgccgtggcatgccatccttctaaggctctgattgcttccgccggtgctgatgcgttagcaaaagtcttcgtatag

SEQ ID NO: 13965 - DNA, 1596 bp, Artificial Sequence
  Description of Artificial Sequence: Synthetic coding sequence
atgcggatgcacacgcgattatccctgcctgggccaccccaccatgtgggcgcagcctacccacctgccggaggcaacaggagcgagaatgctggaagttgggggggcgctggcgcaagcagcgttgagccactggctagaagggtcgccagtggcgaggccacattggctatggaccagcctgccggattgcaggtagactacgtgtttaggggcgtagagcacgcagtccgtgtaatggtcagcggtcaggtgctcgagctggaggtggaagataggatgaccgctgaccagtggcggggtgagtttgacgctgggtttatcgaggacttaacccacaagacaggcaacttcaagcagtttaacatcttctgtcacatgttagagagcgcccttacacaaagctcagagagcgttactctcgacttgcttacctacacggacctcgaatccttgcgaaacagaaagatgggtgggcggcccgggtcactggcccctagatcggcccaactaaatagcaaaagatatctgatcctgatttatagcgtagagttcgaccgcattcactacccccttccgttaccatatcaaggaaagcctgatccagtggtgctccaggggattattaggtcattgaaagaggagctaggacgtctacaaggtcttgatggtcagaatacgagagacacacgagagaacgagatctggcatcttagagaacaggtgtccaggctcgcatctgagaaaagggaactcgaagcccaacttggcaggtctcgtgaggaagccctcgcaggcagagcagcaagacaggaagccgaggcactgagaggactggtccgcggcctcgagttggaactccggcaagagcgaggactaggacaccgcgtagcgggcagacgcgggcaggattgccggcgcctggccaaagagctcgaggaggccaaagcctctgagcgttcccttcgggccaggttgaagacacttactagtgagctggccttgtataagcggggcggccgaggttccaggggtagaggtaggcctgctaggccaagcccatcacctaccggcggtcgagctttgcgtttcgatcctaccgcgtttgtgaaggccaaggagcgcaagcagcgggaaattcagatgaaacagcagcagcgaaacaggctggggagtggcggctctggagacggcccttcagtgagctggtcacgtcaaacccaacctcccgctgccctgacaggaagaggtgatgccccaaatagatctagaaataggagctctagcgtggattcttttagatcaaggtgttcatccgctagctcttgttctgatttagaagatttctccgaatccctgagccgaggcggtcaccggcgacgaggaaagccgccatcacctactccttggtccgggtccaacatgaaatcccccccggtcgaacgctcacaccaccagaagtctctggctaacagcggaggctgggtgccaatcaaggagtatagttccgaacaccaggctgcagacatggccgagatcgacgcccgtctcaaggccctccaggaatacatgaatcgactcgatatgcgaagctag

SEQ ID NO: 13966 - DNA, 1452 bp, Artificial Sequence
  Description of Artificial Sequence: Synthetic coding sequence
atggcttccttactttggggtggagatgccggcgcagcagagtccgagcgcttgaatagtcatttcagtaatctgagtcaacctcggaagaacctgtggggtatcaaaagcactgccgttaggaatattgatggatccatcaataacatcaatgaagacgatgaggaggatgtagtagaccttgcagcgaacagcctgttgaacaagctaattcatcagtctttagtggagagctcccatcgtgtggaggtgcttcaaaaagatccttcaagcccattatattctgttaagaccttcgaggagctaagactgaaagaagaactcctcaaagggatctacgccatgggctttaatcgcccatcaaagattcaggaaatggccttgcccatgatgctggcgcaccctccacaaaacctcattgctcagtcccagagcggaacgggcaagactgccgccttcgtgttggctatgctgagcagagtcaatgccctggagctctttccccagtgcctctgtcttgctccaacctacgaactggctctacagactggcagggtcgtggagcagatggggaaattctgtgtcgacgtccaggttatgtacgcgatcagagggaatagaataccccgcggcactgatataaccaaacagataataatcggcacacccgggactgtgctggactggtgttttaaactcaagctgatcgacctgacaaagatccgggtctttgtactcgacgaggctgatgtaatgattgacacccaggggttctctgatcatagcatcagaatccagcgtgcccttccttcagagtgccaaatgttattgttctctgctacttttgaggattctgtgtggcacttcgccgagcgcatcattcccgaccccaatgtgataaaacttagaaaagaggagctgactctcaacaacatcaggcagtattatgttctctgcgagcaccggaaggacaaataccaggcactgtgcaatatttacggctccattacaatcggccaggccattatcttttgccagactaggaggaatgccaagtggctgaccgtcgagatgatccaggacggacaccaggtttctctgctgtcaggcgaactaacagtggaacaaagggctagtattatccaaagatttcgagatgggaaggagaaggtgctgataaccactaacgtctgtgcccgcgggatcgacgtcaagcaggtaaccatagtcgtgaatttcgacctccccgtgaagcaaggggaggagcccgactatgagacctatctacatagaataggccgaaccgggcgcttcggtaaaaaaggcctggcgttcaacatgatcgaggtggatgaactccccagtcttatgaagatccaggaccactttaactcttctatcaaacagctgaatgctgaagatatggatgaaatcgaaaagatcgactactag

SEQ ID NO: 13967 - DNA, 1014 bp, Artificial Sequence
  Description of Artificial Sequence: Synthetic coding sequence
atggccgacgccgcgccacagcttggaaagcggaagcgcgagctcgatgtcgaagaggctcatgcggcttccaccgaggagaaggaagctggcgtcggcaacggtacttgcgctccagtcaggctgccttttagcggttttaggctgcagaaagtcctaagagagagtgccagggataaaattatctttctgcacggaaaggtaaacgaggctagtggagacggcgatggggaggacgccgtggtcattctggagaagactccatttcaggttgaacaggttgcccagctcctgacggggagcccagaacttcaactgcaattctctaatgacatatactcgacctatcacttgtttcctcctagacagctgaacgatgtgaaaacgaccgtggtgtaccctgccaccgagaagcacctccagaaatacctgcggcaggatttaagattgatcagagagacgggggacgactatagaaatatcaccctgccacatctggaaagccaatcactctccattcagtgggtgtataatatcctagataaaaaggccgaggccgaccgcattgtcttcgaaaacccagacccaagtgacggattcgtgctcattcccgatctcaagtggaaccaacagcagctggacgatctatacctgattgccatctgccacagacgcgggatacgaagcctccgtgacctcaccccagagcatcttcctttactgcggaacattttacatcaggggcaggaggctatactgcagcggtacagaatgaaaggggatcatctgcgcgtctatctgcactaccttccaagctattaccacctacatgtccatttcaccgccttgggatttgaagcacctggttcaggtgtggaaagggcacatctgttagctgaggtaatagagaacttggaatgtgacccccgtcattaccaacaacgcacactcactttcgctctgcgcgcagatgatccactgttgaagctcctgcaggaggcccagcaatcatag

SEQ ID NO: 13968 - DNA, 1782 bp, Artificial Sequence
  Description of Artificial Sequence: Synthetic coding sequence
atgaagctgcaggcagtgatggaaaccctgctgcaaaggcaacagagggccagacaggagctggaagctcgacagcaactgcctccagaccctccagctgcccccccaggacgcgctcgggcagcacccgatgaagaccgagagcctgagtccgccaggatgcagagggctcagatggcagctctcgcagccatgcgcgccgctgcagctggcctcggacaccctgccagtcctgggggttccgaggatggcccccctggtagcgaggaggaggacgctgccagggagggcacgccgggcagtcctggccgcggcagagaaggaccaggcgaggagcatttcgaggatatggccagcgacgaggatatgaagcctaagtgggaggaggaggagatggaggaagaccttggcgaagacgaagaagaggaagaggaagactacgaggacgaagaagaagaggaggatgaggaaggactgggaccaccgggacctgcaagcctgggcaccaccgccctgtttcctaggaaggcccagccgcctcaggccttccgcggagacggggtaccgcgtgtccttggaggtcaggaacgtccaggccccgggccagcgcaccctgggggggcagcccatgtcgctcctcaactgcagccccctgatcatggtgactggacatatgaagagcaattcaagcaattatacgagctggatggtgaccctaagcgcaaagaattcctggacgacctgttctccttcatgcagaaaagaggaacacccgtaaatcgaattccgattatggcaaaacaggtcctggacttgtttatgctttatgtgctggtgacagaaaaggggggcctggttgaggtaataaataagaaactgtggagggaaattacaaaaggccttaatcttccgacctccatcaccagcgccgcgtttacattacgtactcagtacatgaagtacctgtatccctacgaatgtgaaaagcgtggattatcgaaccccaatgagttgcaagccgctatcgatagcaacagacgcgagggcagaagacagtctttcggaggctccttgttcgcatattctcctgggggcgctcacgggatgctgtcaagtcccaagctcccagtgtcgtcactcggtctcgccgcatcaactaatggtagcagcattacgccagctcctaagattaagaaggaagaagatagtgccatcccaatcaccgtgcccggcaggctgccagttagtcttgcaggacacccagtggtcgccgctcaggctgccgcagtgcaggcggctgctgcccaggccgccgtggcagcccaagccgctgctcttgaacagctgagggagaaactggagtcagccgagcctcccgagaagaaaatggcattagtcgccgatgaacaacaacggctaatgcagagagcactgcagcagaatttcctggccatggcggctcagttgccaatgtctatcaggattaatagtcaggcctcagagtccagacaggactcagccgtaaacttgacaggcacaaatggctccaactccatatctatgagtgtcgagatcaatggtataatgtacacaggtgttttgtttgcccagccacccgcccccactccaaccagcgccccaaacaagggtggtgggggagggggcgggagcagctcaaatgcaggggggagaggaggtaacactggcacttccggtggacaggctggtcccgccggactgtccaccccgtctacttccacatcaaacaattctttgccgtag

SEQ ID NO: 13969 - DNA, 6192 bp, Artificial Sequence
  Description of Artificial Sequence: Synthetic coding sequence
atggccgacggcgctccaaggccacagctttacaggagcgtctctttcaaactcttggaacggtggagcgggggaccggggctgcgggaggaagacactgacaccccaggactgcgacggagagccagctgtagaccgactactgccgctagagggcagccctcacgcagagtgtcgaagctcgctagcggacctcttgcagctcccgcgcaacctcggccgcttagaagtttatcaccgtcggtcagacaactgtcaaggcgatttgacgccccacgcttggatgatggcagcgcgggtactcgtgatggcggcgtactgccagctgcggccgaagaggctgcagaaggaccagccagaggtgcctggccaagcgtaacagagatgcgaaagctgttcggagggcctggaagcaggcgaccatccgctgatagtgaaagcccagggactccatctcccgatggggccgcttgggaaccgcccgctagagagagtcgacagccacctacccccccaccccggacctgtttccccctggctgggctgcgcagcgccaggcctctgacaggaccagagaccgaggggaggctgagaaggccgcagcagcagcaggagagagcccaaagacccgcggacggtctccatagttggcacatcttttctcagccacaggccggagctagagccagttgcagcagctctagtattgcagcctcctatccagtcagcaggtctagggcagccagcagcagcgaggaggaagaggaaggccctccccagctgcctggtgcccaaagcccagcctatcacggggggcactcctccggctccgatgacgatagagatggggagggtgggcataggtggggcgggaggcctgggctgaggccagggagctccctcctcgaccaggactgcagacccgattctgatggcttaaatctgagttccatgaactctgctggagtctccggctctccagagcctcctacttcaccccgagcaccaagggaggagggcctcagggaatgggggagtggatctccaccttgtgtgcccggaccgcaagagggacttaggcctatgtcagactctgtcggcggagcgttcagagtggccaaggtgtcttttcccagttacctggcttcacctgccggttcccgtggctctagcaggtatagtagtaccgaaacgctgaaagatgatgacctatggtcatcccgcgggtctgggggttggggggtgtatcggtcgccttcatttggagcaggggagggcctcttaagaagtcaggcacgtacaagagcaaagggccctggggggacaagccgtgctctgcgagacggtggctttgagccagaaaagtcccggcagaggaagtctttaagcaatcctgacatcgcctcagagaccctgaccctgctttctttccttcgatctgacctgtccgagctgcgggtcaggaaaccgggaggtagctcgggtgataggggctctaatccacttgatgggagggacagccccagcgcaggcggccctgtcggacaactggagccaattcctattccagcacctgcaagccctggtaccagacccacactcaaggacctgacggccacactcaggcgggcaaagtcctttacttgctcggaaaaacccatggcacgacgactgccccggacctccgcattaaaaagcagctcgagtgaactgctcctaaccgggccaggggctgaagaagacccactccccctcatagttcaggaccagtatgtgcaggaagcacgacaggtctttgagaagatacagagaatgggcgcccagcaggatgatggcagcgatgccccgcccggctcacctgattgggcaggcgacgtgactagaggccaacggtctcaggaagagctgtctgggccagagtcatctctcactgacgaaggtatcggcgccgatccagagcctcctgtggccgccttttgcggtttaggaacgaccggcatgtggagacctctaagttcctcatccgcacagaccaaccaccacgggccaggcaccgaagactcgctgggagggtgggctctagttagccctgaaacccccccgacccccggagccctccgccggaggagaaaggttccgccctccggctctggaggctcagagttgagcaacggagaggctggtgaggcttacaggtccttaagcgaccctatcccacagcggcatagagccgcaacgagcgaagaacccacggggtttagtgtggatagcaatctgttaggcagcctgtccccaaaaaccggactgcccgcaacttcagcgatggacgaggggctcacctctgggcattcagactggtcagtgggatccgaggaaagcaaaggctaccaggaggtcatccagtctattgtgcagggtcccgggactttaggacgtgttgtggatgacagaatcgccggaaaagcaccgaaaaaaaagtcactttccgacccctcaaggcgtggcgagctggccggccccggattcgagggcccggggggagaacccatccgcgaggttgagccaatgctgccgccctctagtagcgaacccatcttggtagagcagagggcagaacctgaagaaccgggagctacaaggagccgcgcacaatccgagcgagcactgccggaagctttgccaccgcctgctaccgcgcatcgtaatttccatctagacccgaaactggcagacatcttaagtcctagacttattcgccggggatcaaagaaaagacccgccaggagttcacaccaggagctgcgccgcgatgagggctctcaagaccagacggggtcactgtcgagagctcgaccttcctccaggcacgttaggcacgcttctgtgccagctacttttatgcctatcgtcgtgccggagcccccaacatcggtgggtcccccagtcgcagtgcccgagcccatcggcttccccacccgcgctcatccaacactccaggcaccatccttggaggacgtgaccaaacagtacatgttgaacctgcattccggtgaggtcccagcccccgtcccagttgacatgccctgtctccctctcgcagcacccccgtccgccgaagccaaaccgcccgaggctgcccgacccgcagatgagccaacccctgctagcaagtgctgttctaaaccccaggtggacatgcggaagcatgtcgccatgacactcctggataccgagcagtcatatgtagaatctctgaggaccctcatgcagggatacatgcaaccattaaagcaaccagagaattccgtactgtgtgatcctagtctcgtggacgagattttcgaccagatccccgagctcctggaacatcatgaacagtttctcgagcaggtaagacactgcatgcagacgtggcacgcgcagcagaaggttggcgcgttgcttgtccagagcttcagcaaggatgtgctagtgaacatctacagtgcttacattgacaattttctgaatgccaaggacgcagtgagagtcgctaaggaagctcgaccggcatttctgaagttcctcgagcagtctatgagagagaataaggagaaacaggccctcagtgatctcatgatcaaacccgtgcagcgtatcccgcggtacgagctgctcgtgaaagatctgcttaaacataccccggaggatcaccctgaccacccattgttattggaagcccaacgtaacatcaaacaggtggcagagcgtatcaataagggagttaggtccgctgaagaagctgaaagacacgcccgcgttcttcaagagatcgaagcccacatcgagggcatggaggacctccaggcaccgctgcgcagattcctcagacaggagatggtgatagaagtgaaagccatcggtggaaagaaagaccgtagcctgtttctattcaccgacctgatagtgtgcaccacgttgaaaagaaagtcgggtagtctgaggagaagctcaatgagtttatacacagccgcttccgtgatagatacggcgtctaaatacaagatgctgtggaagttgccgcttgaggacgctgatatcatcaaaggggcatcgcaggcgaccaaccgggagaatatccagaaagctattagtaggctggacgaagacctgaccactctcggacagatgtctaagctgtccgaatccctgggattcccccatcagagcttggacgacgccctgcgagacctcagtgcagccatgcatagagacctgagcgaaaagcaggccctgtgctacgcgctctcttttccacccacaaagctggaactgtgtgctacaagaccggaaggcaccgatagctatatatttgaattcccacaccctgatgccaggctgggttttgagcaggctttcgacgaggctaagcgaaagctggctagctctaagtcctgtttagatcccgagtttcttaaggccattccaattatgaaaacaaggtccggaatgcagttctcttgcgcagcccctacgctcaattcctgtccagaaccttcacctgaagtgtgggtatgcaactcagacggatatgttggacaggtttgcctgctctccttacgtgcagaaccagatgttgaggcgtgtatcgctgtctgctccgcgcggatactctgcatcggggccgtccctggattgcagccgcgctgccatagagagcccccacccagtctgagaagtccaccggaaactgccccagagcccgctggtcctgaactcgatgtcgaggctgccgctgacgaggaagccgccactctggccgagcccgggcctcaaccttgcttgcacatctctatcgccggcagcggactggaaatgactccggggctaggcgagggagatccgcggccagaactggtgccgttcgattccgattcagatgatgagtcctcaccaagtcctagcggtacgctccagtcacaggccagcagatctactatctccagttcttttgggaatgaagaaactccatcgtccaaggaagccacggccgaaaccactagttccgaagaggagcaagaaccaggctttttgcccctctctggatcgtttgggccagggggaccatgtggcacctccccaatggatgggagagcactgcgcagatccagccacggtagtttcacaaggggttccttggaggacctgttaagcgttgatcctgaagcctaccagagttctgtgtggctgggtacggaggatggttgtgtgcatgtctatcagtcctccgacagcatccgcgaccgacgaaacagtatgaagctccagcacgccgcttctgtgacatgtatcctgtacctgaataatcaagtgttcgtcagccttgctaacggtgaactcgttgtgtaccagcgtgaggctggacacttttgggatccccagaattttaagagtgtgacgctaggcacgcagggctctcctattactaagatggtgtctgtgggtggccggctctggtgtggttgccaaaatcgcgtgctggttctctcccccgacacgctgcagctggagcacatgttctacgtgggccaggatagctcacgatgtgtggcctgcatggtggactcctcactgggtgtctgggttactttaaagggaagtgctcatgtgtgtttataccatccggatacttttgaacaactggccgaagttgatgttaccccccccgtgcaccgcatgctggcaggctccgacgccattatcagacaacacaaggcagcatgtcttcgtatcacagctctgctggtctgcgaggaacttctgtgggttggcaccagcgccggagttgtcctgacaatgcccactagcccaggaacggtgtcttgccctcgagccccgctcagccccactggtctcggacagggacatacgggccacgtccgtttcctggctgcggtccaactgcctgacggcttcaacttgctatgtccaacacctcctcctccccctgatactggacccgagaagctcccaagcctcgaacaccgggattctccctggcaccgcggcccagctccagcccgaccaaaaatgctggtgatatccggaggcgacggctatgaggactttagattgtcctcaggtggcggctcctcttctgagacagttggaagagatgacagtaccaatcacctgctgctttggagagtgtag

SEQ ID NO: 13970 - DNA, 2499 bp, Artificial Sequence
  Description of Artificial Sequence: Synthetic coding sequence
atgtctgaggccggcggggccgggcccggaggttgcggcgccggggcaggtgccggcgctggccctggcgcattacctcctcagcctgccgctttgcctccagcccccccccaggggtctccctgcgccgcggccgcaggcggatccggagcctgtgggccggccaccgctgtggccgccgcaggcacagccgagggcccgggtggcggaggatctgcccgcatcgctgtgaaaaaggcccagctcaggtccgccccgcgggccaaaaaactggagaaacttggagtttattccgcctgtaaagccgaagagtcatgcaaatgtaacggttggaagaaccctaatccaagcccgaccccacctagagctgatttgcagcagattattgtcagcctgaccgaatcctgcagatcttgctctcacgccctcgcagcccacgtaagccacctggaaaacgttagcgaagaagagatgaacaggctgctcggtatcgtgcttgatgtcgaatatttgttcacatgcgtgcataaggaagaagacgctgacacgaaacaggtgtatttttacctcttcaagcttctccgcaaaagtatacttcagcgggggaaaccggtagtggaaggcagcctagagaagaaaccccccttcgaaaagccgtccatcgagcagggagtgaataactttgtgcagtacaagttcagtcatctcccagctaaagaaagacagaccatcgtggagctcgcaaaaatgtttctgaacagaatcaattactggcacctcgaggccccgtcccagcggcgactccgctctcctaacgacgacatctccggatataaggaaaattacacaagatggctctgttactgtaatgtccctcagttctgcgacagtctcccccggtatgagactacacaggtattcgggaggactctcctccgaagcgtgtttacagtcatgaggaggcagttattagagcaggctcggcaagagaaggataaactgccgcttgagaagcggacactgatattgacccacttcccaaagttcctctctatgctcgaggaggaggtgtattctcagaattccccaatatgggaccaggactttctgagtgcctcctccaggacttctcagctggggattcagaccgttattaacccacctccagtggcaggcactatctcctacaacagcacatctagttccctagaacagcctaatgcaggatccagctctccggcctgtaaggcctcatccggcctagaggccaaccctggagaaaagaggaagatgactgattcccacgtgctagaggaggcaaagaagcccagggtcatgggcgatatccctatggagctaattaatgaggtgatgagtacaattactgacccggcagccatgcttggacctgagacaaactttctctcggctcatagtgcgcgcgacgaagcggctcgcctcgaagaacgcagaggtgtgatcgaatttcatgtcgtgggcaactcccttaaccagaagccaaacaagaagatattaatgtggctggtcggtctgcagaatgtgttttctcatcagctgcctaggatgccaaaggagtatattactcggctggtattcgatcctaaacacaagaccctggctttaattaaagacggacgagtcataggtggcatctgctttcggatgttcccatctcagggattcaccgaaattgtgttttgtgccgtgacgtcaaatgaacaagttaaagggtacggcacacatcttatgaaccacctgaaggaatatcatattaagcatgacattctcaatttccttacatatgctgacgagtacgcaattggatactttaagaaacaagggttctcaaaggagatcaagataccgaagacaaagtatgttggatacataaaggactatgagggagcaaccctgatgggatgcgagttaaatccaagaatcccctacaccgaattctccgtgattatcaagaagcaaaaggagatcattaaaaagttaattgagagaaagcaggctcagattcgaaaagtctatcccggactgagctgcttcaaagacggagtgcgccagatccccatcgaaagtattccgggaatcagagagactggctggaaaccttccggtaaagagaaatctaaagagcctagggaccccgaccaactgtatagtacgctcaagtcgattctccagcaggtcaaatcccaccagtccgcttggccattcatggagcctgtcaagcgcaccgaggcgcccggctattatgaagtgatccggttcccaatggacctgaagaccatgagcgagcgcttgaaaaatcgttactacgtcagcaaaaaattatttatggccgacctgcaacgggtgtttaccaactgtaaagagtataacccacccgagtctgagtactataaatgcgccaacatcctcgagaagttttttttcagcaaaatcaaggaggcggggttaatagacaagtag

SEQ ID NO: 13971 - DNA, 4950 bp, Artificial Sequence
  Description of Artificial Sequence: Synthetic coding sequence
atggctggtggccggggagctcccgggaggggccgtgacgagcccccagaatcatatccccagcggcaggaccacgagctgcaagccttggaggcaatttacggtgcagacttccaagatctgcgccctgacgcgtgcggcccagtcaaagaacctcctgaaatcaaccttgtactgtacccacagggcctgacaggcgaagaagtctacgtgaaggtggacctgcgcgtgaagtgtcctcctacataccctgacgtggtccctgagatcgaactgaagaatgcaaaaggactcagtaatgagagcgtcaacctgttaaaaagtcgattggaggaattagctaagaaacactgcggggaagtcatgatttttgaactagcttaccacgtgcagtcattccttagtgaacacaataaaccccctccaaaatccttccacgaggagatgcttgaaagacgcgcgcaggaagagcagcaacgcttactggaggccaagcgcaaggaagaacaggaacagagagaaatcctccacgagattcagcgtaggaaggaggagatcaaggaagaaaaaaaacgcaaggagatggcaaaacaagaacggcttgagattgcgagtctgtcaaaccaggatcacacaagcaaaaaggatccgggggggcacaggaccgctgccatcttacatgggggatcccctgatttcgtggggaacggcaaacacagggcgaactcgtcaggacgcagcagaagggaacggcagtacagcgtctgcaactccgaggacagccctgggtcttgcgagatcctgtattttaatatgggatctccagaccagctcatggtgcacaagggaaagtgtatcggcagtgacgagcagctggggaagctggtttataatgctcttgaaacagccactggaggcttcgtcctgctctacgagtgggtgctccagtggcagaagaaaatgggaccctttctgacctcccaggagaaagagaaaattgataagtgtaagaaacagatccaggggactgaaacggaattcaatagtctggtgaagctgtctcatcctaatgtcgttcggtatctcgcgatgaacctcaaggagcaagatgattcaatagttgtggatatccttgtggagcacatctctggcgttagtcttgctgcacatttatctcactccggccctattcccgtccatcaactgagaagatatactgcacagctcctgagcggtttagattatctgcacagcaattcagtggtgcacaaggtgctttctgcaagcaacgttcttgtggatgctgaaggaactgtgaagatcactgattatagcatttccaagagactggccgatatctgcaaagaggacgtgttcgagcagactcgtgtgcggttctcagataacgcactaccctacaaaaccgggaagaagggggacgtgtggagactgggtctgttactgctcagcttgagtcaagggcaggaatgcggcgaatatcccgtgactatcccatcagatctccccgccgatttccaggactttctcaagaagtgtgtgtgtttagacgataaggaaaggtggagtcctcaacagttgttgaagcattctttcatcaatccccagcctaaaatgcctctggtcgagcagtcccccgaggattccgagggtcaggattacgttgaaaccgtgattccttccaataggctgccctccgctgcatttttcagcgagacccaaaggcaattctccaggtattttattgagtttgaagagcttcagctgctgggtaaaggggctttcggcgctgtcatcaaagtgcagaacaagctagatggatgctgttacgccgtgaagagaattcccatcaacccagcttctcgtcagttccggcgaatcaaaggcgaggtcacgctccttagcaggctccatcacgaaaatatagtaagatactataacgcctggatcgagagacacgaaagaccggcaggtccggggacacctcctcccgactcagggcctctggccaaggacgatagggcagcccggggccagcccgcctccgatacagatgggcttgacagtgtcgaggccgctgctcctccaccaatcctgtctagcagcgtagaatggagcacctctggggaacgctctgcttcagctagattcccggctacggggcccggatccagtgatgatgaagatgacgatgaggacgagcatggtggagttttctcccagtccttcctccccgcctctgactccgaaagtgatataattttcgacaacgaggacgaaaactctaagagccagaaccaggatgaagactgtaatgagaaaaacggctgccatgaatccgagccatccgtgactaccgaagccgtacactatctgtatatccagatggaatactgcgagaagtcaaccttgcgggatacaatagaccagggcctgtacagggatacagtgcgattatggcgcctgttccgtgagatcttagatgggctcgcatacattcacgagaagggcatgatccatcgggacttgaaaccagtgaatattttcctggacagcgatgatcacgtgaaaattggcgacttcgggctagcgacggaccatctggcatttagtgcagactctaaacaggatgaccagacaggcgacttgatcaaaagtgacccgtctggacacttgacgggtatggtaggcacagctctgtatgtttcacctgaggtgcaaggctctacaaaaagtgcttataatcagaaggtagatctctttagtttggggattatctttttcgaaatgtcatatcatccaatggtcactgcgtctgaacgtattttcgttctgaatcagctgcgcgaccctaccagccccaaatttccggaggatttcgacgacggggaacatgcaaagcagaagtcagtaatatcctggttactgaatcacgatccggctaagcgtcccaccgcaaccgagttgctgaagtccgagctgctcccacctccccagatggaggagagcgaactgcatgaggtgctgcaccacaccctgaccaatgtcgacggtaaagcttatagaaccatgatggcacagatcttctcccagcggataagccccgcaatagattacacctatgattctgacatactcaaggggaattttagtatcagaacggccaaaatgcagcagcacgtgtgtgaaactattataaggatctttaaacgacatggagctgtgcaattgtgcacaccactcttattgcccagaaatagacaaatatacgaacacaacgaggctgctctgttcatggaccactccggcatgctcgttatgcttcctttcgatctcaggatccccttcgctaggtacgtcgctcggaataatatcctgaacctgaagagatattgcattgaacgcgtgttccggcctcggaaacttgaccggtttcaccccaaagagttactggagtgtgcctttgacatcgtaacctctactactaacagtttcttgccaaccgcagagattatttatactatttacgagatcatccaggagtttccagccctgcaggagagaaattactcaatatatctgaaccacacaatgttactgaaggcaatactccttcattgcggcattcccgaagataagttgtcccaagtgtatattatcctctatgatgcagtcactgagaaacttacacgtagggaagtcgaggccaagttctgcaacttatccctgtcatccaactctctctgtcgactttataagtttatcgaacagaagggcgatctacaggacctaatgcctactattaacagccttattaagcagaagacaggcatcgctcaattggtgaagtacggcttgaaagacctggaggaggttgtgggcctgttaaaaaaactgggaattaaacttcaggtgctgataaatctcggtctcgtttacaaggtccagcaacataatggtatcatattccagtttgtggcattcatcaagcgccggcagcgggccgtaccagaaatcttggccgccggcgggcgctacgatctgctgataccccagttccgtggaccccaagctttgggccctgtacccacggccattggggtatccatcgccatcgataagatctcagccgccgtgctcaacatggaagagtcggtgaccattagttcttgcgatctgcttgtggtcagtgtcggtcagatgagtatgagccgcgcaataaacttgacacaaaaattgtggactgccggaatcactgccgagataatgtatgattggagtcagtcccaagaagaacttcaagagtactgcaggcatcacgagatcacctacgtggccctggtgagcgataaggaaggctcccatgtgaaggtgaagtctttcgaaaaggagaggcaaactgagaagcgcgtgcttgagacagaactggtggaccacgtgctccagaagctgcgcaccaaagtaacggacgaaaggaacgggagggaggcttctgacaacctggccgtgcagaatctaaagggatccttcagtaatgcctcaggtctcttcgaaattcacggagcaacggtcgttcctattgtctcggtgcttgcacccgagaagctgtcagcctcaacaagacgccgttacgaaacgcaggttcaaacacggctccaaacttccctggccaacctccaccagaaaagctctgaaatagaaatcctagccgtagatctgcctaaggagactatcctccagttcctgagcctggagtgggacgccgacgagcaggccttcaatactactgttaaacagctgctctcccggctgcctaaacagagatacttaaaattggtgtgcgacgaaatttacaacatcaaagttgagaagaaagtatccgtgctctttttgtattcatatagagatgactactaccgaattctcttctag

SEQ ID NO: 13972 - DNA, 5652 bp, Artificial Sequence
  Description of Artificial Sequence: Synthetic coding sequence
atgccagtcggcagaattgagtgtccaagttcaccatcatttccacgagacatatcacatgaatgccgagtctgtggagtaactgaagttgggctaagcgcatatgcaaaacatatctctggccagctgcataaggacaacgtggacgcccaagagcgtgaggacgatgggaaaggcgaagaagaggaagaagactacttcgacaaagagctcattcagctgattaaacagcgtaaggaacaatctagacaggacgaaccgagtaactcgaatcaggagattaacagcgatgatcggcgccctcagtggaggcgcgaagatcgcatcccatatcaggaccgggaatcttacagccagcctgcctggcatcaccggggcccaccccagagagattggaaatgggagaaagacgggttcaacaacactagaaagaactctttcccgcatagcctgaggaatgggggaggacctcgcggcaggtctggctggcataagggggtggctggaggaagcagcacctggtttcataaccacagcaattcaggcggtggatggcttagcaatagtggcgccgtggactggaatcataatgggacagggaggaatagttcttggctgtcagaaggaacaggcggctttagttcctggcatatgaacaactccaatggtaactggaagagctcagttcgatccacgaataattggaactattccgggccaggtgataaattccagccgggtcgaaacagaaacagtaactgccagatggaggacatgaccatgctctggaataagaagtcaaacaagtccaacaaatatagccacgatcgctacaattggcaacgccaagaaaacgacaagctgggaacagttgctacgtaccggggaccgtccgaggggttcactagtgacaagtttccatccgaaggacttctggacttcaattttgaacagttagaatcccagacgacaaaacaggctgacactgccaccagcaaagttagcggcaagaacggctcagctgccagagaaaaacccagacgatggacgccatatccctctcaaaaaacactggacctgcaatcgggactgaaggatatcacaggaaacaagtctgaaatgattgaaaagcctctcttcgacttctctctaataactaccggcattcaggagccgcagaccgacgagactcggaacagccccacccagaaaacacagaaagaaatccatacgggaagcctcaaccacaaggcatcaagtgactccgcagccagctttgaagtagtaagacagtgtcccaccgcagaaaagccagagcaggaacatacaccaaataaaatgccctctttgaaatcaccactgttaccttgccctgccactaaaagtttgtcccaaaagcaagatcccaagaacatctccaaaaatactaaaactaatttcttcagtcctggcgaacactcgaatcctagcaacaagcctaccgtggaggataaccatgggccatacatctctaagttacgcagtagctgtccccatgtgcttaagggtaacaagtccacgtttgggtctcagaagcagtccggcgacaatctgaatgatactttacgcaaagccaaggaagtgctccaatgccacgagtcactccaaaatcccctcctgtctacaagcaaaagcacccggaactatgctaaagcgtctcggaacgttgaggaatcggagaagggtagtctgaaaattgagttccaagtccatgctctggaagatgaatcggatggcgaaaccagtgatacagaaaagcacggcacgaaaatcggcactttagggtcagccactaccgagttgctcagcggctccacacgtaccgcagatgaaaaggaagaagatgaccgaattctgaagacctctcgagagctcagtacaagcccttgcaatcctatcgtgagacagaaggaatctgagctacagatgacatccgctgcgtctccccatcctggcctcctcctggatttgaaaacttctctcgaagacgctcaagttgatgacagcatcaagagtcacgtatcctacgagaccgagggatttgaatccgctagcctggacgcagaactacagaagtctgatattagtcagccttccggaccacttctgcctgagctttcaaaactggggtttcctgcctccctgcagcgtgatctgacgcgacacatatccttgaaatcaaagactggggtgcacctgccagagcccaacttgaactccgctcgacggattaggaacatctcgggacatcgaaaaagcgagacagaaaaggagtcaggactgaagccaaccctgagacaaatcctaaacgcttccaggaggaacgtaaactgggagcaagtaatacagcaggtgaccaaaaaaaaacaagagctgggcaaagggttacctcgctttgggattgagatggtgcctctggttcagaacgagcaggaggctctcgatttagacggcgagcctgatctgtccagcttggaaggctttcaatgggagggagtgtccatttctagtagtcctggactggccaggaagagaagtctcagcgaatcatctgttatcatggaccgcgcaccaagtgtctactcatttttttccgaggagggaacgggaaaggagaacgagccacagcagatggtgtccccatctaacagtctccgggctggccagtcacaaaaagcgaccatgcacctgaagcaagaggtgactcctagagctgcgagcctccggaccggagagagagcagaaaacgtggctacacagaggagacacagtgcccagctcagtagtgaccacatcatccctctgatgcacctggcaaaggatctaaattcccaggagaggtcaattccgccttctgaaaaccaaaacagtcaggagtctaatggagaaggtaactgcctgagctcctccgcatcatcagccctggccatcagctccttggccgatgcggcgaccgattccagctgcacttccggtgctgaacaaaacgacggccagagcattaggaaaaagcgtagggctacgggagatggatcaagtcctgagctacccagcctagagaggaagaataaacgcagaaagatcaaaggaaaaaaggaaaggtctcaggtagatcaactgctcaacatctctctccgggaggaagagctttccaagtcacttcagtgcatggacaacaacctgttgcaggctagagccgccctgcaaactgcttacgtcgaagtgcaacgcttattaatgctcaaacagcagatcaccatggagatgtctgcgctgcgcacacacagaatacagatcctgcagggcctgcaggagacgtatgagccatcagagcacccggaccaggtgccctgttcgctgacacgggagagacggaactccaggtcacagacttctatagacgccgccttgctgccaacgcccttcttccctttgttcctggaaccaccttctagtcacgtgagtccttctccaactggggcatctctgcagattacaaccagccccacctttcaaacccacggcagtgtcccagcacccgactcttctgtgcaaataaaacaggagcccatgagccccgagcaggatgagaatgtcaacgccgtgcccccctctagcgcatgcaatgtcagtaaagaattattagaagcaaacagagagatctcagattcatgtcctgtgtacccagtgatcacagccagactgtcgctccctgaaagtacggaatctttccatgaaccctctcaagagctgaagttctctgtcgagcagagaaatactcggaatagggagaactctccatcgtcccagtctgccggcctcagctctattaacaaagagggggaagagcctacaaaggggaatagtggatcggaagcctgtacgtcatccttcttacgtctgtcgtttgcttccgaaactcccctggaaaaggagccacactcccccgccgatcagcctgagcagcaggccgaaagtactttgacttctgccgaaactcggggatctaagaagaagaaaaaactgaggaaaaaaaagagtttgagagcggcccacgttcccgaaaattctgacaccgagcaggatgtactgacagtgaagccagtgaggaaggtgaaggctggcaaactgatcaaggggggtaaagttacaacgagcacttgggaggattctcgtacgggccgagaacaagaatctgtgcgggacgagcccgatagcgacagttcactggaagttctggaaatccccaatccgcagctcgaggttgtcgccatcgactcgagtgaatctggtgaagagaaacccgatagtcccagcaagaaagacatttggaactctacagagcagaaccccttagagacaagcagaagcggatgtgatgaggtttccagcacctctgagattgggacccgatacaaagatggcatcccagttagcgtggcagaaacacagaccgttatctcgtcaattaagggatccaaaaatagctctgaaatctcctctgagcccggcgatgatgatgaaccgaccgagggctcatttgagggacaccaagctgccgtgaacgcaatccaaatttttggtaacttgctctacacatgtagcgccgataagaccgtccgcgtgtataatcttgtcagtagaaagtgtattggagtgtttgagggccatacctccaaggtgaattgccttttggtgacccagacctcaggaaaaaatgccgctctttacaccggctcgagcgaccatactattcgctgctacaacgtaaagtctcgcgaatgtgtggagcaacttcagctggaagaccgagtgctttgccttcacagccggtggcggatcttatacgccggcctggcaaatggcacagtggtgacattcaacatcaagaacaataaacgcttggagattttcgagtgtcacggcccccgtgccgtgtcctgtcttgccacagcacaggaaggtgctcggaaactcttggtagttggcagttatgattgcacaatcagtgtgcgcgacgctcggaatggactgctccttcgaaccctggagggccattcgaagaccatcctatgtatgaaggttgtcaacgatctggtgttcagcggttctagtgatcagagcgtgcacgcacacaatatacacacaggagagttagtgaggatttacaaagggcataaccacgccgtgaccgtcgtcaatatattaggcaaggtcatggttactgcctgtctggacaagtttgtgcgcgtgtatgaattgcagagtcatgatcgactgcaggtgtacggcgggcataaggatatgattatgtgcatgaccattcacaagtcaatgatttacaccggctgctacgacggcagcatccaggccgtgagattgaatctgatgcagaattataggtgttggtggcatggctgctccctcatcttcggagtagttgatcacttgaagcagcacctgttgactgaccacacgaatccaaatttccagacactcaagtgcaggtggaaaaattgtgatgccttcttcactgctcgaaaaggcagtaagcaggatgccgcagggcacattgagcgacacgccgaggatgatagtaaaatcgattcgtag

SEQ ID NO: 13973 - DNA, 588 bp, Artificial Sequence
  Description of Artificial Sequence: Synthetic coding sequence
atggctgagccagttcaagaggaactctctgtcttagctgccatcttttgcaggccacacgaatgggaagttctgtcacgctctgaaactgacgggactgtgtttcgaatccacaccaaggcagaggggtttatggatgtggatatacctttagaattggtgtttcacctgccggtgaactatccctcatgtctccccggcatttccatcaattcggagcaactcacgcgtgctcagtgtgtgacagtgaaagagaacctgctggaacaggcggaatcactcctcagcgagcctatggttcatgaactcgtactgtggatccaacagaatttacggcacatattatcccagcctgagacaggatccggctccgagaaatgtaccttcagcacttctacaaccatggacgacggactttggataacgctcctgcacctcgaccacatgagagctaagacaaagtacgtaaagattgtcgaaaagtgggcctcagatctgcgcttgacgggcaggctaatgtttatggggaaaattattctcatattgttgcagggggaccgaaacaacttaaaggtgcctaagtcctag

SEQ ID NO: 13974 - DNA, 1119 bp, Artificial Sequence
  Description of Artificial Sequence: Synthetic coding sequence
atgagtcgaaggaggttcgattgccgcagcatctctgggttgttgacgaccactcctcaaattcccatcaagatggagaatttcaataacttttacatcctgacgtctaaagaactggggagggggaagtttgcagtggtgcgtcaatgcattagtaagagcacaggtcaagagtatgcagccaaattcttaaaaaaaagacgaaggggtcaagactgccgggccgaaatcctgcatgaaatagccgtgctggagctcgcgaagtcatgccccagagtcattaacctgcacgaagtgtatgaaaataccagcgaaattatccttatcctcgagtacgcggccggaggagaaatcttttctctgtgtctgcccgagctggcagagatggtaagcgagaacgatgtcatcagactaattaagcaaatcctcgagggagtgtactacctccatcagaacaatattgtgcatctcgatctaaagccccagaatattctgttgtccagtatctaccccctcggcgacataaagattgtggatttcgggatgtccagaaaaatcgggcacgcttgcgaattaagagagataatgggaactccagagtatctggccccagaaatactgaactacgatccaattacgacagccactgatatgtggaacatagggatcatagcctatatgctcttgacacacacttcaccgttcgtcggcgaagataaccaggagacgtaccttaatatcagtcaggtgaatgttgactatagcgaagagacgttcagctctgtgtcccagcttgccaccgatttcatacaaagcctgctagtcaaaaatcccgagaagagaccaaccgcagagatctgcctgtctcactcctggttacagcagtgggattttgagaacctctttcatccagaggaaacatcctcctcctctcaaacacaggaccactctgtccgaagcagcgaggacaaaacgtccaaaagcagttgtaatggcacttgtggtgacagggaggacaaagaaaatatccccgaagacagctctatggtgtcaaagagatttagattcgatgacagcctgcctaaccctcacgaattggtctcagacttgctatgctag

SEQ ID NO: 13975 - DNA, 930 bp, Artificial Sequence
  Description of Artificial Sequence: Synthetic coding sequence
atggaggccgcccgcacagctgttctgcgagtcaagcgcaagcgaagtgcagaaccggctgaagctttagtgttggcatgcaaaagacttcgtagcgacgccgtggagtcagctgctcagaagacaagcgaaggactcgaacgcgccgcagagaataacgtctttcacctcgtggccacggtgtgctctcaggaagaaccggttcaaccgttgctcagagaggtcctgcggcctagccgggacagccagcaacgcgtccgtaggaatctcagggcatccgcccgcgaggtccggcaagaaggcagatatcgcgtgctgtccagcaggagatctttgggaactacttcgtccggacaggaatccgagtacacccccggaaatccagaggctgccggcaatagcgggttccaactccttgatctagtacacgaagaaggtgagcccgaagcagctagcgctggctcatgcaagacatccgatcctgacgtgatcctgtgcaattcagttgagctgatcagagagagactcaccgtcagcgaggacggtccaggtgtaagacgacaggaggagcagaagcacgacgactacgtctacgatatttactacctcgaaacagccacccctgggtggatcgaaaacatcctttctgttcagccatatagtcaggaatgggaactggtgaacgatgaccaggagcctgaagacatttacgatgatgaggatgacgagaactccgagaataactggcgaaatgagtacccagaagaggagtcttctgatggagacgaggacagccgggggtcggcagattacaacagtctgagtgaggaggagcgtggttctagtcgccagcgtatgtggtccaaataccccctggacgtgcagaaagagtttggttatgattcgcctcatgacctggattcggactag

SEQ ID NO: 13976 - DNA, 1068 bp, Artificial Sequence
  Description of Artificial Sequence: Synthetic coding sequence
atggccgacaattcttccgacgagtgtgaggaggaaaacaataaggtcctgcgggagggcatgccgcaggcaccaggacaccgcgggaaagacatggatcccgttccccccgctccagcttcgctgaagtgccatcagacaccttctcacgttttagaaagggtcggatggtatcgtgaaagccagaaacaccggaaggaaaaaaaaaagacatcgcagctcaccccccagcgaggatttagtgagaatgaggacgacgacgatgacgatgatgatagcagtgaaaccgatagcgactccgacgacgacgacgaggagcacggcgcacccctggaaggggcttatgatcccgccgattacgaacacctcccagtctccgcggagataaaagagctgtttcagtatattagtcgctatacaccgcagttgattgacctggaccataaattgaaaccctttattccggactttattccagcggtgggagatatagatgcgtttcttaaagtcccccgcccagatggcaaacctgataacttaggccttctggttctggacgagccctccacaaagcagtctgaccccactgtactgtccctatggctcaccgaaaactctaagcagcataatattacacagcacatgaaggtcaagtcactggaagatgcagagaaaaacccaaaagctatcgacacgtggatcgagtccatttctgaactacaccgatccaagccccctgcaacagtgcactacacacgtcccatgcccgacatcgacaccctgatgcaggagtggtcgccggagttcgaggagctgctcgggaaagtgagcctacctacagcagagatcgattgtagtttggctgaatatattgatatgatctgcgcaatcttagacatcccagtctacaaaagccgtatccagagtctgcatctcctgttcagcctgtacagcgagtttaagaacagccagcactttaaggcactcgcggagggtaaaaaggctttcactccgtcctccaatagcacaagccaagctggagatatggaaacgctgactttttcttag

SEQ ID NO: 13977 - DNA, 915 bp, Artificial Sequence
  Description of Artificial Sequence: Synthetic coding sequence
atggccgataacagtagtgacgagtgcgaggaggaaaacaacaaagagaaaaagaagacgagccagttaacaccgcagagggggttctccgaaaatgaggacgacgatgacgatgacgatgactcatctgagaccgatagcgacagtgatgacgatgacgaggaacatggcgcccctcttgaaggtgcctacgaccccgctgattatgaacatttgcctgtcagtgctgagataaaagaactgtttcaatatatctctagatataccccacagctaattgacctcgaccataagcttaaacctttcatccccgactttatcccagccgtcggggatattgatgcattcttgaaggtcccaaggcctgatgggaaacctgataatctgggcctcttagttctggacgagccctccacgaaacaatccgatcctaccgttcttagcctctggcttacggagaactcgaaacagcataatatcactcagcatatgaaagtgaagtctctggaggacgccgagaagaatcctaaggctattgacacctggatcgaaagtatctccgaactccaccgaagcaagccaccagccaccgtccactatactcgtccaatgcctgatatagacactctgatgcaggaatggtcaccagagttcgaggagctgttgggcaaggtgagcctgcctacggcagagattgattgttcactggcagaatacattgatatgatatgcgcaattctggacatacccgtgtataaaagtagaatccagagtctccacctgctgttctcactgtatagcgagttcaaaaactcccaacatttcaaggcactggctgaaggcaagaaagcctttacaccctctagcaattcaacctctcaggccggcgacatggagacgctaaccttctcttag

SEQ ID NO: 13978 - DNA, 1335 bp, Artificial Sequence
  Description of Artificial Sequence: Synthetic coding sequence
atgcgagagattgtgcacctccaggccggccaatgtggcaaccagattggggctaaattctgggaggttatatccgacgaacacggcatcgatccaacaggcacgtaccacggcgatagtgaccttcagctggaaagaattaatgtttattataacgaggctaccggcgggaactatgtgccccgggccgtccttgtcgacctggagcctggcacaatggactccgtgcgctccggcccatttggacagatatttcgtccagacaacttcgtcttcgggcagtctggcgctggcaacaattgggctaagggccattataccgagggcgctgagctggtagacgccgttttggatgtggtgagaaaagaggcagaatcctgtgactgcctgcaaggatttcagcttacacattcactgggcggaggcacgggctccggcatgggtaccttgctgatttccaagatccgcgaggaattccctgatagaattatgaatactttctcagtggtgccatctcccaaagtgtccgatactgtggttgagccctataacgccactcttagcgtgcaccaactggttgaaaatacagatgagacctattgtatagataacgaggctctatatgatatttgttttaggacgctaaaactgacaacccccacctatggggatctgaatcacctcgtcagcgcaacaatgtctggagtcaccacatgtctccggttccccggccagctgaacgccgatctgaggaaactagctgttaacatggtgccattccccagacttcactttttcatgccaggattcgcccctttgactagtcgaggttcccagcagtacagagctcttacagtgcctgagctgacccagcaaatgttcgacgcaaagaacatgatggccgcatgtgatccccggcatggcaggtatttgaccgtggccgcggtctttagggggcgcatgtctatgaaagaggtcgacgagcagatgttgtcagtccagtccaagaatagcagctacttcgtcgagtggattcctaataacgtcaagactgcagtctgcgatatcccaccgcgtggcctcaagatggccgccactttcatcggcaatagcacggctatacaggaacttttcaagagaatcagcgagcagttcacagccatgtttaggagaaaagctttcctgcattggtataccggagagggaatggacgagatggagtttacagaggcagagagcaacatgaatgatttagtctccgaataccagcagtatcaggatgccactgccgaagagggtgaattcgaggaagaagcggaggaggaagtggcttag

SEQ ID NO: 13979 - DNA, 1398 bp, Artificial Sequence
  Description of Artificial Sequence: Synthetic coding sequence
atggagcccagctctctcgagctccctgcagatacagtgcaacggatcgctgctgaactcaaatgccacccaactgatgagcgggtggccttacacctggatgaggaggacaagctccgacactttagggagtgcttctacattccgaagattcaggacttaccccctgtcgacctctctctggtcaacaaagatgaaaacgctatatactttttaggcaatagccttgggctccagcctaagatggtgaaaacatatctcgaggaggaactcgataaatgggccaaaatagccgcatacggccacgaggtggggaaacgcccatggattactggggatgaatccatcgtcggcctgatgaaagatatagtaggagccaacgaaaaagagatcgccttgatgaatgcgctgacagtgaatttgcatctcctgatgctgagcttcttcaaaccaaccccaaagcggtacaagatcttactggaggcaaaggcctttccgagcgatcattacgcaatcgagtcccagctgcagctgcacggcctgaacatcgaggagtccatgaggatgatcaaaccgagagaaggggaggagactctgcggatcgaggacatactcgaggtcatcgaaaaagagggtgatagcattgctgttattttgttcagtggggtgcatttctacaccgggcagcatttcaacatcccagccataaccaaagccggacaggctaaaggatgttacgtgggcttcgatctcgcccacgccgttggaaatgtggaactgtatcttcatgattggggtgtggactttgcctgctggtgctcttataaatacttgaatgctggggccggggggatcgcgggagcatttattcatgaaaaacacgcgcataccattaaacctgcattggtgggatggttcggacacgagttgtctacacggttcaaaatggacaacaagttgcagctaatcccgggcgtgtgtggtttccgcattagcaacccccctattctcctggtgtgctcgttgcacgctagcttggagatctttaaacaggctacaatgaaggcgctccgaaagaaaagcgtcctcctgacaggatacctggagtatcttatcaagcacaactacgggaaagataaagctgccaccaagaaacctgtggtaaatatcatcaccccttcgcatgtggaggaacgcggctgtcaattaaccattaccttctccgttcccaacaaggatgttttccaggagttggagaaacggggcgtcgtctgtgataagagaaatccaaacggaatcagggtggcccccgtccccctttacaacagtttccatgacgtgtataagttcacgaacctgctaacctctatcttggacagtgcagagacaaagaactag

SEQ ID NO: 13980 - DNA, 4758 bp, Artificial Sequence
  Description of Artificial Sequence: Synthetic coding sequence
atgaactctcagccacagaccagaagtccattttttcaacgcccccagattcagccaccgcgtgcgaccattccaaatagcagtccatccattaggcctggggctcagaccccaacagctgtgtaccaggccaaccagcacatcatgatggtgaatcacctgccaatgccgtaccccgtaccccagggccctcaatattgcataccccaatataggcacagtggccctccctacgtggggcccccccagcagtacccagttcagcccccaggacctggccccttttatccgggcccgggccctggagatttccccaacgcatatggaacgccattttacccctcacagccagtgtaccagagcgcacctataatcgtgcccacgcagcagcaacctcctccagctaagcgggagaagaagaccatcagaatccgcgaccctaatcaaggcggaaaagacataacagaggaaattatgtcaggtggaggctctcggaacccgacaccaccaatcggcaggcccaccagcaccccaacaccgccacagcaactaccctcccaagtgcccgagcatagccccgtggtctatggaacagttgagtcagcacaccttgctgcgtctacacctgtgacagctgcctctgaccagaagcaggaggagaagcccaaaccggatcctgtactcaaaagccccagtcctgtgctgcgcttagtgctaagcggcgagaagaaagaacaggagggacagacaagcgagactacagctatagtttcaattgcagaactccctctgccgcctagtccaaccacagttagtagcgtggcgcggagcactatcgctgccccaacatcgagtgcactgagctcccagccaattttcaccactgcgatcgacgataggtgtgaattaagtagccccagggaagatacaatccctatcccttctctcacttcgtgcaccgaaaccagcgacccactgcctaccaatgaaaatgacgacgatatctgcaagaaaccctgctcagtcgcacctaacgacattcccttggtgtctagcactaacctgattaatgaaataaacggtgtgtctgagaaactcagcgccaccgagtccattgtggagatcgtgaaacaggaggttctaccccttactctggaactggaaattcttgagaacccacctgaagagatgaaactggaatgcataccagcccccattacaccttccactgttccaagcttccctccaacccctcctactcctccagcaagcccaccgcacacccctgtgatcgtgcctgcggccgcaaccaccgtttcatccccatcagctgcgatcaccgttcaacgggtgctcgaagaggatgaaagcattagaacttgtctatccgaagacgccaaggagatccagaacaagatcgaagtggaagccgacggtcagaccgaggaaatcctcgactcacagaatttgaatagccgcaggagccccgtccccgcacaaatcgctatcaccgtgcccaagacatggaaaaagcccaaggaccgtacaagaactaccgaggaaatgctggaagctgaactcgaattaaaagccgaggaggagctgtcgattgacaaggtgttagagtctgaacaagacaaaatgtcccagggcttccatcctgagagagaccctagcgatcttaagaaggtgaaggccgtcgaggaaaatggtgaagaagctgagcctgtccggaacggggctgagtcagtgtctgagggcgaagggatcgacgcaaacagtggctctacagatagcagcggcgatggcgttacgttccccttcaagcccgaatcctggaaaccaaccgatacagaaggcaagaagcagtacgaccgtgagttcctcttagactttcagtttatgcctgcatgcattcagaagccggagggactgcctcctatttctgacgtggtgctcgataagattaatcagcctaagcttcctatgcgcaccttagacccgcggatcctgcctaggggtcctgactttactcccgcgtttgctgacttcggcagacagaccccaggaggaaggggggtgccactcttgaatgtgggatccaggcgctcacaacccgggcagaggagggaaccccgaaaaataatcacagtttcggttaaggaggacgttcatctgaagaaggccgaaaatgcttggaagccaagccagaaacgcgattcccaggccgatgatcctgaaaatatcaaaacccaagagctctttcgcaaggtgaggtctattttgaacaaacttacaccgcagatgttcaaccaactcatgaaacaggtgtcaggcttgaccgtggatacagaggaacgtttaaaaggagttatagacctcgtgttcgagaaggccatcgatgaaccttccttctctgtcgcgtacgctaacatgtgccgatgccttgtgacactgaaagtccctatggccgacaaacctggcaataccgtcaacttccgaaagctgctgcttaatcgctgccagaaggagttcgagaaagataaggcggatgacgatgttttcgagaagaagcaaaaggaactagaggcggctagcgccccagaagagcgcactagattacatgatgagttagaggaggctaaagacaaggccaggcggcgctccattggcaacatcaaatttatcggtgaactttttaaattgaagatgctgacagaagccatcatgcatgattgcgtcgtaaaactgctgaagaaccacgatgaggagagtcttgagtgtctttgcaggttgctgacaactataggtaaagatctggatttcgaaaaggccaagccccggatggaccagtactttaaccagatggagaagatcgtgaaagagagaaagacttcttcaaggatccggttcatgctgcaggatgttatcgaccttcggctttgcaactgggtcagtagacgagccgatcagggacccaagacaatagagcagatccacaaggaagcgaagatcgaagaacaagaggaacagaggaaagtgcagcagcttatgactaaagaaaagcgccgacctggggttcagagggtcgacgaaggaggttggaataccgtgcagggcgccaaaaacagccgcgtgctggatccgagcaagttcctgaagatcaccaagcccaccatcgacgagaagattcagttagtgccaaaggcccagttgggtagctggggtaagggttcaagcggcggtgccaaggcttctgaaaccgacgcactgcggagcagtgcgagctcactgaataggttttcagctctacagccccccgctccaagtggctctaccccttccactccggtggagtttgactctcggcgcaccctcacaagccgcgggtcaatgggacgggagaagaatgataagccgcttccctcagccactgcgcgcccaaatacctttatgcggggcgggtcatcaaaagacctcctcgacaaccagagccaggaagagcagagacgcgaaatgttagaaactgttaaacaactgacaggcggcgtggacgtcgaaaggaactcgaccgaggctgagagaaacaaaaccagggagtcagctaaacccgagatttccgcgatgagcgcacacgataaggccgccctgtctgaagaggagctggagaggaagtcgaagagcatcatagatgagttcctccatattaatgacttcaaggaggccatgcagtgcgtggaggaacttaacgcacaaggactactccacgtctttgttagagtgggtgttgagagcaccttggaacgttcccagatcacgcgcgatcacatgggccagctgttatatcagttggtgcaaagcgaaaagttatccaagcaggatttcttcaaggggttttccgaaacactggagctcgcggatgacatggcaatcgacattccgcacatctggctgtacctggctgaactggtgactcctatgctaaaggagggagggatctccatgcgggagcttaccattgagtttagcaaacctctgctgcccgtaggacgcgccggcgtgctcctatctgagatcctgcatttactctgtaagcagatgtctcataagaaggtgggcgccctgtggagagaagccgatctgagctggaaagatttcttgcccgaaggggaggacgtacataacttcctgctggagcagaaattggatttcatcgagtctgacagcccctgtagctctgaggcgctgagtaagaaggagttgagcgcggaagaactgtataaacggctggagaaactgattatcgaggataaagccaatgacgagcaaatcttcgattgggtggaggcgaatttggatgagattcaaatgtcatctccaaccttcctaagagcactaatgaccgcggtttgcaaggctgccattattgctgattcatcaacattccgcgtggatactgctgtcattaagcagagggtgccgatcctcctgaaatacctggattccgataccgagaaagagctgcaggcactgtatgcactacaggctagcattgtgaagctcgaccagccggccaacctattgcgaatgttttttgactgtctctacgatgaagaggtgatcagtgaagacgccttttacaagtgggagagctccaaggaccccgccgaacaaaatggcaagggcgtggccctcaaaagcgtgactgctttctttacttggttacgggaggctgaggaggaatcggaggataattag

SEQ ID NO: 13981 - DNA, 378 bp, Artificial Sequence
  Description of Artificial Sequence: Synthetic coding sequence
atggcaccggctaagaagggaggcgagaaaaaaaaagggcgaagcgcgataaatgaagtggtcacgcgcgagtatacaattaacattcataaaaggatccacggagttggttttaaaaaaagagcacccagggccctaaaagaaattaggaagtttgcaatgaaggaaatggggaccccggacgtgcggattgacacccggctgaataaagctgtttgggcaaaggggatcaggaacgttccctaccgaatccgcgtgaggttgtcgagaaaaaggaacgaggacgaggactctcctaacaagctttacacccttgtgacttatgtgccagtcacaacttttaagaacctgcagacggtcaatgtggacgaaaactag

SEQ ID NO: 13982 - DNA, 1590 bp, Artificial Sequence
  Description of Artificial Sequence: Synthetic coding sequence
atgctcgtcttgtttgaaaccagtgtgggttacgccatttttaaggttctcaatgagaaaaaacttcaggaggtcgattctttgtggaaggagtttgagactcccgaaaaggcaaacaagattgtcaagctgaagcacttcgagaaattccaagacacagccgaggcactggccgccttcacggctctgatggagggcaaaattaacaaacagctgaaaaaggtgctgaagaaaattgtgaaagaagctcatgagcccctcgcagtcgctgatgccaagttgggcggtgtgattaaagaaaaattaaacctcagttgcatccacagccctgttgttaatgaattaatgaggggcatccggtcgcagatggacgggctcatcccgggcgtggaacctagggagatggctgccatgtgcctcggtctggctcacagtctctcaagataccggctgaaattttccgctgataaggtcgataccatgatagtgcaggccattagcctgctggacgatctggataaggaactgaataattacataatgaggtgcagggagtggtatggctggcatttccccgaactgggtaagatcatctctgataatctgacgtactgcaaatgccttcagaaggtcggcgaccggaagaactacgcttctgccaagctgtctgagctgttgccagaggaagtcgaggccgaagtgaaagctgcagccgagatttctatgggcaccgaggtctctgaagaggacatctgtaatatcctgcatctgtgtacccaggttattgagatctctgaataccggacccagctgtatgaatatttacagaaccggatgatggcgatagcgcctaatgtcacggtcatggtcggtgaacttgtgggggccaggttgattgcacacgctggttccctcctcaatcttgccaagcacgccgccagcacagtgcagatactcggtgcggagaaagccctgtttcgcgctctgaagtcccgtcgagatactcccaagtacggcttgatctaccacgcctcacttgtggggcagacatcccccaagcacaaagggaaaatctcacgcatgctggctgccaagacagtgctcgccataagatacgacgccttcggggaggattcatcttccgccatgggcgtcgagaaccgagccaaactggaagccaggctgagaacccttgaagatcgaggcatcaggaagatctcggggaccggaaaggctttagcaaaaaccgagaagtatgaacacaaatctgaggtcaagacatacgacccatcaggcgattccacactgccaacctgttctaaaaaaaggaagatagaacaggtggataaggaggacgagatcacagaaaagaaagcgaagaaggccaagataaaggttaaagtggaggaagaagaagaagagaaggtggccgaggaagaagagacctctgtgaaaaaaaagaaaaagcgtggcaaaaagaagcatattaaggaagaacccttgtcagaagaggagccctgcacctcaaccgcaattgcctcgccagagaaaaaaaagaaaaagaaaaaaaagagagaaaatgaagactag

SEQ ID NO: 13983 - DNA, 738 bp, Artificial Sequence
  Description of Artificial Sequence: Synthetic coding sequence
atgaacggacgcgccgattttagggagcccaacgccgaagttccccggcctattccacatatcggccccgattatatccctactgaggaggagcgccgtgtcttcgctgaatgtaacgacgaaagtttttggtttcgttcagtgcccctggccgcgaccagcatgctaattactcagggccttatctcaaagggtatcctctcttctcatccaaagtatggatccattccaaaactcatccttgcttgcatcatgggctattttgccggcaagctgtcttacgtcaaaacttgccaagagaagttcaagaaactggagaattcccctctgggagaggccctgcggtccggccaggccagacgctcttccccaccagggcactattaccaaaagtcgaaatacgatagctccgtgtctggacagtcttctttcgtcaccagcccagcagccgataatattgagatgcttccccactacgaacctattcctttctcctcttctatgaacgagtccgctcccacgggcattacagaccatatagtacaggggcctgatccaaacctggaagaatcaccaaaacgcaagaatatcacatacgaggagctgaggaacaaaaatagagaaagctacgaggtcagcctgacacagaaaacagaccccagcgtacgaccaatgcacgagagggtgccaaagaaagaagtgaaagttaacaaatacggcgatacatgggacgagtag

SEQ ID NO: 13984 - DNA, 1746 bp, Artificial Sequence
  Description of Artificial Sequence: Synthetic coding sequence
atggaggatgttaactcaaatgtcaatgctgaccaggaagtgaggaaactgcaagaactcgtcaagaagcttgaaaaacagaacgaacagctacggtcaagatcaggggccgtccagggggccgggtctctgggccccggaagccccgtccgcgccggcgcctctattccatcttctggcgctgcttcaccaagaggatttccccttgggctgtccgccaagtcgggtggaggcccaggctccggcccaagaaggacatccagtgaggaactgcgtgacgcaacttctttgctggctgccggcgaggggggactactggacgaggtggagcccctgcgcccagatgaactcgagagactgagcggttgggaagaagaggaagagagctggttatatagcagtcccaaaaaaaagctgactcccatgcagaaatcagtttccccactggtgtggtgcagacaggtgctggactacccatcccctgacgtcgaatgcgccaaaaagtcactaatccataaattggaccagaccatgtcagcccttaagcgccagaacctgtataataatccgttcaatagcatgtcctatacgtccccttactcgccgaacgcatcctcaccttacagcagcgggttcaatagcccatcatctacccctgtgaggccacccatcgtcaagcagctgatactccccgggaactcagggaatttgaaatcatctgataggaatcctccactctcccctcagtcatcaatcgactctgaactgtccgcctccgagctggatgaggattctatagggtccaattataaactcaatgatgtcactgatgttcagattctcgccagaatgcaggaagagtcgttacgtcaagagtacgctgcgaccacaagcagaagatccagtgggtccagctgtaactcgacgcgccgcggcacctttagcgaccaggagttggatgcccagagcctggatgacgaagatgacaatatgcatcatgcagtttaccctgcagtgaaccggttctccccttccccaaggaatagccctcggccatccccgaagcaaagccccaggaactcaccacggagcagatccccagctcgtggtatcgagtattcccgcgtgagcccacagcccatgattagtagactgcagcaaccccggttgagtctccagggccaccctaccgatctgcagacatctaacgttaagaatgaagaaaaacttcgtcgatcattacccaatttatctagaacgtctaacacccaagtagattcagttaaaagttccaggtccgatagtaacttccaagtccccaatggcgggatacccagaatgcagccacaggcatcagcaattcctagccccggtaagtttcggtcccctgctgccccttcccctctggccttgcgccagcccgtgaaagcattctctaatcacggctccggctcgcccggctcccaagagatcactcaactgacccagacaacttccagccctgggccacccatggtgcagtcaaccgttagtgcaaaccctccatcgaacattaatagtgcgactcttacacgtccagccggtactaccgccatgcgatctgggctcccaagaccgagcgctcccagcgccggaggaatcccggtacctcggagtaagctggcgcagccggtgaggcgatctctgccagcaccaaaaacatacggttctatgaaggacgacagttggaaggatgggtgctactag

SEQ ID NO: 13985 - DNA, 3153 bp, Artificial Sequence
  Description of Artificial Sequence: Synthetic coding sequence
atgctgtgttgggggtactggtctctagggcagccagggatttccactaatttacaagggatcgtggctgagccacaggtatgcggattcatcagtgacagatctgtgaaagaagtcgcatgcgggggaaaccattctgtgttcctactggaggacggcgaagtttacacttgtggattgaacacgaaaggacagttgggccacgagcgggaaggaaacaagcctgaacagatcggcgccctagcagaccagcacataattcacgttgcatgcggtgagtcacatagcttggctctttctgatagaggtcagctcttttcttggggggcaggctctgacggccaacttgggctgatgaccaccgaagattcagtcgcagttcctcggctcatccagaaactcaaccaacagactatcctccaggtgtcttgcggcaactggcactgtctggccctagcagctgatggtcagttcttcacctggggtaaaaattcccatgggcagctgggccttgggaaggagttccccagtcaagcctccccccaaagagtccgttcgttggagggcatcccgctcgcccaagtcgcggctggcggagcacactctttcgctctaagcctatccggagcagtctttgggtgggggatgaacaacgctggtcagttagggctgtcagacgagaaggaccgcgagtctccatgccatgtgaagctcctgcgaacacagaaagtggtgtatattagctgtggcgaggagcataccgccgttcttacgaagtcaggaggggtgtttacgttcggcgcggggagctgtggccagcttggacacgactcgatgaacgatgaggtgaatcctaggcgcgtgcttgaactaatgggctccgaagttacacagattgcctgtggcaggcagcacacgctggcgtttgtgccatcttcagggctcatctatgcattcgggtgcggggcccgtggccaattggggactgggcacacatgcaatgtaaaatgcccctctcctgtaaaaggttattgggccgctcactctggccagctgtccgcaagagccgaccggtttaagtaccatattgtgaagcagatcttttccggaggggatcagacattcgtgctgtgttctaaatatgaaaactattcgccggccgttgattttcggacaatgaatcaagcgcactacacttccctaatcaatgacgaaacaatcgccgtgtggcgccaaaagctgagcgaacataataatgcaaatactatcaatggggtggtacagatcctgtccagtgcagcctgctggaacggaagttttctcgagaagaagatcgacgaacacttcaagacgtccccaaaaattccgggcatcgacctcaactccacacgggtccttttcgaaaaacttatgaattcccagcactctatgatcctagagcagatactgaactcattcgagagttgcttaatccctcagctatcttccagtccaccggacgtggaagccatgaggatctaccttattctgcctgagttccccctgctgcaggactccaagtattacattacactaacaatccccctcgctatggctatcctgaggctcgacactaatccctcgaaggtgttggataattggtggtcccaagtgtgccccaagtatttcatgaaactagttaatctgtacaaaggcgctgtgctgtacctcctaagaggccgcaagaccttcctcatccctgtgttgtttaacaactacattactgcggcccttaagctgttagagaagttatataaggtaaacctcaaagttaaacacgtagaatacgacacattttacattcccgagatctccaacctcgtggatatccaggaggattacctgatgtggtttctgcaccaggcgggaatgaaagccaggccttccattatccaagacacagttacattgtgttcctaccccttcattttcgatgctcaggcaaagaccaagatgctgcagacagacgcagagctgcagatgcaggtggccgtcaacggggcgaacctgcagaacgtattcatgctgctgaccctggaaccattgcttgctcgaagccccttcttggtgctccatgtacggagaaacaatctagtgggagatgcgctgagagaactgagcatccattcagacatcgatctgaagaagcccctgaaggttatattcgatggtgaagaggccgtggatgcgggtggggttaccaaagagtttttcctgctgctgctgaaggagctcctcaaccccatttatggtatgttcacctattaccaggatagtaacctgctctggttttctgatacatgcttcgtggaacataactggtttcatcttatcggaatcacctgcggtctggcaatctacaacagcacagtggtggacctgcatttcccgctggccttatataagaagctgctgaacgtgaagcctggcctggaagacctgaaagaacttagtcccaccgaagggcgcagcctccaagagttactggactacccaggagaggacgtcgaagaaacattctgtttaaactttacgatctgcagggagagctatggcgttatagaacaaaagaaattgattcccggcggagataatgtaaccgtctgcaaggacaataggcaggagttcgtcgatgcctatgtaaattatgtttttcagatatcggtacacgagtggtacacagctttcagctcaggatttctgaaggtttgcgggggaaaagtgctggagctgtttcagcctagtgaactacgtgctatgatggtaggaaactcaaactataattgggaggagctggaggagaccgcaatatataaaggggattactctgccactcatcctactgtcaaacttttctgggagacattccatgagttccccctggagaagaagaagaaattcttactgttcctgaccggctcggatagaataccaatctatggtatggcttccctgcagatcgtcatccagagtactgccagcggggaggaatatcttcccgtggcccatacctgctacaatctgctcgatcttcctaagtactccagcaaggagatcctgtctgcccgcctcacccaggcccttgacaactatgaagggttttcactcgcctag

SEQ ID NO: 13986 - DNA, 3069 bp, Artificial Sequence
  Description of Artificial Sequence: Synthetic coding sequence
atgtacttttgttggggtgccgactctcgggagctgcaaaggagaaggacggcaggcagccccggtgccgagctgttacaagctgcgagtggagagcgtcacagcctgttgttgctgacaaatcatagagtcctttcctgcggggataatagtcgaggccagctagggcggcgaggcgctcagaggggcgagctcccagagccgatacaagcccttgagaccctcatcgtcgatttggtctcatgtgggaaagaacattccctggcggtctgccataaaggtcgagttttcgcttggggggctggatctgagggtcagctcggcataggtgagttcaaagagatctccttcactcctaagaagatcatgacactgaacgacattaaaattattcaggtgtcctgcgggcactaccattctctcgccttgtctaaagactcccaggtattttcttggggaaagaattcccacgggcagttggggctcggaaaagagtttccgtctcaggcctccccacaaagggtaagaagcctcgagggcattcctttggcccaggtggctgcagggggcgcacacagcttcgctctcagcctctgcggcacatcttttggatgggggtccaactccgcaggacagttggctcttagtggacgcaacgtgccggtccaatccaacaagccactctccgtgggcgccctcaaaaatctgggggtggtctacatctcttgcggggatgctcacactgcagtactaacacaagacggcaaggtatttaccttcggagataacagaagcggccaacttgggtattccccaactcctgagaaacgcggccctcagctggtggagagaatcgatggtcttgtaagccagatcgattgcggaagctatcatactctggcctatgtgcataccactgggcaagtcgtctccttcggtcatggcccaagcgacacatcaaagcctacgcacccggaagcgttaactgagaattttgatatctcctgcctcatcagcgctgaagacttcgtagatgtgcaggtgaagcacatttttgcggggacgtacgctaacttcgttacgacccaccaagatacctcctcaactcgcgcaccagggaaaaccctcccagagatctcgaggatctcacagagcatggctgaaaagtggattgccgtcaaacgacgttccacagagcacgagatggctaagtctgaaatacgcatgatcttcagtagccctgcttgcctgacggcctcttttctgaagaaaagaggtactggtgagaccacttccatcgacgtggatctggagatggcgcgggacacttttaagaaattgactaaaaaggaatggatttcttcaatgatcacaacgtgtctggaggatgacctcctccgcgccctaccgtgtcattcgccccaccaggaagctttgagtgtgttcttgctgttaccagagtgtccagtgatgcacgatagtaagaactggaagaacctcgtggtgccatttgctaaggcggtgtgtgagatgagtaaacagtcactgcaggtgctgaagaagtgttgggcctttctccaggagtcctcgttgaaccccctgatacaaatgctgaaagccgctattatttctcaactgttgcaccaaactaaaaccgaacaagatcattgtaatgtcaaagctctgttgggtatgatgaaagagctccacaaggtcaataaggctaattgtcggttacctgaaaatacatttaatataaatgaactgtcaaacctcctgaacttttatatcgatcgcggccgccagctcttccgcgacaaccacttaatccccgccgagaccccatcccccgtgatcttttctgattttccctttatttttaattcgctctcgaagatcaagctcctgcaggcagactcgcacataaaaatgcagatgtcagagaagaaagcatacatgttgatgcacgaaacaattctgcagaaaaaagacgaatttccaccttctcctcggtttatcctgagggtgcgccggtctagactcgtcaaagacgctcttcgacagttatcgcaagccgaagccactgatttctgtaaagtattagtggtggagttcatcaatgagatttgtcccgaaagcggaggcgtcagcagcgagttctttcattgcatgtttgaggagatgactaagccggagtatgggatgtttatgtatcccgagatgggcagctgcatgtggttcccagcaaagcctaaacccgagaaaaagaggtattttctatttggcatgctctgtggacttagtctcttcaacttgaatgttgcaaacctgccattcccattggctctatataaaaagttgctagaccaaaaacccagcttagaggatctaaaggaactcagcccacgtttaggcaaatcgctgcaggaagtcctggacgacgcagctgatgacatcggcgatgctctatgcatcagattctcaattcattgggaccaaaatgacgtagatttgatccctaatggcatttctatccctgttgaccaaactaataaacgcgactacgtaagtaagtacattgactatattttcaatgtatctgtgaaagccgtgtacgaggaatttcagcgcggtttctacagagtatgcgaaaaggaaatcctcaggcatttctaccccgaagagctgatgacagcaattatcggaaacaccgactatgattggaagcagtttgaacagaactcaaaatacgagcaaggctatcagaaaagtcatcccactatccagcttttctggaaagctttccacaaacttacactggacgagaaaaagaaattcctgtttttcctcactggccgcgaccggctgcacgccagggggatccagaagatggagatagtctttcgctgcccagaaacgttttcagaaagagaccatccaacctccatcacctgtcacaacatcctctccttaccgaaatatagtacaatggaacgcatggaagaagcgctgcaggtcgccattaacaataaccgaggttttgtgtcgcccatgctgactcagtcttag

SEQ ID NO: 13987 - DNA, 1221 bp, Artificial Sequence
  Description of Artificial Sequence: Synthetic coding sequence
atggctgctgctgtgcggcaggacctggctcagctgatgaattcctctggcagccataaggacctcgcgggaaagtaccgacagatcctggagaaggctatacaactgtccggagcagaacagctagaggcgcttaaggcatttgtagaagcaatggtgaacgaaaacgtgtccctggtcatttcaaggcagctactcaccgacttttgtacccacctgcctaaccttcccgacagcaccgccaaggagatttaccacttcacgctcgagaaaattcagcctcgcgtgatatctttcgaagagcaagtggcttccatccgacaacatcttgcctcaatttatgaaaaggaggaggattggagaaacgccgctcaggtgttagtcggaatccccctggagaccggtcagaagcagtacaacgtcgattacaagttagaaacctacttgaagattgcccggttgtatcttgaggatgacgaccctgtacaggccgaggcctatatcaaccgcgcctcgctgctgcagaacgagtccactaacgagcagttacagatccattataaggtctgttatgcccgggtcctcgattataggcggaaattcattgaggcggcccaacgttacaatgagctatcatacaaaacgatcgtgcatgagtccgagagacttgaggcattaaaacatgcgttgcactgtaccattctggcaagcgccgggcagcaaagatcgcggatgctggcgaccctttttaaggatgaacggtgtcagcagctcgctgcttacggcatactggaaaaaatgtatctggataggatcatacgggggaatcagcttcaagaatttgcagccatgcttatgcctcaccagaaggctacaactgcagatgggagctcaatactggatcgagccgtgatcgaacacaacctgctatctgcctccaaactctacaacaacattacatttgaggaactcggcgccttactggaaataccggctgctaaggccgagaagatcgccagtcagatgataacagagggccgcatgaatggatttatcgatcagatagacggtattgtgcacttcgagacacgcgaggctttacctacctgggataagcagattcagtcgctgtgttttcaggtcaacaacctcctggaaaagatctcacaaactgcccctgagtggaccgcacaagcgatggaagcccagatggcacagtag

SEQ ID NO: 13988 - DNA, 1578 bp, Artificial Sequence
  Description of Artificial Sequence: Synthetic coding sequence
atggcagctggcctgctgggatccgaggatccaccttggtcttggaaccttacttgtcgcgccctgagaacatgccaggtgaggaatataagggtactgcaattgttgcttaaaccatggtgtatttccagagctgtgtatcagatgaccgaaggccgcagatgtcaagtgcatctgttggatgatcgcaagctcgagctgctcgtccagccgaagctcttagccaaggagctgctggatctcgtggccagtcatttcaatttgaaggagaaggaatattttgggatcgcttttaccgacgagacaggccatctgaactggttgcagctcgatcgcagagttctcgagcatgattttccaaagaaaagcggaccggttgtgctgtacttttgtgtgaggttctacattgagagtatcagctacctgaaagataacgcaacgatagagttatttttcttaaacgcaaaatcttgtatctataaggaacttattgacgtggacagcgaggtggtgtttgagctggccagctatatactccaggaggccaagggagatttcagtagtaacgaggtggtgagatctgatctgaagaaactgccagcactgcctacccaagctctgaaagaacacccatccttagcgtattgcgaagacagggtcattgagcattacaagaagcttaacggccagacgaggggccaggccattgtgaattacatgagcattgtcgagtcgctgccaacctatggtgtacactactacgccgtgaaggataaacagggaatcccttggtggctcggtctaagttacaagggcatctttcagtatgattaccatgacaaggttaagccaaggaagatcttccagtggaggcagctagaaaacttgtacttcagggagaagaaattctctgtagaagtccatgacccacggcgcgctagcgtcacgagacgcactttcggtcacagtggtattgcagtgcacacatggtacgcctgccccgcactgatcaagagcatctgggccatggctatttcccagcatcagttttatttggacagaaaacaatcgaaatctaaaatacacgccgcaaggagcctctcagagatcgctatcgatctgactgagacgggcacacttaagacttctaagctagccaatatgggttccaaaggcaaaatcatctcaggctctagtggatccctcctgagctccggctcacaggaaagtgacagttcccagtcagccaaaaaggatatgcttgcagcactcaagagtcgccaggaagccctggaagagaccctgcgacagcgtctcgaggaactgaagaaactgtgcctgcgtgaagccgaactgactgggaaacttccagttgaatatcccttagaccccggcgaagaaccccctatcgtaaggcggcgcatcggaacagccttcaagctagatgaacagaagatcctgccaaaaggcgaggaagccgaactggagcggctagagcgagagttcgccatccagagtcaaattaccgaagcagctaggcgtttggcctccgatcccaacgtatccaaaaaactgtag

SEQ ID NO: 13989 - DNA, 1605 bp, Artificial Sequence
  Description of Artificial Sequence: Synthetic coding sequence
atgaaacaggagggtagcgctcgaaggagaggcgccgacaaggcaaaacctcccccgggagggggggagcaggagccacctcctccacccgccccgcaagacgtcgaaatgaaagaagaagccgcaactgggggtggttccacaggagaggccgacggaaaaacggctgcagccgcagccgaacattcccagcgggagcttgataccgtgaccctggaggacataaaggagcacgttaaacagcttgagaaggccgtctccggtaaggaacctcgcttcgttctgagagccctaaggatgctacctagtaccagcagaaggcttaaccattacgtgctgtataaagccgtccagggattctttaccagcaacaatgcaactcgcgacttcctgctccccttcctcgaggagccaatggacacggaggctgacctccagtttaggccaagaacaggcaaagccgcctctacccctctgctgcccgaagtggaagcctacctgcagctcctggtggtcatatttatgatgaatagtaagaggtacaaggaagctcaaaagatttctgatgaccttatgcagaagattagtacccagaatcgacgtgctttggaccttgtagccgctaaatgctattactaccacgcacgtgtatacgaattcttagacaagctggacgtcgtacggagcttccttcacgccaggctgcgaactgccacactgcgacacgatgcggatggccaagccactcttctgaacttgctgctgcgaaactacctgcactactcactttacgaccaagccgaaaagcttgtgagcaaaagcgtgttccccgagcaggcaaataacaacgagtgggcacggtacctgtactatactggccgcatcaaggctatccagctcgagtatagtgaggcacggaggacaatgaccaacgccctccgtaaagcaccccagcataccgctgtgggattcaaacagactgtgcacaaactactgatagttgttgagctcttattaggagagattcccgacagactgcagtttcgtcaaccaagcctgaaacgatcgctgatgccctacttccttttgactcaggcggtacgcaccggaaatctggccaaatttaaccaagtcctagaccagttcggggagaaattccaggctgatggtacctatacattgattatccgccttagacacaatgtcattaagactggggtgcgcatgatttctttaagttattccaggatcagtctggccgatatagcacagaaactgcaactcgattcacccgaggacgccgaattcatcgttgccaaagcgatcagggatggcgtaattgaggcaagtatcaatcatgagaagggctatgtgcaaagtaaagaaatgattgatatttacagcactcgcgagccccagcttgcatttcaccagcgtatctcattttgtctggatatccacaatatgtccgtcaaggcgatgaggtttccccctaaatcctataataaggacttggagagcgctgaagaacgccgcgagagagaacagcaggatctggaattcgctaaagagatggcagaggacgatgacgattctttcccctag

SEQ ID NO: 13990 - DNA, 1311 bp, Artificial Sequence
  Description of Artificial Sequence: Synthetic coding sequence
atgcgacgcgacgtgaacggtgttaccaagagccggtttgaaatgtttagcaattccgacgaagccgtgataaataagaagctgcccaaggaactgctgctgcggatcttttctttcctagatgtggtaacgctgtgtagatgtgcccaggtaagcagagcctggaacgtgcttgcactcgatggctcaaattggcaaaggatcgatctctttgactttcaacgggacattgaagggagagtcgttgagaacatctccaagcggtgcggggggttcctgcgcaaactgagtctgagagggtgcttaggcgtgggcgataatgcactgcgcaccttcgctcagaactgtcgcaacatcgaagtcctcaatttgaatggctgtacgaaaactacagacgctacctgtacctccttatcgaagttctgcagtaaactgaggcacttagatctcgccagttgcactagcattacgaatatgagtctaaaagcccttagtgaagggtgtcctctgctggagcaattgaacatctcctggtgcgaccaggtgactaaggatgggatccaagccctggtgcgaggatgcggtggattaaaagctctctttctgaaagggtgcacacagcttgaagatgaagcccttaagtatatcggcgcccattgtccagaattagtcactcttaatctgcagacgtgtctccagatcactgacgaaggactgattactatttgtcgaggctgtcacaagcttcaaagcctctgcgcttccgggtgcagcaacataacggatgcaatcctcaatgcactaggccagaactgtccgcggttgagaattctcgaagtggctagatgctctcagctaaccgatgtgggcttcaccacactggcgcggaattgtcacgaactggaaaaaatggatttagaagaatgtgtgcagatcaccgactccaccctcattcagctgtctatccattgccctcggttacaggttctgtctttgagccattgcgagctgataacagatgatgggattcggcatcttgggaatggggcatgtgcacacgaccaacttgaggtcatcgagctggataactgtcccctgataacagacgcctctcttgaacatttaaaaagttgtcattcactggaacggattgaactatacgactgtcagcaaatcacccgcgccggcattaagcgactccgcacccacctgcctaatatcaaagtacacgcctatttcgcgccagtaacgccacctccatcagtcggcggtagccggcagcgcttctgtagatgctgtattattctgtag

SEQ ID NO: 13991 - DNA, 1167 bp, Artificial Sequence
  Description of Artificial Sequence: Synthetic coding sequence
atgcggtgcctctacggtcgagtggggggcgcccggcggaaaatggccgcaagtgctgcagccgcagagcttcaggcctccgggggccccagacaccctgtgtgcctgctcgttcttggcatggctggtagtggtaaaaccacctttgtgcagaggttgacaggccatctccatgcacagggcacgccgccttacgtgatcaatttagacccagctgttcatgaggtaccctttcccgccaatattgacatccgggatactgtcaagtataaggaggtaatgaagcagtacggactcggccccaatggcggcatagtcaccagcctgaatctgtttgcaacgcgattcgatcaggtgatgaagtttatagagaaggcacagaatatgtctaagtatgtcctgatcgatacccccggacagattgaagttttcacatggtctgccagtggcacgatcattacagaggccctggcatctagtttccctaccgttgtgatctatgtgatggatacatctaggtccacaaatcctgtgacattcatgtccaatatgctgtatgcttgttctatactctataaaacgaaactaccatttatcgtggtcatgaataagactgatataattgaccactcatttgctgtagagtggatgcaggatttcgaagccttccaagatgccctaaatcaagagactacatacgtgtccaacctgacaagatcaatgagtctcgtgctcgatgagttctactcgtcacttagagtggtgggcgtgagcgccgtccttggcacggggctggacgagctgttcgtgcaggtgacatctgctgctgaagagtatgaacgcgaatacaggccagaatacgagcgacttaaaaaaagcctggccaatgcagagtcccagcagcaacgcgagcaactagaacgactcagaaaagatatgggctcggtggctctggacgctggcacggccaaggactccttgtcacccgtcttgcatcctagcgacttgatcttgacccggggcacattggatgaagaagacgaggaagctgacagtgataccgacgatattgaccaccgggtcactgaggagagccacgaggagccagccttccagaacttcatgcaagagtcaatggcacaatactggaaacgtaacaacaaatag

SEQ ID NO: 13992 - DNA, 1668 bp, Artificial Sequence
  Description of Artificial Sequence: Synthetic coding sequence
atgagactgattggaatgccaaaggagaaatacgatccccctgatccacgcagaatctatacgatcatgagcgccgaggaggtggccaacggtaaaaagagccattgggccgagttggaaatcagcgggagagtgcgatccctctcaacttctctctggagcctcacccatctgacagcattgcacctgaacgataattacctgtccagaattccgccggatatcgcgaaactccacaatctagtctatctggacttgtcttctaacaaactgaggagccttccggctgagctcgggaatatggtgagcctgagagaactgttgctcaacaacaatctcctccgagttctaccctatgagctcggaaggttatttcaactgcagacactgggactgaaaggcaacccattgagccaggacatcctgaacctgtaccaagacccagacgggactcggaagcttctcaattttatgctggacaatctcgcagtgcatcctgagcagttgcccccgcggccatggatcacactgaaggaaagggaccagatcttacctagcgcctcatttaccgtgatgtgctataacgttctctgcgataagtacgctacccggcagctgtacggttactgtccttcctgggccttaaattgggagtaccgtaaaaagggtattatggaggaaatcgtgaactgcgacgccgatataatttccttacaggaggtggagacagagcagtattttaccctcttccttcccgctctgaaggaacgggggtacgacggctttttctcccccaagtcacgggcaaagatcatgagcgaacaggaacggaagcatgtggatggctgcgcgatcttttttaagactgaaaagttcacactcgttcagaaacatactgtcgaattcaaccaagtagcaatggccaacagcgacggctctgaggctatgctgaatagggtaatgacaaaggataacatcggagtcgctgtagtactggaagtccataaagaactatttggagctggcatgaagccgattcatgcagcggataagcagctgctcattgtggctaacgctcatatgcattgggatcctgagtactccgacgtcaaacttatccagactatgatgttcgtttctgaagtgaagaacatattggaaaaggcctctagtcgccccggctcccctaccgccgatcctaacagcattccattggttctctgtgccgatcttaatagccttccggacagcggggtcgtagaatacctctctaacgggggcgtagccgataaccacaaagactttaaagaactgcggtataacgagtgtctgatgaatttcagttgtaacggaaagaatgggtccagtgaggggaggatcacgcacgggttccagttgaagtctgcctatgaaaacaatctgatgccttacaccaattataccttcgatttcaaaggcgtgattgactacatcttctacagcaagacgcacatgaatgtgctcggggttcttgggccactggaccctcaatggttggtggagaataatatcaccggctgcccacaccctcacataccatctgaccatttcagtctgctcacacagttggagctgcaccctccactgctgccattggtaaacggggtgcatctccctaaccgccgctag

SEQ ID NO: 13993 - DNA, 2673 bp, Artificial Sequence
  Description of Artificial Sequence: Synthetic coding sequence
tcatcggactcagaaatcattggctacgctttggacacactttacaacattatttcaaacgaagaagaggaggaggtggaagagaactccacgcgacagagtgaggatctgggatcgcagttcactgagatctttattaaacagcaggagaacgtgacattgctcttgagtctgctggaggagttcgacttccatgtgaggtggcctggtgtaaaattgctaacttccttactgaaacagcttggcccacaggtccagcaaattatcctcgtcagtccaatgggggtatcaagactgatggatttgcttgccgatagcagagaggtgatcagaaacgacggagtactgcttcttcaggctctcaccagatctaacggggcaatccagaagatcgtggcgttcgaaaatgctttcgaacgcttgctcgacataatctctgaggagggaaattcggacggcgggattgtagtagaggattgcctgattctgcttcaaaatctgctgaaaaacaataactcaaatcagaattttttcaaggaaggtagctatatacaacgtatgaaaccatggttcgaagttggggacgaaaattcaggttggtccgcacaaaaggttaccaatctccatctcatgctgcagctcgttcgcgtgctggtatcacccacaaatccacccggtgcaacctcttcatgccagaaggccatgttccagtgcggcctcctccagcaactctgcacaatactgatggccacaggagttcctgccgacatcttaacagaaactattaatacagtgagcgaggtgattcgcggatgtcaagtgaatcaggactattttgcctcagttaatgcaccctccaacccaccaaggccagcaatcgtagtcctacttatgtcaatggtgaacgagcggcagcccttcgttctgcgctgtgctgtactgtactgtttccagtgcttcctctataaaaaccagaaaggccagggcgagattgtcagcacactgcttccgtccactattgatgcaaccgggaatagcgtcagcgctgggcaactgttgtgcgggggcctcttttccaccgattccttaagtaactggtgcgccgctgtggcactggcccatgcattgcaagaaaatgccacccagaaggaacagctgcttagagtgcaactggcaaccagtattggcaacccacctgtatccttgctgcaacagtgcacaaacattctctcacagggcagcaagatccagacacgggtgggcctgctgatgctgctgtgcacctggctgagcaactgcccgatcgctgttacccacttcctccataattctgctaacgtcccgttccttacaggacagatcgcggagaatcttggagaggaggaacagctcgtccaaggactgtgcgctcttctgctgggtatctctatctatttcaacgataattccctggagtcgtacatgaaggagaaactgaagcaactgattgaaaaaaggattgggaaggagaatttcattgaaaagcttggatttatttccaaacatgaactttactccagagcctctcagaaaccgcaaccgaattttccaagccccgagtacatgatctttgatcatgagttcaccaaactcgtcaaggagctggagggcgtgatcaccaaggcaatttacaagtccagtgaggaagataagaaggaagaggaggtaaagaagacccttgagcagcacgacaatatcgtcacacattacaagaatatgatacgcgaacaggatctgcagctggaggagttgagacagcaggtgagcactttgaagtgtcagaacgagcagcttcagaccgctgtcacccagcaagtcagtcagatccagcagcacaaagatcagtacaacctgctcaagattcagctcgggaaagataatcagcatcagggctcctacagcgaaggcgcacaaatgaatgggatacagccagaagagatcggacgactccgtgaggagatagaagaactgaagcgcaatcaagaactgctgcaatcacaactgactgagaaggattctatgatcgagaacatgaaaagtagtcaaaccagcgggacaaatgagcagtccagtgcgatagtcagtgcacgcgattccgagcaggtggccgagttaaaacaggaactggcaacgttaaagagtcaactcaactcacagtcagtggagatcacaaaattacagaccgagaagcaggagctgttgcagaaaacagaggccttcgccaaaagcgtcgaagtccagggggagacagagacgatcatcgctactaaaacaactgacgtcgaaggccgactcagtgcactgctgcaggagacaaaggagctgaagaatgagatcaaagcgctatccgaagagcggaccgccattaaagagcagttggactccagcaacagtaccatagcgatcttgcagacagagaaggataagttggagctcgagattactgactccaagaaagagcaggatgatctcttggtgctcctggcagaccaggatcagaaaattctttctctaaagaataaactcaaagatctggggcaccccgtggaggaggaagacgagctggagagcggtgatcaggaggacgaagacgacgaatcagaggacccaggcaaagatttggaccatatttag

SEQ ID NO: 13994 - DNA, 1944 bp, Artificial Sequence
  Description of Artificial Sequence: Synthetic coding sequence
atggcccgtgctgggccacggttagtcctgtctgaagaagcggtacgggcaaagagtggtctgggtcctcaccgcgatcttgctgagctgcaaagcctgagcatacctggaacatatcaggagaagataacgcatctcgggcactccttgatgtccctcaccggcttaaagtcacttgacctctcccggaactcgctggtttccttggaggggattcagtatcttacagccctggaatccctgaacctttattacaattgcatttcttcactggcagaagtatttaggctgcacgctctgacggagcttgtcgatgtggacttccggctcaatcctgtagtgaaagtggaacctgactacaggttgttcgtggtgcatctgctcccgaagctgcaacagctcgatgatagaccagtcagagcaagtgagaggaaggctagccggctgcatttcgcttccgaagatagtctggactctaaggagagtgtgcctgcgagcttaaaagaggggcggccccatcacccccgagccaaatgtacggaggctctcgcaaagcagtctttggtgatggacgccgatgatgaggccgtcctcaacctgatcgccgaatgcgagtgggacctgggcagacccccgggatccacttcattttctcagaaaggacgtgaagctgatagcaggggatcccaggagtccagacatttgctctccccacagcttgtacaataccagtgcggggactccggaaagcaggggagagagacaagacggtcctcctgcaggggctgttgtctggaaaaaatgccttggagccagttatgtggcgagcttcccccactgtacggcgctgaaccggaagctagccgcgcccctcggccccacacatattttaccccccatcccgactctatggacacagaggattctgccagctctcagaagctcgacctgagcggtgagatggtgcccggcccccttccagctcccggaaagtgcaggaagaggagaatgcccgtggggaggttccaaacattcagtgaccaggagggattaggctgtcctgagcgaacgcatggtagctcagttcccaaggagagccttagcagacaggactcctccgagagccggaatggcagaactttgtcccagcctgaggcaagcgaaacggaagagcagaggagtaggggggtcaccgatactcgcgaaccgagtccaggaagccacagcgccctgcccggtaaaaagacagcgctgcaggctgcattactggaaaccttgctggacctggtcgataggagttggggtgggtgccgtagcttgcacagcaatgaggcattccttgcacaggcccgacacatactgagtagtgtcgaggagtttacggcagcccaggattccagcgccatggtgggcgaagacgtgggcagtttagcgctggagagcaaatcgcttcagagtagactggctgagcagcagcagcagcatgcacgcgaaatgtcagaggtgaccgccgagttgcatcatacccataaggagctcgacgatttacggcaacacctggacaaatccctagaagagaactcacgccttaaatccctactgctctcaatgaagaaagaggtgaaaagtgcagacaccgcagcgacccttaatcttcaaatcgcagggttacagacctccgtgaaaagactgtgcggagagatcgtggaactcaagcagcacttggaacactacgacaagatccaggagctcacgcaaatgctccaggagtctcattctagcctcgtctcaaccaatgagcaccttttgcaggagttgtcccaggtccgggcccaacatagggctgaggtggagcagatgcattggagttaccaggagctgaagaaaaccatggcactcttcccccacagtagtgcttctcacggcggctgtcaggcctgttag

SEQ ID NO: 13995 - DNA, 777 bp, Artificial Sequence
  Description of Artificial Sequence: Synthetic coding sequence
atggccgagacagaagagagatctcttgataattttttcgccaaacgtgataaaaagaagaagaaggaacgctccaatcgggccgcaagcgccgctggcgctgcagggagcgcagggggctccagcggcgccgccggcgcggctggggggggcgccggggcagggacaaggcccggcgacggaggaactgcctccgccggggccgctggacctggggccgcgaccaaagctgtaaccaaggatgaagatgagtggaaggagctggagcagaaagaggtggactactccggattacgagtgcaggctatgcagatatcaagcgagaaggaggaagatgacaatgagaagcggcaggatccaggggacaactgggaggagggaggagggggcggagggggcatggagaaaagcagtgggccctggaataaaactgctcctgtacaagcacctcctgctcctgtgatagtgaccgaaacccctgaaccggctatgacgagcggtgtatataggcctccgggggcgcgccttacgacaacacgcaagacccctcagggacccccagagatctactcggatacacagttcccaagtttgcagagtaccgcaaagcacgtcgaaagtcgaaaagacaaagagatggagaagagtttcgaggtagtcagacacaaaaaccgaggtcgtgatgaagtgagtaagaaccaggcactgaaactacaacttgacaatcagtatgcagtcctcgagaatcagaagtccagccacagtcagtataactag

SEQ ID NO: 13996 - DNA, 1077 bp, Artificial Sequence
  Description of Artificial Sequence: Synthetic coding sequence
atggcccctcaaaacctgagcacattttgcctactgttgctctacctgattggcgcggtgatcgctggtcgtgatttctacaagatcctgggagtgccccgcagcgcatctataaaggatattaagaaggcttatagaaaattagctctccaattacacccagatcgcaaccctgacgatccgcaggcacaagagaagttccaggatttgggagcagcctatgaggtgctgtccgattccgagaaacgcaagcagtacgacacgtatggagaagaaggcctgaaggatggccatcagagctcacacggcgatatattctcacatttcttcggtgattttgggtttatgtttgggggaactcctcggcagcaagataggaatataccacgggggtccgacataattgtggatcttgaagtgacactagaagaagtgtacgccggaaactttgtcgaagtggtgaggaacaagccagtggctagacaggccccgggtaagagaaagtgtaattgccgccaggaaatgcgtacaacacagctgggcccgggacgcttccagatgacgcaagaagttgtttgtgacgaatgccctaatgtgaaactcgtcaatgaggagcggactctcgaggtcgagatcgagcccggcgtccgagatgggatggagtaccccttcatcggggagggcgagccccacgtcgacggcgagcctggcgatctgcgctttcgcataaaggtcgtcaaacaccctatctttgaacgccgcggcgacgacctgtataccaatgttacaattagcttggtggagagtcttgtaggcttcgagatggatattactcatctggacgggcacaaagtccacatatcacgagataaaataacccgccctggcgccaagctttggaaaaaaggcgagggtctcccaaacttcgacaataacaatattaaaggcagcttgattatcacgttcgatgttgatttccccaaagagcaactgacagaagaagcgcgcgaaggcattaaacagttgctaaagcagggtagcgtgcagaaagtttacaatggcctgcaggggtactag

SEQ ID NO: 13997 - DNA, 624 bp, Artificial Sequence
  Description of Artificial Sequence: Synthetic coding sequence
atgacatcacgcaaaaaagtcctgttgaaagtgattattttgggggacagcggtgtggggaagacctctctcatgaatcagtacgtcaacaagaaattctccaatcagtacaaagcgactattggcgccgactttctcacgaaggaagtgatggtcgatgaccgcctcgtcaccatgcagatctgggacactgctggacaagaacgatttcaaagccttggtgtagcattttatcgcggcgccgattgttgcgtcttagtgttcgacgttacggctcccaacacctttaagactttggacagctggagggacgaatttctaatccaggcttctccgcgtgatccggaaaattttccttttgtcgttctgggaaataagatcgacctggagaacaggcaggtcgctaccaaacgggcccaggcctggtgttactcaaaaaacaacatcccttatttcgaaacgtcagcaaaagaggccatcaatgtggaacaggctttccagaccatcgccaggaacgccttaaagcaggaaaccgaagtggagctctacaatgagttcccggagcccatcaagctggataaaaacgatagagccaaagcctcagccgagagctgtagctgctag

SEQ ID NO: 13998 - DNA, 3225 bp, Artificial Sequence
  Description of Artificial Sequence: Synthetic coding sequence
atgatacctatctgcccagtggtatccttcacatatgtgccgtcacgcctgggcgaagacgccaagatggccacaggcaactatttcgggtttactcatagcggagcagctgcggccgccgccgctgcccaatactcacagcaacccgctagtggagtggcttattcgcacccaactactgtggccagttacactgtccaccaggcccccgtcgctgcccacacagtgaccgccgcgtatgcccccgctgccgcaacggtggctgtggcaagaccagcccccgtggccgtggccgcagccgccacagcagccgcctatggcggctatccgactgctcatacagctacggattacggttacacacagcgacagcaggaggctccacctccccctcccccagccactacccaaaactatcaagactcttattcctatgtgcgttctaccgcccctgccgtggcctatgactctaagcagtattatcagcaacccacagctaccgcggccgctgtggcagctgctgctcagcctcagccctctgtcgctgagacttattaccagactgcgcccaaagccggctatagccaaggcgcaacccagtatactcaggcacaacagactaggcaggttacagccattaagcctgcaaccccctctcctgccacaactacattcagcatctaccccgtgtcttcaaccgtccagccagtggcagccgccgccaccgtggttcccagctacacacagtcagccacatatagtaccacagctgtgacttatagcggcacctcatactccggatatgaggccgcggtgtacagcgccgcgagctcttactatcagcagcagcagcagcagcagaagcaagcagccgcagcagctgccgccgctgcagccaccgccgcatggacaggtacaacttttacaaaaaaagctcccttccagaacaagcagctaaagccgaagcagcctccaaaaccccctcagatccattactgtgatgtgtgcaaaatttcatgtgccggaccacagacctataaagagcatctcgagggccagaaacataaaaagaaagaggcagcactcaaagcttcccagaacacatcttccagcaactcatcaaccaggggaacgcagaatcaactgaggtgtgaactatgtgacgtttcttgtaccggtgctgatgcttacgccgcccacatcagaggggccaagcatcaaaaagtagttaagctgcacacaaagttgggtaagcccatcccctcgactgaacctaacgtagtatcccaagccacctcctctactgccgtctccgcgtctaaacctaccgctagtccctcttcaattgcagccaacaactgcactgtcaacactagttccgtggctaccagcagtatgaagggcctgaccaccaccggtaacagcagtctgaactctacaagtaatactaaggtctcagcagtgcctacaaatatggctgctaaaaaaacctctacacctaagattaacttcgtaggaggaaataaactccagtcaacagggaataaagctgaggatatcaaaggaaccgaatgcgtaaagtctacccctgtgacctctgctgtgcagattcccgaggtgaagcaggacacagtatccgaaccagtgacacccgcttctctggcagcactccagagcgatgtgcagcctgtaggtcacgattatgtagaggaggtcaggaatgatgagggcaaggtcatcagattccactgtaaactgtgtgaatgcagcttcaacgacccaaacgcgaaagaaatgcacctgaagggaagaagacatcgcttgcagtataagaaaaaagtcaaccctgaccttcaggtagaagtgaagcctagtattagggcgagaaagatacaggaagagaagatgaggaaacagatgcaaaaggaggaatactggaggcgtagggaagaggaagaacgatggcggatggaaatgagacgatatgaagaagatatgtactggcgaagaatggaagaggagcaacaccactgggatgacaggcggcggatgccagacggcggatacccccacggtcccccaggccccttggggttgctgggagtgcgtcccgggatgccccctcagcctcagggtccggcaccacttcgcaggccagactctagcgatgataggtatgttatgacaaaacacgctacaatctatccaactgaagaagaactccaagcggtgcagaaaattgttagcatcactgagagggcccttaaattggtttcagacagtctgtcagaacatgaaaagaacaaaaataaagaaggagacgacaagaaggagggggggaaggaccgggccctcaaaggtgtcttgagggtgggtgtgcttgccaaagggcttcttctccggggtgaccgtaacgtcaatctggtgctgctgtgttctgagaagccctcaaaaactcttctctctagaattgccgagaacctgccaaagcagctcgctgtgatttcacccgagaagtacgatattaaatgtgctgtaagcgaggccgctatcatccttaacagttgcgtagagcccaagatgcaggtaaccatcactctgacctccccaatcatccgcgaagaaaacatgcgcgagggggatgtgactagcggcatggtcaaagaccctcccgacgtcctcgaccggcagaagtgtctggatgctctggcggcactgcggcacgctaaatggttccaggctagagccaatggacttcagtcctgtgtgatcataattcgcattctcagagatctgtgtcaacgcgtccctacttggtccgactttccttcctgggctatggagttacttgtggaaaaggctattagctccgcgagctcgccacagtcaccaggggatgcattgcgacgcgtgtttgaatgtattagctctggaatcattcttaagggatctcctgggctccttgatccttgcgaaaaggaccccttcgacacattggcgacaatgactgaccaacagcgggaagatatcacttcctcagcccagtttgcgctccggcttttggcttttcgacagattcacaaagtgcttggcatggatcctctgccccagatgagtcagcgctttaacattcataacaacagaaagcggcgacgcgactctgatggggtcgatggcttcgaagccgaggggaaaaaagataagaaggactacgacaatttttag

SEQ ID NO: 13999 - DNA, 438 bp, Artificial Sequence
  Description of Artificial Sequence: Synthetic coding sequence
atgaagttcaacccctttgtcacttccgatagatcaaagaataggaagcggcactttaacgcgcctagtcacgtgcggcggaagataatgagctcaccgctgtcaaaggaactcagacaaaaatacaacgtgagaagcatgcctattcgaaaggacgacgaggtgcaggtggtaagagggcactacaagggccagcagatcggtaaggtcgtacaggtgtacagaaagaagtacgtcatctatatagagagggttcagagagagaaggccaacggcaccactgtccatgtcggaatccaccctagtaaagttgtcattacgaggctgaaattggacaaagatcgcaaaaagatactggagagaaaagccaagtcccgccaggtcggaaaggagaaaggcaagtataaggaagagctcatagagaaaatgcaggaatag

SEQ ID NO: 14000 - DNA, 3177 bp, Artificial Sequence
  Description of Artificial Sequence: Synthetic coding sequence
atggaggacggaacgcctaagcacatcattcagatgactgggtttaaaatggaggagaaagaagcactggttaaactcttgctgaagctagattgcacgttcatcaagtctgaaaagtataagaactgcacacacttgatcgccgagcggctttgtaaatcagagaaatttctggctgcatgtgccgccggtaagtggatcctcaccaaagactatatcattcactcagccaagagtggacgttggctggatgagaccacttatgaatggggctataaaattgagaaggactcaagatattcgccacagatgcaaagcgcccctaaaagatggcgcgaggaactgaagcgtactggggcgcccggagccttccaccgctggaaagtggtcttactcgtgcgcaccgacaagaggagcgatagcctgattcgtgtgctggaagctgggaaagcaaacgttattctgcctaaatcttccccttctggcataacacacgttatcgccagcaatgcaaggatcaaggccgaaaaagaaaaagacaatttcaaagctccattctatcccatccagtacttgggcgacttcctgctagagaaagagattcagaatgacgaggatagccagacaaacagcgtttggacggagcacagtaatgaggaaaccaacaaggactttcgcaaggatgccggattcctggagatgaagggagcactccgcgaaactatgtatcgtactcagaaagaaatgcagaatcacgaggacgttaacgttgggtcaatcttgattcagcaccacaaaaaagagaaattctctggttcatccaaggacctcaaatttgtaaaaatgcggaatactttcgggtcacacacttacgaaaaccagaaagagatcaagaaaaaagacgaggacatccagcggagctatacactcagaaggaaacgcaaaaaaggaaaagagagcaactgtaagaagggagttgagcacgaaaagataaagtcaacactccggaggcatatatataaccgggaccagaaggaaatgaaaaacagtatattcgctgagtatgcgaaggaaagcaaggccatggccattaagaccgacgtggacgtcgtggaaataaagaacaccctgagaaagcatatctacagagcacaggccgttcgctataactgcatccgcattgacaagcaaccggtgtataacgtggaggtgaaaaacgccgaattcccacgcggggtcctcaaccttattgagagtctgattgaaggccatttcttcaaagaggcaatcgaggagctgtccacactccaagcacattacatcccccctgtatgcgttctgcatgctctgttagagaatgttcttcaggataacatagatacattttcaggcagatacttccatatcctctcagctttgttacacttgcatccaccatggaagtcaccggcaatgtcccggtactatctcgaattattccagtgtccaacctgtatgaaaggcgcttggagtctcgtcgaggtgcttatcaggagctgcttgttcaacgaaagcttttgccatcagatatcggaaaatatcgggtccaaggtgctgcatctgacactgctcaagttttttttcaatctaattgaatccgaagtacagcacctgagccaaaagctgtatgattggtcagattcccagaacttaaagattacgggcaaggccatgctgcttgagatcttctggtccggctctgagacctccggactgctgaccaaacccgttaacatgctattagagtggaccatatactcccataaagaaaaatttaagagtaacgatgtgttcaaacacgagctggcttacctgcttgccggcatattgggtgccgctatcgattattggattttcctggggttgaagatggggaggaacgtaatgaggcatatgagcgatgatttgggatcctacgtgtcactgtcctgcgatgatttcagctctcaagagctcgagatctttatctgcagtttctcttccagttggctgcagatgtttgtggccgaggctgtttttaaaaaactgtgcctccaatccagtggatctgtgtcaagcgaaccccttagccttcagaaaatggtgtatagttatcttccagccctcggaaagaccggcgttctcggttcaggcaaaattcaggtctctaaaaaaatcggccaacgcccctgctttgatagccagcgcactctactgatgctcaacgggaccaaacagaagcaagttgaggggctcccagaacttctcgacctgaatctggccaaatgctcaagcagtttgaaaaagctgaaaaaaaaatccgagggggagctgtcctgttcaaaagaaaattgccccagtgttgtgaagaagatgaacttccacaagaccaatttgaaaggagagacggccttgcaccgggcatgcattaacaatcaagtagaaaagcttattctcctcctgagcctgcccgggattgacatcaatgtgaaggacaatgcaggatggacaccactccacgaagcatgtaattacgggaatactgtgtgcgtccaggaaatcctgcagcggtgccctgaagtggacttgctaacccaagtcgatggcgtgacacctctgcacgacgcgttatccaacgggcacgtggaaataggtaagctgttgttgcagcatggtggacccgtgctgctccagcagcgaaacgccaagggggaactgcctcttgactatgttgtctcaccgcagattaaggaggagctgtttgcaattactaaaattgaggacacggtggagaattttcacgcacaggccgagaagcactttcactaccagcagctggaatttggctcctttctcctgtcccgaatgctgctcaacttttgctctatttttgacttgtcaagtgagttcatccttgcttccaagggcctaactcacctcaacgaactcctgatggcctgtaaatcccacaaggagactacttccgtgcataccgattggctgctcgatctctatgctggcaacatcaagacgctgcaaaaacttcctcacattttgaaggaacttcctgagaatcttaaagtgtgtccaggggttcacaccgaagccctgatgattactctcgagatgatgtgcaggagcgtcatggaattctcctag

SEQ ID NO: 14001 - DNA, 660 bp, Artificial Sequence
  Description of Artificial Sequence: Synthetic coding sequence
atggagcccaaggaggctacaggcaaggagaacatggtcacaaagaagaagaatctggcttttctgcgatcccggttgtacatgttggagcgtcgcaagacagacactgttgttgagagctcagtgtcaggtgatcactccggtacattgagacggagccagtctgatcgcactgaatacaaccagaaattacaggaaaagatgaccccacaaggggagtgctccgtcgcagaaacactgactcctgaggaggaacaccatatgaaacgtatgatggccaagcgggagaaaatcattaaagaactgatccagactgagaaggattacctgaacgacctcgaactgtgcgtgagagaggttgtacagcctttaagaaacaaaaagaccgataggctagacgtggattcacttttctcaaatatcgagagcgtacaccagatctccgcaaagcttttgtctttgctagaggaggctaccactgacgtggagccagctatgcaggtgatcggggaagtgtttctgcagatcaaaggacccctggaggacatctacaagatatattgttatcatcacgatgaagcccactccatacttgagtcttatgaaaaagaagaagagcttaaggagcatctgtcacactgcatccagtcgctgaaatag

SEQ ID NO: 14002 - DNA, 3183 bp, Artificial Sequence
  Description of Artificial Sequence: Synthetic coding sequence
atgctgatagaagatgtggatgcgcttaagagctggttagccaaactcctggagccaatatgtgacgccgatcctagtgcgctggcgaactatgttgtcgcactcgtgaaaaaggataagccggagaaagaactcaaggcattttgtgcagatcaactcgacgtttttcttcagaaggagacttcaggctttgtcgacaaattattcgagagtctctacacaaagaactatctgcccctgttagagccagtaaaacctgagcctaagcccctcgtccaggagaaggaagaaatcaaagaggaggtctttcaagagcccgcagaggaagaaagggatgggaggaagaagaaatatcccagcccacagaaaaccaggagtgaaagttccgagaggcgcacgcgggaaaagaaacgggaagatggaaaatggcgggactacgaccgctattacgagcgcaacgagctctatcgagagaaatacgattggagacgcggtagatctaaatcgcggtccaagtcaaggggtttgagccgctctagatcgcggtcccgcggacgcagtaaagatcgcgaccccaacagaaatgtcgaacatagagaacgctccaaattcaagagtgagaggaatgacttagaatccagctacgtcccagtgagcgcacctccccccaattcatctgaacagtattcaagcggagcgcagagtattccttccacggtgactgtgatcgctcccgctcaccactccgaaaacacaaccgagtcatggtctaactattataataatcactcaagttctaattcgttcgggcgtaacttgccaccgaagcggcgctgcagggattatgatgagcgtggcttctgcgttctgggagacctttgtcagtttgatcacgggaacgatcctctggtagtagatgaggtagcactgcctagcatgatcccatttcctcccccaccacccgggttgccccctcccccccccccaggaatgttgatgccacctatgccagggcccggccccgggccaggtcctgggccagggcccggccccggtccaggccccgggccgggccattcaatgagactgcctgttcctcagggtcacggacaacccccacctagtgttgtgctgccaatccccaggccacccattactcagagcagtttgattaactcccgggaccaacctgggacgtcagctgtccccaatctggcgtcagtcgggacgcggctgcctccgcccttgccacagaacctgctgtatacggtgtcagagaggcagcctatgtattcacgcgagcatggagcggcggcatccgagaggctccaattaggtacacccccccctctcctcgccgccagattagttcccccccggaaccttatgggttccagtattggctatcatacaagcgtcagcagccccactcctctggtacccgatacctacgagcccgatgggtataaccccgaggcacctagcattaccagctcaggtagatctcaataccggcagttcttcagccgcacacagactcagcggcccaatctgataggactcacctctggggatatggacgtgaatccacgagctgcgaatatcgtgattcagactgagcctcctgttcctgtgagtatcaattcaaacattaccagggtagtgctggagcccgattcacggaaaagggcaatgtccggattggagggacctctgaccaagaagccctggcttggcaagcagggtaacaacaatcagaataagcccgggtttctccgaaaaaaccaatatacgaatacaaagctcgaggtgaagaagatcccccaagagttgaacaacattactaaactgaatgaacatttctcaaaattcggaaccattgtgaacatacaagtcgcctttaagggcgaccccgaggctgccttgattcagtacttgaccaatgaagaggcaagaaaagcaatcagctccacggaagccgtgctcaataatcgcttcatccgagtcctatggcacagggagaacaatgagcaacccaccttgcaatcttccgctcaactcctgttgcaacagcaacagacactgtcacacctgagtcaacagcaccaccacttgccgcagcacctccaccaacagcaggtgctggtggcccagtccgccccaagtactgtccacggcggcatacagaaaatgatgtctaaaccccagacttctggtgcctacgtgctgaacaaggttcccgttaagcaccggctgggtcacgccggtgggaaccagtcagacgcttcccacttgctgaaccaaagcggaggcgctggcgaggattgccaaattttttcaacaccaggccaccctaaaatgatctacagcagctccaatttgaagactccctcaaagctgtgctctggctccaaatcccatgacgtgcaggaagtgctgaagaaaaaacaggaagctatgaagctgcagcaggatatgcgcaagaaaagacaagaggtgctggaaaaacaaattgaatgccagaaaatgctgataagcaaactggaaaagaacaaaaatatgaaacccgaggagcgagcgaacattatgaaaacactgaaggagttgggcgaaaagatctcccaattaaaagacgagcttaagacaagctccgcagtctcaacccccagcaaggtgaaaacaaaaaccgaggcacagaaagagctcctggataccgaattagatttacacaagcgcctgtctagcggggaggataccacagagcttcggaaaaagctcagccagctccaggtggaagctgcccgcctcgggatcctgcccgtcggccgcggcaagactatgtcgtctcaaggcagggggcggggtagggggcgtggaggacgcggtcggggctccctgaatcatatggtcgtggatcatcgacccaaggcactgaccgtgggcggcttcattgaggaagagaaagaggatctgctccagcatttttctaccgcaaatcaaggacctaagtttaaagacaggcgactgcagatatcctggcacaagccaaaggtgcccagcatttctacggagaccgaagaggaggaagttaaagaggaggagacagagacatcagacctgtttctccctgacgatgacgacgaggacgaggatgaatacgaatccaggagctggaggcgatag

SEQ ID NO: 14003 - DNA, 1818 bp, Artificial Sequence
  Description of Artificial Sequence: Synthetic coding sequence
atggaggcggacattatcaccaaccttagatgtaggctgaaagaggccgaagaggagcgcttaaaggctgcgcagtatggattacagttagttgagtcccagaatgagcttcagaatcagctggacaagtgccggaatgagatgatgacgatgaccgagtcatacgaacaggagaagtacacactccaacgggaggtggagctgaaatcgaggatgcttgaaagcctgagctgtgagtgcgaggcgatcaagcagcagcagaagatgcatctcgagaagcttgaggagcagttatcccgctcacacggccaggaggtaaacgagctgaagacaaagatagagaagctgaaggtagagcttgacgaagcacggctgagcgaaaagcagctgaagcatcaggttgatcaccagaaggagttgctgtcttgtaagagcgaagaactccgcgtgatgagtgaaagggtacaagagtctatgagctcagaaatgctggccctgcaaattgagctcacagagatggagagcatgaaaactacgttaaaagaagaggtgaacgaactgcagtataggcaggaacagcttgaattgcttatcaccaacctgatgcgccaagtggaccgactgaaagaggagaaggaggagagggagaaagaagcagtcagttattataacgccctggaaaaggcccgcgtggcgaaccaggatctccaggtgcagttggaccaggccctccagcaggccctggacccaaattctaagggaaactctctgtttgctgaggttgaggatcgcagggctgccatggaacgccagcttatctccatgaaagttaaataccagtctctgaagaagcagaacgtttttaatcgtgagcagatgcagcgcatgaagttgcaaattgccactctactccaaatgaagggtagccagactgagtttgagcagcaggaaagactccttgccatgctggagcagaaaaacggcgaaattaagcacctccttggagagatccgaaacttggaaaagtttaagaacctttacgatagtatggaaagcaagccatccgtagattctggtacactggaggacaatacgtattacaccgatttacttcaaatgaagctggataacctgaataaggagatagagtcgacgaaaggcgaactgtcaattcaacggatgaaggcactgtttgagagtcagcgagccttagatatagagagaaaacttttcgcaaacgagcgatgtctgcagctaagtgagagcgagaatatgaaattgcgagctaaactcgacgagcttaagctgaagtacgaaccagaggaaaccgtggaggtgccagttttgaaaaagaggagggaagtgctgcctgttgacattaccactgccaaggacgcctgcgtgaacaactcagccctgggtggtgaagtttacaggttgcctccacagaaggaggagactcagtcttgtcctaactccctcgaggacaataatctgcagttggagaagtcggtttctatctacacaccagtggtctcactgagtccccataagaacctcccagttgatatgcagctcaagaaggaaaaaaagtgcgtcaaattgattggtgtgcccgccgacgccgaggcgctgtctgagcgatccggtaatacgcccaactctccacgcctggctgcggagagtaaactgcagactgaagtcaaggaggggaaagaaactagcagtaaactagagaaagaaacatgtaagaagttgcacccgatcctttatgtctcctccaaaagtacccctgaaacccaatgcccacagcagtag

SEQ ID NO: 14004 - DNA, 888 bp, Artificial Sequence
  Description of Artificial Sequence: Synthetic coding sequence
atgatggctaagaagcctcctaaaccagctcccagacgcattttccaagaacggctgaaaatcacggctctgcctctgtactttgaggggttcctcctgattaagcggagcgggtacagagaatacgagcattactggactgaactgagaggcaccacactgtttttttacaccgacaagaaatctatcatttacgtggacaagctggacatagtggaccttacatgtctcaccgaacaaaattcgactgaaaaaaactgcgcaaaattcaccctcgttctgccgaaggaggaagtgcagctgaagaccgagaacaccgaatccggcgaggaatggcgggggtttatcctgacagtcaccgaactgtctgtgccacaaaacgtgagtctgctccccggccaggtgatcaagctgcatgaagtactggaacgggagaaaaagagaaggattgaaactgaacaatctacatcagtggagaaggaaaaagagccgaccgaggactatgttgatgtgctcaaccctatgccagcttgtttttacaccgtctcacggaaggaagccactgaaatgcttcagaaaaacccctccctcggaaacatgatcctaaggccagggtctgactcaagaaattattccatcacgatcaggcaggagatcgacatcccgaggattaagcactacaaagttatgtcagtcgggcagaattacaccatcgagctagagaagccagtgaccctccctaacctgttcagtgtgatcgattattttgtgaaggaaactcggggaaatctgcggccctttatttgtagtaccgatgaaaacactggacaagagccaagcatggagggcaggagcgaaaagctgaaaaagaacccacacatcgcatag

SEQ ID NO: 14005 - DNA, 4821 bp, Artificial Sequence
  Description of Artificial Sequence: Synthetic coding sequence
atgtttcacatctgccctgcagaaaacctgtaccagaatagatttttaggactcgcagctatggcctcgccatctcgaaactctcagtctcgaaggagatgcaaagaaccactccgatactcttacaaccctgatcagttccataatatggatctcaggggcggtcctcatgacggcgtgaccattcccaggtcaactagtgacactgatcttgttacctcagatagccggagtacacttatggtctcatcatcatattacagcattggccacagtcaggacctggtgatacattgggatattaaagaggaggtggacgcaggggattggattgggatgtatctcatcgacgaggtcctgagtgagaacttcttggattataaaaaccgaggcgtgaacggctcccaccgcggccagattatttggaagatcgatgccagctcctatttcgttgagccagaaaccaaaatttgctttaagtattaccacggggtctcaggagcacttcgggcaaccaccccatctgtgactgtcaagaacagcgccgcaccgatctttaagagtattggcgctgacgaaactgttcaaggccagggatcccggcgcctaatttccttttccctttctgacttccaggccatgggtctcaagaaggggatgtttttcaatcctgacccctatctgaagatttccatccagccaggaaagcactctatcttcccagctctcccccaccacggccaagagagaagatctaagataatcggcaatacagtgaaccctatatggcaggcagagcagttctcctttgtcagcttgcccacagacgtgctggaaattgaagtaaaagacaagttcgccaagagcaggcctatcatcaagcgatttctgggaaagctgagcatgccagtgcagagattgttggaaagacatgcgatcggcgatcgggtggtgtcatacacgttaggcagaaggctacccactgaccacgttagcggtcagctgcaatttcgtttcgaaatcaccagtagcatccaccctgcagatgacgaggagatttctttgtctacagaacccgagtctgcacaaattcaggacagtcccatgaacaatctcatggaaagtggctccggtgaacctcgttcagaggctcctgaatctagcgagtcttggaaaccagagcaattgggagagggaagcgttccagacggaccaggtaaccagtccatcgagctgagtaggcccgccgaggaggctgccgtgattaccgaggccggtgatcagggcatggtgagcgtagggcccgagggtgctggcgagctcttagctcaagtgcaaaaggatatacagcctgccccatctgctgaggagctggcagagcagctggatctcggagaagaggccagcgccctgctgctagaagacggtgaagcgcccgcgtccactaaggaagagccccttgaggaagaagcaaccactcaaagtcgagcaggaagagaagaggaagaaaaggagcaggaggaggagggagacgtttctacattggagcaaggagagggcagacttcagcttagggcttcagtaaaacgcaaaagcaggccttgcagtctgcctgtctccgagctagaaactgtgatcgctagcgcttgcggcgaccctgagacaccaaggacacactatattaggatccataccctgctccattccatgccatcagcacaaggaggctccgccgctgaggaagaagacggtgcggaagaagagagcactttaaaagattcctcggaaaaggatgggctcagtgaggtggatacggttgctgctgacccaagcgccctcgaggaggatcgcgaagaacccgagggcgcgacccccggcacggcacaccccggccacagtggaggccacttcccttccctggcaaatggggccgctcaggacggggatacccacccttcaacaggcagtgagtctgactcgtctccacgtcagggcggggaccatagctgcgaggggtgtgacgcttcgtgctgtagtccctcttgttactcttccagttgttacagcacctcctgttactcctcttcctgctacagcgccagttgttactcgccgagttgctataatgggaataggttcgcttcccacacgcggtttagtagtgttgattctgccaagatctcggagtctacagtcttcagcagccaggatgatgaggaggaagagaatagtgcctttgagtcagtgcccgacagtatgcagtctcctgagttggatccagaatcgactaacggcgctgggccgtggcaggatgagcttgctgcgccttccggtcatgtcgaaaggtcccccgagggtttggaatccccagtggctggcccatctaaccgtagagagggtgagtgtcctattttgcacaattcgcaacccgtctcacagttgccctcactgaggcctgaacaccatcattacccaacaattgacgagcctttaccgcccaactgggaagcacgcatcgactctcacggcagggtcttctatgtagaccacgtgaataggaccaccacatggcaaaggcccactgccgccgcaactcctgatgggatgcgccggtctggctctatccagcaaatggagcagctgaaccggcgttatcagaatatccagcgcactatcgccaccgaaaggtccgaagaggactccggtagtcagtcctgcgagcaagcccctgcggggggaggaggcggaggaggatcagattccgaggcagagtcatcccagtcaagtctcgacctccgtagagagggctcactgtcccctgttaattcacagaagattaccctgctcctgcagagtccggcagtgaaatttatcacaaatccggaattcttcaccgtgttgcatgccaattatagtgcctatagggtttttacttcctctacttgcctgaagcacatgatcctgaaagtccgcagagacgcccgaaatttcgagaggtatcagcacaatcgggatctggttaactttattaatatgttcgcagacacgcgcctagagcttcctcgaggctgggagattaaaaccgaccagcaaggtaagtctttttttgtggaccacaatagtagagcgacaacgttcattgatcctaggatcccattgcaaaacggcagactgcctaaccatttgacacacagacagcaccttcaacgtctacgaagttacagcgccggtgaggcgtcggaggtgtccaggaacaggggcgcatcgttgctggccaggccaggccatagtctggtggccgcgattcgctcccagcatcagcatgaatctctgcctcttgcctataatgacaagatcgtggcttttctaaggcagccaaacattttcgagatgctacaggaaaggcaaccgtccctagcccgtaatcacacgctgagggagaaaatccactacattcgcacggaaggcaatcatggtttagagaaactctcctgtgatgcagaccttgtgatactgctgagcctttttgaagaggaaattatgtcttacgtgcccctgcaggcagccttccaccctggctacagcttcagccccagatgtagtccttgtagcagcccacaaaacagtcccggccttcaaagggcctctgcccgcgccccgtccccttatagaagagatttcgaagccaagctccggaacttttatcggaagctggaagctaaaggcttcggccagggacctgggaagattaaactcattattaggcgggaccatttactcgagggaaccttcaaccaggtaatggcttacagccgaaaggaactgcagagaaataagctttacgtgaccttcgtgggtgaagaaggcctcgattactctggccctagccgggaatttttttttctactgtctcaggaacttttcaacccttattacggactgttcgagtactctgcaaatgatacctacactgtgcagatcagcccaatgagcgcgttcgttgagaatcatctggaatggttccgcttctctggcaggattcttgggttagccctcatccaccagtacctcctggacgccttcttcacacgacctttctataaggctctgctgcgcttgccatgtgacctgtccgatctggaatacctggacgaggagtttcaccagagcctgcagtggatgaaggataacaacattactgacattttagatctgaccttcaccgtcaacgaagaggtcttcggccaagtcaccgagagggagctaaaatctggtggagccaacacccaggtcactgaaaagaacaagaaggaatacatcgagcgcatggtcaaatggcgcgtcgaaaggggcgtggttcaacaaacagaggccctagtccgagggttttacgaagtagtggactctcggctggtgtcggtctttgacgcccgcgagttagagttagtgattgccggcaccgcagagatcgacctcaatgattggcgcaacaacaccgagtatcggggaggctatcacgatggccacctcgtgataagatggttttgggcggcagttgagaggttcaacaacgagcagagacttcggttgctccagtttgtgactggaaccagtagcgtgccatacgagggcttcgccgcgctgagaggaagtaatggcctgcgacgtttctgtatcgagaaatggggcaagatcacaagcctgccgagggctcacacctgcttcaacaggctcgatctccccccatacccatcctattccatgctgtatgagaagctgctaactgcagtcgaagagacttcaactttcggactggagtag

SEQ ID NO: 14006 - DNA, 2373 bp, Artificial Sequence
  Description of Artificial Sequence: Synthetic coding sequence
atgggtacacggaagaaggtgcatgccttcgtccgcgtgaagccaactgatgatttcgctcatgaaatgatccggtatggggatgataagcgtagtattgacatccacctcaagaaggatatcaggcgaggggtcgtgaacaatcagcagacagactggagttttaagctagacggagttctccacgatgcatcacaggatctggtttacgaaaccgtcgccaaagacgtggtgtcacaggccctggacggttacaatggaaccatcatgtgctacggtcaaaccggcgccggcaaaacatatacaatgatgggagctactgagaactacaaacaccgcggcatcttgcctcgggcactccagcaggtatttcgcatgatcgaagaacgaccaactcatgctatcacggtacgcgtttcctaccttgaaatttataatgagtctctcttcgacctgctatctacgctcccttatgttggtccctctgttactcctatgaccattgttgagaaccctcagggagtgttcataaaaggcctttcagtgcacctcacttctcaggaggaggacgcattcagcttgctgttcgaaggagaaacgaatcgaatcattgcctcgcatacgatgaacaagaactcatctagatcccactgtatatttacaatttacctggaagcacactctcgaactttatccgaagagaaatatatcacctcaaaaatcaatttagtcgatctcgctggctctgagagactaggaaaatctggatctgaggggcaagtcctgaaggaggctacttatatcaacaagagtctgagcttccttgaacaggctatcatcgcactgggtgatcagaagagagaccacatcccttttcggcagtgcaaattgactcacgccctgaaagacagcctcggcggaaactgcaatatggtgctggtgacgaatatctacggagaggccgcgcaactggaggaaactctgtcttccctacgcttcgccagcagaatgaagctggtaaccacagaacctgcaataaatgagaagtacgacgctgagcgcatggtgaagaacctggagaaagagctggcactattaaaacaggagctggccattcacgatagcctgacaaatagaactttcgttacatatgacccaatggacgaaattcagatcgccgagattaacagtcaggtcagaagatacctagagggcacgctggacgaaattgatattatcagcctgagacaaataaaggaggtgtttaaccagtttcgggtagtactgtcccagcaggagcaagaagtcgagtccacactgcgtcgaaaatacacgctcatagataggaacgattttgccgcgatctccgcaatccagaaagcggggctcgtggacgtggatggccacctggtaggagagccagagggacaaaatttcgggctgggggttgccccgttttcgactaaaccaggtaaaaaggctaaatcaaagaagacctttaaggaacctctgtccagcctggcacgcaaggagggggcgtctagccctgttaacgggaaggacctggactacgtgagcacctccaaaactcaattggtccctagcagcaaggatggggatgttaaagacatgctatcgcgagacagagagacatcctccatcgagcccctcccttctgattctccaaaggaagaattaagacctattagaccggacacaccccccagcaagccggtggccttcgaagagtttaaaaacgagcagggatccgagatcaaccgcatcttcaaagaaaataaatcaatacttaacgagaggcggaaaagagcatctgagactacccagcacatcaacgctataaagcgggaaatcgacgtgactaaagaagcgcttaattttcagaaatccctgcgtgagaaacagggcaagtacgaaaataagggcttaatgattattgacgaagaagagtttcttctcatcttgaaattaaaagacctcaagaaacagtaccggtctgagtaccaggacctacgtgatctgcgagcggaaatccagtactgccaacacctggtggaccaatgtaggcatagactcctgatggagtttgatatatggtataacgagagttttgttatcccagaagacatgcaaatggccctgaagcctggagggtctatacggccaggcatggtccctgtgaatagaatcgtttccctgggcgaggatgaccaggacaagttctctcagctgcagcagagggtgctgcctgaagggcccgacagtatctcgttctataacgccaaggtgaagatcgagcaaaaacacaattacctgaaaacaatgatgggtctgcagcaagcccatcggaagtag

SEQ ID NO: 14007 - DNA, 876 bp, Artificial Sequence
  Description of Artificial Sequence: Synthetic coding sequence
atggcctctgtgaccctgtccgaggctgagaaggtatatattgttcatggtgttcaggaagacctacgggtggacggaaggggatgtgaggattaccgttgtgtcgaggtggagactgacgtcgttagcaatacttcagggtcggctcgggttaaactgggacacacggatattctcgtcggggtgaaggccgagatgggcacccctaaactcgagaagccaaatgagggctacttagagttctttgtggattgttctgcttccgctacgcccgagttcgaaggacgcggtggggatgacctgggaaccgagatcgccaatactctatacagaatttttaataacaaatcatcagttgacctcaagactctgtgcatatcacctcgtgaacactgttgggtcctgtacgtggatgtgctcctcttagaatgcggtgggaatttattcgacgcaatctctattgctgtgaaggctgctctgtttaacacacgtattccgcgagtcagagtactggaagacgaagagggctcaaaagacatagaactgagtgatgacccatacgactgtatcagactctctgtggagaatgtgccctgtattgttacgctctgcaagataggttaccggcacgtagtggatgccactctccaagaagaagcatgtagtctagcctctctgctggtgtccgtaacgtccaagggcgtggtaacgtgcatgagaaaggttggcaagggtagcctcgaccctgaaagtatctttgagatgatggaaactggaaaaagagtgggcaaagtactgcatgcaagtctccagtcagttgttcacaaagaggagtccctggggcctaaaaggcagaaggtcggtttcttgggctag

SEQ ID NO: 14008 - DNA, 2382 bp, Artificial Sequence
  Description of Artificial Sequence: Synthetic coding sequence
atgttttggaaattcgatctgcattccagttctcatattgacacactgttggaacgggaagacgtgaccctgaaggagttaatggacgaagaagatgttcttcaggagtgtaaagcccaaaaccgtaagttaattgaattccttctcaaagccgaatgtctcgaggatctcgtgtcctttatcattgaagagcctcctcaggacatggatgagaaaattcgctacaagtaccctaacatcagctgcgaactgcttacctcagatgtctcgcaaatgaatgatcgcctcggcgaggacgagtccctcctgatgaagctctactcatttctgttgaatgacagtcccctgaaccctttgctggcaagtttcttttctaaagtcttgagcattttaatctcaagaaagccagaacagatcgttgacttcttaaagaagaaacatgacttcgtggacttgattattaaacatattggcacaagcgccatcatggacttgttgctccgactgctgacgtgtatcgagcctccacagccgaggcaagacgtgctgaattggctcaacgaagagaaaattattcagcggcttgtggaaatcgttcacccaagccaagaggaggatcgacactccaatgcctcccagtccctttgtgagatagttcggttatctagggaccagatgctgcagatacagaactcaactgaacctgatcctctgctggctactttggagaagcaggagatcatcgagcaactgctgtcaaatatttttcataaggaaaagaatgaatcggccatcgtgtcagctattcagatccttctgacacttcttgagacacggcgccccactttcgaggggcatatcgagatctgccctcctggaatgtcccactctgcttgttcagtcaacaagagtgtattagaggccatcaggggccgcctcggttcttttcacgaacttttgctggagcccccaaagaatatgtttttcaaatacacttggaacaactttctgcacacccaggttgaaatttgtatcgctctcatcctggcctcccctttcgagaataccgagaatgcgacgatcactgatcaggattcaaccggagacaatcttcttctgaaacacctgttccagaaatgtcaactgatcgaaagaatcctcgaagcctgggaaatgaacgaaaagaaacaggccgagggaggccgtaggcacggctacatgggacacctcacccggatagccaactgtattgtccactctaccgataagggcccaaatagcgctttggtgcagcagctgatcaaggacctgcccgacgaggtgagggaaagatgggaaactttctgtacctcatcactgggcgaaacgaacaaacggaacaccgtggacctggctttcagcgactatcagatgcaacagatgacttccaacttcattgatcagtttgggtttaatgacgagaagttcgcagaccaggatgacattgggaacgtcagttttgaccgtgtgagcgatatcaatttcactctgaacacaaatgaatccggcaatattgctttgttcgaggcgtgttgcaaggaacgcatccaacaattcgatgacgggggctcagatgaagaggatatctgggaggaaaagcatatcgcttttacgcccgaatctcagcgccgctctagttccgggagcactgatagcgaagagtccaccgacagcgaggaagaagacggggcaaagcaagacctgttcgagccctcctctgctaacactgaagataagatggaagttgacctgagcgagcctccgaattggtccgccaacttcgacgttccgatggaaacgacacacggggcccccttagattctgtagggtcagacgtgtggtcgacagaagagcctatgcccactaaggagacaggatgggcctcctttagcgaatttacaagtagtctgagcaccaaagactctctgaggtctaatagccccgttgagatggaaacctctaccgagccaatggacccacttacaccctctgctgccgctctcgctgtgcaacctgaggccgccgggtctgtagccatggaagccagcagtgacggtgaagaggatgccgagtccactgacaaggtcacagaaacggtgatgaatggtggtatgaaagaaactctgagtctcactgtcgacgcaaaaactgaaactgccgtttttaaatcagaggaaggaaagctttcaacaagccaggacgcagcgtgtaaggatgccgaagagtgccccgaaactgctgaggccaaatgtgctgctcctaggccccctagctcctccccagagcagcgaacggggcaaccatcagctcctggcgatacctctgtgaatggccccgtttag

SEQ ID NO: 14009 - DNA, 3375 bp, Artificial Sequence
  Description of Artificial Sequence: Synthetic coding sequence
atggacccttttaccgagaagcttttggaacgtactcgggctcgccgtgagaatctgcaacgaaagatggcagagcgcccgaccgccgctcctcgaagcatgacccacgcgaagcgggccaggcagcctctgtctgaagcctccaatcagcaacctcttagcggcggagaagaaaagtcatgtacaaagccatctccatctaagaaacgctgtagtgacaatacagaggtggaggtgtccaacctggagaacaaacagccagttgaatcaacatcagccaagtcatgctcaccaagcccagtatcaccacaggtgcaaccacaggccgccgacacgataagcgattccgtcgcagtccctgcttccctgctcggtatgcgtagaggacttaatagcagactggaggctactgcagctagctccgtcaaaacaagaatgcagaaacttgccgaacagcgtcggaggtgggataacgatgacatgacagacgacatccccgaatctagtctgtttagcccgatgccctccgaggaaaaagctgcgtctcctccccgacctctgctctctaatgcctctgccacccctgtggggcggcgtggccgcctggccaatctggccgcaaccatatgcagctgggaggacgatgtgaaccactccttcgccaaacagaattccgtccaggaacaaccaggaacagcctgtctgagtaagttttcaagcgcctccggcgcctcagctcgcatcaactcaagcagtgtgaaacaggaggccaccttttgttcgcagagagatggcgatgcctccctcaacaaagccctgagcagcagcgctgatgatgcttcactggtaaatgcctctatctcttccagcgtaaaagccacaagccccgtgaagtctacgacctcaattaccgatgcgaagtcttgtgaggggcaaaacccggagctgctgcctaagacgcctatttctccattaaagactggtgtgtcgaaacccattgtgaagtccaccctgtcccagacagtgccatccaagggcgagctgtcccgggaaatctgtctccagtctcagtcaaaagataagtctaccactccgggaggcacaggaatcaagcctttcctggaacgtttcggggagaggtgccaggagcacagtaaggaaagccctgcacggagcacgccacatcgcacacccatcatcacgcctaacacaaaggctatccaggagaggttgttcaaacaggacactagtagttctaccacacatcttgcacagcaactcaagcaggagaggcaaaaggagctcgcctgcctgcgcggtcgttttgataaagggaatatttggtcagcggaaaagggcgggaattcaaaatctaagcagctggagacaaagcaagagacacattgccagagcaccccattgaagaaacatcagggagtgagtaaaacgcaaagcctgcctgtgacagagaaagtcacagagaatcagatccctgctaagaactcctccactgagccaaagggcttcacagagtgcgagatgaccaaatcaagcccactgaaaatcacactatttctggaagaggacaagagtttgaaggtgacaagtgaccccaaggttgaacaaaaaatcgaagtgatcagagaaatcgaaatgtccgtcgatgatgatgatattaattcgagcaaggttattaatgatctctttagcgacgtgcttgaggaaggggaattagacatggagaaaagtcaggaggaaatggaccaggccctcgctgagagctcagaggagcaggaggacgctttgaatattagctccatgtcattgctggcccccctcgcccagactgtcggcgttgtcagcccggagagccttgtgtctaccccacggctggaactcaaagatactagccgctcggacgagagtccgaaacctggaaagttccagcggacccgggtgcctcgcgcggagtcgggggattccctgggtagtgaggaccgtgaccttctctacagtatcgacgcttaccggagtcaacgattcaaagagactgagaggccctctatcaaacaggttattgtgcgaaaggaagatgtcacctctaagctggacgaaaagaacaacgcattcccttgtcaggtcaacatcaagcagaaaatgcaggaacttaataatgagataaatatgcagcagaccgtaatttatcaggcaagtcaggctcttaactgctgcgttgatgaggaacatggaaaaggatcccttgaggaagctgaagcggaaagattactcctgatcgcaaccggaaaacgaaccctgctgatcgacgagctgaacaaactcaaaaacgaggggccccagcggaagaacaaagcctccccacagtccgagttcatgcccagtaaggggtccgtgactctgtctgaaatccgtctacctctgaaggccgacttcgtgtgtagcaccgtgcagaagcccgacgctgcaaattactactatcttatcatcctcaaagctggggccgaaaatatggtcgccactcccttagccagtacttctaacagcttgaacggcgatgctttgactttcacaaccacttttaccctccaggatgtcagtaacgattttgaaattaacattgaggtttactccctcgtgcagaaaaaggacccaagcgggttggataagaagaaaaaaacctccaaatctaaagcaatcacacctaagcgcctcctcactagcattacgacaaagtccaatatccatagtagcgtgatggccagcccgggcggcctctctgcagtgagaacctcaaattttgcgctggtgggtagttataccctgtctctctcttctgtagggaacaccaaatttgtactagataaggtgccattcttgagctccctcgagggacacatctaccttaagattaaatgtcaggtgaactccagcgttgaagagcgggggtttctgacaattttcgaagacgtgagcggcttcggggcatggcaccggaggtggtgcgtcctcagcgggaactgtattagttactggacctacccagatgacgaaaagcggaagaatccaatcggcagaatcaacctggcaaattgcacatcgagacagatagagcccgcaaaccgcgagttctgcgccagaaggaacactttcgaattgataaccgtgcgaccccagcgagaagacgaccgcgaaacgctggtgagccagtgtcgtgataccctatgtgtgactaagaattggctgtcagcggataccaaggaagaacgcgatttgtggatgcagaagctcaatcaggtcctcgtcgatatcagactctggcagcctgacgcctgttataaacccatcggcaagccgtag

SEQ ID NO: 14010 - DNA, 1365 bp, Artificial Sequence
  Description of Artificial Sequence: Synthetic coding sequence
atgcttaaacagattctgagcgagatgtacatcgacccagaccttttggccgagctgagcgaagaacagaaacaaattctctttttcaaaatgagggaagagcagatacgccggtggaaggaaagggaagcagcaatggagcggaaagagtcacttcccgtgaagccaagaccgaagaaggaaaacggcaaaagtgtgcactggaagcttggggcagataaggaggtgtgggtctgggtcatgggtgaacaccacctcgacaagccgtatgacgttttatgtaatgagattatagcagagcgcgcccgtctgaaagctgaacaggaagccgaagaaccacgaaaaacccacagcgaagagttcactaactccctgaaaactaaatcccagtatcatgatctgcaggctccagataaccaacagacgaaagacatctggaaaaaagttgcggagaaagaagaacttgagcagggctcgcgtccagctccaaccctggaggaggagaagattcgttcactctcgagcagctctcgaaacattcagcagatgctggctgacagcattaatcgcatgaaagcgtatgccttccatcagaagaaagagagtatgaaaaagaagcaagacgaagagatcaatcagatagaggaggaacgcaccaagcagatttgtaagtcatggaaggaggactccgagtggcaggcgtccttacggaaatcaaaagccgccgacgaaaaacggcggagcctggctaagcaggctcgggaagactataagaggctttcccttggcgcgcagaagggccgagggggagaaagattgcaaagtcccctgagagtgccgcagaaaccagagcggcctccactgcctcctaaacctcagttcctaaactcaggggcctaccctcaaaaaccgctgaggaaccagggagtggtcagaactctcagctcaagcgcacaagaagatatcatcaggtggttcaaggaagagcagctacccctccgagccgggtatcaaaagacatcagatacaatagccccttggttccacgggattctcacattgaagaaagccaacgaactgctattgagtacagggatgcccggctcctttctaatccgtgtgtctgagagaataaaggggtacgcgctttcctatctctcagaggacggctgcaagcatttcctcatcgatgctagtgccgatgcatatagttttttaggcgtagaccaactgcagcacgccacgctggcagacctggttgagtaccacaaggaggagccgatcaccagtttggggaaggaactgctgctgtatccgtgtgggcagcaagatcagctcccagactacctggagttgttcgaatag

SEQ ID NO: 14011 - DNA, 1497 bp, Artificial Sequence
  Description of Artificial Sequence: Synthetic coding sequence
atggatgagactgaatggattcatcggcatcccaaggccgaggacttgcgggtcggcctgataagctgggctggcacatacctgacttttgaagcctgcaagaataccgtgaccgcaactgcaaaaagccttggtagaagacaaacctgggaaattctcgtcagtaatgagcacgagactcaagctgtggtgcggctcaagagcgtgcaaggcttgtatctgctgtgtgagtgcgatggcacagtgtgttatggcagaccccgtacatcgcaccacggctgttttctgttaaggttccacaggaactctaagtggactctccagtgcctgattagcggccgctacctggagagtaacgggaaggacgtattttgcacctcccacgttctgagtgcttaccacatgtggacccctagaccagccttacacgttcacgttatactgtacagccctatccatagatgttacgcccgggcggaccctaccatggggcggatctgggtcgacgccgcagtgccttgcttagaggagtgcggattcctcctgcactttcgagacggatgctaccatttagagacttcaacccaccattttttatcacacgtggataggttgttttcccaaccatcctcccagactgctttccacatgcaggtacggcccggtggcctagtggccctgtgtgacggagaaggtgggatgctgtacccgcaagggacacacctgcttctcgggatgggatgcaaccctatgcgcggtgaggagtggttcatccttcaacactgcccaacctgggtgagtctccgaagcaagaccggcaggttcatttctgtgatttacgatggtgaagttcgggctgctagcgaacggttgaatcggatgtctctgttccagttcgaatgcgacagtgagagcccaacggttcagctgaggtctgctaacggatattacctgagccagaggcgccatcgcgctgtgatggccgacggccaccccctcgagtctgatacattctttaggatgcactggaattgtgggagaatcattctccagtcctgccgggggcgcttcctcgggatcgccccgaattcattgttaatggccaacgttattttgcccggccccaacgaggaattcgggattctgttcgccaaccgcagctttttggttttacgcggtcgatatgggtacgttggctcatcttctggccatgaccttattcagtgtaatcaggatcaacctgacagaatccatttgctgccttgcaggccgggcatctatcatttccaggctcagggcggatcattctggagcatcacatctttcggtacttttaggccgtgggggaagttcgctttgaatttctgcatcgagcttcagggtagtaacttgctgacagttctcgctcctaacggattctatatgcgcgcagatcagtccggaaccttactggctgattctgaagacatcacaagggaatgtatctgggagttttag

SEQ ID NO: 14012 - DNA, 1377 bp, Artificial Sequence
  Description of Artificial Sequence: Synthetic coding sequence
atggagcgcgaacccagtgcttctgaggctgcacccgctgctgccgctctgttcgcatggggtgcaaactcttacggtcagttgggactgggacacaaagaggacgtgctactaccacaacagctcaacgatttttgtaagcctagatcagttagaaggatcactgggggcggaggccattctgcagtggtgacggacggaggcgacctgtttgtttgtggacttaacaaggacggccagctgggattaggccataccgaggacattccctatttcactccatgcaaaagcttgttcggatgcccaatacagcaagtcgcttgcggctgggacttcacgattatgctgacagagaacggccaggtacttagttgcggctctaactctttcggtcaactgggcgtgccacacggaccaagacgctgcgtagttccccaggctatcgagctgcacaaagagaaagtggtgtgtatcgctgccgggttgaggcacgccgtcgctgccactgcctcagggatcgtgttccagtggggaacaggtctcgccagttgcggaagaaggctttgcccgggacagacgctcccgctattttttactgctaaagagccaagccgggttaccggcctggagaactccaaagcgatgtgcgttctcgcaggctctgaccattcagcatcactgacagacgccggcgaggtgtacgtttggggatccaacaagcacggtcagctggctaacgaggcggcttttctcccggttccccaaaagattgaagctcattgtttccagaatgaaaaagtcacggccatttggtcaggatggactcaccttgtggcccagaccgaaactggtaaaatgttcacctggggcagagccgactatggccagctgggcaggaagctcgagacatacgaggggtggaaactggagaaacaggactcattcctgccgtgctctcgaccccccaactcaatgccctctagccctcactgccttacaggcgccacagaggtgtcctgcggaagtgagcacaacttggctatcatcgggggagtgtgctatagctgggggtggaatgagcacgggatgtgcggtgatgggaccgaggcaaatgtatgggcccctaaaccggttcaggcactgctgtcatcctcaggcctgctagtgggctgcggagccggccattctctcgccttatgccagttacctgcccatcccgctcttgtgcaagacccaaaagtgacttatctgtcgcccgatgcaatcgaggataccgagtcacagaaggcaatggacaaggagcgaaattggaaggagcgccaatccgagaccagtacccagtctcagagcgattggagcagaaacggcggtctgtag

SEQ ID NO: 14013 - DNA, 2961 bp, Artificial Sequence
  Description of Artificial Sequence: Synthetic coding sequence
atggaaagaatgaactggctctctcggctagccagccgggggcctgggcacaggattccacagggcgctaacttgcagacgcctgtgatggcagacccggagacatgcctcatggtgttcaagaaccactggtcccaagttgtgaggatcctcgaacggcaggggcccagagctgcacctggaggtgcagacgatctgtcagcggtgagaaaccacacataccagatgttaacattgcttgctgaggatagggccgtcccgtcagctcccaccggtccagggccgctgctcgagttcgcactgcatgaggacttattaacccgcgtccttacctggcagttacaatgggacgagctgggagacggcgtggaggagcgcagagctgagcagcttaaactgttcgagatgctagtatccgaggcgaggcaaccattgcttcgacacggccccgtcagggaggccttgctgactctcctggacgcctgtgggcggcccgtgccctccagcccagcactggatgaagggttggtcctgctcttgtcgcagttgtgtgtatgcgttgcccaggaacccagcttattagaattttttctacagccacctccagaacccggtgccgcccctaggttgctcctcttcagtaggcttgtgccgtttgtgcacagggagggtacacttgggcagcaagcgagagacgctctgttactgctgatggccctttccgccggttcccccaccgtgggcaggtacatcgccgatcactcttacttttgtcccgttctggccacggggcttagcgctctctatagtagtctcccgagaaaaattgaagtgcccggagatgactggcattgtttacgacgagaggactggctgggggtgcccgcccttgcattattcatgtcatcgctcgaattctgtaacgcggtcatacaggtggcccaccccctggtgcaaaaacaactggttgactacatccacaacggatttcttgtgccagttatgggccccgcactccacaaaacatctgtcgaagagatgattgcctcaacagcttacctcgaactgtttttacggtctatcagtgaaccagccttgctgcgaacctttctgcgatttctcctgttgcatcgacacgatacacataccatcctggacacacttgtagcaagaatcggatccaattcccgcttatgcatggtgagtctgtccttgttccgcaccttgctcaacctatcgtgtgaggacgtcctcctgcagctggtcctccggtacctggtgccatgtaaccatgtgatgctgtctcagaagccagctgtgcgcgatgtggatctgtatggccgggccgccgacaaattcctcagcctgataccacgttgctgtaggcatcacgctccgtccccccctagacctgagcatgcatcctgggcacgagggggcccgagccgggagactggccggcgcgaagacattacaggaccagggagtccatccgtcgacagctcatcagtcaccacagtacccagacctagcacaccatcccgccttgccctgttcctgagacagcaaagcctcggtggctctgagagccctggccccgcaccctgttcccccggactatcggccagccccgcctcttcacctgggcgccggcccactcctgcagaagagccgggtgagctggaggacaactacctagaatacctacgtgaagccagacgtggggttgaccggtgcgtcagggcgtgtagaacgtggtctgccccatatgacggcgagagaccatcacctgaacccagcccttttggctcacgcaccaagaaaagatcgctcctgcccgaggaagatcgcaacaacgtgggagaaggggaagaggaagagctggggcgcagaggccgagcagggggggcaggtgaagggccaggccacctcccacctccccagctgaacggtgtccccgggagctggcccgaaggtgccaagaaagtgcgcttggtcccaaaagaaggagccggggagcttttggagggcatatccgagggcatggcgggtctggaagggttcggccaagagttgagggagcttgaagtcgcactaagtaatggcgggactggatcggaatcaccacttgagcccccactgccactggaggaagaggaggcttacgagtctttcacctgccctcctgagccgcccggtcccttcctgtcctcacctctgcgcacccttaaccagctcccaagtcagcccttcacggggcctttcatggccgtcctgtttgccaaactagaaaatatgttgcaaaactcagtgtacgtcaacttcctgctgactggcctggtggcgcaactagcatgccaccctcagccccttttacgaagcttcctgctgaacactaatatggtcttccagccttcggtcaagtccctcctgcaggtattgggcagtgttaagaacaagatcgagaacttcgccgcctcacaagaggatttcccagccctgcttagcaaggcaaagaaatacctgatcgcccggggcaagctggattgggccgagggtccggccgcaggcccggcaccccgtcgctctgatcctctcgtgaagtctcgccggcctagtctaggggagctgttgctccgtcacgcgcattccccaactcgagccaggcaggcagcacagctggtactgcagcccggcagagacggcgcagggttaggcctgtctggcggaagtcccggggcctccaccccggtgctgttgactagggggggagcgcccgagcgacagggcgaagctttgagggtaaagaatgccgtgtactgcgctgtgatcttccccgagttccttaaagagcttgcagctatttctcaggcacacgccgttacaagtccttttctcctcgaaactagtgaagaaggttcagggcctttaatatccggatgcggccctctgaacccttag

SEQ ID NO: 14014 - DNA, 6723 bp, Artificial Sequence
  Description of Artificial Sequence: Synthetic coding sequence
atggatgacaaaggcgaccccagcaacgaagaggcccccaaagccattaaacccacatcaaaggaattcagaaagacttgggggttcaggagaaccacaattgcaaagcgggagggtgccggcgatgccgaagcagatcccctggaacctcccccacctcagcaacagttgggtttgtcactgcgaagatctggcaggcaacccaagaggactgagcgggtagagcaatttctgactatagctcggagacgggggaggagatccatgccagtaagcttagaagactccggagagccaactagctgccccgcgaccgacgctgaaactgcctccgagggaagcgttgaaagcgccagtgagactcgatcaggaccgcagagcgcctccacagccgtgaaagagagacccgcatctagtgaaaaagtgaaaggcggtgatgatcacgacgacactagtgattccgatagcgacggcctgaccctgaaggaactgcaaaaccgtctgcggcggaaacgcgagcaagagcccacagaaaggccgctgaagggcatccaaagcaggctacggaaaaaaagaagagaagagggtccagccgagaccgtgggatcagaggcgagcgataccgtggagggagtgctgcccagcaaacaagaaccagaaaacgaccagggtgtggtttcacaagccggcaaggatgaccgggagtccaagcttgaaggtaaggctgcccaggatatcaaagatgaagagcccggtgacttaggccgcccaaaacccgagtgcgaaggatatgaccccaatgctctgtactgtatctgccgccaaccacacaacaaccgcttcatgatatgctgtgatcgctgtgaagagtggtttcacggcgactgcgtgggtatatccgaggctagaggccggctgttggagagaaatggggaggactacatctgtccaaattgcacgatcctgcaagtgcaggacgagacccacagtgaaacagccgatcaacaagaggctaagtggagaccgggtgacgccgacggcacagactgcacatcaattggcactattgagcagaagtccagcgaggatcagggcatcaaaggaagaatcgagaaagcggctaaccccagcggcaaaaagaaactgaaaatcttccagcccgtgatcgaggcccccggagcatccaaatgtatcggccccggttgctgtcacgtcgcccagcccgactccgtctattgttccaacgactgcatcctgaaacatgccgccgctacaatgaaatttttatcttctgggaaagagcagaaacccaagcccaaggaaaagatgaaaatgaagcccgagaagcccagcctgcccaaatgcggagctcaggcaggtattaaaattagctcggtacacaaacggccagctccagaaaaaaaagagactacagtgaagaaggctgtcgttgtccccgcccgcagcgaggccctcggcaaagaggctgcatgtgagagtagcacaccctcctgggcctcagaccataactataatgccgtgaagccagaaaagacagcagccccgtcaccatctctcctctacaagtccaccaaagaagatcggagatccgaagagaaggcagcagctatggcagccagcaaaaaaactgctcctccagggtcagctgtgggaaagcagccagctcccaggaacttggtacccaagaagtctagcttcgctaacgttgcagccgctacccccgctatcaagaagcccccgagcggctttaaagggactattccaaagcggccatggctttccgcgactccaagttccggagcttcagccgccagacaggccggaccagctccagctgccgcaacagccgcttcaaaaaaattccccggatcggcagcactagtaggtgccgtgaggaaacctgtggtaccctccgttcctatggcctccccggcacccggcagactgggcgcaatgtctgccgccccctcacaacccaacagtcagattcggcagaatatcagaagaagtctgaaagagatcctgtggaagagggtaaacgactctgatgacctgattatgacagaaaacgaagtgggtaagattgccctgcacattgaaaaagaaatgttcaacttgttccaggtgacagacaatcgctacaaatctaagtatcgcagtattatgttcaatctcaaggaccctaaaaaccaaggcctgttccatagggtgcttagggaagaaatatctctagcgaaactagtgcggcttaagcctgaggagctggtgtctaaagaacttagcacttggaaggagagaccagctagatctgtaatggagtcccgtacaaagctgcacaatgagtctaagaagaccgccccccggcaggaagctatcccagatctggaggacagcccccccgtgtctgactccgaagaacagcaggaatccgcccgtgccgttcccgagaaaagcaccgccccattgctagacgttttttcctcgatgctaaaagacaccacatcacagcacagggcccatttattcgacttgaactgtaagatttgtacaggccaggttccctcggctgaagacgagccggctcctaagaagcagaagctttcagccagcgtaaaaaaagaggatctcaagtccaaacacgattctagtgctcccgatcccgctccagattcagctgatgaagtaatgcctgaggctgtccccgaagtcgcatcggagcctggccttgaatcagccagccatccaaatgtcgatcgcacatatttccctggcccgccaggggatgggcatcctgagccatcccctctggaagacctgtccccctgccctgcttcctgtgggtctggcgtggtgaccaccgtaaccgtgtctgggagagacccgcgcactgctccgagctcttcctgcacggccgtcgcctcggccgctagccgaccagatagcacccatatggtcgaggctcggcaagatgtcccaaaaccagtgttgacctctgtgatggtgccgaagtccatccttgcgaagccttcctcaagccctgatcccagatacctgtccgtgcctccatcacctaatatttcaactagtgaatctcgaagtcccccagagggcgatactacactgttcctcagcagactcagcacgatttggaagggcttcatcaatatgcagtcagtagcaaagttcgtgaccaaggcatatcccgtctcaggatgcttcgattatctgagcgaggacttgcctgacacgattcacataggcggaaggatagcccccaaaacagtttgggactatgttggaaagcttaagagctcagtgtcaaaagagctttgtttgataagatttcaccctgctactgaagaagaggaagtcgcgtacatctcattatatagctatttttcttcgagaggcagatttggcgtcgttgcaaacaataacagacatgttaaagacctctatctgatccccctgtcggcccaggatcctgtgcctagtaagctgctgcccttcgaaggccccggactggaaagtccacggcctaatataatattgggcctcgtcatttgtcagaagataaaacgccccgccaatagcggcgagttggataagatggacgagaaacgtaccagactccagccagaggaggctgacgttcctgcttaccccaaggtcgcaacggtgccacaatccgaaaagaaaccctcgaaatatccgttatgttccgcggacgcggcggttagcacaaccccaccaggaagccccccgccacccccacccctccccgagcctccagtgctcaaggtccttagttcactcaagccagcggccccttcccctgcaaccgccgccaccaccgctgcggctgcctcaaccgccgccagttcaactgcaagtagcgcctcaaaaaccgctagcccacttgagcatatcctgcagacgttgttcggaaaaaaaaaaagcttcgaccctagtgcgcgtgagcctccaggctctactgccgggctgccacaagaacccaagaccactgcagaagatggggtccctgcccctccgctcttggaccctatcgttcagcaatttgggcagttcagcaaagacaaggcccttgaggaggaggaggacgatagaccctacgacccggaggaggagtatgacccggagagagccttcgacactcagttagttgaaagaggacgaagacacgaggtagagagagcccctgaagcagcagccgctgagcgtgaagaagtcgcgtacgatcccgaggacgagacgatcctggaggaagccaaggttactgtagatgaccttcccaaccggatgtgtgcagatgttcgaaggaactctgtggaaaggccggcggaacctgtcgccggcgcggccaccccaagcctggtggagcagcagaaaatgctcgaggaacttaacaagcagattgaagaacagaaacgtcagctcgaggagcaagaagaggcactcagacagcagcgagcagccgtgggcgtgtcgatggctcacttttcagtgtctgacgccctcatgagccctcctcctaagagcagcctccccaaggcggaacttttccagcaggaacaacagagtgccgacaagcccgcatccctgcccccagcttctcaggcttcaaaccacagagatcctagacaggctcggagactggccaccgagaccggggagggagagggagagcctctgagccgactgtctgcgcgcggcgcacagggcgccctccccgagcgcgatgcatctcgaggtggcctagttggtcaggcccctatgccagtcccagaggagaaggagccagcgagcagtccatgggcttctggtgagaagccccccgccggttccgagcaggacggctggaaggccgaaccgggagaggggacccgtccagcaaccgtgggcgattcatccgcacgtccagcccgcagagtgcttttaccaactccaccttgcggcgcgctgcagccaggattcccacttcagcacgacggagagcgggatccttttacttgtcccgggttcgccagccaggataaagccttgggatctgcacagtacgaggatccacggaatctgcactctgctggtagatcttctagccctgctggggagacggagggcgaccgcgaaccacaggctaggcccggcgagggtacagcaccactccccccaccaggacagaaagtcggagggagccagccaccctttcaggggcagcgggaacctggtccccatgcactggggatgagcggcctgcacggtccaaacttcccaggtccacgggggcccgccccccctttcccagaggagaatatcgcttcgaatgacgggccgcgcggtccacctcctgcaaggttcggagcacagaagggacccataccttcattgttcagtgggcaacacggaccacctccctacggcgactcacgaggaccttcccctagttaccttggaggtccccgcggcgtggccccctcccagttcgaagagaggaaggatccccatggtgagaagcgggagttccaagacgccccatacaacgaagtgactggagcccccgctcagttcgaagggaccgaacaagcccccttcctggggtctagaggtggagccccctttcaattcggcggacaaagacgtcctctgttaagtcagttgaaaggtccccggggaggaccaccccctagtcaattcggcggacagcggggtccacctcccgggcattttgtcggaccccggggcccacatccctcccagtttgaaacggccagaggaccccaccccaatcaatttgaaggtcctcgaggccaagctcccaattttatgccgggacctaggggaatccaaccccagcagtttgaggatcagcgagtccacagcccacccaggttcaccaatcagagagcgcccgctccccttcagttcgggggccttcgcggctccgcaccattcagtgagaagaatgagcagacacctagtcgttttcatttccaagggcaggcaccacaagtcatgaaacccggacctaggcccctgctcgaactgccttctcacccgccacagcaccgcaaagaccgttgggaggaagccggccccccctcagccctcagtagcagtgcccccgggcagggcccagaggccgacggccaatgggcatccgccgatttcagggagggcaaaggtcacgagtaccggaatcagacctttgaaggccggcagcgcgagcggtttgatgtgggccctaaggaaaagcctctggaggaacccgatgcacagggaagagcctcagaggatcggcggcgggaaagagagcggggaaggaactggtccagagagagagattgggacagacccagagaatgggatcgacacagggacaaggactccagcagggactgggaccgcaatcgcgagcgctccgcgaaccgtgaccgggaacgggaagcagaccgaggtaaagaatgggaccgttcacgcgaaaggtcccgcaaccgggaaagggagcgggaccgtagacgggatcgggatagatcacggtctagagaacgagacagggacaaagcaagagaccgggagcgggggcgcgaccggaaggatcgctccaagtctaaggaaagcgcccgggatccaaaacctgaggccagtcgcgcttccgacgccggtaccgcctcccaggcctag

SEQ ID NO: 14015 - DNA, 1635 bp, Artificial Sequence
  Description of Artificial Sequence: Synthetic coding sequence
atggatgacaagggcgaccccagcaacgaggaagcaccaaaagctattaaaccgacgagcaaagaattcagaaaaacctgggggtttcggaggacgaccattgccaagcgtgagggagccggcgacgcagaagctgacccattggagcctcctcctccgcagcagcagctggggctgtccctgcggaggtccggccgacaaccaaaacggacagagagagttgaacagtttctaacaattgctcgtaggaggggaagaagatccatgcccgtgagcctggaagacagcggggaacctacctcgtgtccggccacagacgccgaaaccgcaagtgaagggagtgtggagtccgcaagcgagactcggtcaggcccccagagcgctagcaccgccgtcaaggaacgtcccgctagctcagagaaagtcaaagggggtgacgaccacgatgatacctctgactcagactccgacggtttgacccttaaagagttgcagaatcggcttcgtcggaagcgagaacaagagccaaccgagaggcccctcaagggaattcaatcacggttgaggaagaaacgacgcgaggagggcccggccgagacagtcggcagcgaggcgtccgacaccgttgaaggcgtgctgccatctaagcaggaaccagaaaatgatcagggggtggtttcccaggccggtaaagacgaccgagagagtaagcttgaggggaaggctgcacaagatattaaagatgaggagccgggggaccttggcagacccaagccggagtgtgaaggctacgatcctaacgcactctattgcatctgccgccaaccacacaataataggttcatgatttgctgtgatcgctgcgaggaatggttccacggagattgtgtcggaatttcagaagcccgcggccgcttgctggaaagaaacggagaggactacatatgcccaaattgcacaatactccaagtacaggatgagacccatagcgagaccgcggaccaacaggaggcaaagtggagacccggagacgccgacggcacggactgtacaagtattgggaccatcgaacagaaatctagtgaggatcaaggtattaagggacgtatcgaaaaagccgctaatccttcagggaagaagaaactgaaaatcttccagcctgtgatcgaagctcccggtgcatcaaaatgcatagggcctggttgctgtcacgtggcacagccggatagtgtgtattgtagtaacgactgcatactcaagcatgccgccgccaccatgaagtttttatcaagcggaaaggagcaaaagccgaagccaaaggaaaagatgaagatgaaaccagaaaagcccagcctgcccaagtgtggagctcaagccggcattaaaataagttcagtccataaaaggccggcccccgagaaaaaggagacaaccgtgaagaaagccgtcgtggttccagctagaagtgaagccctggggaaagaggccgcgtgtgagagcagtaccccctcctgggccagtgaccataattataatgcagtcaagcctgaaaagacagccgcgccttctcccagcctgttgtacaagtgctcgggaaagtatagctattccctacacccatcactgattgcatag

SEQ ID NO: 14016 - DNA, 1164 bp, Artificial Sequence
  Description of Artificial Sequence: Synthetic coding sequence
atggaaagaccccctccgagagcagccggcagagaccccagcgcattgagggctgaagcaccatggctgcgcgccgaagggcccggaccacgggccgcccctgtgacagttccgacaccgcctcagggttcaagcgtcgggggcgggttcgcgggtctagagtttgctaggccacaggagtctgagcccagagctagcgacctgggagcacctagaacttggacaggagcggcggccggcccacggactccgtcagcccatattcccgttccggctcagcgagccaccccaggcaaagccagactggatgaagtgatggccgcggccgcgctgacatcactctccacatcacctctcctgctcggggccccagtggctgcatttagcccagaacctggtctagaaccttggaaggaggcgcttgtgagacctccaggttcatatagctccagctccaatagcggagactggggctgggacctcgcttcagaccagagttctccatccactccttcacctcctctgccaccggaggccgcccattttctcttcggggagcccacactcaggaagcggaagtctcccgcccaagtcatgttccaatgtctgtggaaatcttgcgggaaggtgctgtccaccgcttccgccatgcagagacatatccgtctcgtgcatctcggcaggcaggccgagcccgagcagagtgacggggaggaggacttttactataccgagctggatgtgggggtggacacgctgaccgacggactgtccagtctgactccagtgtccccaactgcctccatgccccctgcatttcctcggcttgagctcccagagctattggagccccccgcacttccctcccccttgcggcccccagcccctccgctgccccctccaccagtgctgtccacggtggctaacccgcaatcttgtcacagcgacagagtttaccagggttgcctcacacctgcccgactggagcctcagcctacagaagttggtgcctgtcccccagccctttcgtcaagaattggcgtaaccctgaggaaacccaggggggatgcaaaaaaatgccgaaaagtgtacggtatggagaggcgggacctctggtgcaccgcttgcaggtggaagaaggcttgccagaggtttctggattag

SEQ ID NO: 14017 - DNA, 414 bp, Artificial Sequence
  Description of Artificial Sequence: Synthetic coding sequence
atgttacggttttgcgccggcctgagtgacttcgcaccggtggctgtgcgttctctgcaggatctggcacgaatagcgataagaggcactatcaaaaagatcatccaccaagagacagtctctaaaaatgggaacggtcttaagaatacgccccgctttaagcggagaagggtccggaggagacgcatggaaaccatcgtgtttctggacaaagaggtattcgccagtcggatcagtaatccctctgatgataactcctgcgaggacctggaagaagagagacgcgaagaggaagagaagaccccaccagaaactaaacccgaccctccagtgaatttcctcaggcaaaaggtattgtcactgcccctacctgacccattgaaatattacctcctgtactatagagagaaatag

SEQ ID NO: 14018 - DNA, 2505 bp, Artificial Sequence
  Description of Artificial Sequence: Synthetic coding sequence
atgagactactcgatggcaaacagaccagtcgttattcggagaacgcctgcgaaaagaagatcttctcaatttacggccactatcctgtcgtgagagctgctctgcgacgcaaaggatgggtggaaaaaaagtttcacttcctgcctaaagtgatacccgatgtggaagatgaaggtgctcgggtaaacgatgatacgtgtgccaaggtcaaagagaaccaggaaatggcactcgagaagacggacaatatccacgacgtgatgagccgccttgtaaagaacgagatgccatatctcctgtggacaatcaagagagacatcatcgactaccatagcctaacctacgaccagatgctgaatcactacgctaagactgcctctttcaccacaaagataggactctgcgtgaacatgaggtcactcccttggtacgttcccgcaaacccagattcattcttccctagatgttatagcctttgcaccgagtcagaacagcaggagtttcttgaggacttccgcaggactatggcttccagcatactgaagtgggtggtgagtcatcagtcatgctcaagatcttcacgcagtaaaccccgcgaccaaagggaagaggccggcagttccgatctatcatcgcgacaggacgccgagaacgcagaagctaaactcaggggactacccgggcagctagttgacattgcctgcaaagtttgccaggcttatctgggccagctggaacacgaggacatcgacaccagcgccgatgccgtggaggatcttactgaagctgaatgggaggacctcacccagcagtactattctttggtacaggtccctctgggctcatccatcgtactgtgcatctttaagattcagaaggtgatgatgtcctttgagccgcccacagccagggatcgacagtgtcaagccctgcttaaccgtattactagcgtaaatcctcagacagacattgatggattacggaatatatggatcattaaacccgcagctaagagcagaggcaggggggagagtcctgatatcgtgtgtatggatcgcgtggaggaaatccttgagctggcagccgcagaccatccactgtcacgggacaacaagtgggtggtgcagaaatatattgagacacctctgctaatctgtgatacaaagttcgacatcagacagtggtttcttgtgacagattggaatcccctcacaatttggttttataaggaaagctatttgcggttttcgactcaaagattttccctggacaaactggatagcgcaatccacctttgcaacaatgctgtgcagaaatacctaaagaacgacgtgggacgaagccctttactccccgctcataacatgtggacatccacacgctttcaagaatacctccaaagacagggtaggggcgctgtgtgggggagtgttatctacccaagcatgaagaaggccatcgcacatgctatgaaagttgcccaggaccacgtcgaaccgaggaaaaattcatttgaactgtacggggctgacttcgtgctgggccgagacttcaggccttggctgatcgaaataaactcctcacccaccatgcacccttccacccctgttactgcacagctctgcgcacaggtccaggaggacaccatcaaggtagccgtagaccggagttgtgatatagggaatttcgaactgctttggagacagccagtggtggagccaccccccttttccggatccgatttgtgcgtcgcaggggtatctgtacgtcgtgcccggagacaagtgctcccagtctgtaacctgaaggcaagcgcctccctcctagacgcgcagccgttaaaagcccgcggaccaagtgcaatgcccgatcccgcccagggtcccccgtcccctgcacttcagcgcgatctggggctcaaggaagagaaggggctaccactggcactgctggcacctctgcgaggcgctgcagaaagcggtggggcagcccagcctactcgtacaaaggcggccgggaaagtggaactcccagcgtgtccctgcagacacgtggacagtcaggcccccaatacgggcgttcccgtggctcagcccgcgaagagctgggaccctaatcagctgaatgcgcacccgttagagccagtgctacgcggactgaagaccgctgagggcgcactccggcctccgccgggggggaagggtgagggtactgtgtgtagtaggctgcctcatcatggccatcacgtggctgcttgtcagacaactgggacaacatgggatgggggccccggcgtatgcttcctcagacagcttctggcttcggagctacctatgggtccagggctgccacgtgatccccgcgcgccaccctgtctcgtatgtcgcggtctgctcccccccgcggggccttgtaaacgctgcaggtctttttgcgcggctgtgctgcagggggcctccttcgtacgtctcggaggccggagctgctcacccaggaccccttag

SEQ ID NO: 14019 - DNA, 759 bp, Artificial Sequence
  Description of Artificial Sequence: Synthetic coding sequence
atgtgcagtacttccggctgtgatctggaggagatcccactcgatgacgacgacctgaacacaatcgaattcaaaattttggcgtattatacccgacaccatgtgttcaagtccacacccgccctgttctcccctaaactgctgaggacacgtagcttatctcagagaggactgggtaattgctccgcaaacgagtcctggacagaggtgtcctggccatgcagaaactcccagagctcagaaaaagcaatcaatctcggaaaaaaaaagagcagctggaaggcattttttggtgtggttgaaaaggaggactcccaatctacaccggcgaaagtttccgcccaagggcaaagaacactggagtatcaagatagccatagccagcagtggtctcgctgcctgtctaacgtcgaacaatgtctcgaacacgaagccgtagatccgaaggtcattagcattgctaaccgggtggcagagattgtctacagctggcctccaccccaggccacgcaggcaggagggttcaagagcaaggaaatattcgtcactgagggattgagctttcagctccagggacacgtgcccgtggcttcttcgtccaagaaagacgaagaggagcaaattctggcaaaaatcgtggaacttctgaagtacagtggtgatcaacttgaaagaaaagacaccgcatttatccctatcccactcgttgacacatcaattcagggttttccccaggacggcttaatggcctgtatatag

SEQ ID NO: 14020 - DNA, 261 bp, Artificial Sequence
  Description of Artificial Sequence: Synthetic coding sequence
atgtccttacccctcaatccaaaacccttcctgaatggattgaccgggaagcctgtcatggtgaagttaaagtgggggatggagtataaaggttatctggtgtccgttgacggatacatgaacatgcagctggctaacacagaagagtatatcgacggggcactctccgggcatctcggggaagtattaatcagatgcaacaatgttttgtatatcaggggtgtcgaagaggaggaagaggacggagaaatgcgggagtag

SEQ ID NO: 14021 - DNA, 1281 bp, Artificial Sequence
  Description of Artificial Sequence: Synthetic coding sequence
atggcctcagggcattccctcttgctagagaacgctcagcaggtggttctggtgtgcgcccgaggcgaaagattcctagcacgcgacgcccttagaagcctggccgtgctggagggtgcctcccttgtcgtaggcaaggacggatttattaaggccatagggccagctgacgtgattcagcggcagtttagcggcgaaacattcgaagaaattattgactgctctggaaagtgcattcttcccggcttggtggatgcccacactcaccctgtgtgggcaggagagagggtgcacgagtttgctatgaagctcgccggggcaacctatatggaaatccaccaagcaggtggcggtattcacttcacagtggagaggacccggcaggcgacggaagaagagctgttcagatctctgcagcaaagacttcagtgcatgatgagggctggcactaccctggtggaatgtaaatctggctacggcttagacctggagacagagcttaagatgctccgggtgatcgaaagggcgcgacgggagctggatatcggtatttccgctacctattgcggtgctcattctgtcccaaaaggaaagaccgccaccgaagctgcggatgacattatcaataatcatttgcctaaactcaaagaactgggccgtaacggggagattcacgtggataacatagatgttttctgcgaaaagggcgtttttgatctggacagcaccagacggatcctgcagcgaggcaaggatattgggctacaaatcaactttcacggagacgagctgcatccaatgaaggccgccgagctgggcgccgagctaggagctcaagccatctctcacctcgaggaggtgtctgacgaggggatagtcgcgatggcaactgcccgctgttccgcaatactgctgcccaccactgcctacatgctcagactcaagcagcccagagcccggaagatgctggacgaaggagtgattgtagcattgggcagtgactttaatccgaatgcatattgtttttcaatgcccatggtgatgcatcttgcatgtgttaacatgaggatgtcaatgcctgaggccctcgcagcagccaccataaatgcagcgtacgcactcggaaagagccacacgcatggcagcctggaggtaggcaaacagggggatctgataataattaactccagtaggtgggagcaccttatttaccaattcggagggcaccacgaactgattgagtatgtgattgccaagggaaagctgatatacaaaacttag

SEQ ID NO: 14022 - DNA, 1263 bp, Artificial Sequence
  Description of Artificial Sequence: Synthetic coding sequence
atgttttcacccggccaagaggagcactgtgcccctaataaagaacccgttaagtatggagaactggtcgtgctcgggtataacggtgctctgcccaacggagataggggcagacgaaagtctcggttcgcactgtataaacgacccaaggctaacggagtcaagccttccacagtacacgtcatcagcacaccgcaggcatccaaggcaataagctgtaaggggcagcatagcattagttacactctgagccggaatcaaaccgtggtagtcgaatacactcatgacaaggatactgacatgttccaggtaggacgatcgaccgagtcacccattgactttgtcgtgactgacacaatatctggcagccagaataccgatgaggcacagatcacccagagcacaatcagccgatttgcatgccgaattgtctgcgataggaatgagccttacacggctcgcatcttcgctgccggctttgacagcagtaagaatatctttctcggagagaaggccgctaagtggaagaacccagacggccacatggatggactgaccaccaacggcgtgctggtgatgcatcctcggggaggcttcacagaggaatcgcagcctggcgtgtggagggagatttccgtgtgcggcgatgtgtatactttgagggagacaagatccgcccagcagaggggaaaattagtggaatcagagaccaatgtattacaggatgggtctttgattgacctgtgcggggctaccctgctctggcgcaccgcagatgggctgttccacacaccgacccaaaagcatatcgaggccctgagacaggagatcaacgcggcaaggccccagtgcccggtaggactgaatacgctggcatttccctccatcaaccgaaaagaagtggtggaggagaagcagccttgggcctatctaagttgtgggcacgttcacggctaccataattggggccacagatcagacaccgaagccaacgaaagggagtgcccaatgtgtcgcactgtgggaccttacgtgcccctgtggctgggatgcgaggccggtttctacgtcgatgccggaccacccacccatgcgtttactccgtgcggtcacgtctgcagcgagaagagcgcaaagtactggagccagatacctttacctcatggcacccacgccttccatgcagcctgccccttctgcgcaactcaactggtgggagaacagaactgcatcaaactcattttccagggtcccattgactag

SEQ ID NO: 14023 - DNA, 1056 bp, Artificial Sequence
  Description of Artificial Sequence: Synthetic coding sequence
atgatcgtacagagggtagttctgaattcccggcccggtaaaaacggcaaccctgtggccgaaaatttcaggatggaggaggtctacctgcctgacaacataaacgagggccaagtgcaggtccgcaccctgtacctgtccgtggatccttatatgaggtgcagaatgaacgaggacacgggcaccgactacattacaccctggcagctgtcacaggttgttgatggcggggggattggtatcattgaagaatccaaacatacaaaccttaccaaaggggatttcgtgacctctttctactggccctggcaaacgaaagtaatactcgacggcaactctcttgagaaggtcgacccacaactggttgatgggcacctgagttacttcctgggtgcaataggcatgcccggactaacttccctcattgggatccaagaaaagggccatattactgctggctccaataaaaccatggtggtctcaggcgccgcaggggcttgcggctccgtggccgggcaaatcggacattttttggggtgcagtcgggttgtggggatttgcggcacccacgaaaaatgcatcctcctaacatccgaacttggcttcgacgccgctatcaactacaagaaagataatgttgctgaacagttaagggaatcttgcccggctggggtagatgtctacttcgataacgtcgggggcaacatcagcgacaccgtcatatcacagatgaatgaaaacagccacataatactatgcgggcagatctcccagtacaacaaggacgtcccttatccgcccccacttagccccgcaatcgaggcaatccagaaggagaggaacattacaagagagcggttcttggtactcaattacaaagataagtttgaaccaggcattcttcagctgtcccaatggttcaaggaggggaagctgaaaattaaagaaacagtgatcaatggactggaaaacatgggagcagccttccagtcgatgatgactggaggaaatattgggaagcagatagtgtgcattagtgaagaaatctcactgtag

SEQ ID NO: 14024 - DNA, 2172 bp, Artificial Sequence
  Description of Artificial Sequence: Synthetic coding sequence
atggccgaggaagaggagacggccgccctgaccgaaaaagtgatcaggactcagcgggttttcattaatctcttggactcttatagcagcggcaacataggaaaatttctgtctaactgtgtggtaggcgcttccctggaggagataacggaggaggaggaggaggaggacgaaaataaaagcgcgatgctagaggcgtccagcaccaaggttaaggaggggacgttccagatagtcggtaccctctcaaagccagattctcctcggcctgactttgctgtggagacttatagtgcgatttccagagaggacctgcttatgaggcttctcgaatgcgacgtgataatatataacataactgaaagtagtcagcagatggaggaagcaatctgggccgtctcagcactgagtgaggaagtctcgcattttgagaagcggaagttgttcattttgctttcaacggtgatgacttgggcccgcagtaaggccctggacccagaggatagtgaggtgcccttcacagaggaagactaccgccggaggaaaagccacccaaacttcctcgaccatattaacgccgagaagatggttctgaagttcggcaagaaagcccgaaagttcgccgcctatgtcgttgccgctggtttacagtacggagcagaaggcggaatgctgcacacgtttttcaagatggcctggcttggggagatccccgccctcccagtgtttggagacggtaccaatgtgatcccgacaatccacgttctcgacttagctggtgtgattcagaatgtgattgaccacgtgcctaaaccccattatctagtcgcggttgacgagtctgtacacaccttggaggacatcgtgaagtgtatctccaaaaatacaggccctggcaagattcagaaaatcccaagagaaaacgcgtacttaacaaaagatcttacccaggactgtctggaccaccttctggtcaatctcagaatggaggccttgttcgtaaaggagaactttaatattcgttgggccgcccagactggatttgtcgagaatattaacaccatcctaaaggagtacaaacagtcgagggggctgatgcctatcaagatttgcattctgggccctccagccgtcgggaagtcatccattgctaaagagctagccaactactataaattgcaccacattcagttaaaagacgtgatttccgaagccatcgctaaactggaagccatcgttgcccccaacgacgtaggtgagggggaggaggaggtggaggaagaggaagaggaggagaacgtagaagatgcgcaggagctgctggatggtatcaaagaatccatggaacaaaatgctggacagctcgacgaccagtacatcatccgcttcatgaaagaaaagctcaagagcatgccctgtagaaatcagggctacattctcgatggttttcccaagacttacgatcaagcaaaggatctctttaatcaggaagacgaggaggaagaagacgatgtgcgcggacgcatgttccccttcgataagctcatcatccctgagttcgtatgtgcgctggacgcatcagacgaattcctgaaggagagggtgatcaatctccctgaatcaattgtggccggcacacattactctcaagatcggtttctgcgggctctaagtaactatcgcgacattaacattgatgacgaaaccgtcttcaactactttgatgagctagagatacatcctatccatatcgacgtgggtaaactagaggatgcccagaaccgtctggccattaaacagctgatcaaggaaattggcgaaccacgcaattatggcttgaccgacgaagagaaggccgaggaggagcgcaaggcagcggaggagagacttgcacgagaggcagcggaggaggcggagcgggagcatcaggaagctgtcgaaatggctgaaaaaattgcgcgctgggaagaatggaataagaggttggaagaggtcaagcgtgaagagagggaactgctagaggcgcagtcaatccctttacggaattaccttatgacttacgtgatgccaactctgatccaggggttgaacgagtgctgcaacgtccgtcctgaggaccccgtcgactttttagctgaatatctctttaagaataatccagaagcgcaatag

SEQ ID NO: 14025 - DNA, 1245 bp, Artificial Sequence
  Description of Artificial Sequence: Synthetic coding sequence
atgcagaccttcctgaaaggaaagcgcgtcggatattggctgtcagaaaagaagattaagaagttgaatttccaggcgtttgccgagctttgcaggaaaagaggtatggaagtcgtacagttaaatctgagtagaccaatcgaagagcaaggtccattggatgtaataattcacaagctcactgacgtaatcttggaagccgatcaaaatgattcccagtccctggaattggtgcatagatttcaggagtatatcgatgcccaccccgagacaattgtcctagatccactcccagccattcgcacgctgctggaccgctcaaagtcttacgagctgattaggaagatcgaggcgtatatggaggatgaccggatatgctcccccccgtttatggaattgaccagcctgtgtggagacgatacgatgcggttgctcgagaagaacggccttaccttcccttttatctgtaaaacacgtgtagctcatgggaccaattctcacgaaatggctatcgtcttcaaccaagaaggactgaatgctatacagcccccgtgtgtcgtccagaattttataaaccacaatgctgtgctttataaggtatttgtggtgggcgagagctacacagtcgtgcaaagaccgtccctcaaaaatttcagcgccggcactagcgatcgtgagtccatcttctttaattctcataacgtgtccaagcctgaatcttcctcagtgttaacagagctcgataaaattgaaggggtctttgaacgcccatcggacgaggtcatccgggagctatcacgagctcttaggcaggccttgggcgtctcgctgtttggcattgacattataatcaataaccagacaggacagcatgcagtcattgacattaacgctttccctggatatgagggcgtctccgaattcttcacagacctccttaatcatatcgccaccgtactccaggggcagagtacagctatggccgcaaccggagacgtagcgctattgcgacactccaagttactggccgaacctgccgggggactggtgggtgagaggacttgttctgcatcaccagggtgttgtggtagcatgatggggcaggacgcaccatggaaggccgaagccgatgccggtggcacagcaaagttacctcatcaaagactggggtgtaacgctggcgtttccccaagtttccaacagcattgtgtggcaagcctggcgacaaaagcatcctctcaatag

SEQ ID NO: 14026 - DNA, 600 bp, Artificial Sequence
  Description of Artificial Sequence: Synthetic coding sequence
atgaggttccgattctgcggggatctcgactgccccgactgggtcctcgcggagatttccacactggcaaaaatgtcttctgtaaagttgcggttgctttgcagccaagtactaaaagaactcctggggcagggaatcgactacgagaagattttaaaactgactgctgatgctaagttcgagtctggggacgttaaggccacagtagcggtacttagttttattctcagctctgccgctaaacattctgtggatggagagagcctctcgtcggagctccaacagctcggcctgcctaaagaacatgctgcgtccctttgccgctgttacgaagagaagcagagccccttgcagaagcatctgagagtttgcagcctccgcatgaaccgtctggcaggagtaggctggcgagtcgactacacactgagctcgagtctgttgcaatccgtagaggagccaatggtgcacctccgtcttgaggtggctgcagcaccgggaaccccggcgcagcctgtggcgatgagtctatctgcggataagtttcaggtcctcttagcagaactgaaacaggctcagaccctcatgtcctctcttggctag

SEQ ID NO: 14027 - DNA, 1224 bp, Artificial Sequence
  Description of Artificial Sequence: Synthetic coding sequence
atgagccatcgtaaattctctgctcccaggcatggccacctgggtttcctccctcataagcggagtcatcggcaccgagggaaggttaaaacgtggcctagagatgatccatctcagccagtgcacctaacagcctttttggggtacaaggctgggatgacccacacccttcgcgaagtccataggcccgggctgaagatatccaaacgtgaagaagtcgaggctgtgaccattgtagagactcccccgctcgtggtcgtcggtgttgtcggttacgttgccactccccgcggtctacgaagctttaagacaatcttcgccgagcatctttctgatgagtgcaggaggaggttttacaaagactggcataaatcaaagaaaaaggcttttaccaaggcttgcaaacgctggagggatactgacggtaagaagcagttgcaaaaagatttcgccgcaatgaagaagtactgcaaagttatcagagttatagtgcacacacagatgaaattgctgccttttaggcagaagaaggcacatataatggagatacagctcaacggaggaacagtggctgaaaaggtggcctgggcccaagctaggctcgagaagcaggtccccgttcactccgtgttctcccagtctgaagttattgatgtgatcgccgtaacaaaagggcgaggtgttaagggggtgaccagccgatggcacacgaagaaactgccacgaaaaacccataagggcctgcggaaggttgcatgtatcggagcatggcatcccgcgcgggtgggctgtagcatcgcaagagctggtcagaaaggctatcaccaccgaaccgaactcaataagaaaattttccgcatcgggcgaggcccccacatggaggacggaaaactggtcaaaaacaatgcctcaaccagttacgatgttactgctaagtctattacccctctgggtggatttccccattacggcgaggtcaacaacgactttgtcatgctgaaagggtgtatcgctggaactaaaaaaagggtaattaccctccgtaagagtctgttggtacaccattcacgccaagccgtggagaacatcgaactcaagttcatagacaccactagtaagtttgggcatggccgctttcagacagcccaggagaagagagctttcatgggaccccaaaaaaagcacctggagaaggaaactccagaaacatccggggatttgtag

SEQ ID NO: 14028 - DNA, 7323 bp, Artificial Sequence
  Description of Artificial Sequence: Synthetic coding sequence
atgtccagttccggttaccccccaaatcagggcgccttctccaccgaacagagccgatatcctccacactccgtgcagtatacatttccgaatacacgtcaccaacaggagtttgccgtgccagactacaggtcttcacatttggaagtgagtcaggcatcgcaactgctgcaacaacagcagcagcagcagttgcggcgccggccttccttactgtcagaatttcaccctgggtccgaccgcccacaagaaagaagaaccagctacgaaccttttcatcccgggccttcccctgtggaccacgattcactggaaagcaaacgaccccgtcttgagcaggtgtcagactcccactttcagcgcgtgtctgccgcagtccttcctctggtgcatccgctcccagagggattgagggccagtgccgacgcgaagaaggacccagcctttggcggtaaacatgaggccccaagctcacccattagcggccagccatgcggggatgatcaaaatgcttcacctagtaaactttcaaaagaggagctcatacagtccatggaccgtgtggatagagaaatagctaaggtcgaacaacagatcttgaaactgaaaaaaaagcagcagcagctcgaggaggaggctgctaagccccccgagcccgaaaagcccgtatccccccctcctgtcgaacagaagcataggtccatcgtgcagataatttacgatgaaaatcgcaaaaaagcggaagaggcccataagatattcgaaggactgggtcccaaggtggaacttccgctgtataaccagcccagcgacactaaggtctatcatgagaatatcaaaaccaaccaggttatgagaaaaaaactgatcctcttcttcaagcggcggaaccacgcccgtaaacagagagaacagaaaatatgtcaaaggtacgatcagctgatggaggcatgggagaagaaggtggatcgcatcgagaataatcccagaagaaaagccaaggagtctaaaacgcgtgagtattatgagaagcagtttcccgagatccgtaaacagagggagcagcaggaacggtttcaacgggtcggacagcgcggagcaggcctttccgccactatcgcccggagcgaacacgagattagcgaaatcatagatggactatctgaacaagaaaacaacgagaaacagatgaggcagctctccgtaatccccccaatgatgttcgacgcagagcagcggagagtcaagtttatcaacatgaatggactgatggaagaccccatgaaggtctataaagatcgacagttcatgaacgtatggactgatcacgagaaggaaattttcaaggataagtttatccagcacccaaagaatttcggcctgatcgcctcctacttggagcgtaaatcggtgcccgactgcgtactgtattactaccttaccaagaaaaacgagaactacaaagcactggtgagacgcaattatggcaagcgtcgtggccggaatcagcagattgccaggccctctcaagaggagaaagtggaggaaaaagaagaggataaagctgaaaagacggaaaagaaggaggaggaaaagaaggatgaggaagaaaaagatgaaaaggaggattcaaaagaaaatactaaggagaaggataagatcgatgggaccgcagaggagactgaggaacgcgagcaagcgacacccaggggccggaaaactgccaatagtcaggggcggagaaagggacgtattacccgctctatgacaaatgaggccgcagctgcctctgctgccgcggccgccgccactgaggaaccccctccacccctgcctccacctcccgaacctatctcgacggagccagtggagacctctcgatggacagaggaggaaatggaagtggccaagaagggacttgtagaacatgggaggaactgggcagccatcgccaaaatggtcggcactaagtccgaggcacagtgcaaaaacttctattttaactacaagcggaggcataacctagataacctcctgcagcagcacaagcaaaaaacctcaagaaagccccgggaggaacgggatgttagccaatgcgaatccgttgcatcaaccgtctccgcccaggaagacgaggacattgaagcgagcaacgaggaagaaaatccagaagatagtgaggttgaggctgtcaagccaagtgaagactcaccggagaatgccacatcaagggggaacaccgagccagcagtagaacttgaaccgactacggagaccgcaccttcaacctccccctccctggcggtaccctccacgaaaccggcagaggatgagtccgtcgaaactcaggtgaatgactctatctccgctgagacagccgaacagatggacgtcgaccagcaagagcacagtgcagaagaaggtagtgtgtgtgaccctcccccggccacaaaggcagattcagtggatgtagaagtgcgagtgcccgagaatcacgcgtcaaaggtcgagggcgataatacaaaagagagagacctggaccgagcaagcgagaaagtggagcccagggacgaggatttagtggtcgcacaacagataaacgcgcaacgaccggagccccagagcgacaacgattcctccgctacttgttccgcggacgaggatgtcgacggtgaacctgaacgacagcgcatgttcccaatggatagcaaaccaagtttgctaaatccaaccggtagcattctggtttctagtcccctgaagcccaacccgctggatctgccccagctgcagcatcgagcagccgtgataccacccatggttagctgtaccccttgcaacatccctattggcactcccgtttcaggctatgctctgtaccagcggcatatcaaggcaatgcacgagagcgcgctgcttgaagaacagcggcaaaggcaagaacagatcgatctggaatgccgcagctctacctccccctgtggcacaagcaaaagcccaaatagggagtgggaggtgcttcagccagctccccaccaggtaatcaccaacctccccgagggggttagactgcccactactcgccctactcgtcctccccctcctttaatcccctcctccaaaaccactgtggcctcagagaagccctccttcattatggggggctccatcagccagggtacacctggaacctatctgactagtcacaatcaggcctcatacactcaggagactccaaagcctagtgtgggcagcatttccctgggcctaccaaggcagcaggagagcgccaagagcgccaccctgccatatatcaaacaagaggaattttccccacgcagccagaattcccagcctgagggcctgctggttagagctcagcatgagggagtcgtgaggggtactgctggggctatccaggaaggcagcatcacgagggggacgcctactagtaaaatttcagtggagagtattccctctctgcgggggtcaataacacaggggacgccagcattgcctcagacaggtattccgaccgaggccctagtcaagggctcaatcagtcggatgccaatcgaggattcctcccctgaaaaaggccgcgaagaggccgcttctaagggccacgttatctatgagggaaaatctgggcacatactctcctatgacaacatcaagaatgccagagagggtacccggtcgcccagaaccgcccacgagatctccctgaagaggagctacgaaagcgttgagggtaacataaagcagggaatgtctatgcgcgagtcccctgtgagtgcgcctttggagggtctgatctgccgcgccctgcctcgagggagtccccattcagacttaaaagaaaggaccgtgctatccggatctatcatgcaagggactccgagggctacgacagaatccttcgaagatggactgaagtaccccaaacagataaagcgcgaatcaccacctataagagccttcgagggggcaattaccaagggcaagccctatgatgggatcacgacaattaaggagatggggcgtagcatacatgagattccgcgacaagatatcctgactcaggagtctcgaaaaaccccagaggtggtccagtcgaccagaccaattatcgaaggtagcatttcccagggaactccgattaagttcgataacaattccggacagtccgcgattaagcataacgtgaaatctctgattactggccccagcaagctgtcccggggcatgcctccactggagatcgtccctgagaatattaaggtggtggagagaggtaagtacgaggacgtgaaggctggggagactgttcgatcgcggcacacgtccgtggtgtcatccggtcctagcgtgttacggagcacattgcatgaagcccctaaagcccagctgagccccgggatatatgacgataccagcgctaggaggacacccgtgagctaccagaacacaatgtcacgtggatccccaatgatgaatagaaccagcgacgtgaccatatcaagcaataagtctaccaaccatgagaggaagagcacattgaccccaacgcaacgggagtcaattcctgcgaagtctccggtgccaggcgtggaccctgtggtgtctcattccccattcgatcctcaccatcggggatccactgccggggaggtttacagaagccatctcccaacgcatttggacccagctatgccttttcaccgcgccctggaccctgctgccgcagcctaccttttccagaggcagctctccccaacacctgggtatccgtcccagtatcagctgtacgccatggagaatacaagacagactatcctcaatgactatataacctcacagcagatgcaggtaaacctccgcccagatgtggcccggggcctaagccctcgggagcagccactggggcttccatatcctgccactagaggtatcatagacctgactaatatgccacctactattctggtgccccacccaggcggaacatcaacccccccaatggacagaattacctacatccctggcacacaaatcaccttcccaccaaggccatacaatagtgcgtctatgtcaccaggacacccgacacatctagctgccgctgcctccgccgagagagagcgcgagagagaacgagagaaggaaagagagcgagaacgcattgcagcagcttcatcagacttatacctcaggccagggtccgagcagccaggacgtcccgggagccacggctatgtgagaagccccagcccaagcgtacgaactcaagagaccatgctgcagcagagaccgtccgtatttcaaggcacaaacggcacaagtgtcatcaccccgttggacccaaccgcgcagctgagaatcatgcctttgcccgccggcggcccatctattagccagggcctaccagcatcccgttacaacacggcggctgatgccctggcggccttggtggatgctgcagccagcgcgccgcagatggacgtctcaaagaccaaggagtctaaacacgaggcagctagattagaggaaaatctgagatcacggtctgccgccgtttccgagcagcagcagctggaacagaagactcttgaagtagaaaagcgatctgtgcaatgcctctacacctcctccgcctttcccagtggaaaaccgcaaccacattctagtgtggtttattccgaagccggaaaagataagggtccacctccgaagtccaggtatgaagaagagcttcgcacccgcggcaagacaacaatcacagctgcaaactttattgatgtaattatcacccggcaaatagcttccgacaaggacgctagggaacgcggcagtcaaagtagcgactccagcagttctctgtcatcgcatagatacgagacccccagcgacgctatcgaagtgatttcccctgcctcatcacctgcaccaccacaggaaaagctgcagacctaccagcctgaggtagtgaaggcaaatcaagctgagaatgaccctactcggcaatatgaaggtccacttcaccactataggcctcaacaggaatctcccagcccccagcagcagctccctccatccagccaggccgaaggcatgggtcaggttccccgtactcatcggctgataaccttggctgatcatatctgtcaaatcatcacgcaggattttgccagaaatcaagtgtcctcacaaacaccccagcagcctccgacatctacttttcaaaattccccctccgccttagttagcactcccgtgcggaccaaaacatccaaccggtacagtcccgaatcccaagcacaatcagtgcatcatcaacggcccggctcaagggtctcaccagaaaatctcgtcgacaagtcgagagggagccggccaggcaagagccctgaacgctcacatgtgtcaagcgaaccatacgaacccatttctccaccgcaggtcccggtggtacacgaaaagcaggattccctactgctactttcacagcggggtgccgagcctgccgaacagcgcaacgacgctcggtctcctggctccatcagctaccttccttccttcttcaccaagctcgagaacacatctcctatggtgaaatccaagaaacaagagatctttaggaagctcaattccagcggggggggggattccgatatggcagccgctcagcctgggacagagattttcaaccttccagccgtgacgacgtccggctccgtgtcctcaagagggcatagttttgcggatccagccagcaatctggggcttgaagatataataaggaaggctctgatgggatcgtttgatgataaggtagaggatcatggcgtggtgatgagccaacccatgggtgtagttcccggaaccgctaatactagtgtcgtaactagtggagagacaagaagagaagagggagatcccagcccacattccgggggggtgtgtaagcctaagctgatttccaagagtaattctcggaaatcaaaatcccctatacctgggcagggttatctgggcacggaaagaccatcatctgtctcctctgttcattcagagggcgattaccacaggcagaccccgggctgggcatgggaggatcgcccaagtagcaccggttccactcaattcccttacaatcccttgacaatgcgtatgttgagcagcactccccctacgccaatcgcatgtgccccttcagctgttaaccaggccgcacctcatcagcagaatcgcatctgggaacgagagcccgctcccttgctgtcagcccagtacgagaccctgtcagatagtgatgactag

SEQ ID NO: 14029 - DNA, 2313 bp, Artificial Sequence
  Description of Artificial Sequence: Synthetic coding sequence
atgctccaacaggtcaatggccacaaccccggctcggacggacaggcccgcgagtatctgcgggaagacctccaggagttccttggaggcgaggtgctgctgtacaaacttgatgacctcacccgcgtaaatcctgttacgctggagactgtcctgcggtgtctgcaagctcggtacatggccgacactttctacacaaacgctggctgtactctggtagcactgaatcctttcaagcctgtgccacagctgtattcccctgaattgatgagggagtatcacgccgctccacagccccagaagctgaaacctcacgtgttcacagtcggagagcagacttacaggaacgtgaagagcttgatcgaacctgtaaatcagtcgattgttgttagcggcgaaagcggcgctggtaaaacctggacctcccggtgtctgatgaagttttatgccgtggtggccacttcccctgctagctgggaatcgcacaagatcgctgaacgcatagagcaaaggatcctgaactctaacccagtcatggaggccttcggcaacgcctgcacactgcgcaataacaactcaagccgcttcggcaaatttatccagctgcagttgaacagggcccagcagatgacaggagctgccgtacagacatacctcttggaaaaaacccgagtcgcctgtcaggcgagttccgaaagaaacttccacattttttaccagatatgtaagggtgcatccgaggacgaacgtttacagtggcacctgcccgaaggcgccgccttctcctggctgcccaaccccgagaggtcccttgaggaagactgttttgaggtgacaagggaagcaatgctccaccttggaatagacaccccaactcagaacaacatattcaaagtgctagccggactacttcatctgggtaatatacagttcgccgcctcagaggacgaagcacagccctgccaacccatggacgatgcaaaatattcagtccgcaccgctgctagtctcttgggccttccggaagacgttctgttagagatggtgcagattagaactattcgcgctggacggcagcaacaagtctttagaaaaccgtgcgcgagagccgagtgcgacacacgcagggattgtttggcaaagctgatttacgccagactgttcgactggcttgtgagcgtgattaactcaagcatttgcgctgatacagacagttggacaaccttcatcggtctcctggacgtgtatggattcgaaagcttccccgacaattcacttgagcagttgtgtattaattatgctaacgagaagttgcaactggaggcctgtggcctggtagaaacaattcacatctccgccgcaggtttccctatcagagttagccaccgcaacttcgtcgaaagatacaagctcctcagacgcctacacccctgtacttcctcgggccccgactctccttatccggccaagggcctccctgagtggtgcccccactctgaggaggccaccctagaaccactaatccaggacatactacacactctgcctgttttgactcaggctgccgccattactggagattctgcagaggcgatgccagcgcctatgcactgtggtcggactaaagtgtttatgactgattcaatgcttgagctgctcgaatgcggtagagctcgtgtcttagagcaatgcgcacgctgcatccagggcggatggagacggcaccgccacagggagcaagagcgtcagtggagagccgtgatgcttatacaggccgcaatcaggagttggctgacccgaaagcatattcagagattacatgctgctgctacagtcattaaaagggcctggcaaaaatggcggatccgcatggcctgcctggcagccaaagaactcgacggcgtcgaggagaagcacttctctcaggctccatgttctctgagcacttcacctctgcaaactaggctcctggaagctattatcaggctgtggcctctcggtctagtccttgccaataccgcaatgggcgtcggctccttccaacggaagcttgtggtctgggcctgtctgcaactgccgcgcggctctccttccagctatacggtgcagaccgcacaggatcaggctggtgtgactagtattcgggctctccctcaaggctcgataaagtttcattgcaggaaaagcccacttcgctatgcagacatttgtcccgaaccttctccttattcaattaccgggttcaaccagattcttctggaaaggcaccgattaattcacgtgacctcaagcgctttcactggactcggatag

SEQ ID NO: 14030 - DNA, 2796 bp, Artificial Sequence
  Description of Artificial Sequence: Synthetic coding sequence
atggctgaagtcgaggctgtgcagctgaaggaggaagggaacaggcattttcagctgcaagattataaagccgcgaccaacagctattcacaggccctgaaactgactaaggacaaagctctcttagccaccctttatagaaacagagccgcgtgcggtctgaaaaccgagtcatatgtgcaggctgcttccgatgcctcgagagcaattgatatcaattcgtccgacatcaaggcattataccggcggtgccaggccttggagcacttgggaaagctggaccaggccttcaaagacgtccagaggtgcgccaccctcgagccacggaaccaaaacttccaggagatgctgagacgccttaataccagcatccaggaaaagctcagggtccagttcagcacagattctcgggtccagaagatgttcgaaatcttattggacgagaactccgaggccgacaagagggagaaggctgccaacaacctcatcgtgctaggcagagaagaggccggagccgagaaaatcttccaaaataacggggtagctctgctcctgcagctcttggacactaagaaaccagagctcgtcctagccgcggttaggacactttcgggaatgtgctcagggcaccaagctagagccacggtgatcttgcatgcagttcggattgacagaatctgttccctgatggctgtagaaaacgaggagatgtctttggcagtgtgcaacctccttcaagctatcattgactctctgtctggcgaggacaaaagagagcatcgggggaaggaggaggcgcttgtgctggatactaagaaagacctaaaacaaatcacatcgcacctgctcgacatgttggtttccaagaaggtgagcgggcaggggagggatcaagcccttaatctactcaacaagaatgtgcctagaaaggacctcgctatacacgataactctcggactatatacgtggtcgacaatggcctgcgtaagatcctgaaggtcgtgggccaggtccccgatcttccctcctgtctgccactgacggataatacacggatgctcgccagcatcctgattaacaaactgtatgacgatctgcgctgcgacccagaacgagatcactttcggaagatctgcgaagaatacatcaccggtaaattcgaccctcaggatatggacaagaatctcaacgcaattcaaaccgtcagcggcatcctgcaaggacccttcgatctgggtaatcagcttctggggctgaagggagtgatggagatgatggtcgccctgtgcggatcagaacgggagaccgatcagcttgtggcagtcgaggccttaatccatgcgtccactaaactgagcagggccaccttcataataacgaacggggtgtctctgttaaaacagatctacaaaactactaagaacgaaaaaataaagatcagaacactggtcggtctttgcaaactgggttctgccggcggcaccgattacggactacgccagtttgccgaaggcagcactgagaaactggccaaacaatgccgcaagtggctctgtaatatgtctattgacactaggactaggcgatgggcagtagaagggctggcctatctgacgcttgatgcggacgtcaaagacgatttcgtccaggatgttcccgccctacaggctatgttcgaactggccaaggcagggacttccgataagaccattctctattccgtcgccactaccctagtgaattgtaccaatagctatgacgtgaaggaagtgatccccgagttagtccaactggccaaattcagcaagcagcatgtgccggaagaacaccctaaggacaaaaaagacttcatcgatatgcgtgtgaagcgcctcctcaaagctggcgtcatttctgccctggcatgtatggtgaaggccgattctgccattctaactgatcagaccaaagagttgctggcccgcgtcttccttgctctttgcgataacccgaaggatcggggcacaattgtggcccaggggggtggcaaggcgcttatccccttggcccttgaaggcactgacgttgggaaagtaaaggctgctcatgctttagccaagattgcggcagtgtcaaacccagacatcgccttcccgggtgagagggtctatgaagttgtgcggcctctggtgcgcttgctggacacccaaagggatggactacagaattacgaagcactcttgggcctgaccaacttaagtgggcggagcgataaattgcgacagaagatctttaaggaaagggccttgccagatattgagaactatatgttcgaaaatcatgaccagctgcgccaggcggccaccgagtgtatgtgcaacatggttctccacaaagaagtgcaggagcgctttctggctgatggtaatgataggctcaagctcgtggttctgctctgcggcgaggacgatgacaaggtgcaaaatgccgctgccggagctctggccatgctgaccgccgcgcataagaagctgtgtttgaagatgactcaggtaaccactcagtggttggaaatcctccaacggttgtgtctccacgaccaactctccgtccagcaccgcggcctggtgatcgcttacaatctgttggccgctgatgcagagctagcaaagaagctggtagagtccgagctgcttgagattctgaccgtggttggcaaacaggaacctgacgagaaaaaggctgaagtagtgcaaacagcgcgggaatgtctgataaagtgtatggactatggttttatcaagcccgtctcttag

SEQ ID NO: 14031 - DNA, 2022 bp, Artificial Sequence
  Description of Artificial Sequence: Synthetic coding sequence
atggccagtcagttttgcctgcctgagtctccctgtctgtctccactcaagccactgaagcctcattttggtgacatccaggagggaatttacgtagctatccagcgctctgataagcgaattcaccttgccgtcgtgacagagatcaatcgcgaaaactactgggttacagtcgaatgggtggagaaagcagtcaagaaaggaaaaaagattgacctggaaaccatcttactcctcaacccggcattagatagtgctgaacatccgatgcccccccctccactgtccccactggcactagcccccagctcagctattcgggaccaacgcactgcaactaagtgggtggccatgataccacaaaagaatcagacagcaagcggggacagtctcgacgttcgtgtgccttctaaaccttgcctaatgaaacaaaaaaagagtccctgcctgtgggagatacaaaaacttcaggaacagcgcgaaaagaggcgccggctgcagcaggaaattcgggcacgaagagccctggacgtgaatacccgcaaccccaattacgagattatgcatatgatcgaggaatatcggcgtcaccttgattcttcaaaaatctccgtgcttgagccaccccaagaacataggatctgtgtttgcgtgcggaaaagaccactgaaccaacgcgagaccaccctgaaggatcttgatattatcaccgtccccagtgataatgtggttatggtgcacgaatctaaacagaaggtggacttgacccggtacctgcagaatcagactttctgctttgaccacgcatttgacgataaggccagtaatgaactggtctatcagtttaccgctcagccgctggtcgagtctatctttcgaaaaggaatggccacatgtttcgcctacgggcaaacaggttccggaaagacttacactatgggcggcgacttttccgggaccgcccaggactgctccaaaggcatctacgccctcgtcgcgcaagatgtgtttctgcttttgcggaattctacatacgaaaagctggacctaaaagtttatggtactttttttgagatctacggcggcaaggtgtatgacctgctgaactggaagaagaagttgcaggtgctggaggatggcaaccagcaaattcaggtggtggggttacaggaaaaggaggtctgctgtgtcgaagaggtacttaacctcgtagagatcggcaattcttgccgaacatcccgccagacacccgtcaacgcacactctagtagatcccacgccgtattccaaattatcttaaaatcgggaagaatcatgcacggcaaattttcacttgtagacttggccggtaacgaacgtggggctgatacaacaaaggcaagtagaaagaggcaactggagggagctgaaattaacaaatccctgctcgcactgaaggaatgcatccttgccctgggccagaataagccgcatacgccattcagagcctccaagctcacactggtgttgagggacagcttcattgggcaaaattccagtacctgtatgatcgctacaatctcacccggaatgacctcttgtgaaaacacgctcaatactctgcgctacgctaatcgggtcaaaaaacttaacgtggacgtgcgcccctaccaccgcggccattatccaattgggcatgaagcaccacggatgctgaaaagccacattggcaattcggagatgtctctgcagcgtgacgagtttattaagattccatacgtgcagagtgaggagcagaaagagatcgaagaggtcgagacccttcccactctgctaggtaaggacactaccatcagcggaaagggaagcagccagtggctggagaatatccaggagagagccggtggagtccaccacgacatagatttttgcattgccaggtctctgagtatcttggagcagaagatcgatgcactgactgagatacaaaagaagttaaaactgctcctagccgatttacacgtaaagtcgaaagtggagtag

SEQ ID NO: 14032 - DNA, 1236 bp, Artificial Sequence
  Description of Artificial Sequence: Synthetic coding sequence
atggctaccacagcgacgatggcaacgtcaggctctgctcgaaaacgcctacttaaggaggaggacatgactaaggtggaattcgagacctctgaggaagttgacgtgacacccacattcgacacaatgggtcttcgggaggacctgctgcggggaatctatgcctatgggtttgagaagcccagcgctattcagcagcgggctatcaaacagatcattaagggcagggatgtcattgcccagtctcagagcggcactgggaagaccgcaaccttcagcatcagtgtgttgcagtgcttggatatccaagttagagaaactcaggctctgattctggcccctacccgggaactcgccgtgcagatccagaaggggttactggcgctgggcgactacatgaacgttcagtgccacgcttgcatcggcggcactaacgtgggtgaggacattcgcaagctggactatggacagcacgtggtggctggcaccccggggagggtttttgacatgatccgtagacgatcgctgagaacccgggccataaaaatgttagtacttgacgaagccgatgagatgttaaataagggcttcaaagagcaaatatacgatgtgtacagatacttgccacccgcaacacaagtggttctcatttcagcaactctcccccacgagatcctggaaatgacaaacaagttcatgactgacccaatacgaatcctagtgaaaagagatgagttgacacttgaggggattaagcagttctttgtcgccgtagaaagggaagagtggaaattcgatacactgtgtgatctgtatgacacactcaccatcacacaggcggttatattctgcaatacgaagcgcaaagttgattggttgacggagaaaatgcgggaggccaactttacggtgtcaagcatgcacggcgatatgccgcagaaggagcgagagtcgattatgaaggagtttagatcaggcgcctctcgagtcctcattagcaccgacgtctgggcacgggggcttgatgtgcctcaggtgagcctcatcatcaactacgacctgccaaataaccgcgaactgtatatacaccgtattggcagatctggccgctatggaaggaaaggagtggccataaacttcgttaagaacgacgatatccggatactgcgggacatagaacagtactacagcactcaaatcgatgagatgcctatgaatgtggccgacctaatctag

SEQ ID NO: 14033 - DNA, 1683 bp, Artificial Sequence
  Description of Artificial Sequence: Synthetic coding sequence
atggaactgcccgctgtgggcgaacacgtgttcgctgttgagagtatcgagaaaaagcggattcggaaagggagggttgagtatctcgtaaaatggcggggctggtcccccaagtacaacacctgggaaccggaagagaacattctggatcccagactgctcatcgcttttcagaatcgcgaacgacaggagcagttaatgggatatcggaaaaggggacctaaacctaagccactcgtcgtccaggtgccaacatttgcacgacgcagtaatgtactgacaggactccaggactcatccactgacaaccgcgctaaactcgatttgggcgcacagggaaagggccagggccatcagtacgagctgaactcaaaaaagcaccatcagtatcagccacactcaaaggagagagctgggaagccccctcccccaggcaaatctggaaagtactactatcagcttaattcaaaaaaacatcacccctatcaacctgatcccaagatgtatgacctccaataccaagggggacacaaggaggcaccttcccctacctgccccgacctgggggccaagtcccacccaccagacaagtgggctcagggcgctggcgcaaagggctacctgggagcagtcaagcccctggcgggcgctgccggcgcaccaggtaaagggagcgagaagggccctccaaatgggatgatgccagctccaaaggaggctgtgaccggcaatggcattgggggcaaaatgaaaatcgttaaaaataaaaacaaaaatggacggatcgtcatcgtgatgtccaagtatatggaaaacggtatgcaggctgtcaagattaaatcaggagaagtggccgaaggtgaggcacggagccccagccataagaagcgggctgctgacgaaagacatcctccagctgaccgcacgtttaaaaaggcggccggagccgaagagaagaaagtcgaggctcccccgaagaggcgcgaggaggaggtgtctggagtaagtgatcctcagcctcaggacgctggcagtagaaaactatccccgactaaggaagcctttggggagcagcctctgcagttgactacgaagcctgacctcttggcctgggaccctgcccggaacacacatccccccagtcaccatcctcaccctcatccccatcaccaccatcaccaccaccaccatcaccatcatgctgtcgggcttaacctgagccatgttcgtaaacgatgtctgtcagagacccacggcgagagggaaccatgcaaaaagaggctgacagcaaggtctatatcaacaccaacatgtctcggtggttccccggcggcagaacggcctgccgatctgccacccgccgccgccttgccccaacctgaggtgatcctgctggattcggatctggacgagccaatcgatctaaggtgtgtgaagacccggtctgaagctggcgaaccgccctcctcattgcaggtgaagccagagacccccgcttcagctgcagtcgctgtagctgccgcggcagcacccacaaccaccgccgaaaagccacccgccgaggctcaggacgaacctgctgagagtttatccgagttcaagccgttctttggcaacatcatcatcacagacgtaactgctaattgtctgaccgttacctttaaggagtacgtcacagtttag

SEQ ID NO: 14034 - DNA, 1218 bp, Artificial Sequence
  Description of Artificial Sequence: Synthetic coding sequence
atggattctctggttactgctaatacaaagttttgttttgaccttttccaggaaatcggaaaagacgatagacacaagaacatcttcttttcacccttgtcactttctgcggccctggggatggtccgcttgggagccagaagcgatagcgcacaccagatagacgaagtcttacatttcaacgaattttcacagaatgaatctaaggaacccgatccgtgcttgaagtcaaataagcagaaagcaggatcccttaataatgagagcggcctggtgtcttgctatttcgggcagttgttgtcaaagcttgatcgcatcaagactgattatactttgagcatcgctaatcgcctgtatggtgagcaggagttcccgatctgccaggagtatctggatggcgtgattcaattctatcatacaacaatcgagagcgtggattttcagaagaatcccgagaagagtcggcaggaaataaacttttgggtcgagtgtcagagccaagggaagattaaagaactgttctctaaagatgcaatcaatgctgaaactgttttagttctcgtcaatgctgtctactttaaagcgaaatgggagacatactttgaccatgagaacaccgtggacgcccctttttgcctgaatgctaacgaaaacaagtctgttaaaatgatgacacagaagggcctgtacaggattggatttatcgaagaggtgaaagctcagattttggaaatgcggtacacaaagggcaaattgagcatgtttgtgctgctccctagtcacagcaaagataatcttaaggggctcgaagagttagaaaggaagataacctatgaaaagatggtggcctggtcaagcagcgagaatatgagcgaagagtctgtggtgctcagttttcctcgattcacactcgaagacagttacgatttgaactccatcctgcaggatatgggaattaccgatatctttgacgagacccgcgcggacctgactggaatcagcccgtctcctaacctttatctctccaaaatcattcataagactttcgtcgaagttgacgagaacggtacacaggctgccgccgccaccggcgctgtggtgtcagagcggagtctcaggagctgggttgaattcaacgctaaccacccattcctgttttttatacgccacaataaaacccaaaccattcttttttacgggcgcgtgtgcagtccgtag

SEQ ID NO: 14035 - DNA, 3537 bp, Artificial Sequence
  Description of Artificial Sequence: Synthetic coding sequence
atgttaagaatgaaacttccattgaagcctactcaccccgctgaaccaccccctgaggccgaagaacccgaggccgacgctcgcccaggggctaaagctccttctcggaggcgacgtgactgccgccctcccccccctccaccaccccctgccggaccctcacgggggccactgcctcccccacccccaccccgcggcctggggccacctgttgccggtggagctgctgctggcgccggaatgcctgggggagggggaggtccgagcgccgccttgcgagagcaagaacgcgtgtatgagtggtttgggctggtccttgggagcgcccaacggctcgagtttatgtgcggactcttggacctctgtaatcctctcgagctgcgtttcctggggagctgtctcgaagatttggctaggaaggactatcactatctgagggacagtgaggccaaagctaatggcctctctgatcccggacctcttgcagactttagggagccggccgtccggagtaggctgattgtatacctcgctctgttggggtcggagaacagagaagcggcaggtagactgcaccgtctgctgccccaggtggactccgttctgaaaagcctgcgcgcggccaggggggaggggagtagagggggggccgaggatgaaaggggggaggacggcgacggcgagcaggacgctgaaaaggacgggtccggccctgaaggcgggatcgtggaacccagagtgggaggaggactgggatcgagggctcaggaagagttactcctcctgtttacaatggctagtttacaccccgcgtttagtttccatcagagggtgacgttacgggagcacttagaacgtctccgcgctgcactgcgcgggggacctgaggatgccgaggtggaggtcgagccgtgcaagtttgctggtccacgggcgcagaacaactctgcccatggtgactacatgcagaacaatgaatcctcactgattgaacaggctcctattccccaggatggcctgaccgttgccccgcacagagcgcagcgggaagccgtgcacattgagaaaataatgcttaaaggcgtacaacgtaagagagcagacaagtattgggagtacacatttaaagtaaactggtcggacctcagcgtgacgacggtgaccaagacacaccaggaacttcaggaatttctgctcaagctgcccaaggaactgagtagcgagactttcgataaaacaatcctgcgcgcccttaatcagggctctctgaagcgtgaagaacgccgacaccctgatttggagcctatcctgaggcaactcttctcgagctccagtcaggctttcctccaaagtcaaaaggtgcacagcttttttcaatcgatctcatctgactctctgcattcaatcaacaatctgcagtctagcctgaagacctctaaaatcttggagcacttgaaggaagactcgtccgaggcttctagccaggaggaggatgtcctgcagcacgcaatcattcacaagaaacacactggtaagtcacctattgtcaacaacatcggcacaagctgtagccccctggatgggctgactatgcaatactctgaacaaaatggaattgtagactggcgtaagcagtcatgtacaactattcagcatccagagcactgcgtcacatccgcagaccaacacagcgcagaaaaaaggtcgttatcctcaattaacaaaaagaaagggaaaccccagacggaaaaggagaagatcaagaagaccgacaacagactcaactcgcgcattaacggcataagattgtctacgccccagcatgctcatggaggaaccgtgaaagatgtgaatctagatatcggctccgggcatgatacttgtggcgaaacctcaagtgagtcctatagttcccccagttccccccggcatgacggacgcgagtctttcgagagtgaagaggaaaaagatagagacacggacagcaacagcgaggactccgggaatccgagcactaccagattcaccgggtacggatcagtaaaccagaccgttacggttaagccaccggtccagattgcctcattagggaacgagaacggcaacttgttggaagatcccctcaactctcctaagtaccagcacatttcattcatgcccacactgcactgcgtgatgcacaatggtgcccagaaaagcgaagtcgtggtgccagctcccaaacccgcggatgggaagacaattgggatgctggtgcctagccccgtggcaatatccgctatccgcgaatccgcaaatagcacccccgtcggcatcttgggccccacagcatgcacaggtgagtcagagaaacacctcgagttgctagcatcccctttacctataccctctacattcctgccacattccagtacccccgccctacacttgaccgttcagagactgaagcttccgccaccccaggggtccagcgagtcttgtaccgtgaacattcctcagcagccgcctggctcgctctctattgcttctcccaacacggctttcatacccattcataatcccgggagctttccgggatcacctgtggccaccacggaccccatcactaaatcagcctcacaggttgtgggtcttaaccaaatggtgcctcagatagagggaaacacgggcacggtcccacagcccaccaatgtgaaagtggtcttacctgccgccgggctgtctgcagctcaacctccagcttcctatccattgcccggctcaccgctggcggccggggtgttacccagccagaacagtagcgtactaagtacagctgcaactagcccacaacctgcttctgctgggatcagccaggcgcaggccaccgttcccccagccgtgcctacccacacaccaggcccagctccatccccttcccctgctttaacgcactcgaccgcacagtctgactccacttcctacattagcgctgtgggtaacacaaacgcaaacgggacagtggttccaccccaacagatgggatcggggccgtgtggctcctgtgggcgtcgatgtagctgcggaaccaacggtaacctgcagttgaacagctactactaccccaatcccatgccagggccaatgtacagagtccccagcttctttaccctgccttccatttgtaatggctcatacttaaaccaggcgcatcagtccaatggcaaccagcttcctttctttctcccccagaccccctatgccaatggcctcgtgcatgatcctgtgatgggctcccaagcaaattacggcatgcaacagatggccgggttcggacgtttttacccagtttaccctgcgccaaatgtcgtggctaatacctctggctcagggccaaaaaaaaatgggaatgtgagttgttacaattgcggagtgtcagggcattatgcccaggattgtaaacaatcatccatggaggccaatcagcaaggtacctatagactgcgctacgcccccccattgccccctagcaacgacaccctggactccgccgattag

SEQ ID NO: 14036 - DNA, 411 bp, Artificial Sequence
  Description of Artificial Sequence: Synthetic coding sequence
atgccaggtaagaaagccagaaagaatgcccagccctcccccgcaagggcgcccgcaggccccgccggtacagctgggactgcccgcgaccaggccggatttgccataggcatgcagcttcggttcacacgcgggaagaagctactcagctcatccctttcatcaagccctttggccctgccaagggggcatgaggaacaggttcaggtagccggttctcgagtatgctactctactcaggagatatggcgccaaaccgagctcccggctgaaacgtccgaatctgatattcagactctccttcttcggaatctgaccgccagcaagacatgcatgcggggtctgctgcagaagagtttcctgcggagatgcacttttcaccagtttgaggaacgcttacactgcaactag

SEQ ID NO: 14037 - DNA, 879 bp, Artificial Sequence
  Description of Artificial Sequence: Synthetic coding sequence
atgaaggccactgttctgatgaggcaaccgggtcgagtccaggaaatagtgggcgcacttagaaaagggggaggcgatcgtcttcaggttatctcagactttgacatgactctgtctaggtttgcatacaacggcaaacgttgccccagctcatataacatcctggacaattccaaaataatttctgaagagtgcaggaaggagctgaccgctctgctgcatcactattacccaattgaaatcgacccccatcggaccgtgaaggaaaagctgcctcatatggtggaatggtggaccaaagcccataacctcctgtgccagcagaagatccagaagttccagatagctcaggtagttcgcgaatccaacgctatgcttagagaaggatataaaaccttttttaacaccctgtatcataataacataccgctgttcatttttagtgccggaatcggcgatatcttagaagagatcatacggcagatgaaggtcttccatcctaatattcacattgtctctaactacatggatttcaacgaggatgggtttctccagggcttcaaaggccagttaattcatacttacaacaagaatagtagtgcctgtgaaaatagcggctacttccagcagttagaagggaagaccaacgtcatcctgctaggcgactccatcggagacctaaccatggcagatggcgtacctggagtgcagaatattctgaagatcggtttcctgaacgacaaagtcgaagaaagacgggaacgttacatggatagttacgacatcgttctcgagaaagatgagacgctggatgtggtgaatggtctgttgcagcacatactgtgtcagggtgtccaactcgagatgcagggtccttag

SEQ ID NO: 14038 - DNA, 2010 bp, Artificial Sequence
  Description of Artificial Sequence: Synthetic coding sequence
atggatctgaggaccgccgtgtataatgccgcccgggacggtaagctacaattgcttcagaagcttctcagcgggagatcacgcgaagagttagatgagttaactggcgaggtggccgggggaggcacacccctgctgatcgccgcccgctacgggcacctggatgtcgtggaatatctggtggaccgctgcggggcttccgtcgaggcaggcggttctgtccatttcgacggcgaaaccatagaaggggccccacccctgtgggccgcatccgccgccggtcacctagacgttgtgagatctctcctgagaaggggcgcctccgtgaacaggactacgcgtaccaattccacccccctgagggccgcctgctttgacggccatctagaggtcgttaggtacctggttggggaacaccaggctgacctcgaagtcgccaatagacacggacacacctgtttgatgattagctgctacaaaggtcaccgggaaatcgctcgctacctgctagaacagggtgcacaggtaaatagaagatcggctaaggggaatacggcactacacgattgcgcagaatccggctctctggagattctccagctgctgctggggtgtaaagctagaatggaacgggatggatacggaatgaccccccttctcgcagcaagtgtgactgggcacaccaacatcgttgagtatctaattcaagagcagcctgggcaggagcaggtcgccgggggcgaggctcaacccggcctgccacaagaagacccatccaccagccagggatgtgcccagccacaaggagccccatgctgcagttcatccccggaggagcccctgaatggagagtcttatgaatcctgttgcccaaccagtcgtgaggcggcagttgaagccctggaactgttgggagccacttacgttgataagaagcgcgatctccttggggcactaaagcactggagacgtgccatggagctgagacatcaagggggagaatatctgccaaagccagagccaccccaactggtcttggcttatgattattctagagaagtcaataccacagaggaactcgaagcactgattactgatccagacgagatgcgcatgcaggcccttctcattcgtgagcgaatcctcgggcctagccatccggatacgtcgtactatatccggtatcgaggtgctgtctatgcggattcggggaattttgaaaggtgtatccgcctgtggaaatacgccttggatatgcagcagtcgaatctggagcccctaagccctatgactgccagctcgttcctctccttcgcagaactgttctcctatgtgctccaggatcgcgccgccaagggctctcttggcactcaaattggtttcgcagaccttatgggcgtgctcaccaagggcgtgagggaagtcgagagagccctgcagctaccccgggagcccggtgatagtgcccagttcacaaaagctctcgccataatcctccatctcctctacctcctggagaaggtcgagtgtacaccctctcaagagcacctgaaacaccagaccgtataccgactgctcaaatgcgcccctcggggcaaaaacggctttacccctctacacatggccgtggacaaagacacaacgaatgttggacggtatcccgtgggacggtttccatcgctgcatgtcgtcaaagtcttgctagactgtggagccgacccagacagccgggattttgataacaacacccccctgcacatcgcagcccagaataactgtcctgccattatgaacgcactcatcgaagcaggagctcacatggatgcaaccaatgccttcaagaagactgcctatgagttgctggatgagaaactgctcgcccgaggaacgatgcagccgtttaattatgtgacccttcagtgtctggcagcccgggctttagacaaaaataagattccctacaaagggtttattcccgaggacttggaggctttcatcgaacttcactag

SEQ ID NO: 14039 - DNA, 720 bp, Artificial Sequence
  Description of Artificial Sequence: Synthetic coding sequence
atggccgcaactctgcttgcagcacggggggccggccctgctcctgcctggggtccagaggcctttacccctgactgggaatcaagggaggtttccacaggaactaccatcatggccgtccaatttgatggaggagtagtgctgggcgcagattcacgcaccacaactggctcttacatagcgaaccgcgtaacagacaaactcacgccaatccacgataggatcttctgttgtcgaagcggctctgcagcagacacccaggccgtggctgatgcagtgacatatcagttagggtttcacagcattgagctgaatgaaccccccttagtgcataccgcagcctctttgttcaaagaaatgtgctaccggtacagggaggacttgatggccggaataatcatcgcaggctgggaccctcaggagggcggccaggtgtatagtgtgcctatgggaggtatgatggttcgccagtcgtttgcaattggagggtccggcagcagttacatttatggatacgttgatgctacatatagggaagggatgacgaaagaagaatgtttacagtttaccgcgaacgcgctagcactggccatggagagggatgggagcagcggaggggtcattcggctcgccgccatcgcagaaagtggcgtggagagacaggttctgcttggggaccagatccctaaatttgctgttgctaccctgccccctgcctag

SEQ ID NO: 14040 - DNA, 1383 bp, Artificial Sequence
  Description of Artificial Sequence: Synthetic coding sequence
atgaatttttccgaggtgttcaagctcagcagcctgctttgcaagttctcccccgacgggaagtacctggcgagctgcgtgcagtacagactcgtggtgcgggacgtgaacacactacagattctccagctgtatacgtgtctggaccagattcagcatatcgagtggtccgctgattctctgtttatcctatgcgcaatgtacaagcgagggctggttcaagtttggagtctcgaacaacccgagtggcactgcaaaatcgacgagggctcagccggcttagtggcctcctgctggagcccggatggtagacatattctgaacaccacagaattccacctgcggattaccgtctggagtctctgcacgaaaagcgtgtcttacattaagtatcccaaggcctgcctacagggaattaccttcacgcgggacggacgctacatggccctcgctgagaggcgcgactgtaaagactacgttagcatattcgtctgttctgattggcaacttttacggcattttgacacagacactcaggatctcaccgggattgagtgggcccctaatgggtgcgtgttagccgtgtgggacacttgcctggagtacaaaattcttctgtactctctcgatggtcgccttctgtccacttattccgcctacgaatggtccctcggcatcaaaagcgtggcatggtcgccttcctctcagtttcttgcggtgggtagctacgacgggaaagtcaggatcctcaatcatgtgacctggaagatgataactgaattcggtcatccagcggcaatcaacgacccgaagatcgtggtctataaggaggctgaaaagagcccccagctgggcttagggtgcctctccttccctccccccagggcgggggctggaccgctcccttccagtgagtctaagtacgagatcgcatcagtgcctgtgagccttcagactctgaagccagtgaccgaccgtgcaaatccaaagattgggatcgggatgcttgcattcagtcctgattcatacttcctggcaaccagaaacgacaacataccaaacgcagtgtgggtgtgggatatacaaaagctcagactctttgctgttctagaacagctgtccccggttagggcctttcagtgggacccacagcagcccagactggccatatgtaccggggggtctcgtctctacttgtggtctccagccggatgtatgagtgtccaggtgccgggcgaaggagacttcgccgtcctaagcttatgttggcacctttcaggagactcaatggccctcctcagcaaggatcatttctgcttgtgcttcttggaaaccgaagcggtggtcgggactgcttgcaggcagctgggcggccacacttag

SEQ ID NO: 14041 - DNA, 282 bp, Artificial Sequence
  Description of Artificial Sequence: Synthetic coding sequence
atgtctggccttcgggtctactcaacatctgtcaccggctctcgcgaaattaagagtcaacagtcggaggtgactcgaattctcgatgggaaacgcatccagtatcagctcgttgacatttcccaggacaacgcgttgagggacgagatgagggccctggccgggaatcccaaggccacacctccccagatagtcaacggagatcagtattgcggtgactacgagctgttcgttgaagcagtggagcagaacacactccaggaattcctgaagcttgcctag

SEQ ID NO: 14042 - DNA, 1920 bp, Artificial Sequence
  Description of Artificial Sequence: Synthetic coding sequence
atgaacttagagaagctgtctaagcccgagctgctgaccttgttcagtattctggaaggagagctggaagcccgcgatctggtgatcgaggcactcaaagcacagcaccgggacacgtttatcgaagaacgatacgggaaatacaacatctccgaccctctgatggccctccaacgtgacttcgagacactgaaagagaaaaacgatggcgaaaaacaacctgtgtgtacgaacccacttagcatcttgaaggttgtgatgaaacagtgtaagaatatgcaggagcgcatgcttagccagttggccgccgctgaaagcagacaccgtaaggtcatacttgacctcgaagaggaaagacagcgacacgcacaggacacagccgagggagatgatgtcacctatatgttagaaaaagaaagagagcggctgacccagcaactggaatttgagaagagtcaggtgaaaaaattcgagaaggagcagaagaaactcagtagccagctggaagaggagcgttcacgacacaaacaactgagcagtatgttggtgctggagtgtaagaaggccacaaacaaagccgctgaagagggacaaaaggccggagaactgagtctgaagttagagaaggaaaaaagccgggtgtctaaattggaagaagaacttgcagctgagcggaaacgcggacttcaaacagaagcccaggttgagaaacagctgtccgagtttgacatcgaacgggaacagctgcgggcgaagcttaacagggaagaaaatagaactaaaacattgaaagaagagatggagtcgttaaagaagattgtgaaggatctcgaagcctctcaccaacattcgagtcccaacgagcaactgaagaaacctgttacagtgtccaaaggtacagccacagaacccctcatgctgatgagcgtattttgccagactgagtcattccctgcagagagaacacacggaagcaatatagctaagatgactaacacagggctgcccggcccagctacacccgcgtactcatacgctaagaccaatgggcactgtgatcctgagattcagactaccagggagctcactgcaggcaacaacgtcgaaaaccaagttcctcccagggagaagagcgtagctcttgcgcaggaaaagccggtggagaatggcggatgcccagtaggcatagagacacctgtgcccatgccctcacccctctcctcctccggatcttcactgtctccgagctctacggcttcctcaagcctgacatcgagtccttgtagctctcctgtgctaaccaagcgtctccttgggagttctgcatcctcccctggatatcaaagctcttaccaggttgggataaatcagcgattccatgcagcgaggcacaaattccagtcccaggctgatcaggatcagcaggcttccggtctacagagtcccccttcccgcgacttgtccccgaccctcatcgataacagcgctgctaagcagctggccaggaacacggtgacccaggttcttagccgcttcacctcccagcaaggtccaatcaaaccggttagtcctaatagcagccctttcgggaccgactaccgcaatctggccaacaccgcaaatcctcgcggcgacaccagccactcgcctactcccggtaaggtgtctagtccgctaagccctttgtcccccggcatcaagagcccgacaatcccgcgcgccgagagaggaaatcctcctccaattccaccaaagaaaccgggactgactccatccccctccgccactacacccctcaccaaaacccactcacaagccgcctcactgacaacagccgaagacctggccagctcttgttctagtaacaccgtcgtggccaatggcaaagatgttgagctgctgttacccacgagctcttag

SEQ ID NO: 14043 - DNA, 2487 bp, Artificial Sequence
  Description of Artificial Sequence: Synthetic coding sequence
atgcgtttcctcgaagcaaggagtttggccgtggccatgggcgatactgtggtggagcctgcgccactgaaacccacatcggaacctacgagcggccctccggggaacaacggtggctctctcctctcagtgatcacggagggcgtcggagagcttagtgtcattgatccggaggtagcccagaaggcttgccaggaggtattggagaaggtcaagctcttgcatggcggcgttgcagtgtcatccagagggacacctctggagctcgtgaatggcgacggtgtcgacagcgaaataaggtgtcttgacgaccccccagcgcagataagagaggaggaagacgaaatgggggcggcggttgcgtccggcaccgccaagggagctagaaggcgacggcagaataattcagccaaacagagctggctactgcggctcttcgagtctaaactgtttgatatctctatggcaatctcttacctatataattccaaggagcctggtgtgcaagcctatataggcaaccgccttttctgtttcaggaacgaggatgtggatttttacctgcctcagttattgaatatgtacatccacatggacgaagatgtgggcgacgccattaaaccttatatcgttcataggtgccgccagtcaataaacttcagcctccagtgtgctctccttttaggggcatactcttctgatatgcacatctcaacccagcggcactcgagaggaactaagctacggaagctcatcctgagcgatgagctaaaaccagcacaccgcaaacgcgaactgcccagcctttcccccgccccagacaccggactgtctccttccaaacggacacaccagagaagcaaaagcgacgcaactgcaagcatcagcctgtcatctaatttgaagaggaccgcaagtaaccccaaggttgaaaacgaggacgaggagttatcatcatcaaccgaaagcatcgataactcattctcttcaccagtacgccttgctccagaacgtgagttcattaaaagcctcatggcaattggaaaacgtctcgcaactctgcccaccaaagagcagaaaacacagcgcttaatttccgaattgtcccttctgaaccataagctgcctgcccgggtttggctgcccacagcaggattcgatcaccatgttgtccgggtcccacacacgcaggctgttgtgcttaactccaaagataaggcaccttacttgatttacgtcgaggtgttagaatgtgaaaatttcgataccacatctgtcccggctcggattcctgagaatcgaatacggagcacgcgttcagtcgaaaacctacccgagtgcggcatcacacacgagcagagggcaggttctttctccactgtgccgaactacgataacgatgacgaagcatggtcggtggatgacatcggagaactgcaagtggaactgcctgaagtgcataccaacagctgcgacaacatctctcaatttagcgtggactcaatcaccagccaggagagtaaggagcctgtcttcatcgcagccggcgatataagaagaaggctttcagaacaactggcgcacactcccacagcgttcaagcgcgacccggaggaccccagcgcggtggccttgaaagaaccgtggcaagagaaagtacgccgtattagagaggggtctccttacggacatttgcccaactggcgcttgctcagtgtaattgtgaaatgcggcgatgacctccgccaagaactgctggcatttcaggtgctgaagcagcttcagtcaatttgggagcaagagcgggtgcccctctggattaagccttataagatccttgtcatatccgccgatagtgggatgattgaacccgttgtaaacgcagtcagcatccaccaggttaagaaacagtcacaattgtcactactggattattttctccaggagcatggcagttacactactgaggctttcctgtcggcacagcgcaacttcgtgcaatcctgtgctggctactgcttagtatgctatctgctccaggttaaagacaggcacaatgggaatattcttctggacgcagagggtcacattatccatatcgattttggtttcatacttagttcatccccaagaaacctgggatttgagacgagtgccttcaaactgacaacagagttcgtcgatgtcatgggaggccttgatggtgacatgtttaattattataagatgttgatgctgcaggggctcatagccgccagaaaacacatggacaaggtcgtccagatcgtggagatcatgcaacaggggagtcagctgccatgctttcacggctcatcaaccatacgcaacctcaaggagaggttccatatgtctatgaccgaagaacagctgcagctgttggtagagcagatggtcgacggttctatgcgtagtattacaacaaagttatacgacggattccagtacctgaccaacggaataatgtag

SEQ ID NO: 14044 - DNA, 4233 bp, Artificial Sequence
  Description of Artificial Sequence: Synthetic coding sequence
atggcagacaccgacctctttatggagtgtgaggaagaggaactggaaccatggcagaagatctctgatgtgatcgaagactccgttgtagaagattacaactccgtggacaaaactactacagtgagcgtatcacagcaacccgtgagtgcgccagtcccaatcgctgcacacgctagtgtagccggacacctctcaaccagcaccacggtatccagtagcggcgcccagaattctgattccaccaaaaaaaccctcgttacgctgatagctaataacaacgcagggaatccattggtacaacagggggggcagcccttgatactgacccagaatccagcacctggtttgggcacgatggtgactcagccagtgttacggcccgtgcaggtgatgcagaatgccaaccatgtcactagctctccagtcgcatcgcagccaatttttattactacacaaggttttccagtaagaaacgtgagacccgtccagaatgctatgaatcaagtgggaattgtgcttaatgtacagcagggccagactgtgcgtccaataacgttggtgcccgcgcctggaacacagttcgtgaaaccaacggtgggagtgccacaagtgttcagccagatgaccccggttcggccggggtccacaatgccggtccgacccaccacaaacacctttacgacagtgattccagcaactctcacaatccgttcaacagtgcctcagtcccaaagtcagcaaactaaatccaccccatctacgtccactacccctacagcaactcagccgacctctctcggccaactggccgttcagtcgccaggacagagtaaccaaactacaaatcctaaactggcgcctagctttccatcgccaccggctgtgagtattgcctcctttgtcaccgttaaaaggccgggtgtgacaggggagaatagcaacgaggtcgcaaagctggttaacaccctgaacaccattcccagccttggtcagtctccaggccctgtggtagtgtccaataatagcagtgcgcacgggagccaaaggacatcaggccccgaatcctccatgaaggtgacatcttcaatccccgtgtttgacctgcaggacggtgggagaaagatttgtcctcgctgcaatgcacaattccgagtgaccgaggccctcagggggcacatgtgctattgttgtcccgagatggtggaatatcagaaaaagggcaaatcattagactcagagccttctgtaccctcagcggcgaaaccacccagtcccgaaaaaacggcacctgtggcctctactccttcctctaccccaataccggccctctctccgcctaccaaggttcccgagcccaatgagaatgtgggcgacgctgtacagactaaattgattatgctggtggacgatttttattatggaagggatggcggcaaggtagctcagctgacaaactttcccaaggtggccacttccttccgttgcccccactgtacaaagagactgaagaacaacatcaggttcatgaatcatatgaagcatcacgtcgagttggaccagcagaacggggaagtagacgggcatacgatatgccaacattgttatcgtcagtttagcaccccctttcagctgcagtgtcacctcgaaaatgtacacagcccttacgaaagcaccacaaaatgcaagatttgtgagtgggccttcgaatccgagccactcttcctccagcatatgaaggatacgcacaaaccgggcgagatgccgtacgtctgtcaggtctgtcagtatcgctctagcctctacagcgaggtagatgtccactttcggatgatccatgaggacacaagacacctgctgtgtccctactgcctgaaagtgtttaagaacggcaacgcattccaacagcactatatgcggcaccagaagagaaacgtataccactgtaacaaatgcaggctccagtttctgttcgctaaggataagattgaacacaagctgcagcatcacaagacttttcgaaaacctaagcagctggaaggcctgaaacctggaactaaggttaccatacgggcatcacgcggacaaccgagaactgtccccgtgtctagcaacgacaccccacccagcgctctacaggaggcagcacctttaacatctagcatggatcctttgccagtgttcctctatccccctgtgcagcggtctatccagaagcgggcggtgaggaagatgtcagtgatggggcgccagacgtgtctcgaatgctcattcgagatcccagactttcctaaccacttcccaacttatgtgcactgtagtctctgtcggtacagcacatgttgctctagagcttacgccaatcacatgatcaataaccacgtgccacgaaagagtcctaagtacctggccctgttcaagaactctgttagtgggatcaagttggcatgtacttcctgcactttcgtcaccagcgttggggatgcgatggccaaacatttggttttcaacccctcgcaccgaagttccagcatacttccgcgcggactaacctggattgctcactcccgccacgggcagacaagagatagagtacatgacagaaacgtcaaaaatatgtacccccccccatctttccccactaacaaggccgctaccgtgaaatcagcgggagcaacacctgcggaacctgaggagctgcttactccactggcccccgccctcccttctcccgctagcacagcaactccccctccaacccctacccatcctcaggccttagcactgcctccactggcaaccgagggagccgagtgcttaaatgtcgacgaccaggatgaggggtctcctgtgacccaagaaccagagcttgcatcaggcgggggagggtcgggaggagtaggaaagaaggagcagctatccgttaagaagctccgtgtggtgctgtttgccctgtgctgcaatacagagcaagccgctgaacattttagaaatccccagcggaggattcgccgttggctccgtaggttccaggcatctcagggcgaaaacttggaaggcaagtatttgtcctttgaggcagaagaaaagctcgccgagtgggtcctgacacaaagagaacagcagctcccagtgaatgaggaaacattatttcaaaaggcaacgaaaattggacggagtctagaggggggatttaaaataagctacgagtgggccgtgcgttttatgctacgtcaccacctgactcctcacgcgagacgggccgtggcacatacactgcccaaagacgtagccgagaatgcaggcctttttatcgatttcgtccagcgccagatccacaatcaggatttgccccttagcatgattgtagcgatagacgagatctcacttttcctcgacacagaagttctgtcttctgacgatcgcaaggaaaatgcccttcagaccgtggggacaggggaaccatggtgtgacgtggttcttgctatcctggctgatggcactgtcctgcctacactggtattttatcggggccagatggatcagccagccaatatgcccgattccattctgctggaggctaaggaatccggctactccgacgatgaaatcatggagctgtggagcacaagagtatggcaaaagcacaccgcctgccagcgttctaaagggatgctcgtcatggattgccaccgaacccatcttagcgaggaggttttggccatgctctccgccagcagtaccctgccagccgttgttccagccggctgctcgtctaagattcagcccctggacgtgtgcattaaacgcactgtgaagaattttcttcataagaaatggaaggagcaggctcgtgaaatggccgacaccgcatgtgactctgacgtcctcctgcagctggttctggtatggctgggtgaagtgttgggcgtgatcggggactgccctgagctggtgcagaggtcttttctggtcgcttccgtgcttcccggtcccgatggtaacatcaactctccaaccagaaatgcagatatgcaggaggaattaattgcgagccttgaggaacagctaaagttgtctggcgaacatagtgaatcatcgacaccgagacctcggtcctcaccagaggaaactatcgaaccagagtcactgcaccagttgtttgaaggcgaatcggagactgagtccttctatggctttgaggaagcggacttggatctgatggagatctag

SEQ ID NO: 14045 - DNA, 1488 bp, Artificial Sequence
  Description of Artificial Sequence: Synthetic coding sequence
atgccccaactgctccagaatattaacggcatcattgaggcctttagacggtacgcccggaccgagggcaactgtaccgctctgactcgcggcgaattgaagaggctgttggaacaggaatttgcggacgtcatcgtcaagccgcatgatccagcaacagttgacgaggtgttaaggctgctcgatgaagaccacaccgggacagttgagtttaaggaatttctggtcctcgtgtttaaggtcgcacaggcctgttttaaaaccttgtcagagagtgccgaaggagcttgcggttcacaggagtctggttccctccattctggcgcttcccaggagctcggtgaaggacaaaggtctggcacagaggtcggacgagcaggcaaggggcaacattacgaggggagctcacaccggcaaagccaacaggggtccagaggtcaaaaccgccccggagtgcagacccagggacaggccactgggtcagcatgggtctcttcctatgaccgccaggctgaatctcagtcacaggagagaataagcccacagattcagttaagtgggcagacggagcagacccagaaagccggtgagggaaagaggaaccagacaaccgagatgcgccccgagcggcaaccccagacccgagagcaggatcgcgcccatcaaaccggagagactgtcactgggtccggaacccagacccaggccggtgcgacacaaacagtggaacaagactcaagccatcagacagggcgcacttctaagcagacacaggaagccactaacgaccaaaaccgaggcaccgagacccatggacaaggccgcagtcagacatcccaggctgtgaccggcgggcacgcccaaatccaggctggaacgcatacacagacccctacccaaactgttgagcaggattcatctcaccaaaccggtagtacctctacccagacacaggaaagcacgaatggtcagaaccggggcacggagattcacggccagggcagatcacagacctcgcaggctgttactggcggccacacgcagattcaagcaggctcacacaccgagacagtggaacaagataggagccagactgtcagccacggaggcgcacgtgagcagggtcagacgcaaacccagccgggtagcggacagcgatggatgcaggtttccaatcccgaagccggggaaacggtccccggcggccaggctcaaacaggcgcatctacagagtccggtagacaggaatggagctctacacatcccaggcggtgcgttacggaggggcagggagacagacagcctacagtggtgggtgaagagtgggttgatgatcattctagggagaccgttatcttgcgtcttgatcagggcaatctgcacactagcgtgagcagcgcacagggccaggatgctgctcagtcagaagagaagagggggatcactgcaagggaactgtacagctacttgagatccacaaagccctag

SEQ ID NO: 14046 - DNA, 1233 bp, Artificial Sequence
  Description of Artificial Sequence: Synthetic coding sequence
atgaacatgccctctacgcctttggccccaacaaccgggactgctacatgctcttggagcgcctccacatgcacgaccacaaggcccgctgtcaggccccccagcttcccgcatcgccctcctggcaacgcagccctgccctcactcatgccatccaggcccacacaggtggcaggccagtgcggcgccggtaataattgggccaaggggcattacacggaaggagcagaattgatggagagtgtgatggatgtggtccgtaaagaggctgagtcttgcgactgtttacagggtttccagcttacccattccctcggcggaggaaccgggagtggtatgggaacactgttgctgagtaagatacgcgaagagtacccagatcgaattatcaatactttcagcattctgccgagtcctaaagtgtctgataccgtagtggaaccttacaatgctacgctgtccgtccaccagctgatcgagaacgcggacgagactttttgcatcgataacgaagcactgtacgacatctgcagcaaaacactgaagctgccgacgcccacatacggcgatttgaaccacctcgtgtccgctacaatgagcggggtgacaacctgtttgcggttccctggccagcttaacgcagacctgaggaagctggccgtgaatatggtcccattcccccgattacatttttttatgccaggcttcgcacccctgacttcccggggcagccagcagtatagagctctgactgtggccgagctcacacaacaaatgtttgatgcgaaaaatatgatggcagcatgtgatccacggcacgggagatatctcaccgcggcggccatctttcgcgggcggatgcctatgcgcgaggtagatgagcagatgttcaatattcaggacaagaatagttcttattttgccgattggttgcctaacaacgttaaaaccgctgtgtgtgatatcccacctcgtggtcttaaaatgagcgccacatttatcggcaacaacacagccatacaggagctttttaagagagtcagcgaacagttcactgcaatgttcagaagaaaagctttcctgcattggtatactggcgaaggcatggacgagatggagttcacagaggctgaaagtaacatgaacgatctcgtttcggaatatcagcagtaccaagacgctactgcggaggaggaagaggacgaggagtatgcggaagaggaagtcgcctag

SEQ ID NO: 14047 - DNA, 2106 bp, Artificial Sequence
  Description of Artificial Sequence: Synthetic coding sequence
atggggtcagctgcggacgtccggttctctctgggtacaaccacccacgcgccacccggggtccataggaggtactccgcgcttcgcgaggaatcagccaaggattgggagaccagtccgctgccgggaatgttagccccagccgccggcccagccttcgattctgatcccgagatttctgacgtggatgaggacgaaccagggggactggtcggaagcgctgatgtggtgtctccttcgggacactctgacgctcagacactggccatgatgctgcaggagcagctggatgccattaatgaggagatccgcatgattcaggaggaaaaggagtccacggagctgagggccgaagaaatagaaacgcgggttacatccggtagcatggaagcgcttaacctgaaacagctgagaaagcgcggcagcatccctacatcgttaaccgcgctctcgctggcatcagccagccccccactgagcggaagaagcacacccaaactcacgtctaggagtgccgcacaggacttagatcgtatgggagttatgacactcccttcagacttgcgcaaacatagacgcaagctgttgtcacctgtgagcagggaggagaatagggaggataaagctactatcaaatgtgaaacttccccaccaagttctccacgaactctgagattagagaaactgggccatcccgccttgagtcaggaggagggaaagagcgcattggaggatcaggggtccaacccatccagttccaattctagccaggactccctgcacaagggcgccaaaaggaaagggatcaaaagcagtattggaagactgtttggcaaaaaagagaagggcagactcatccaactctccagggatggtgctactggccacgtgctcctcactgacagtgaatttagcatgcaagagcctatggtgcccgctaaactggggacccaggccgaaaaggataggcggcttaaaaaaaaacaccaactgctggaagacgcacgacggaagggtatgccctttgctcagtgggatggccccacagtggtgtcttggttagagttgtgggttggcatgcccgcttggtacgtggccgcctgcagagctaacgtaaagagtggggcgatcatgtcggcactctcggacaccgagatacagagagaaatagggatatccaacgcactgcaccgcctgaagttgaggctggccattcaggagatggtgtctttgacatcaccatccgccccccccacttctagaacctcaagtggcaatgtgtgggtgactcacgaagagatggaaacgctggaaacttcaactaagaccgactctgaggagggcagctgggcacagaccctggcgtacggggacatgaatcacgagtggatcggaaatgaatggcttccatccttggggcttccccagtacagaagctattttatggaatgtctagtggacgcccggatgctggaccacctcactaaaaaggacctcagggtacatctaaaaatggtcgactccttccacaggacatccctccaatatggcatcatgtgtctgaaaaggttaaactatgacaggaaagaactggagaagagacgtgaggagagccaacacgagatcaaggacgtgttggtgtggacgaatgaccaagtggtccattgggtccagagcatcggactgagagattacgccggaaatctgcacgagtctggtgtacacggagcactgctggcccttgacgagaacttcgatcataatacactcgccttgatcctgcaaattccgacgcagaacactcaggcgagacaggttatggagagagagttcaataacctactcgccctgggtaccgaccggaagctcgatgatggcgatgataaagtctttagaagagcgccttcatggagaaagaggtttaggccccgcgagcatcacggccgtgggggcatgctctccgcttctgcggagacccttccagccgggttcagggtctccacacttggaactctccaacccccccccgcgccacccaaaaaaattatgcctgaggcccatagtcattatttgtacgggcacatgctatctgcattccgagactag

SEQ ID NO: 14048 - DNA, 1029 bp, Artificial Sequence
  Description of Artificial Sequence: Synthetic coding sequence
atggcctcagtgactcgcgccgtttttggggaactcccatccggcggcgggacagtggaaaaatttcagctgcaatctgatctcttgcgggtggacatcatttcctggggatgtaccatcaccgcactggaagtaaaagatcggcagggcagggccagtgacgtcgttttaggcttcgcagagttggaaggctacctgcaaaagcagccctattttggcgcagtgatagggagggtggctaaccggatcgctaagggcactttcaaggtggatggaaaggaatatcacctggctatcaacaaggaaccaaactcgcttcacggaggcgttcgcggttttgataaggtgctgtggacgcctcgcgttctatctaatggcgtgcaattctctcgaatatcaccagatggcgaagagggttacccaggggaactcaaggtttgggtcacctacactctggatggcggcgagttgatcgtcaattatagggcccaggcgagccaggcaacccctgtgaatttaaccaaccactcgtactttaatctggccggccaggcctcaccgaacattaatgaccacgaggtgactattgaggccgacacttacctcccagttgacgaaaccctgattccaactggggaggtggctcctgtgcaagggaccgcttttgacctcagaaaaccagttgagctgggcaagcatttacaggacttccacctgaatggctttgatcataacttctgcttgaaaggttcaaaagaaaagcacttttgtgcgcgcgtgcaccacgctgcgtccggccgcgtcctagaagtctacaccacccaacccggcgtgcaattctacactgggaatttcctcgacggtacactgaaaggaaagaatggggcagtgtatcctaagcacagcgggttctgcctcgagacacaaaactggcccgacgccgtgaaccagccacgctttccacctgtgttgctccgccctggcgaagaatatgatcatacaacctggtttaaattttccgtggcctag

SEQ ID NO: 14049 - DNA, 2295 bp, Artificial Sequence
  Description of Artificial Sequence: Synthetic coding sequence
atgtctgacaccaggagacgggtcaaggtgtacactctcaacgaggacagacagtgggatgacaggggaacggggcatgtcagcagcacctatgtggaagagctgaaagggatgagcctgcttgtaagagccgaaagcgatggctcactacttttggaaagcaaaattaaccccaatacagcataccaaaaacagcaagatactctgatcgtctggagcgaggccgagaattacgacctggctctgtcatttcaggagaaagctggctgtgatgaaatctgggaaaaaatatgtcaagtgcagggtaaggacccttctgtggaagtcacccaggacctcattgacgaatcggaggaagagagatttgaagaaatgccagaaacttcccacctgatcgatctgccaacatgcgaacttaacaaacttgaagaaattgccgacttggttacgtcagtgctgtctagccctattagacgagagaaactcgccctcgccctcgaaaatgaaggatatatcaaaaagctcctccaactgtttcaggcctgcgaaaacctagagaacacagaggggctgcaccatctatacgagattattagagggatcctgtttctgaataaggctacactctttgaggtcatgttcagcgatgagtgtatcatggatgttgtcggatgtctggaatacgatcccgcgttggcacagccgaagagacatcgcgagttcttgacaaaaaccgccaagtttaaggaagtcatccctatcacggattccgagcttcgccagaagattcaccaaacctacagggttcagtacatacaggacatcatcttgccaaccccttccgttttcgaggaaaactttctgtccaccctgacttcattcatattttttaataaagttgagatagtaagtatgctccaggaagacgaaaagtttctgagcgaggtgttcgctcagttgacagatgaggccacagacgacgataagcgaagggaattagtgaatttcttcaaggagttctgtgcttttagccagacgctgcagcctcagaatcgtgacgccttttttaaaactctggcgaagctgggtatcctgcctgccctcgaaatcgttatgggaatggacgacctccaggttcggagcgccgctaccgatattttttcttacctagtcgagttctcccctagcatggttcgcgagtttgtgatgcaggaggcacagcagtctgacgatgatatcctgctcatcaatgttgttattgagcagatgatctgtgatactgatcctgagctgggtggcgccgttcagttgatggggcttttaaggaccctgatagaccctgagaacatgctggccaccaccaataagactgaaaagtcggaattcctaaacttcttctacaaccactgtatgcacgttctcactgctcctctgctgaccaatacgtcagaagataaatgcgagaaggacaacattgtgggctcaaataaaaataataccatttgccctggagcgctgcggttcatgcgcaggatcatcggcctgaaggatgaattctataatagatacataacaaaagggaatctatttgagccggtgattaacgcccttcttgacaacggcacccggtataacctactgaatagtgcagtgatagagttatttgagtttattcgggtggaggacattaaaagtctgactgcccatatcgtggagaatttctataaagctctcgagagtattgagtacgtgcagaccttcaaggggctcaaaaccaaatatgagcaagagaaggatcggcagaatcagaagctcaattcggtgccgtccattctgcggagcaaccgcttccgccgggatgctaaggccctggaggaagacgaagaaatgtggttcaatgaagacgaagaggaagaaggcaaagcggtcgtggcgcctgtggaaaagcccaagccggaagatgatttccctgacaactacgaaaaattcatggagaccaagaaggccaaagaaagcgaggacaaagaaaacctgcccaagaggacctccccaggcgggttcaagttcacattctcccatagcgcgtccgccgcaaatggcacgaatagcaagagcgtggttgctcaaattccccccgccactagtaatggcagtagctcaaagacaactaatctcccaacttctgtcaccgccaccaaggggagtcttgttggtttagtggactacccggacgacgaggaggaggacgaggaggaggagtccagccccaggaagcgccccagactggggtcttag

SEQ ID NO: 14050 - DNA, 231 bp, Artificial Sequence
  Description of Artificial Sequence: Synthetic coding sequence
atgagcaaggcccaccccccggaactaaaaaagtttatggacaagaaactatcactcaaattaaatgggggtaggcatgtgcagggcattttgcggggcttcgatccatttatgaatcttgtgatcgatgagtgtgtcgaaatggcgacatcaggacaacagaataatatcggcatggtggtgattcggggtaattcgattatcatgctcgaggcccttgagcgagtctag

SEQ ID NO: 14051 - DNA, 528 bp, Artificial Sequence
  Description of Artificial Sequence: Synthetic coding sequence
atgcaacttacacaccagctggacctttttcctgagtgtcgggttactctactactgtttaaggatgtgaaaaacgccggagatctcaggcggaaagctatggagggaactatcgacgggtctctaataaatccgaccgtgatcgtcgatccatttcagatcctggtcgccgcaaacaaagcggttcacctctataaactgggaaaaatgaagacacggaccctgtccaccgaaatcatttttaatttgtcccccaataacaatattagtgaggcattgaaaaaatttggaatctccgccaacgataccagcattcttatcgtgtatatcgaggagggggaaaaacagataaaccaggagtacctcataagtcaggtggagggccaccaggtgagtcttaagaatctgcctgagatcatgaatataaccgaagtgaaaaaaatatacaagctaagctcacaagaagagtcgatcgggaccctgctcgacgcaataatctgtaggatgtctactaaggacgtcctgtag

SEQ ID NO: 14052 - DNA, 909 bp, Artificial Sequence
  Description of Artificial Sequence: Synthetic coding sequence
atggccctgcacgacatggaagactttaccttcgacggaacgaagaggctgtctgtgaactatgtgaagggcatactgcaacctacggacacttgcgacatctgggataagatttggaatttccaagctaaaccagacgatctactgatcagcacctaccctaaagctgggaccacgtggacccaggagatagtggagctcatacaaaatgagggggatgtggagaagtcaaaaagagcccctactcaccaacgcttccccttcttggaaatgaaaataccctcccttggctccgggctcgagcaggctcacgccatgccaagccctcgtatactcaagacacacctgcccttccatctgcttcccccgtcactgcttgaaaagaactgcaagattatttatgtcgcccgcaatccaaaggataatatggtgtcgtactaccattttcaaagaatgaataaggcccttcccgcgccgggaacatgggaggaatactttgagaccttcctggccggcaaggtctgctggggatcttggcacgagcatgttaaagggtggtgggaggcaaaggataagcatcggatcctctatcttttctatgaggatatgaagaaaaacccaaagcatgaaatacagaagctggccgaattcatcggtaaaaagcttgatgataaagtgttggacaaaatcgtgcactatacgagttttgatgtcatgaagcagaaccctatggccaattacagcagtatccccgctgaaataatggaccactccattagtcctttcatgcgtaagggggcagtgggggattggaaaaagcactttacagtggcgcagaacgaacggtttgatgaagactacaagaaaaaaatgaccgatacccggctgacgtttcattttcagttttag

SEQ ID NO: 14053 - DNA, 2892 bp, Artificial Sequence
  Description of Artificial Sequence: Synthetic coding sequence
atgtggtgcctccactgtaactccgagcgtacccagagcttgcttgagttagaactcgactccggtgtggaaggagaagctccgtcaagtgaaaccggaacaagcttggatagcccgagcgcatacccccaagggcctctggtgcccggtagcagcctaagcccagatcactacgagcatacatcagtgggggcttacggcctgtacagtggaccacccggacagcagcagagaactaggagaccaaaactccaacactctacctccatattgcgcaagcaggctgaggaggaggccatcaagcggtctcgttcactctctgagagctatgaactttcctccgacttgcaggataagcaagtcgagatgctcgagcgaaaatacggagggcgactagtgactcgccatgctgccaggaccatccagaccgccttcagacagtaccaaatgaacaagaattttgagcgattgcggagctctatgagtgagaaccggatgagtcgacgcatagtgctgtctaatatgcggatgcaatttagctttgaagggccagaaaaagtgcactctagttattttgaaggaaagcaggtaagcgtgacaaacgatggaagtcaacttggcgccttggtcagccctgagtgtggcgatctttccgagcccacgacccttaaatcaccagctccatcatccgacttcgccgacgctatcactgagttggaggatgctttttcaaggcaggtcaaatctctggcagaatccatagacgacgcattaaactgtcgctccctgcacactgaggaggcccccgctctcgatgcggcccgggccagagacactgaaccacagaccgcgttgcatgggatggaccaccgaaaactcgacgagatgacagcatcgtactctgacgtaactctgtacattgacgaagaggagctttcaccacctctgcctctgagccaggctggagacagaccctctagcaccgaatccgatctgagactccgagctggcggtgcggcacccgactactgggcacttgcccataaggaagataaagctgacaccgatacatcctgtagatcaaccccttctctagaacgtcaggaacaaagactgcgggtagaacacctgcccctcctgaccattgagcctcccagcgattcctctgtggacctcagcgacaggtctgagagggggagcttgaagagacagtcggcctacgagcgatccttgggaggccagcagggctctcctaagcacgggccccactcaggcgctccaaaaagccttccccgggaagagccggagttgaggcctagaccccccagacccctggacagtcatctagcaatcaacggcagcgccaaccgacaaagtaagagtgagagcgactattccgacggcgacaatgattccattaactcgacatcaaacagtaacgataccattaattgttcctccgaatcctcctcacgggatagcctgcgggaacaaacgctgagcaagcagacatatcacaaggaagcgaggaactcctgggattctccggccttctctaatgatgtcatccgcaagcggcactaccgcattggtcttaatctgttcaataaaaaaccagaaaaaggggtccaatacctaattgagcggggctttgtgccagacactcctgttggggtagcacattttctgctacagcggaaagggttgtcacgacagatgattggtgaatttcttggcaatcggcagaaacagttcaatagggatgttttggactgtgtggtcgacgagatggatttctcgactatggagttggacgaggcactcaggaaatttcaggcccacatacgcgtgcagggagaagcccagaaggtggagcgactgatcgaggcattcagccaaaggtattgtatttgcaaccccggagttgtgaggcagttcagaaacccagatacaatattcattctcgcctttgcaatcattctgctgaacactgatatgtactcgccgaacgtgaagcctgagcgtaagatgaagttagaggactttatcaagaatctgcgaggcgtggatgatggagaagatattccacgggagatgcttatgggaatctacgaacgcattaggaaacgagaacttaaaacaaatgaggaccacgtcagccaggtccagaaggtcgagaagctcatagtgggcaaaaagcccataggtagcttgcaccctggcctgggctgcgtccttagtctaccccatcggcgcttggtgtgttattgccgactgttcgaggtacctgaccccaataaaccccagaagttgggacttcaccagagagaaatcttcctcttcaacgacctgctggtggtgacaaaaatcttccagaagaagaaaaatagtgtgacctattcatttcgacaaagtttctcattatatggaatgcaggtgcttttgttcgagaatcaatattatcccaatggaattcgcctcacttcaagtgtaccaggggcagacattaaagtattgataaatttcaatgcgcctaaccctcaggataggaaaaagtttaccgacgatctgagagagtctattgctgaagtccaagaaatggagaaacacagaatagagagtgagctggagaagcagaaaggggtcgtcaggcctagcatgagccaatgtagctctctgaagaaagagagtggcaacgggacgctgtcccgggcttgcttggacgattcctacgcaagcggggaggggctgaagaggtctgccctcagtagctctcttcgggacctgtctgaagccggcaaaagagggcgacggagctcagctggtagtcttgagagtaacgtcgagttccaaccctttgagcctttacagccttctgttctctgtagctag

SEQ ID NO: 14054 - DNA, 711 bp, Artificial Sequence
  Description of Artificial Sequence: Synthetic coding sequence
atggccagcctggatagggtcaaggtgctggtgcttggggattctggcgtcggtaaatccagcctggtgcatctattgtgccaaaaccaggttctgggcaacccatcctggacagtcggttgttctgtggacgtaagagtacacgactacaaggaaggcaccccagaggaaaaaacctattacattgagttatgggatgtcggtgggtctgtggggtcagcttctagcgtgaagagcacacgtgcagtcttttataatagcgtcaatggaatcatcttcgtgcacgatctcaccaataagaaatcctcacagaatcttcgccgatggtcgctagaggccttgaatcgcgacttggtgccaaccggagtactagtcacaaatggagactacgatcaggaacagttcgccgataatcagattcccctcctcgtgataggtaccaaactcgaccagatccatgaaacaaagagacacgaggtgttaacccgcactgctttcctcgctgaggatttcaacccggaggagataaatctcgactgtacaaatccccggtatctcgcggcaggcagttccaatgcggttaaactgtcgagattctttgacaaggtgattgaaaaaaggtattttttacgtgaagggaatcagatccctggtttccccgatcggaaacgcttcggggccgggacactgaagtcccttcactacgattag

SEQ ID NO: 14055 - DNA, 2784 bp, Artificial Sequence
  Description of Artificial Sequence: Synthetic coding sequence
atgcaatctattctttatcatggcctgattagagatcaggcctgccggaggcagaccgattactggcaatttgtgaaagacataaggtggctgagccctcactccgccctccacgtggagaaatttataagtgtacatgagaatgaccagtcctccgccgacggagcaagtgaaagggcagtagcggagctatggttgcagcattcactgcagtatcattgtctgagcgcccaattacggccgctactaggtgaccgccaatacattcgtaagttttacacggatgcagcgttcctgctgtccgatgcacacgtgaccgccatgctccagtgtttggaagccgtagaacagaataatcctcgactcttagctcagattgatgccagcatgttcgcacgtaaacacgaaagcccattgttggtcactaaatcccaatcccttaccgctctgccatcttccacctacacaccccctaattcatatgcacagcattcttacttcgggtcattcagttctctccatcagagtgtgccaaacaatggatccgaaagaagaagtacaagcttccccctctctggcccccctaggaagccgcaagagtcacggggtcacgtttcgcccgccgaagatcaaaccatccaggctccacctgtgtctgtcagtgcactagcccgagactcccctctgacccccaacgaaatgagtagcagcactttaacctctcccatagaagcaagctgggtgagctcccaaaatgattcaccaggtgatgcatcagaggggcctgaatatctggccatcggaaatctggatcctagaggtcggacagcctcctgccagtcacatagcagtaatgccgagtcctcaagcagcaatctcttttcgtccagtagtagccagaagcccgatagcgctgccagctccctcggtgatcaggagggggggggagaaagtcagcttagcagtgtgctccggcggagctctttctctgagggacaaacattaacagtcaccagcggagccaaaaaatctcacattcgctctcattcggacacctcaatcgcctcccggggagcgcctggcggtccccggaatataaccattattgtcgaggatcccatagccgagtcatgcaacgataaggccaagctgaggggtcccctcccatacagcggacagtcatcagaagtgagcacaccctcaagtctttacatggagtacgagggcggccgttacctttgctcaggtgagggcatgttccgccggccctccgaaggtcagagtctcatatcttatttgtccgagcaggatttcggaagctgcgccgatctggagaaggagaatgcccacttttcaatttcagagtccctcatcgctgcgatcgaacttatgaagtgtaacatgatgtcacagtgcctggaagaagaggaggtggaagaggaggacagtgatcgagagattcaggagctcaagcagaaaattaggctgagaagacagcagattcgcactaagaatctcctgcccatgtatcaggaagccgaacacggtagctttagagttactagttcctcgtcacagttctcatcgagggacagtgcacagttatccgacagcggaagtgctgacgaagtggatgagtttgaaatacaagatgcggatattaggaggaacactgcctcctccagcaagagtttcgtgtccagccagagcttttcccattgctttctgcattcgacatcagccgaagctgtggcaatgggcctcttgaaacagttcgaggggatgcagcttcccgctgcatctgaactggaatggctcgttcccgaacacgatgctccacagaagctcctccccataccagacagcctaccaataagccctgatgacggccagcacgcagatatctacaagctgcgtatacgcgtcaggggcaacctcgaatgggcacctccaagaccgcaaattatctttaacgtgcatccagccccaacccggaagattgccgtagcaaaacagaactatcgttgtgccggatgcggcattagaaccgatcccgactacattaaacgtctgagatattgtgagtatttgggaaagtacttctgccaatgctgccacgagaacgctcagatggccattcccagtagggtcctgcgcaaatgggacttttctaaatattacgtgagcaacttctcaaaggacctgctgataaagatttggaacgaccccctctttaacgtccaggatattaatagtgccttgtaccgcaaagtgaagctgcttaatcaggttcggctgctccgcgtccagctttgccatatgaaaaatatgtttaaaacttgccgcctggcaaaggaactgttggattccttcgacacagtacctgggcatctgactgaggatttgcacctatattcattgaatgatttgacagccacgcgcaagggagaactcggcccacggttagcggagctaacacgcgcaggcgctacgcacgttgagagatgtatgctgtgccaggctaaaggctttatttgtgaattttgccaaaatgaggacgatattatctttccctttgagcttcataaatgcagaacgtgcgaagagtgcaaggcttgctaccacaaagcatgttttaaatccggatcctgccctaggtgtgaacggttacaagccaggcgcgaggccctggcacgccagtctctggagagctacttgtccgattatgaggaagaacctgccgaggctctggccctggaagcagccgtgctagaggcgacctag

SEQ ID NO: 14056 - DNA, 300 bp, Artificial Sequence
  Description of Artificial Sequence: Synthetic coding sequence
atggcgagcgcatccgctagaggaaatcaggataaggacgcacacttccctccgccctctaaacagagcctgctcttttgccccaagagcaagttacatattcatcgcgccgagattagcaagattatgcgggaatgtcaggaggaaagcttctggaagagagctctccctttttcacttgtgagcatgctcgtgactcaggggctcgtgtaccaaggctatctggcggccaacagtagatttggcagcctcccaaaggtggccagaactgcttcactccctgtaagaaatgcaaagtag

SEQ ID NO: 14057 - DNA, 786 bp, Artificial Sequence
  Description of Artificial Sequence: Synthetic coding sequence
atggtggtattgtctgtgccagctgaggtgactgtgatcttgttggacatcgagggcacgacaactcctatagcatttgtgaaggatattctatttccctacatagaggagaatgtgaaggagtacctgcagacgcactgggaggaggaggagtgccaacaggatgtgtctctgctaagaaagcaagccgaggaagacgctcaccttgacggcgcggtgcccattccagctgccagtgggaacggcgtcgacgaccttcaacaaatgatccaggccgtggttgacaacgtgtgctggcagatgtccctggatcgtaagaccacggccctgaaacagctgcagggtcatatgtggcgggctgcatttaccgccggccggatgaaggccgaattcttcgctgacgtcgtgcctgccgtgagaaaatggcgcgaggccgggatgaaagtctacatctattcctctggctcagtggaagctcaaaaactcctgttcggacacagcacagaaggtgacatccttgagctcgtggatggccattttgataccaagatcggccacaaagtcgaaagcgagagttacagaaagattgctgattctatcggctgtagcactaataacattttgtttcttactgacgtcaccagggaggcatccgccgctgaggaggcagacgtgcatgttgccgtggtggttcgccccgggaacgccgggctgaccgacgacgagaagacgtattactctctgataacgagcttctcagagttgtacctaccgtccagcacttag

SEQ ID NO: 14058 - DNA, 1188 bp, Artificial Sequence
  Description of Artificial Sequence: Synthetic coding sequence
atggctgaagatggactgcctaagatttatagccatcctccaacggaaagctctaagacccccaccgctgctactatcttttttggagcagacaacgccatccccaagtccgagacaacgattacttctgagggcgaccacgtgacatcagtgaatgagtatatgctggagtccgatttttccactacgacagacaataagctcacggcaaagaaggagaagttgaagtcggaggatgacatgggaacggattttatcaaatctactactcacctgcagaaggagatcacatccttgaccggaaccaccaattcaataacacgagattccataaccgaacacttcatgcctgtgaaaattgggaacatctcatctccggttacaactgtttcactgatagattttagcacggacatcgcaaaagaagatatcttactggcaacgattgacaccggcgatgctgaaatttcgattacttccgaagtcagtggaaccctcaaagattccagcgccggcgtggccgatgcacccgcatttcctaggaagaaggacgaagccgatatgtccaactataacagctcgatcaagtccaatgtgccagccgatgaagctgtacaagtaaccgatagtactatacccgaagcagagatccctccagcacctgaggagtcctttactacaataccagatatcaccgccctggaagaggagaaaatcaccgagatcgacctgagcgtgctcgaagatgacacaagcgctgtggctacgctgaccgacagtgacgagaaattcatcacggtatttgaactcacaaccagcgcggaaaaagataaggacaagcgggaagatacactacttactgatgaagaaactacggagggggcatccatttggatggagcgagatactgctaacgaggcagagacccattccgttctgttgaccgccgttgagagccgctatgacttcgtggtgcccgcaagcattgccacaaacttagtcgaggagtcttccaccgaagaagacctgtctgagacagacaacaccgagaccgtgcctaaaatcacagagcccttttccggcacaacgtccgttctggatacaccagattataaggaggatacaagcacaaccgagacagatattttcgaacttctcaaggaagaacctgacgagttcatgatttag

SEQ ID NO: 14059 - DNA, 921 bp, Artificial Sequence
  Description of Artificial Sequence: Synthetic coding sequence
atgtacttttgttggggcgctgactctcgcgaactgcaacggaggcgtaccgccggctcacccggggcagagcttctgcaggccgcctccggtgagcgccactcactcctactgctgaccaaccatagagttctctcttgtggggataacagcagaggccaacttggaagacggggtgcgcaacgcggcgagttgccagaacccatccaggcgcttgagaccctgatcgtagatctcgtgtcctgcgggaaagaacattctctggcggtctgtcacaaggggcgcgtgttcgcatggggagctggaagcgaaggccaactaggaattggtgagttcaaagagatctcgtttaccccgaagaagattatgaccctcaacgacattaaaattatccaggtgagctgcggccactaccattctctggctctgagcaaggatagccaggtgtttagctgggggaagaattcacacgggcaattgggtctggggaaggagttcccatctcaggcatcacctcagcgagtgcgctcactggaagggattcctctggctcaggtcgccgcaggcggtgcacattcttttgcactttctctctgcggaacctcgttcggttggggctctaactctgcaggccagcttgccctttctggcaggaacgtgccagttcagagcaacaagcccctgtctgtgggggccctgaaaaatctgggcgtggtttatatttcatgcggtgatgcgcacacagccgtcctaacccaggacgggaaggtctttacgttcggggacaacagaagcgggcagctcgggtatagtccaactcctgaaaaaagaggtcctcagttggtggaacggatagatgggcttgtgtctcaaatcgattgtgggagaaattccaagcatgggttcatgacgttcttttag

SEQ ID NO: 14060 - DNA, 909 bp, Artificial Sequence
  Description of Artificial Sequence: Synthetic coding sequence
atggggaactgctgctggacccagtgttttgggcttctgaggaaagaggctggccgactgcagagggtaggcggcggcggaggcagtaaatacttcaggacctgttcaaggggggagcacctgactatcgaattcgagaatctggtggagagcgatgaaggagagtcacccggatctagtcatcgccctctgactgaggaggagatcgtcgatttgcgcgagcgccattatgattcgattgctgagaagcaaaaggacctggacaaaaagatccaaaaagaacttgccctgcaagaggagaagctgcggttggaggaagaagccctgtatgccgcacagcgggaagcagctcgcgctgctaaacagaggaagctgcttgaacaagagcgtcagcgcattgttcagcagtaccacccgagcaataatggagaatatcagagtagcggccctgaggacgattttgaaagctgtctaagaaatatgaagtcccagtacgaggtctttcgttcaagtagactgagcagcgacgccacagtgcttacaccgaatacagaaagttcgtgcgacctgatgacaaagactaaatccacatctgggaacgacgactctacttccctagatcttgagtgggaagatgaagaaggcatgaatcggatgttgcctatgagagaacggagtaaaaccgaagaggacatcctgagagctgctcttaaatactcgaacaagaaaacagggagtaatcccaccagcgccagtgatgactccaatggtctggagtgggagaacgattttgtgtccgctgagatggatgataacggcaactccgagtactctggcttcgtgaatccggtgctagagctgagcgattccggcatccggcacagtgacactgaccaacaaactcgatag

SEQ ID NO: 14061 - DNA, 1641 bp, Artificial Sequence
  Description of Artificial Sequence: Synthetic coding sequence
atggccactctggtggtgaacaaactgggtgctggcgtggactccggcagacagggctcccgtggcactgccgtggtgaaggtgttagagtgcggagtctgcgaggacgtcttctctctgcaaggcgacaaggtgcctagattgctgctttgtggccacaccgtgtgccatgattgcctcactcgacttccactccacggcagggccatcaggtgtccttttgaccggcaagtgactgaccttggggattccggcgtgtgggggctgaagaagaatttcgccttgctggaattactcgaacgcctccagaacggtcctatcggccaatacggagctgctgaagaatctattggcataagcggagagtcaatcattcggtgtgatgaagatgaggcgcaccttgcttcagtatactgcacagtctgcgctacccatctgtgctctgagtgttctcaggtgacacattcaacaaaaacactagctaagcataggcgtgttccattagcggataaacctcacgaaaaaactatgtgcagccagcaccaggtgcacgctattgagtttgtgtgtctggaggagggttgccagacttctcccctgatgtgctgcgtttgcaaagagtatggcaagcaccaggggcacaaacactctgtgctggaacccgaggcgaaccagatccgggccagtatcctggatatggcccactgcatacgaacattcactgaagagattagcgactactccaggaaattggtgggaatcgtgcagcacatcgaggggggagaacagatcgtcgaggatggcattgggatggcgcacacagagcacgtgcctggcaccgcggagaatgccagatcatgcatcagagcttatttttatgacctccacgagacactttgccggcaggaggaaatggctttgtctgttgtggatgcacatgtgcgggagaaactcatatggctgaggcagcagcaagaggatatgaccattctgctgtctgaggtgtcggccgcttgcctgcattgtgaaaagaccttgcagcaggatgattgccgtgtggtcctggccaaacaggaaatcaccagactgctggaaaccttgcagaagcagcagcagcagtttactgaggtggcggatcacatccaacttgacgcttccatccctgttacattcaccaaggataatcgcgtgcacatcggccctaagatggaaatcagggttgtcaccttaggtctggacggtgcaggtaagacgacaattctctttaagctaaagcaggatgagttcatgcagcctattcccaccataggcttcaatgtggagaccgtggaatacaaaaacttgaagtttaccatttgggatgtcggtggcaagcataaactgcgtccactctggaaacactactaccttaacacccaggcagtggtgttcgtcgtggacagctctcatcgtgaccgcatctctgaggcgcactcggaactggccaagctgcttaccgaaaaagaactgcgcgatgctcttctcctcatctttgccaataaacaagacgttgcaggcgcgctaagcgtagaagagataacagagttgctgtccttgcacaaattatgctgcggaagaagctgcttcagcgacaacatgtag

SEQ ID NO: 14062 - DNA, 609 bp, Artificial Sequence
  Description of Artificial Sequence: Synthetic coding sequence
atggcagtgccagcggctcttattctgagagaatcaccttccatgaagaaggcagtcagcttgatcaatgccatcgacacgggtagattccctcgtcttctaacaaggatcctgcagaagttgcatctgaaggccgagtcttcattttccgaggaggaggaggagaaattacaagctgcatttagcttggagaaacaggacctccacttagttctagaaaccatttcgttcatactagaacaagctgtgtaccacaatgtaaagccagcagccctccaacaacagcttgagaatattcatctgagacaggacaaagccgaagctttcgtgaatacatggtcgagcatggggcaggaaaccgtggagaagtttaggcaacggatcctggccccatgtaaattggagacggtcggctggcaactaaatctgcagatggctcactctgcccaagcgaagcttaagtctccacaagcggtgctgcaactgggggtgaacaatgaggacagcaagagcctagagaaagtgttggtagagtttagtcacaaagagctgtttgacttttacaacaagttggagactattcaagctcagctcgactccctcacgtag

SEQ ID NO: 14063 - DNA, 1521 bp, Artificial Sequence
  Description of Artificial Sequence: Synthetic coding sequence
atggaagctgacatcatcacaaatctgaggtgtcgactcaaggaagctgaagaggagcggctgaaggccgctcagtatggactacagttagtggagagccaaaatgaactacagaatcagctggataagtgccgcaacgagatgatgaccatgacagagtcatacgagcaggagaagtacactctccagcgagaagtagaactgaagagcaggatgctagagagtttgagttgtgagtgcgaggcaatcaagcagcaacagaagatgcatctggagaagctggaagagcagctttcaaggagccatggtcaagaagtgaacgaactcaagaccaaaatcgagaagctgaaagtagaattggacgaggcacggttatccgaaaagcagctcaaacaccaggtcgaccaccaaaaagagttgttaagttgcaagtctgaagaactaagagtgatgtccgagagagtgcaggagagtatgagcagcgagatgttggcgttacaaattgaactgacagaaatggagagcatgaaggttaagtaccaatcattaaaaaaacaaaatgtgttcaatcgagagcaaatgcagaggatgaaattacagatcgctaccctgttacaaatgaagggctctcagacagagttcgagcagcaagagcgcctgctggccatgctggaacagaagaatggcgagattaagcacctcctgggtgaaattaggaaccttgaaaaattcaaaaacctatacgattcgatggaaagtaagcccagcgtcgactcaggaactcttgaggataacacctactacacggatttactacagatgaaactggacaacctcaataaagagatcgagtccaccaagggcgaactcagcatacaacgcatgaaggccttgttcgaatcacagcgcgcactagacatcgagcgaaaactgttcgccaatgaacggtgcttgcagctgtccgaatcggagaatatgaaactccgagccaagctcgacgagttaaaacttaaatacgaacccgaggagaccgtggaagtgccagtattgaagaagagacgtgaggtcttaccagtggacattaccacggccaaggatgcctgcgtgaacaactcagctttgggtggggaagtgtatcggttgcccccccagaaagaggaaactcagagctgccccaatagcctagaggacaataacctccagttagaaaagtccgtgtccatttataccccagtagtcagtttgagcccccataagaacctgcctgtggacatgcagcttaaaaaagagaagaaatgtgtcaaactcatcggtgtcccagctgatgctgaggccctgtccgaacgctctggcaacaccccaaactctcctcgcctcgctgcagaatccaagctccagaccgaggtcaaggaggggaaagagactagctcgaagctagagaaagagacctgcaagaaactgcacccaatcttgtatgtatccagcaaaagtacaccagaaacccaatgcccgcagcaatag

SEQ ID NO: 14064 - DNA, 1842 bp, Artificial Sequence
  Description of Artificial Sequence: Synthetic coding sequence
atggcgacaatacctgactggaaactacagctgcttgcccggaggcggcaagaggaggcgtcagtaagagggcgtgagaaggctgaacgcgaaaggctgtcccagatgcctgcttggaagaggggactgctggagcggagacgtgccaaattgggattgagtcctggagaaccatcaccagtactcggaaccgtggaggcgggtccaccggatcctgacgaatcggcggtcctgctagaagctattggtcccgttcatcagaatcgctttattagacaggagagacagcagcaacagcaacagcaacaacgaagtgaggagcttttagccgagaggaaacccggacccctggaggcgcgagagcgcaggccatcacctggtgagatgcgcgatcaatccccgaagggtcgagaaagtagggaggagcgcctctcaccccgggaaaccagagagagaagactcggtatcggtggcgcccaagagctttctctgcgacccttagaggcacgggattggagacagtcccctggagaggttggagaccgcagcagccggctaagtgaggcttggaagtggcgcctgagtcccggcgagactccggagcgctcactgaggctggcagagagcagggaacagtcccctaggcggaaagaggttgaatcgcgcctcagccctggggaatcagcatatcagaagctcggcctgacagaagcgcataaatggcgtcctgactcccgggagtcccaggaacaatccttggttcaactagaagccaccgaatggaggctccggagcggtgaggagagacaggattatagtgaagagtgtggaaggaaagaagagtggccggtgcctggcgtcgcccctaaagagaccgcagagctttcagaaactctgaccagagaggcccagggaaattcctctgccggggtggaggctgcggagcaaaggcctgtggaggacggggaacggggcatgaaaccgaccgagggctggaagtggacccttaacagtggcaaagctcgcgaatggaccccccgcgatatcgaggctcagacacagaaaccagagcctcctgagtctgccgagaaactgttggaatctcccggcgtggaagccggagaaggtgaagccgaaaaggaggaagccggtgcccagggccgaccactgagggccctccagaattgttgtagcgtgccgtctccactccccccagaagatgctggaacaggaggcttgcgccagcaagaggaggaagccgtggagctccagcctccccccccagccccgctctctccgcctccacctgctcctacagctccccagccgcccggcgatccactgatgtccaggctgttctacggtgtgaaggccggaccaggagtcggggcacctcggcggtcaggccacacgtttaccgtgaatcccagaaggtccgtcccgcctgcaaccccggccacacccacgagtcctgccacagtcgatgccgcggtccccggggcgggaaaaaagagatacccgactgcagaggagatcttggttctgggaggataccttcgtctgtccaggagttgcctggcgaaagggtcaccggaacggcaccacaaacagctcaagatatcgttctctgagaccgcccttgagactacctatcagtatccatctgagtccagcgtgctggaggagctcggacccgagccagaggtgccaagtgcacctaatcccccggctgctcagcctgatgacgaagaggatgaggaggaactccttttgctgcagcctgaactacagggaggcttgcggacaaaggccctgatcgtcgacgaaagctgccgcaggtag

SEQ ID NO: 14065 - DNA, 654 bp, Artificial Sequence
  Description of Artificial Sequence: Synthetic coding sequence
atgagttggacctgtcctcgctgtcagcagcctgtattctttgctgaaaaggtcagttcacttgggaaaaactggcacaggttttgcctgaagtgcgaaagatgccattccattttatctcctggaggccatgcggaacataacggtcggccttattgtcacaagccttgctacggggctctttttgggcctaggggggtgaacatcggcggggtaggtagctacctgtataatccacccacacctagccccggctgtacaacccctctcagtcccagtagtttctcccctccgagacctcgcaccggcctcccacaagggaagaagtctcctccacatatgaaaacttttacaggagagacctcactgtgccctgggtgcggggagcccgtatactttgccgagaaagtcatgtcccttggaaggaactggcacagaccttgcctcaggtgtcagcgttgccataagacgctaactgcaggatctcatgccgagcacgatggtgttccatattgtcacgtcccatgttacggatatctgttcggcccgaagggtggacagcctcatccccggcattgggatggaatgtacatgccggaagtgtggcacgtgcatgggctgtgggtgtgcgtggataattttccctgtggatag

SEQ ID NO: 14066 - DNA, 1503 bp, Artificial Sequence
  Description of Artificial Sequence: Synthetic coding sequence
atgaaccagcggaggtcagagtctaggcctggcaaccacaggctgcaggcctacgcggagccaggtaagggcgattccggaggtgctggtccactctcaggcagtgcacgacgcggcagaggcggcggtggcgccattcgggtccgtagaccttgctggagcggcggggcaggcagggggggggggccggcctgggccgtccgcctgcctactgtgactgccggctggacctggccagcactcaggacactgagctcactgcgcgccggcccctccgagcctcacagtcctggcaggcgaccacccagggcagggcggcctctgtgccaggctgatcctcagcctggcaaggcagcacgcaggagtctagaacccgaccctgctcagacaggaccaaggcctgccagagccgccggcatgtcagaggcacgcaaaggccctgacgaggcagaagagtctcaatatgactcaggcattgagtccttgcggagtctccgctcactacccgagtctacaagcgcccccgcctcaggccccagtgacggttcccctcagccatgcacccacccccccgggcctgtgaaagaacctcaggagaaagaggacgccgacggcgagagagcggatagcacatacgggtccagcagcctgacctacaccctctctttgctgggggggcctgaggccgaagatcctgccccccgtttgccattgccacacgtgggcgctctctccccacagcagctggaagctctgacgtacatatccgaggacggggacacacttgtgcacttggccgttattcatgaagcacccgcggtcctcctgtgctgtctggcccttctgccccaagaggtgttggacatccagaacaatctgtaccagaccgccctgcacctggccgtgcacttagatcagccaggtgcagtccgggcgctggtcctcaaaggagcgtccagagcactgcaggacaggcatggcgataccgcgcttcacgttgcctgccagcgtcagcacctggcctgtgcccgctgcttgctggagggacgcccagaaccaggcagggggactagccacagcctcgatctccagcttcagaactggcagggtctcgcctgtctgcatatagccaccctgcagaaaaatcaacccttgatggagctcctattaagaaatggcgcagacatagatgtccaagaggggacctccggaaagacggcgctccacttagcagtggaaacccaggagaggggattggtacagttcctgctacaagctggcgcccaagtcgatgctcgcatgctgaacggatgtacaccactccatctggccgcaggcaggggtctcatgggcatctcgagcactctgtgtaaagccggcgctgacagtctgctaaggaatgtggaggatgagacaccccaggacctgacagaggagagcctggtcctgctgcctttcgatgatctgaagatttccggtaaactactgttgtgtacggactag

SEQ ID NO: 14067 - DNA, 1881 bp, Artificial Sequence
  Description of Artificial Sequence: Synthetic coding sequence
atggaaggaccaagagagaatcaagatcccccccccagaagtctggcccgccatctcagtgacgccgatcggctcaggaaggttatccaggaactggtcgacacggaaaaatcctatgtcaaggacctatcatgtctgtttgagttgtatttggaaccactccagaatgagacattcctcacacaagacgagatggaatccctgtttggatcgcttcccgagatgctcgaattccagaaagtgttcctggaaaccctggaggatgggatcagtgcttccagtgatttcaatacactcgaaactccgtcacagttccgcaagttactcttttcactgggcgggtcattcctatattacgctgatcacttcaagctgtactctggcttttgtgcaaatcatatcaaagtccaaaaagttctcgaaagggctaaaaccgataaggcattcaaggccttcctggacgccaggaatcctaccaaacagcactctagtaccctcgagtcttacctgataaagcctgtccagcgagttctgaaatacccactgctgcttaaggagctcgtctcactgaccgatcaagagtccgaggaacattatcacctgaccgaagcattgaaggccatggagaaagttgccagccatatcaatgaaatgcagaaaatatacgaagactatggaacagtattcgaccagctcgtggccgagcagagcgggactgagaaggaagtcacagagctgtcaatgggcgaactccttatgcattctacagtatcctggcttaatccattcctgagcctaggcaaggcacgcaaggacctcgaactgacagttttcgtgtttaaaagagccgtgatcctcgtgtacaaggagaattgcaagctcaagaagaaattgccgtcgaatagccgccctgctcacaattctacagacctagatcccttcaagttcagatggctcatccctatatcagccctccaggttcggctgggaaaccctgccgggacggagaataacagcatttgggagctgatccacacaaaatctgagattgagggtaggccggaaacaattttccagctctgttgctctgacagcgaaagcaaaactaatatcgtcaaagtgatcaggtcaattctgcgcgagaactttaggcggcacattaaatgcgagttgcctcttgagaaaacctgtaaggaccgtctggtcccgttgaagaatagagtccccgtgagcgctaagctggcctcctctcgaagcctcaaggtacttaagaattcctctagcaacgagtggactggcgaaacaggaaagggtacattactagactcagatgaaggctcactgtcatccggaacccagtcgagcggttgtcccacagccgaaggcaggcaagactccaaatctacctctccaggcaagtacccccatcctggcctggctgattttgcggacaacctcatcaaggagagcgacattctctccgatgaagatgacgaccatcgccagaccgtcaaacaaggctcacccacaaaggacattgagatccaattccagagactgagaatttccgaagatcccgacgtacacccagaagctgagcaacagccaggccctgaaagtggggagggccagaagggaggcgaacagcccaaactggtgcggggccacttctgtcctataaaaaggaaagccaattccactaaaagggatcgagggactctgctgaaggcgcaaattaggcaccagagccttgacagtcagtcagaaaacgcaacgattgatttaaacagtgtcttggaaagggaattcagcgtccaatcgctgacttccgtggtaagcgaagagtgcttttacgagactgaatctcacggaaaaagttag

SEQ ID NO: 14068 - DNA, 1596 bp, Artificial Sequence
  Description of Artificial Sequence: Synthetic coding sequence
atggccgcagttaagacactgaatccaaaagcggaagtcgcgagggcacaagccgcacttgcagtaaacatttccgccgcccgggggctgcaggacgtgctccggaccaaccttggccctaaggggactatgaagatgctggtgtctggagctggcgacattaaactgacgaaagatggaaacgtccttttacatgaaatgcagattcagcatcccaccgcctccttgatcgccaaagttgctacagctcaggatgacatcacaggagacggaactaccagcaacgtactcattataggtgagttactgaagcaagctgacctgtatattagcgaagggctccaccccagaattatcacggagggttttgaagccgcaaaggaaaaagctctgcagttcctggaggaagtgaaagtttcccgggagatggaccgtgaaacacttatcgatgtagcacggacgtcccttcggacaaaggtgcacgcagaacttgccgatgtactgacagaagccgttgttgattcaattttggcgattaaaaagcaggatgaacctattgacctgttcatgatcgagataatggaaatgaaacacaagtcagaaacggatacttctctgatcagaggtctagttcttgaccatggtgcacggcaccctgatatgaaaaagcgcgtggaggatgcctacatccttacctgtaatgtgagccttgagtacgaaaagactgaggtcaacagcggcttcttttataaatcagctgaggagcgtgaaaaacttgttaaggccgagcggaaattcatcgaagatcgcgttaagaagattatcgaactgaagcgaaaggtctgtggggatagtgataagggctttgttgtcataaatcagaaaggaatcgatccgttctcactggatgctttatccaaggaaggtatcgtggccctcagaagggccaagcgtagaaacatggaacggctcaccctggcatgtggcggggtcgcattaaatagcttcgacgatctttcaccagactgtctaggccacgccggactggtatatgagtacaccctcggagaagagaaatttacctttatcgaaaagtgcaataaccccaggagtgtgactctcctgatcaaaggtccaaacaagcacacactcacacagataaaggatgcagtgcgagatgggctgagggcggtgaaaaacgccatcgacgatggctgcgtcgtgccaggcgcaggggctgtcgaggtcgcaatggccgaggccctaatcaagcacaaaccctcggttaagggcagagcccagcttggagttcaggccttcgcagacgctctgctgataatcccgaaagtgttggcacagaactcgggcttcgatctccaggagacactcgtcaaaatacaggccgagcacagcgagtccggccagctggtgggtgtcgatttgaatacaggggagccaatggtcgccgctgaggtgggggtttgggacaactactgcgtcaaaaaacagctgcttcacagttgcactgttattgccaccaacatcttattagtggatgagataatgcgagccggaatgtccagtctcaagggatag

SEQ ID NO: 14069 - DNA, 666 bp, Artificial Sequence
  Description of Artificial Sequence: Synthetic coding sequence
atgtctgcttttggccacgatgaggcttggatggaagctggcggcttcggtcttgaagctgccgagagaacagaatatcaatctttgtgcaaatctaaacttctgtttctcggagagcagtcaggcaaaaccagcataatttccagatttatgtacaactccttcggttgcgcttgtcaggctactgtgggcatcgatttcctttctaaaactatgtacttagaggaccagatcgtgcagctccagctgtgggacactgctggacaggaaaggttccacagtctcattcccagttacattcgcgactctacaatagccgttgtggtctacgatataacgaacataaactcattcaaagagacggataaatgggttgagcacgttcgggctgagcggggagacgatgtcgttattatgctgctggggaataagattgacctggacaataagaggcaggtgaccgcagaacagggggaagagaaaagccggaacttgaatgtcatgttcattgagaccagcgccaaaactggctataacgtgaaaaaattgtttagacgggtcgcgtcagcgcttctgtcgactcgtacctcacctccccctaaagaaggtactgtagagatcgagttggaatcttttgaggagtccggaaacagatcctactgctag

SEQ ID NO: 14070 - DNA, 6222 bp, Artificial Sequence
  Description of Artificial Sequence: Synthetic coding sequence
atggcagaagtgcgcaaattcactaagagactttcaaaacccggcaccgcagctgaattgcgccagagtgtgtctgaggcggtgaggggtagtgtggtgctagagaaggcgaaagtggtggagcctctggattatgagaatgttatcgcacagagaaaaactcagatttacagcgaccctctaagagatcttctaatgttccccatggaggacataagcatctcagtcataggccgccagcgacgtacggtacagagcactgtgcctgaggatgctgagaagagagcacagagtctcttcgttaaagaatgcattaagacatactccaccgattggcacgtggtgaactataaatacgaggacttctccggagattttagaatgcttccctgcaaatcactacggcctgaaaaaataccgaaccatgtttttgaaatagacgaggattgcgaaaaagacgaggactcttcgtctctatgtagtcagaagggcggcgtaattaaacaaggctggcttcataaggcgaacgtcaatagtactataacggtgacaatgaaggtttttaagcgtcgctacttttatctgactcaattacctgatggcagctacatactgaacagttataaggatgagaaaaactccaaagagtcgaaaggttgtatttaccttgacgcctgtatcgatgtggtacaatgtcccaaaatgcgtagacatgccttcgaactcaaaatgctcgacaaatactcgcactatctggctgcagagacagaacaagagatggaggaatggttgatcactttaaaaaagattatacagatcaacactgactcactggtgcaggaaaagaaggagaccgtcgaaacagcgcaggacgatgaaacttcatctcaagggaaggcagagaatatcatggcatcacttgaaaggtctatgcatccagagctgatgaaatacggcagggagaccgaacagctgaacaagcttagcaggggggacggccgtcagaatttgttctcctttgattcagaggtacagcggctggactttagtggtatcgagcccgatattaaaccattcgaagaaaaatgtaataaaagattcttagtgaactgccacgatctaacttttaatatactggggcagatcggtgacaacgctaagggaccccctaccaacgtggaaccattctttataaatttagccttgtttgatgtgaaaaacaactgcaaaattagcgccgacttccacgtcgacttaaatcctccctctgttcgagaaatgctatgggggtcttcaactcagcttgcgagcgatggaagtcccaagggcagcagccctgaatcctatatacacggaattgccgagagccagctgagatatatccagcagggcatcttcagcgtgacgaatcctcaccccgagatttttctcgttgcccggatcgaaaaggtactgcaaggtaacataacccactgcgccgagccctacatcaagaatagtgaccccgtaaagacggcccagaaggtgcaccggactgccaagcaggtgtgctcacgccttgggcaatataggatgccgttcgcgtgggccgcaagaccaatcttcaaggacacccagggtagcctggatttagatggcaggttctccccgctctacaagcaggactcctctaaactcagcagcgaggatatattgaagttattgagcgaatacaagaaaccggagaaaaccaaacttcagattataccaggacagctgaacattacggttgaatgcgtgcccgtcgacctgagcaactgtatcacatcttcctacgtgcccctgaagcctttcgaaaaaaactgccaaaatattacagttgaggtcgaggagtttgtcccggaaatgactaagtattgctatcccttcacaatctacaagaaccatttgtatgtctaccccttacagctgaagtacgattcccagaaaactttcgctaaagctcgtaatatcgctgtctgtgtcgagttcagagactccgacgagagcgatgcatccgctcttaaatgtatatatggcaagcccgccggtagcgtttttacaacaaacgcctatgctgttgtgagtcaccacaaccagaatcccgagttctacgacgaaataaaaattgaactccccatccatctacaccagaagcatcacttgcttttcaccttctatcacgtctcttgcgagattaacaccaagggtaccaccaaaaagcaagatactgtagagacccccgtcggatttgcttgggtgcccctcctgaaagatggccgcatcatcacattcgaacagcagctgcccgtgtctgctaatctgcctcccgggtatctgaatctcaatgatgccgagtcccggcggcagtgcaacgtcgatatcaagtgggtagatggtgctaagccactgcttaaaataaaaagccacttggagtctacaatctacacgcaggaccttcacgtccacaaattttttcatcactgtcagttgatccaatctggctcaaaagaagtaccaggggagcttatcaaatatctaaagtgtctccatgccatggagattcaagtaatgatccagtttctgcccgttattctaatgcaactgttccgcgtccttaccaacatgacgcatgaggacgacgttcctatcaactgtacaatggtactactgcatatagtcagcaaatgccatgaggaggggctcgatagctacctgcgctcgttcatcaagtatagctttcggccagagaagccatccgccccccaagcgcaactgatccacgagacccttgcgacaacaatgatcgctattctgaagcagagtgccgattttctgtctattaataagttgctgaaatacagctggttctttttcgagattatcgccaagagcatggccacttatctgttagaggaaaacaagatcaagcttccacggggacagcggttccctgaaacataccaccatgtgttacatagcttgctgttggccattatcccccacgtgactatacggtatgccgagatacccgacgaatcacggaatgtgaactactcactggccagcttcttgaagcgctgcctgacgctcatggaccggggctttatctttaaccttattaatgattacatttcaggcttctctccaaaagaccccaaagtgctcgctgagtataagttcgagttcctgcagactatatgtaatcatgagcactacattcctctcaacctgcctatggcctttgctaagcccaaacttcagcgcgtccaggatagtaacctggagtattcactgagtgacgaatattgcaagcaccattttctggtagggttattactccgtgaaacctcgattgctcttcaggacaactacgagattcgctataccgctatttcagtcattaagaatctgctaatcaagcatgcatttgacaccagataccaacacaagaaccagcaggccaaaatagcacagctgtatctcccttttgtcggacttctgttagagaatatacagagactggccggccgcgatacactgtattcttgtgcagcaatgcccaattcggctagcagagacgaattcccctgcgggttcacaagccccgcaaatcgcggcagtctctcgacggacaaagacactgcttatgggagtttccagaatggccacgggattaagcgcgaggacagcaggggtagccttattccagaaggcgctacggggttccctgatcagggaaacacaggggagaatactcgccaaagtagtacacgctcatccgtgagtcaatataacaggctggaccagtatgagatccgctcactgctcatgtgttatctgtacatcgtcaaaatgatttcggaagataccttactgacatattggaataaggtttctccgcaggagctgattaatatcttgatccttttagaagtttgcctcttccactttagatatatgggaaagcggaatatcgccagggttcatgatgcttggctcagcaaacatttcggaattgaccgcaagtctcagacaatgcctgccttacggaacagaagcggtgtcatgcaagctaggctacaacacctgtcatcgctcgagagtagttttactctgaaccacagttctactacaaccgaggctgacatcttccatcaagcacttctagaaggaaacaccgctactgaagtgagtttgacagtcttggacacaatttcatttttcacacaatgctttaagactcagctcctgaacaatgacggtcacaatcccctcatgaagaaggtctttgacatccacctcgccttcctaaaaaacggccaatcagaggttagtttgaagcacgtgttcgcatcactcagggccttcatatctaaatttccctcggccttttttaaaggtagggtgaacatgtgcgcagcattttgttacgaggtgctgaagtgctgtacctccaaaatatccagcacccgaaacgaggcgtctgctttgttgtatttgctcatgcgcaacaacttcgagtacactaagaggaagacatttctgagaacccatctgcagattataatcgccgtcagtcagctcatcgccgacgtggccctctccgggggcagccgttttcaggagtcactgttcataataaacaacttcgcaaattccgaccgcccaatgaaagcaacagcctttcccgccgaagtcaaggacctgacaaaaagaattagaaccgttcttatggcgactgcccagatgaaagagcatgagaaagatccggagatgctgatcgatctccagtattcactggctaagagctacgcatcaactccggaacttcgcaagacatggctggatagtatggctaagattcacgttaagaatggagacttttccgaggctgcaatgtgctatgtacatgtggccgccctggttgccgaattcctccaccgcaagaagctcttccccaacggctgcagcgctttcaagaaaatcacaccaaatattgacgaagagggagcaatgaaggaagatgcaggcatgatggatgtgcactacagtgaggaagttctcttggaactgctggaacaatgcgttgatgggctttggaaggcagagagatacgaaatcatctctgagatcagtaagctgatcgtccccatttacgagaagaggcgggagttcgaaaaactaacccaagtgtatagaacgttacatggcgcctacacgaagatattggaagtcatgcatactaaaaagcgattactgggaacatttttcagagtggctttctacggacaatccttcttcgaggaagaagatggaaaggagtacatttataaggagcccaagctcactggcctgtcggaaatctcgctcagactcgtaaagctttacggggaaaaattcggcaccgagaacgtgaagattatccaggacagcgacaaggtcaacgccaaggaactcgatcctaagtacgcgcacatccaggtgacctatgtgaaaccctatttcgatgacaaagaactgaccgagagaaagaccgaatttgaaaggaaccataacatcagcaggtttgtattcgaagctccatacactctgagtgggaagaagcaggggtgtattgaggagcagtgtaaaagaaggaccatactgacgacaagcaacagttttccttacgtgaagaaaaggattccaattaactgcgagcagcaaatcaatctgaagcctatcgacgttgccacggatgaaattaaggacaagactgccgagttgcagaaattgtgctctagtacggacgtcgacatgatccaactgcaactcaagctgcagggctgtgtctcagtacaggtgaacgccgggcctctggcatatgctcgtgcctttctcaacgacagccaagcatcgaaatacccacctaagaaggtgtcggagctaaaagatatgtttcgaaagttcattcaggcatgctccattgccttggaactgaacgaaaggctgatcaaggaagatcaggtcgaatatcacgagggactgaaatctaattttcgggacatggtgaaagagctctccgacatcatccacgagcagatccttcaggaagacactatgcatagcccttggatgagtaacacactccatgtattttgtgctatctccgggacttcttctgacagaggctatggctcacccagatacgcagaagtttag

SEQ ID NO: 14071 - DNA, 1644 bp, Artificial Sequence
  Description of Artificial Sequence: Synthetic coding sequence
atgggcgggtgcattcccttcttaaaggctgccagggcgctgtgcccccggatcatgccgcctttattactgttatccgcgttcatctttctcgtctccgtgcttggaggcgcccccggacacaacccagatcggagaacaaagatggtctccattcatagtctttctgagttggaaaggctgaagctacaggaaacagcctaccacgagctagtcgctaggcacttcttaagtgaattcaaacctgaccgtgctttgcccatagaccgccccaacaccctggacaagtggttcctaattttgagaggccagcagcgcgccgtgtcgcacaagacgttcggtatatcactagaggaggtcctggtcaacgaattcacaaggcgcaaacacctggagctgaccgccacaatgcaggttgaggaggcaactggccaagctgctggaaggcggcggggcaacgtagtccgacgcgtgtttggaaggatcaggaggttcttttcacgcaggaggaatgagcccacactgcccagagagttcaccaggaggggacgtcggggagccgttagcgtcgactctctcgccgaacttgaagacggcgctctgctccttcagacattacagctgtcaaagatatccttccctattggtcagaggctgctgggctccaaacgaaaaatgagcttaaatccaattgctaagcagatccctcaggttgtggaggcgtgctgtcagtttatagagaagcacggcctgtcggcggtcggaatcttcactctggagtattctgttcaaagggtacgtcagctgcgcgaagaattcgatcaaggtctggatgtcgtgcttgatgataatcagaatgtgcatgacgtggccgcacttctgaaggagttcttcagggacatgaaagactcgctgcttccagacgatctgtacatgagcttcctgcttaccgcgacactgaagcctcaggaccagctgtcagctctgcaacttctcgtctacctgatgcctccctgccacagcgacaccctggaacgcctgctcaaggctctgcataagatcaccgagaactgtgaggactccatcggaatcgacgggcagctggttccaggtaatcgaatgacgagcaccaacttggccctcgtattcggatccgccctgctgaagaagggcaaattcggcaaaagggaaagtagaaagaccaagctgggaatcgaccattatgtcgcttccgtgaatgtggttcgcgccatgattgataactgggacgtcttgttccaggtcccgccccacattcaacggcaagtggccaaacgtgtgtggaagtccagccccgaagcgctggatttcatccgccgtagaaacttgagaaaaatccaaagtgcccgaatcaaaatggaagaggatgccctgctgagcgaccctgttgaaacaagcgcagaagcgcgggctgcggttttggcccagtcgaagccatccgacgagggtagcagtgaggaacccgccgtgccatccgggaccgccagaagtcacgacgacgaggagggtgctgggaacccccccattccggagcaagaccgcccactgctgcgggtgcctcgggagaaggaggctaaaaccggagtctcatattttttcccgtag

SEQ ID NO: 14072 - DNA, 5613 bp, Artificial Sequence
  Description of Artificial Sequence: Synthetic coding sequence
atggcacgctggattcctacgaaaaggcagaaatacggggtggccatctacaactataacgcgagccaggatgtggaactttctctgcagataggggacaccgtgcacatccttgagatgtacgagggttggtaccgggggtatactctccagaacaagagcaaaaaggggatctttcctgagacctacatacatctgaaggaagccaccgttgaggacctgggccaacacgaaactgtcatcccgggagaactgcccctggtgcaagaattaacaagtactctgagggaatgggccgtgatctggaggaaactttacgttaataataagttgactctgttccggcagctccagcagatgacgtattccctgatcgaatggcgaagccagatcttgagcggcactcttcccaaagacgagctggcagagctcaagaagaaggttaccgcaaaaattgaccacggtaatcggatgttaggcctggacctcgtcgtgagggacgataacggcaacattctggatcccgacgaaaccagcaccatcgcactgtttaaagcccacgaagtggcgtccaagcgaattgaggagaagatccaagaagagaaatcaatcctgcagaatttggacctcaggggccaatcaatcttttctaccattcacacgtatggtctgtacgttaacttcaagaacttcgtctgcaatatcggtgaggacgcagagctgttcatggccctgtatgatccagaccagagcacctttattagtgagaattacctgatcaggtggggttctaacggtatgcccaaagagatcgaaaagcttaacaatcttcaggctgtatttaccgacctgagctccatggacttaatacgccctcgggtttctctcgtgtgccaaattgttagagtcggtcatatggaacttaaggagggcaagaaacacacctgtggtctcagacggccttttggcgtcgccgtcatggatattaccgatattattcacggtaaggtagatgacgaggagaaacaacactttatccccttccagcagattgccatggaaacatacatccgtcagagacaacttattatgtctcctttaattacaagccatgtaatcggagaaaacgagccactgacttccgtgctgaacaaagtgatcgcggccaaggaggtgaaccataaggggcaggggctatgggtcagtctgaaactgctgccgggcgacctaactcaggtacagaaaaactttagccacttggtggataggagcaccgctattgccagaaagatgggattccctgagatcattctgccaggggatgttcgtaatgatatctacgtcacactgatccacggtgagtttgataaaggaaagaagaagacccctaaaaacgtcgaagtcactatgtcagtgcacgacgaggaagggaagctcctggagaaagctatccaccccggagctggttacgaaggcatcagtgaatacaagagcgtggtgtactaccaggtgaaacagccctgctggtatgaaacggttaaagtgagcatcgcaatcgaagaggtgacaaggtgccatattagattcaccttccgacaccgttcgtcacaggagacacgggataaaagcgagcgggcctttggcgtggcgtttgtcaagctgatgaacccagacggcaccaccctccaggatggcaggcacgatctggtagtgtacaagggagataataaaaagatggaggatgccaagttctacctaactctgcccgggaccaaaatggagatggaggaaaaggagttgcaggcttcaaagaacctcgtaacgttcacccctagtaaagactctacgaaagactcctttcagatagcgacactcatttgcagcactaagttgacccagaatgtggatctattaggcctactgaactggcgtagtaattcccagaatattaaacataatctcaaaaaattgatggaggtggatggcggcgagatcgtgaaattcctccaggatactttagatgctctgtttaacataatgatggaaatgtcggattccgaaacctatgatttcctggtcttcgacgctctggtgttcatcatttccttgataggagatataaagtttcaacacttcaacccggtcctggagacttacatatacaaacatttttctgctactctcgcgtatgtcaaactgagcaaggtgttaaatttctacgttgccaatgccgacgactcgtctaaaacagagctgttgttcgccgccctgaaggcccttaaataccttttccggtttataattcaaagcagggtgctgtatctgcgattctacggccagagcaaggacggagacgaatttaataattcaattcgccagttattcctggctttcaacatgctcatggataggccgctcgaggaggctgtgaaaatcaaaggagcagcactgaagtacctgccctcaattattaacgatgttaaactcgtgttcgatcctgtggagcttagcgttctgttctgcaaatttattcagtcgatccccgataaccagcttgttaggcagaagctgaactgcatgacaaagatcgtggagtctaccctcttccgccagagcgaatgcagggaagtactcctgccactactcaccgaccaactgagcggacaactcgatgacaattctaataagcctgatcacgaggcatctagccagctgctgagcaacattctcgaagtattggataggaaagacgtgggagccaccgccgtgcacatccagctgatcatggaaagactcttgcggaggattaatcgtacagtaatcgggatgaatagacagtccccccacatcgggtccttcgtggcatgtatgattgccctgctccagcagatggacgactcccattatagtcactatatctcaacgtttaagaccaggcaggatatcatagacttcctgatggaaacattcatcatgttcaaagatctgataggcaagaatgtttacgccaaggactggatggtgatgaacatgacgcagaacagggtgttccttagggcaataaaccagtttgcggaggttctgacccgcttctttatggaccaggcatcgtttgagttgcagctctggaacaactacttccaccttgccgtagcttttttgacccatgaatctctgcagctggagactttctctcaggccaagcggaataagatcgtgaagaagtacggcgatatgcgaaaggagataggcttccggattcgggacatgtggtacaatctcgggcctcataagataaaattcatcccctcaatggtgggccccatcctcgaggtcaccctgactcctgaggtcgagttgcgcaaggcaacaatccccatcttctttgacatgatgcagtgtgaattcaactttagtggcaatggaaacttccacatgtttgaaaacgaactgattacaaaactcgatcaagaggtggagggcggcaggggggatgagcagtacaaggtcttactggaaaagctcctgctggagcactgtcgcaagcataaatacctgagtagttccggtgaggtattcgcactgttggtctcaagcctcctagaaaacctgctggattaccggacaatcatcatgcaggatgagtctaaagagaatcggatgagttgcacagtgaacgtgttgaatttctacaaggagaagaaaagggaggatatttacatccgctatctttacaaattgcgggatctgcacagagactgcgaaaactatactgaagcggcctatacactccttctgcacgctgagcttctgcagtggagtgacaaaccttgtgtgccccatctattgcagaaagacagctactatgtgtacacccagcaggaactaaaagagaagctgtatcaggaaattatttcctacttcgacaagggcaagatgtgggagaaggcaatcaaacttagtaaagagctggccgagacatacgagtccaaggtgttcgactacgaaggattggggaacctcctgaaaaagcgggcaagcttttatgaaaatattattaaggctatgcggccccaaccagagtattttgccgttggatactatggccagggcttcccaagctttctacggaataagatctttatatacagagggaaggagtatgaaagaagggaggacttcagtctccgcctgttgacacagtttcccaatgcagaaaagatgacctcaaccacaccaccaggcgaagatataaaaagttcccctaagcaatatatgcagtgctttacagtgaaacctgttatgtccctccctccaagttataaggacaaacccgtgccggagcagattttaaactactaccgtgcaaacgaggttcaacaattcagatactcacgaccattccggaaaggggagaaggacccagacaatgagttcgctacaatgtggatcgagcgtacaacatacacaacggcctacactttcccaggaatcctgaagtggttcgaagtgaaacagatatctactgaggaaatctccccgctggagaatgccatcgagacaatggaactgaccaacgagcgtatctctaattgcgtccagcagcatgcctgggatcggtctctgtccgtgcatccactaagtatgttgctctcgggcattgtggatcccgccgtcatgggcggcttttctaactacgagaaggctttcttcactgaaaagtacctgcaagagcatcccgaagatcaagagaaagtcgagctgcttaaacgactgatcgccctgcaaatgcctctgctgacagaagggattcgcatacacggggaaaagctgaccgagcaactcaagcccttgcatgagcggctgagtagctgtttcagagagctcaaggagaaggtggaaaagcattatggcgttatcaccctgccacctaacttgaccgagagaaagcagtcccggactggatcaattgtcctgccctacattatgagctctaccctaaggagactgtccatcacaagcgtgacaagtagcgtggtttcgacttccagcaattccagtgataacgcaccatccaggcccggctcggatgggtctattctggaaccactgttggagcgcagagcttcaagcggtgctagggtcgaagaccttagccttcgggaagagaacagtgaaaatagaatctccaagttcaaaagaaaagactggtccttatccaagagccaggttatagcggagaaggcccctgagcccgacttgatgtcacccactagaaaggctcagcgacctaagtctctacaactgatggataaccgtttaagcccattccacggctcctctccaccacagtcaacaccgctcagccctccccctttgacaccaaaggctaccaggactttgtcttctccaagtctacaaaccgacggcattgccgccacccctgttcccccaccaccgccaccaaagtcaaaaccttatgagggttcccaaagaaattcaactgaactcgcccctcctctgcctgtgcgtcgggaagctaaagcgcctccccccccccccccaaaggcccgaaagtcaggcatccctacttcagagcctggcagtcagtag

SEQ ID NO: 14073 - DNA, 1623 bp, Artificial Sequence
  Description of Artificial Sequence: Synthetic coding sequence
atgtccgcatcacttaattacaaaagctttagcaaagaacagcagacaatggacaatttggagaaacagctcatctgcccaatttgcctggaaatgttcaccaagcccgtggtgatattaccatgccagcacaatttgtgtaggaagtgcgcaagtgacattttccaggcttcaaacccatatctgcctaccagaggggggaccacgatggctagcggcggacggtttcgatgtccttcatgcagacatgaggtggttctcgacagacacggcgtttacggactgcaacgaaatctgttggtcgagaacatcatagacatctacaagcaggagagcacgcgccctgagaaaaagtcagatcagccaatgtgcgaggagcacgaagaggagcgtatcaatatttattgcctaaattgcgaagtccccacgtgttccttatgcaaagtctttggcgcacacaaagactgccaggtcgcccctctcactcacgtgtttcaaaggcagaagagtgagttgtcagatggcatagccatcctggtcggaagcaacgatcgggtgcagggagtaataagccagttggaagatacctgtaaaacaatagaggaatgctgtaggaaacagaagcaggagttgtgcgaaaaattcgactacctgtacggaatactggaggagagaaagaacgaaatgactcaggtaatcacacgaactcaagaagaaaaacttgaacatgtgcgggcccttattaaaaaatactccgatcatctggagaacgtgtctaagctggtagagagcggtattcagttcatggacgagcccgaaatggcagtcttcctccagaacgcaaaaacgctccttaaaaagatcagcgaggccagcaaggcgttccagatggaaaaaatcgaacacggatacgaaaatatgaatcactttacagtaaatctgaatcgggaagagaaaattatcagagaaatcgacttctatagggaagatgaagacgaggaggaggaagagggaggggagggcgagaaagagggcgagggagaggtgggcggcgaagcagtggaggttgaggaagtcgagaatgtgcagacagagttccccggggaggacgagaatcccgaaaaagcaagcgaactgtcacaagtcgagttgcaggcagcacctggagcccttcccgtctcatctccagagccgcctcctgcgctgcccccggctgcagacgctcccgtaacgcagggagaagttgttccaactgggtcagaacagactacagagtcagagacgcctgtgcctgccgccgcagagactgctgacccgcttttctatccatcctggtataagggccagactagaaaggcaacgactaaccctccttgcacccccgggagcgagggattaggccagatcggccctcctggttcagaggattcaaacgtcaggaaggctgaagtcgccgcagcagccgcgtccgaaagggctgccgtgagcggtaaagagaccagcgccccagccgctacgagtcaggagctcgtcatctgcctcgccctgctggcttttctcatcttgcactacatttggtcacaaatccagtgtttgatattcacactgatggactggatctag

SEQ ID NO: 14074 - DNA, 3252 bp, Artificial Sequence
  Description of Artificial Sequence: Synthetic coding sequence
atgtcacagacccaggactatgaatgccgatcccacaacgtggatttgccggaaagccggatacctgggagcaacacgaggctggagtgggtggaaataattgagcctcgcacccgcgaacggatgtacgccaacctcgtgacaggcgaatgcgtctgggacccccctgcaggggtacgtattaaaagaacgtcggagaaccaatggtgggagctgttcgatcctaatacaagcagattttactactataatgccagtacgcaacgaacagtgtggcatagacctcagggttgcgatataattcctctggcaaagctccagaccctcaaacagaataccgaatcaccccgcgcgagcgctgagagcagcccaggccgtgggtcttccgtctcccgggaaggctctacatcctcctcactggagcctgagcccgacactgagaaagcacaagagttacccgctcgcgcaggtaggcctgcagcctttggtactgtcaaggaggatagcgggagctcctcaccacctggtgtctttcttgaaaaggactatgaaatttacagagattactccgcggacggacagttgttgcattaccgcacttcaagcctgcgttggaactccggcgcaaaggaaagaatgctgatcaaagtggctgatcgagagccctctttcctcgctgcccagggtaatgggtacgctcctgatggccccccgggtgtccgatcgcgacgtcctagcggctcacagcatagcccgtccctccagaccttcgcacccgaagcggacggcaccatattcttccccgaacggcggcctagtcctttccttaaaagagctgaacttccagggagttctagcccccttctggcacaacccagaaagccaagcggcgacagccagccgagctcgccacgatacggatatgaacctccactctatgaagagccaccagttgagtatcaagcccctatttacgatgagcctccaatggatgtgcagttcgaggccgggggtggttatcaagcagggtcaccccagcggtctcctggccgcaaacctcgccccttcttacaacccaataagcagggtcccccctctccctgtcagcaactcgttttgactaaacaaaaatgccctgaaaggtttcttagtcttgagtatagcccagccggcaaggagtacgtccggcagttggtgtacgtggagcaagcaggctcaagccccaagctacgagccgggcctcgacacaagtatgctccaaatcccggggggggctcctactccctgcagcccagtccgtgcctgttgcgtgaccagcgtcttggtgttaaatccggtgattactccaccatggagggtccggagctccgccactcccagccccctacccctttgcctcaagctcaagaagatgctatgagctggtcttcacagcaggacactttatcttccaccgggtacagccccggtactcgcaagagaaaatctaggaaacccagtctttgtcaggccaccagcgcaacacctactgaaggccccggcgacctgctagtcgaacagccattagcagaagagcaaccgccttgcggtacatctcttgcgccagtgaaacgcgcagagggcgaagcagagggcgcacggggtgccgctgaaccttttcttgctcaggcaaggctggcatgggaggcccagcaggctcacttccatatgaagcagaggtcctcttgggatagccagcaagatggctctggctatgaatccgatggcgcactgcccctgcctatgcctgggccggttgttcgtgccttcagtgaggacgaggctctggctcaacaagaaaacagacattggcggcgtggaacctttgagaagcttggcttcccccagatcctcctggaaaagagcgtgagcgttcagaccaacctcgcttcacccgagccctatctccacccttcgcaatcagaagacctcgccgcctgcgcccagtttgagtcaagcaggcagtcccgctccggagtgccttctagttcatgcgtgtttcccacctttaccttgcggaaacctagctctgagacagatatcgagaattgggcatcaaagcattttaataagcacactcaaggcttgtttcgtagaaaggttagtatagctaacatgcttgcatggagttccgagagtatcaagaaacctatgattgtcacctccgacagacacgtcaaaaaagaagcgtgcgagctgtttaagttaatccagatgtacatgggcgataggcgagcaaaggctgaccccttgcatgtggctcttgaagtagcgaccaagggctggtcagtgcaagggttgcgcgacgagttatacatccagctttgccgccagaccaccgagaactttcgcctggaatcactcgcccgcggttgggagttaatggccatttgcctggccttctttccgccgacaccgaaattccacagttatctcgagggttatatttaccgccacatggaccccgtgaatgatacaaaaggggtggctatctctacttatgccaaatattgttaccacaagttgcagaaagcagccttaaccggcgcgaagaaggggctgaagaaaccaaacgtcgaggagattcggcatgctaaaaacgcagttttttccccgtccatgtttggctccgcgttgcaagaagtgatgggcatgcagagggaacgataccctgaacggcagctgccgtgggtccagactcgcctctcagaggaggtcttagcactaaacggagatcagactgaaggtatatttcgtgtgcccggcgacattgacgaggttaacgcccttaagctgcaggtcgaccagtggaaggtgcccacgggacttgaagatccacatgtacccgcaagtcttctcaagctctggtaccgggagctggaagagcctctgataccccacgaattttacgagcagtgtatcgcacactacgatagcccggaagctgccgtagcagtggtgcacgcgctgcctagaatcaacagaatggtgctgtgctacctgatcaggttcctgcaggtttttgtgcagcccgcaaatgtggctgtcaccaagatggacgtctcgaaccttgctatggtcatggccccaaattgcctgcggtgccagagtgatgaccccagagtgattttcgagaacactagaaaagaaatgagtttcctccgggtgttaatccagcacctcgataccagtttcatggaaggggtcctgtag

SEQ ID NO: 14075 - DNA, 426 bp, Artificial Sequence
  Description of Artificial Sequence: Synthetic coding sequence
atgggcaaaggcatccccctgaacgatcaggacagaatcccttggttatgtaatctgcacgatatcctgctgagagacgtggcctctgggcaacgggtcgttttggcttgctccgctctcaagaagacttatcgcgatattctgacacagggcaaggacggggtggccctgaagtgtgaggagagtggcaaggaagccaaacaggccgagatgcagctgctggtggtccacctgtccggcagcttcgaggtcataagcggccggctgctgaagagagaaggccattttatgccacctgagctgctccaaagtcagtttgaaaccctggagccccctgctgcgcctgaaaattttatacaaatctctgtggacaagaatgtgtctgaaattatcgcaaccattatggaaaccttgaagatgaagtag

SEQ ID NO: 14076 - DNA, 1701 bp, Artificial Sequence
  Description of Artificial Sequence: Synthetic coding sequence
atggacatacagctggaccctgccagggatgatctgcccttgatggctaacacatcacatatcctggtaaagcattatgtgctggacctcgacgttgactttgaaagtcaggtgattgaaggaacgatcgtcctcttcctcgaagatggaaatcggttcaaaaaacaaaatagctccatcgaagaggcctgccagtccgaaagcaataaagcatgcaaattcggcatgcccgaaccgtgccacattcctgtgaccaatgctaggactttcagcagtgaaatggaatacaacgacttcgccatttgctctaagggtgaaaaggacacgagcgacaaggatggcaatcatgacaatcaggaacacgcaagtggaatatctagttcaaagtattgctgcgatacaggtaaccatggcagtgaagacttcttgctcgtactcgactgctgtgacttatcagtgctgaaggtagaggaagtggacgtcgccgcagtgcccgggttggagaagttcactcgctcacccgagttgacagtcgtttctgaagagttcaggaatcagatcgtgcgggaattggtcaccctccccgctaataggtggcgggaacaattggattattatgcaagatgcagtcaagctcccgggtgcggagagctacttttcgacacagatacctggagtctgcagatcagaaaaaccggtgctcaaaccgcgactgattttccgcacgcaatcaggatctggtataagaccaaacctgagggccgctctgttacctggaccagcgaccaatccggcagaccctgcgtttacacagtggggtccccaatcaacaatcgggccctattcccctgccaggaaccacccgtagctatgtctacttggcaggcgaccgtgagagcagctgcaagcttcgtagtgttaatgagcggcgagaattctgctaagcccacacaactttgggaggaatgcagctcatggtattattacgtgactatgccaatgccggcgagtaccttcactatcgctgttgggtgctggacagaaatgaagatggagacgtggtcatccaacgatctcgcaacagaacgccctttcagtccatcagaggcaaacttccgccatgtgggtgtctgttctcacatggagtacccttgcaggttccaaaacgccagcgccaccactcaggaaattattcctcatagggtattcgcccctgtctgcttaacaggggcctgccaagagacgttgcttcggcttattcccccctgcctttctgcggcacacagcgtgctgggcgcacatcctttttcccgcctggatgtactgatagtgcctgcaaacttcccctctctgggaatggcatctccccatatcatgttcttatcccagtccatcctgactggaggcaatcatctctgcggaacccggctgtgccatgaaattgcacacgcctggttcgggcttgccataggggccagagactggacggaggaatggctctcagagggtttcgccacccacttggaggatgtcttttgggccaccgcgcagcagctcgctccatacgaagcccgagagcaacaagagctgcgcgcgtgccttaggtggcgacgtctccaggatgaaatgcagtgttctccagaggaaatgcaggtcttgcgcttccctcatgtaggcggctgcagcggttcatttagctag

SEQ ID NO: 14077 - DNA, 1266 bp, Artificial Sequence
  Description of Artificial Sequence: Synthetic coding sequence
atgccattcctccatggatttcggcgaattattttcgagtaccagcccctggtcgacgctatactcggcagcctgggaatccaagatcctgagcggcaagaaagcctggaccgcccatcatacgtggcgagcgaagaatccagaatcttggtattaaccgagctcctcgaacggaaagcccactccccattctaccaggaaggggtttcaaatgctttgctcaagatggccgagctcggcctgacacgagcagctgatgtgctgttgagacatggggcgaaccttaatttcgaggatcctgtgacctactacacagctctgcacatcgcagtccttaggaaccaacccgacatggtggaactgctggtgcaccacggcgcggacgtgaaccgcagagatagaattcatgagtcaagcccattggacctggcttccgaggagcctgagcggcttccatgtctgcagcggctgctagatctgggagcagacgtaaacgccgctgacaagcacggaaaaaccgctcttttgcacgcgctggcctcctccgatggcgtccaaatccataatacagaaaatatccgcttactgctagaaggaggcgcggacgtcaaagcgactacaaaagatggggatacagtctttacatgtattattttcctgttgggcgagacagtgggcggggataaggaggaagctcaaatgatcaaccggttctgctttcaggttaccagactgctcctggcacatggggccgacccctctgaatgccctgcacacgagagccttacccatatctgtttgaagagtttcaaactgcatttccctctgctccgcttcctcctggaatccggcgcagcctacaattgcagcttacacggcgcatcctgctggtctggcttccatattatattcgagaggctctgctcccaccccgggtgtactgaggacgagtcacatgccgatctgttgaggaaggcagaaacagtcttggacctgatggtgaccaattcccagaagctacaactgcctgagaatttcgatattcatcccgtgggttctttggccgaaaaaatccaggcactgcactttagcctacgccagttggagagctatcccccccccttgaagcacctgtgtagggtggcaattaggctgtatttgcagccatggccggtggacgtcaaggtgaaagccttgcccctgcccgatcgcctcaaatggtatctgctctcggagcactccggctctgtggaggacgatatctag

SEQ ID NO: 14078 - DNA, 594 bp, Artificial Sequence
  Description of Artificial Sequence: Synthetic coding sequence
atgccattcctgcacgggttccggcggataatcttcgagtaccagcctctggtggacgccatcctggggtccttgggaatacaggatcccgaaagacaggagagtctggatcgcccctcttatgtggccagcgaggagtctagaattctcgtcttgacagaactcctcgagcgcaaagctcactctcccttctaccaagagggcgtgtctaatgcgctgctcaagatggctgaactgggcttaactagagccgctgatgttctgctccgacatggtgctaatcttaacttcgaggaccctgtcacctactatacagccttacacatcgctgtactgaggaaccaaccagacatggtagagcttctggtgcatcatggggccgacgtaaatcgcagggatcgcgagaaattgctgtgctccatgctgtggcctgcagcgacgggatgccggagtaccatactccggacattcgtatcctactggaaggagggccagaccagtcggccccccccaaagatggggacacagtgctctcccgcgtctagcagttgtctcgttcggccctgggaaggtactaaacgacggcctagatag

SEQ ID NO: 14079 - DNA, 684 bp, Artificial Sequence
  Description of Artificial Sequence: Synthetic coding sequence
atgagcgacattaaccttgattgggtcgacagaaggcagttacagaggctggaggaaatgttgatcgtggtggatgaaaatgataaggtcattggtgctgatactaaacgaaactgtcacctgaacgagaacattgaaaaaggactcttacatagggctttctccgtggtactgtttaataccaaaaataggatacttattcaacagcgcagcgataccaaggtgactttccccggatattttaccgattcctgttctagccacccactgtataatcccgcagaactcgaagagaaggacgccattggtgtacgccgggctgcccagagacggctgcaagcagaactgggaataccaggagagcagattagtcctgaggatattgtcttcatgaccatctaccaccacaaggctaaatccgacagaatttggggggaacacgaaatatgctatctcttgcttgtaagaaaaaacgttacattgaaccctgacccgtctgagaccaagtccatcttgtatctttcccaggaagaactttgggagctgctcgagcgagaggcaaggggcgaggttaaagtcactccctggttgagaacaattgccgaacggtttctttacagatggtggccacacctagacgacgtaactccgttcgtcgagctacacaaaatccatcgcgtttag

SEQ ID NO: 14080 - DNA, 864 bp, Artificial Sequence
  Description of Artificial Sequence: Synthetic coding sequence
atggaggtgatggaaggaccgctcaacctggcacatcagcagagtcgccgcgccgaccggctgttggctgccggaaagtacgaggaagctatttcgtgtcacaaaaaggctgctgcgtatctatccgaggccatgaagttaactcagtctgagcaggcacatctgagtctggagctgcagagagattcccacatgaaacagctgctcctgattcaggagcgctggaaaagagcacagagagaagaacggctgaaggcccagcagaacacagataaggatgctgctgcccatctgcaaacaagccacaaaccgtcagcagaggacgctgaagggcaatcacccctgtcccagaagtattctccaagcacagaaaagtgcctgccagagatccaggggatctttgaccgcgatcccgacacactgctgtatcttctgcaacagaagtcagaacccgccgaaccatgcataggctcaaaggcaccaaaagacgataagacaataattgaggagcaggctactaagattgccgatctcaagaggcatgtggaatttttggtggccgagaacgaaagactgagaaaggaaaataaacagctaaaagctgaaaaggccagactgctgaaaggcccaattgaaaaggaactagacgttgacgcagatttcgtggagacttctgagctgtggtctctgcccccccacgctgagaccgccacagcctcctccacgtggcagaagttcgcagctaacactggtaaggctaaggatatcccgatccctaatctcccgccgctggattttccaagtccggaattgcccttgatggagctctctgaggacatcttgaaaggatttatgaataattag

SEQ ID NO: 14081 - DNA, 2844 bp, Artificial Sequence
  Description of Artificial Sequence: Synthetic coding sequence
atgtgcgtcgattcactggtgcgcatttgcagcggactttcttacggccggattaggaatattaagagtctgtccgacattcagattgtgcaggtggcctgcggctactaccactctttggcgctttctaaggcctccgaggtgttctgttggggtcagaacaagtatggccagctgggtttaggaacagactgcaaaaaacaaacttcaccccaactgctgaaatctcttttgggcattccatttatgcaagtggctgctgggggtgcgcacagctttgttctgaccctgagcggtgccatctttggctgggggcggaacaagtttggccagctgggcctgaacgacgagaatgaccgctatgtcccgaatctcttgaagtctctcagatcccaaaagatcgtgtatatatgttgcggcgaagaccacacagctgctctcactaaagagggtggcgtgttcacctttggagctgggggatacgggcagctgggacataactcaacttcgcacgagatcaatccacgtaaagtcttcgagctgatgggttcaattgttacggaaatcgcgtgcggcaggcaacatacgagcgccttcgttcctagcagcggtagaatatattccttcggcctgggaggcaacgggcagctcggcacaggcagcacgagcaataggaaatccccgttcacggtaaagggcaactggtacccatacaatgggcagtgcctcccggacatcgactccgaggagtacttctgtgtcaaacggattttttctggcggggaccaatcctttagccactattcatctccccagaactgtggcccacctgatgattttcgatgcccaaacccaacaaagcagatatggacggtcaatgaggctctcatccagaagtggctaagttacccatctggtcggttcccagtggagatagccaacgaaatcgacggcacgttcagttcaagcggctgtctcaacgggtcattcctggccgtctccaatgatgatcattatagaaccggaactcgtttctctggggtcgacatgaacgccgcaaggctgctattccataaacttatccagcccgatcaccctcaaattagccagcaggtcgcggcatccctggaaaaaaacctcatcccaaaattgacaagcagcctgcccgacgtggaggcactgcggttttacctcaccttacccgagtgccccttaatgagcgacagtaataacttcactaccatcgcaatcccatttggtactgcacttgtaaatttagagaaagctccactgaaggtgctggagaactggtggagcgtgcttgaaccgccactgtttctgaagattgttgaactttttaaagaagtggtagtccacctgctgaagttgtacaagattggaatccctccttccgagcgccgtatttttaacagtttcctgcacacggcgttgaaagtattggaaatcctccaccgcgtgaatgagaagatgggtcagatcatacagtacgataaattctatatccatgaagtacaggagctgattgacattcggaacgattacattaactgggtccagcagcaggcttatggcatggacgtaaatcatggtctgactgagctcgccgatattcccgtaacaatttgtacgtatcctttcgtgtttgacgcacaggctaaaactacgctcctgcagacagatgctgtgctgcagatgcagatggctattgatcaggctcacaggcagaacgtaagctcattgttcctccccgtgattgagtcagttaacccttgccttatccttgtcgtaaggagagaaaacatcgtgggagacgccatggaggtgctgcggaaaaccaaaaacatcgactataagaaacctctaaaggtaattttcgttggagaagatgcagtggatgccggaggcgtccggaaggaattcttcctcctaatcatgagagagctgctggatcctaaatacggcatgttcaggtactatgaggattcacggctgatatggtttagtgataaaacattcgaggatagcgacctgtttcatctgatcggggtcatttgtgggctcgcgatttataattgcacaattgttgatcttcatttcccactggccctttataaaaagctgctgaagaagaaaccctcccttgatgacctgaaggaactgatgcccgacgtcggccgcagtatgcaacagctgctagattatccagaggacgacatcgaggagactttttgcctgaactttactatcaccgtggaaaattttggagctaccgaggtcaaggagctggtactcaacggcgccgacacagcagtcaacaaacagaatcggcaggagttcgtggacgcttacgtggattacattttcaacaagtccgttgcgtcactcttcgatgccttccatgctgggtttcataaggtatgtggagggaaagtgttgcttctgttccagcctaacgagctgcaggcgatggtgattgggaacaccaactacgactggaaggaattggagaaaaataccgagtataagggcgaatattgggcggaacacccgaccattaaaattttttgggaagtgttccacgaattgcccctggagaagaagaagcagttcctgcttttcttgacaggatcagacaggatacctatccttggaatgaagtcacttaaactggttattcagtctaccggtgggggcgaagagtaccttcctgtttctcacacatgcttcaatctgctggacctcccaaaatatactgagaaggagaccctccgctctaagctcattcaggccattgatcataacgaagggtttagccttatttag

SEQ ID NO: 14082 - DNA, 2541 bp, Artificial Sequence
  Description of Artificial Sequence: Synthetic coding sequence
atgccagcttttctcggcctgaagtgtttggggaaactatgctcatcggagaagtccaaagtgacctcctccgagcggacctcagcaagaggaagtaaccggaagcggcttattgtggaggatcggcgcgtgagcggaacaagtttcaccgcccaccgacgcgcgacaatcacgcaccttctgtacctctgcccaaaagactattgcccgagaggtagggtgtgcaattctgtcgacccatttgtggctcacccacaggatccacatcacccatccgagaagcccgtaatccactgtcacaagtgtggcgaaccgtgcaaaggagaggttttgcgggtacagaccaagcatttccatataaaatgtttcacgtgcaaagtatgtggctgtgatctcgcccagggaggcttctttattaagaacggggaatacttgtgtacactggactaccagcgcatgtacggcacgcgctgccacggctgtggagaattcgttgaaggggaggttgttactgcgcttggaaagacttatcaccctaactgtttcgcttgtacaatatgcaaacgtccctttccaccaggcgatagggttaccttcaacgggcgggattgtctatgccaactgtgtgctcaacccatgtcgtcatctcctaaggagactacattcagctccaattgtgcagggtgtgggcgcgatattaaaaatgggcaggcactgctcgcactggacaaacaatggcatttagggtgttttaagtgcaagtcgtgtggcaaagtgctgaccggggagtatattagcaaagacggtgcaccatactgtgagaaagattaccagggactcttcggggtcaaatgtgaggcctgtcaccagttcattacaggcaaggtacttgaggccggggacaaacattaccacccgtcctgtgcaagatgtagtcgctgtaatcagatgtttacagaaggcgaagagatgtaccttcaaggcagcacagtatggcaccctgactgcaaacaatcaacaaaaacggaagagaagctgaggcttccgaatatccggcgctcatcttccgactttttttactccaaatcgctaattagacgaacggggaggagcccatctctgcagccaacacgaaccagcagtgagagcatctactcacgccccggatcctcaatacctggcagccctgggcacaccatctacgccaaggtggataatgagatcctcgattacaaggacttagccgccatcccgaaagttaaggcaatatacgatattgagaggccagacttgatcacttatgaaccattttatactagtggatacgatgacaagcaggagagacagagcctcggcgaaagtccccgtactctttctcccactcccagtgcggaggggtaccaggacgtgcgggaccggatgatccataggagtacgagccagggttctatcaactcacctgtctatagtcgccacagttacactcccaccacttcaaggagcccacagcactttcacagaccagaactcctcagtcccggagtgcagagattgagttatctacggacatcatccttgtcccccactcattctgacagtagaccgaatccacctttccggcaccactttattccgcacatcaaagggaacgagccatcctccggacgtaactcccctctcccttatcgacccgactctcgccccctgacgccgacatacgcgcaggctcctaagcattttcatgtgcccgatcagggcatcaatatctatagaaagcctccaatttacaagcagcacgcagccctggcggctcagagcaaatcaagcgaggacattatcaagttctcaaaatttcctgcagctcaagcgccagacccatctgagacacccaagatcgaaacagatcactggccaggtcctccaagcttcgcggtggtgggccctgatatgaaaaggcggagcagtggccgtgaagaggacgacgaagagctgctgaggcgccggcagctacaggaggagcagctgatgaagttgaatagtggcctcggccaattgatattaaaggaagagatggagaaggaatctagggaacgttccagcctgctggctagccggtacgacagcccaattaacagcgcctctcacatccctagcagcaaaaccgcctcattaccaggctacggacgaaacggtttacaccgtcccgtcagcaccgattttgctcaatataattcctatggtgacgtgagcgggggagttcgggactaccagaccctgcccgatgggcacatgcccgcgatgaggatggatagaggcgtctcaatgcctaacatgctcgagccaaagatctttccatatgaaatgctcatggtgaccaacagaggaagaaataaaattctccgtgaagtcgaccgaacaaggctggagaggcacctggcccccgaggtttttagagagatttttgggatgagcatccaagaatttgaccggttgcctttatggcgtcgaaacgacatgaaaaagaaagcaaaactgttttag

SEQ ID NO: 14083 - DNA, 594 bp, Artificial Sequence
  Description of Artificial Sequence: Synthetic coding sequence
atgtttggttgcctggtggcaggtagacttgtccagaccgccgcccagcaagtggctgaggataagtttgtttttgacctgccagattacgagtctattaaccacgtggttgtattcatgttggggactattccattcccggagggaatgggtggatcagtctacttctcctaccctgactcaaacggaatgcccgtttggcaactactaggcttcgtgacaaatggcaaaccatccgccattttcaagattagcgggctgaaatccggagagggttcccagcaccctttcggcgccatgaacatcgtgagaacccccagcgtagcccaaatcggtatttctgtcgagctgctggattccatggcccagcagactccagtcgggaatgccgccgtcagctccgtggactcctttacccagttcacacaaaaaatgctggataatttctacaatttcgcttcctcttttgcagtgagccaggcacagatgacaccttctccgtccgagatgtttattcccgccaacgttgtcctcaaatggtatgagaatttccaacgccggctggcccagaatcccctattttggaaaacttag

SEQ ID NO: 14084 - DNA, 930 bp, Artificial Sequence
  Description of Artificial Sequence: Synthetic coding sequence
atggtcttccccgccaaaagattctgcctggtcccaagtatggaaggcgtcaggtgggctttctcatgcggtacttggttacctagcagagcagaatggctgttagccgtgaggtccatacaaccagaagagaaggaacggataggccaatttgtattcgctcgagacgccaaagcagcaatggctggcaggctgatgatccgcaagctcgttgccgagaagttgaatattccctggaatcacatcaggctgcagagaactgcgaaaggcaaaccagttctcgcaaaggatagctctaatccatatcccaatttcaacttcaatattagtcaccagggcgattatgctgttctggctgccgagcccgaactgcaagtggggattgacattatgaagacatcatttccgggtaggggatccatccctgaattttttcacataatgaaaagaaagtttacaaacaaagagtgggagaccatcagatcatttaaggacgagtggacacagttagatatgttctataggaattgggccttgaaggagtcatttatcaaagccatcggggtgggcctaggatttgaactgcagcggctggagtttgatctgtcgccactgaacttagatataggtcaagtctacaaagagactcgactgtttctggacggcgaggaggagaaagaatgggctttcgaggagagcaagatcgatgagcatcacttcgtagctgtagctttacgcaaaccagacggaagccgccaccaggacgtgccgagtcaggatgactccaaacccacgcagcgccagttcacgatcctgaactttaatgatctgatgagcagtgctgtgccgatgactccggaagacccttcattctgggattgcttttgttttaccgaagagataccaatccgtaatggtacaaagagctag

SEQ ID NO: 14085 - DNA, 1599 bp, Artificial Sequence
  Description of Artificial Sequence: Synthetic coding sequence
atgcagtcctgtgagagcagcggtgactccgccgacgacccgctctctagaggcctccgccgaagaggccaaccgcgcgtggtagtgataggggccggactggcaggtctagccgcagccaaggcattgttagagcaaggattcaccgatgtgacagttctggaagcatcaagccacattggcggccgggtgcaaagcgtgaagctcggccatgcgacctttgagttgggggcgacatggatccacggtagccacgggaatcccatataccacctagcagaggcgaacgggttgttggaagaaacgacagatggcgagcgatcagtcggcagaatcagcctgtacagcaagaacggcgtggcctgctacctgaccaatcacggcaggcggatcccaaaggatgttgtggaggaattctcagacctctataacgaggtctataacctgacacaggaattctttcgtcacgataagcccgtgaatgccgaatcccagaacagtgttggtgtgtttacccgagaggaggtccgaaatagaatcaggaacgaccctgatgatcccgaagccacaaagcgcctgaagttagctatgattcagcaatatcttaaggtcgagagctgcgaaagcagttcacactccatggatgaggtatccctttccgccttcggggaatggaccgagatcccgggggcccaccatatcatccccagtggatttatgcgtgttgtggaattactggctgaggggattcccgcccatgtgatccagcttggcaagcctgtcaggtgcattcactgggatcaggcttccgcccgcccacgtgggcctgaaattgagccccgtggcgttctgaaacggcagtacactagtttttttagacccggactcccgactgagaaagtggcagctatacaccgtctgggcattggaacaaccgacaagatatttctggagttcgaggaaccgttctggggcccagaatgcaattcattgcagttcgtatgggaggacgaagctgagagccacactcttacttatccaccggagttgtggtaccgcaagatatgtggctttgatgtactctaccccccagaaagatacggacatgtactctcaggctggatctgtggtgaggaggctctcgtcatggaaaagtgcgacgatgaagcagtcgcggagatctgtacggagatgctcaggcaattcactggaaatcccaacatccctaagccgcggcgcattctgagatcagcatggggctcaaatccgtatttccgagggagctatagctacactcaggttggcagttctggggcggacgtggagaaactcgccaagcctctgccatacaccgagtcaagcaaaacggcccatgggtcctcaacgaagcagcagcccggccatctcttctcctctaaatgccccgagcagcccctggatgctaatcgcggagccgtaaaaccgatgcaggtcctattctctggcgaagcaactcacagaaaatattactctaccacacacggtgctctgctgtctggtcagcgtgaagctgcgagactgatcgagatgtatcgcgacctgtttcagcaggggacatag

SEQ ID NO: 14086 - DNA, 2349 bp, Artificial Sequence
  Description of Artificial Sequence: Synthetic coding sequence
atggattcttctatccatttaagtagtctcatctccaggcatgatgacgaggccacacgtactagtacctccgagggcctggaagagggcgaggtggagggggagaccctccttattgtagaaagcgaagaccaggcctccgtagacctaagccacgatcaatctggcgactctctgaattcggatgaaggagacgtgtcatggatggaagagcagctgtcgtatttctgtgataagtgtcagaagtggattcccgcatcgcaactccgggagcagctaagctatcttaagggagacaatttttttcggtttacatgttccgactgtagcgctgacggcaaggagcagtacgaacgccttaaactcacttggcagcaggttgtaatgttggccatgtataacctttctcttgagggaagcggacggcaagggtactttcggtggaaggaggacatctgtgctttcattgagaagcactggaccttcctactgggaaacaggaagaagacaagtacctggtggtctacagtcgcaggctgcctgtcagttggcagccctatgtatttccgctctggagcacaggaattcggcgaaccaggctggtggaaactggttcataataagcccccaactatgaagccagaaggcgaaaaactgtccgccagcaccctgaaaataaaggcagcctccaagccaactcttgatcctatcataaccgttgaaggtcttcgaaagcgcgcctcccgcaacccagtggaatcagctatggaattaaaagagaagcgaagtcgcacccaagaagcaaaagacattaggcgggcccagaaggaggcggccggcttcttggacaggtctacaagcagcacccccgtcaagttcataagcagagggcggcggcccgatgtgattttagaaaagggagaagtaatcgacttttcgtctctgtccagctcagaccggacacctctgaccagccctagtccgtctccgagcctagattttagcgcacctggcacacccgcctcacactctgctacaccatcgctgctgagtgaagcggatttaatccccgatgtcatgccgccacaggcactcttccatgacgacgacgagatggagggagatggtgtgatagacccaggcatggagtatgttccaccacccgctggctcagtggccagcggccctgtggtgggcgtgagaaagaaagtcaggggtcctgaacagatcaagcaagaggtggaatccgaggaggagaagccagaccggatggacattgattctgaagatacggatagcaatacaagcctccagactcgcgcacgcgaaaaacggaagccccagcttgagaaggataccaagcctaaagagccaagatatactcccgtctccatctacgaggaaaagttgctccttaaacgcctcgaggcctgcccgggcgctgtggccatgacaccagaggcccgccgattgaagcgcaagcttatcgtcaggcaggcaaagagagaccgcggcctccctctgttcgacctggaccaggttgttaacgctgccctgctcctggttgatgggatctatggggcgaaagagggagggatttcccgcctgcctgcaggccaggcaacctatagaacgacttgtcaggactttcgtatcctggacagatatcagacgtccctgcctagccgtaagggcttccggcaccaaaccaccaaattcctctaccggctggtggggtcagaagatatggcagtggaccagtccattgttagcccctacactagccgcattctgaagccctatatcaggcgcgactacgaaaccaaacctccaaagttacaattgttgtcccagattcggtcgcacctgcataggagcgatccacattggaccccagagccagatgccccactagattattgctatgtcaggcccaaccatatccccactatcaacagcatgtgccaggagtttttttggccggggattgacctctccgagtgccttcaataccctgacttcagcgtggtcgtcctgtacaagaaggtgatcattgcattcggctttatggtgcctgacgtgaaatacaatgaggcttacatttctttccttttcgttcatcccgaatggaggagggcgggaatcgccacctttatgatctaccatctcatccagacgtgcatggggaaggacgtgacactccacgtgtccgccagtaatcctgccatgctcctgtatcagaaattcggtttcaaaacggaggagtatgtgttggacttctatgataagtactatccactggagagcacagagtgcaagcatgctttttttcttcgtctcagacgttag

SEQ ID NO: 14087 - DNA, 2745 bp, Artificial Sequence
  Description of Artificial Sequence: Synthetic coding sequence
atgggaacgactgctccggggcctatacacttgcttgaattatgcgaccagaaacttatggaattcctgtgtaacatggataataaggatctggtgtggctggaggagatccaggaagaggccgagcggatgtttactagggagttcagtaaagagcctgaattgatgccaaagacacccagccagaaaaaccgcagaaaaaaacgtcggatttcatacgtgcaggatgagaatcgggaccccataagaagacgactgtctcgccgcaaaagcaggtcttcacaactcagttcacgaagactccgcagtaaggattccgtggaaaagctggcaactgtggtgggcgaaaatgggtccgtgctgagacgtgtcaccagggccgccgccgctgctgctgcagctactatggccctggctgcaccttcttcacccacacctgagtctccgaccatgctgactaaaaagcccgaagataatcacactcagtgccaattagtcccagtggttgagatcggaatctccgaacgacagaacgctgaacaacacgtcacacagttaatgtcaaccgaaccactgcctcggaccctctccccaacaccagcaagtgcaacagcccccacctctcagggcatccccacctccgatgaagaatccacacccaaaaagtccaaggctaggattctggagtcaataaccgtgagctctcttatggctaccccacaggatcctaaaggacaaggagtgggaacagggcggagcgcttcaaaactacgcatagcgcaggtgagtcccggacctcgtgactctcccgcctttccagactctccatggagagagagagtgttagcgcctatcctcccagataacttctccacccctactgggtcccgcacagattcccagtcagtccgtcatagccccatcgccccaagtagtcccagcccacaagtgctggcgcaaaaatatagtctcgtggctaaacaggagtcagtagttaggcgcgcaagccgcaggctggccaagaagactgctgaggaacccgccgcttccggtaggatcatttgtcatagttatctagaacgacttctgaacgttgaggtaccccagaaggtaggctcagaacaaaaggaacctccggaggaggccgagcccgtcgcagccgccgagccagaggtgccagaaaataatgggaacaatagctggccccacaacgacacagagattgcgaactccacccctaaccccaagccggcagcctctagtcccgagacaccatccgcaggccagcaggaggccaagactgaccaggctgacggaccacgggagccgccccaatctgcccgccgaaagcgctcatataagcaggctgtcagcgagctcgacgaggagcagcatctggaggacgaggaactccagcctccccgaagcaaaactcccagctccccgtgccctgcaagtaaggttgtgcgtcctctgcgcacatttttgcataccgtgcaacggaaccaaatgctaatgacgcccacctccgctccaaggtccgttatgaagtcattcatcaaacgcaatacgccactacggatggatcctaaggagaaggaacgccaacggctggaaaaccttagaagaaaggaggaggccgagcagctgaggagacagaaagtggaggaagacaagcgaagaaggctcgaagaggtgaagctaaagagggaggagcgtctgcggaaagtgctgcaggccagagaaagggtggaacagatgaaggaagagaagaaaaagcagattgagcagaaatttgctcagattgatgagaaaacagaaaaagcgaaggaggagagactggccgaggagaaggccaagaagaaggcagccgcaaaaaaaatggaagaggtcgaggctcgcagaaagcaagaagaagaggcacgacgcctgcgctggctgcaacaagaagaggaggagcggcggcaccaggagttactacaaaaaaagaaggaagaagagcaggagaggttgcgaaaggcagctgaagcaaagcggttggccgagcagagggagcaggagcgcagagagcaagaacggagggagcaagaacggcgggagcaagaacggcgggaacaagaacgtcgagagcaggaacgccagttggccgaacaggagcgcagacgggagcaggaacggttgcaagcagaacgggagctgcaggaacgggagaaagccctaaggctgcagaaggaacagctgcagagagagctggaggaaaaaaagaaaaaggaagagcaacagcggctggccgagcggcagctgcaagaggagcaagagaaaaaggctaaggaggccgccggagcttccaaagcccttaacgtgaccgtagatgtacaatctccagcttgtacaagctaccagatgactccacagggccatagggcaccccctaagatcaaccctgacaactacgggatggaccttaacagcgatgactcaaccgatgatgaggcccaccccagaaaaccgataccaacctgggctcggggtaccccattgagtcaggccattatccatcaatactaccatccaccgaatctccttgagctcttcggcacgatcctgcccctagacctggaagacattttcaagaaatccaaaccacgttatcataagcgcacatcctctgctgtttggaatagccctccactgcagggtgctcgagttccctcctccctggcctactcactgaaaaaacactag

SEQ ID NO: 14088 - DNA, 4149 bp, Artificial Sequence
  Description of Artificial Sequence: Synthetic coding sequence
atggatgaagaggagaatcactatgtcagtcagctgcgtgaggtctatagtagctgcgatactacgggcactggattcttagaccggcaggaactcacccagttgtgcctaaagctgcatcttgagcagcagctgccggtcctcctacaaactttgctgggcaatgaccacttcgcccgtgtgaacttcgaggagttcaaggagggtttcgtggctgtgctttcaagcaatgcaggcgtcaggcccagtgatgaagacagctcatccctggaatcagctgccagtagtgcgattccccccaagtatgtcaacgggtctaaatggtacggcaggcgctcaagaccggagttatgtgacgcagccaccgaggcccgaagagtgcccgaacagcaaactcaagcaagcctgaaaagtcacctgtggcgctccgcatccttggaatctgtggagagcccgaaaagtgacgaggaggcagagagcacaaaagaagcccagaatgagctgtttgaggcacaaggccagctgcagacttgggattctgaggacttcgggtccccccagaagagctgctcccccagcttcgacacccccgagagccagattcgaggagtgtgggaagagctaggcgtcggatcttcaggccacctgtccgaacaagagttagccgtggtctgccagagtgtgggcctgcaaggcctggaaaaggaggaattggaggacctgttcaataagctggaccaagatggggacgggaaggtaagcctggaggagtttcaattgggcctcttcagccacgaacctgccctgctgctcgagagctccactagggttaaacccagcaaagcttggtcccactatcaggtgcccgaggaatccggctgtcacactactactacaagcagcctggtgagtttgtgtagctctctgcgactttttagtagtattgacgatggtagcggcttcgcttttccagatcaggtgctcgccatgtggacccaggagggtatccagaatggcagagaaattttgcagtccctggatttctccgtagatgaaaaggtcaacctccttgaactgacctgggctttagataacgaactgatgactgttgacagcgccgtgcagcaggcagccctcgcttgctaccaccaggaactgagttaccaacagggacaagtcgagcagctggctcgagagcgtgacaaagcacgccaagatctcgagcgtgcggagaagcgtaacttggaattcgttaaagagatggacgactgtcacagcacattagaacagctgactgagaaaaagattaagcacctcgagcagggatatcgggaacgactcagcctgctacgatctgaagttgaagcagagagggaactcttttgggaacaagctcaccgccagagggcagctctggaatgggacgtcggcagattacaggccgaggaagcgggactccgtgaaaaactgactctggcattgaaggaaaactctcggctgcagaaagagatcgttgaggtggtcgagaagctcagcgacagcgagcggcttgctctgaaattgcaaaaagacctggaatttgtcctcaaggacaagctggaaccccagtccgccgagctgctggcccaggaggagcgctttgccgctgtcctgaaggagtacgagttaaaatgcagagacctgcaggacaggaatgatgaattgcaagcagaacttgaaggattgtgggcgcggttgccgaagaatcgccattctccatcttggagccccgatgggcgtcggcgccaactgcccggtcttggacctgcagggatttcttttctcgggaatagtgctcctgtgtccatagaaacagaattgatgatggagcaagtgaaagaacattatcaggacttgcgtacccagctcgagactaaagtcaattattacgaaagagagattgctgcactaaaacgcaacttcgaaaaagagcggaaggacatggagcaggcccgccgtagggaggtgagcgtgctagagggacagaaagcagatctcgaagagctccacgaaaagtcacaggaggtcatttggggcttgcaagaacagttacaagatacggctagaggacctgaaccagagcagatgggactggccccctgctgtacccaggcactgtgcggactggccctgcgccatcatagccatttgcagcagatccgccgcgaggccgaggccgaattaagcggtgaactctcaggcctaggcgctctgccagccaggcgcgacctcactctagaactggaggagccccctcagggcccattaccccgtggcagtcaacgatctgaacagctagagctggagagggcacttaagttacaaccatgtgcttcggagaaacgtgcacagatgtgcgtgtcccttgccctcgaggaagaggaattggaattggcacgggggaagagggttgacggaccctccttggaggccgagatgcaggcgctgccaaaagacggtttggtggccgggtctggccaggagggcactcgtggccttctgcccttgcgccctgggtgtggagagaggcctctagcttggcttgcccctggagacggtcgggagtctgaggaagccgccggtgccggccctaggagaaggcaagcccaggataccgaggctacccagtcacctgctccagcccccgcccccgctagtcatggccctagtgaacgttggtctcggatgcaaccctgtggggtcgacggtgacattgtgcctaaagaacctgagccatttggtgcatccgcggccggtctcgagcagccaggcgctcgcgaattacccctgctgggaacagaacgggacgcgtcccaaacgcagcctcggatgtgggaaccacccctcaggccggcggccagttgccgcgggcaggcagagaggctgcaagctattcaggaagagcgcgcaagaagttggtctcgtggtacccaggaacaggccagtgaacagcaagctagggcagaaggtgcccttgagccaggatgtcacaagcacagtgtggaggtagctcgacggggttctttaccctctcacctgcagctggcagatccgcagggaagttggcaggagcagctggccgcaccagaggagggggaaacgaaaattgctctcgagcgcgaaaaagacgatatggagaccaaactattgcatcttgaggacgtcgtgcgcgctctcgagaaacacgtcgatctgagagaaaacgaccgtcttgaattccacaggctctctgaggagaacactctgctcaagaatgatctgggccgtgtacgtcaggaacttgaggctgcggaatccacgcacgacgctcaacgtaaagagatcgaggtccttaagaaggacaaggagaaggcctgttcagagatggaggtgcttaaccgacagaaccagaattataaggaccaactgtcccaactcaatgtcagagtgctgcagctgggccaggaagcatctacacaccaagctcagaacgaggagcatcgggtcactatacaaatgctcactcagtcccttgaagaagtagtacgctccgggcagcagcaaagcgaccagatccagaagctgagggtcgaactggaatgcctcaatcaggaacaccagagcctgcaactgccatggagcgagttaactcaaaccctcgaagagagtcaggatcaggttcagggagctcacctacgcctccgccaagcacaagcacagcacctacaggaggtgcgcctagttccccaggatcgtgtggctgaactccaccgtctgctgtcccttcagggcgaacaggcgcggcggaggcttgacgctcaacgggaggagcatgaaaaacagctcaaagcaactgaagagagggtagaagaggcggaaatgatcctcaaaaatatggaaatgctgttgcaggaaaaggtggacaaactgaaggaacagtttgaaaaaaataccaagagcgacctgctgttgaaagaattgtatgtagagaacgcccatctcgtaagggccctgcaagccacagaggagaaacaaagaggggccgagaagcagtctcgcttattggaagagaaggtgcgggcactgaacaaactagtcagtagaattgcccctgcggcacttagtgtgtag

SEQ ID NO: 14089 - DNA, 4383 bp, Artificial Sequence
  Description of Artificial Sequence: Synthetic coding sequence
atggccggacgacctctgcgaatcggggatcagctggttctcgaggaggattacgacgaaacctatattccctcagagcaggaaatcctggagtttgcacgcgaaatcgggatcgatcctattaaggagcctgaactgatgtggctcgctagagagggtatcgttgcccctctgcccggcgaatggaaaccctgccaggatattactggcgatatctactattttaactttgccaatggccaaagcatgtgggaccacccttgtgacgagcattaccggagtttggtaattcaggagcgggccaaactgagtacctcgggggcaattaaaaagaagaaaaaaaagaaggagaagaaggacaaaaaagatcgcgatcctcctaaatcatctcttgccctgggctcttcacttgctcctgtgcacgtgccactgggtggcctggctcccctaagagggctggtagacacacccccttctgctctcagggggagtcagagcgtcagcctgggatcaagtgtggaatctggccggcaactcggggagctcatgctaccttcccagggcttgaagacatcagcttatacaaaggggctgctaggctccatctacgaagataagacagccctgagcctgctcgggctgggcgaggagaccaacgaagaggacgaagaagaatctgacaatcagtcagttcactcctccagcgagccccttcggaaccttcacctggatatcggcgcactgggaggagactttgaatacgaggagtctctacgaacctcacaaccagaggagaagaaggatgtgtccttggactctgatgcggccggacccccaaccccgtgcaagccctcttcacccggggccgactcatcactctctagcgcagttggaaaagggcgacagggtagtggcgctagaccggggttgccagaaaaagaggaaaacgagaaatctgagcccaagatctgtaggaatttggtgactcccaaagccgaccctaccgggtctgagccggcaaaagcctcggaaaaggaagcccccgaggataccgtggatgctggagaggaagggagtcgtagagaagaagccgccaaggaacctaagaaaaaagcctccgccttagaagagggaagcagtgacgcgtctcaggagcttgaaataagtgagcatatgaaagaaccgcaattgagcgattccattgcaagtgaccccaagtcttttcatgggctagacttcggttttaggagtcgcatcagcgaacaccttctggacgtggacgtgctgtcacctgtgctcggcggagcatgccggcaggcacaacaacccctgggcatagaagacaaagacgattctcagtcatcccaggacgaacttcaatctaaacaaagcaaagggcttgaggaaagactctccccccctctgccacatgaagagagagcccagagcccccctcggagcctggctactgaggaggagccaccccaaggaccagagggacaaccagagtggaaggaggcagaagaactgggagaggatagcgctgcctccctgtcccttcagttatcgctgcagcgcgaacaggccccatcaccccccgccgcatgcgaaaagggcaaggaacagcattcccaagctgaagagctcgggccaggccaggaggaggcggaggatcctgaggagaaagtggcggtctcccctactccaccagtgtcccccgaggtgcgctccacagaacctgtggccccaccagagcagttgtctgaagcggctctaaaagctatggaggaagccgtggcgcaggtgctggaacaggaccagcgccacctgcttgaaagtaaacaagagaagatgcagcagctgcgggaaaagctgtgccaggaagaggaggaggagattttgagactgcaccaacagaaggagcagtctctctcgtctctgagggaaaggctgcagaaggccatcgaagaagaggaagctcggatgagagaggaggagtcgcagaggctttcttggttgcgagcccaggtccagtctagcacccaggctgacgaagaccagattcgagcagaacaggaggcatccctccagaaactccgggaagaactcgagtcccagcagaaggccgaaagagcctcattagagcagaagaacagacagatgctggaacagctcaaggaagaaatcgaggctagcgaaaagtcagaacaggctgctttgaacgccgcaaaggagaaggcactgcaacaactcagggaacagttagagggggagagaaaagaagccgtggcaacactcgaaaaggaacacagtgcggaactggaaagactgtgctcttctctcgaagccaagcatcgcgaggttgttagttccctccagaaaaaaatccaggaagcgcagcagaaagaagaggcccagttacaaaagtgtttggggcaagtcgaacatagggtgcaccaaaaaagttatcacgtcgccgggtacgaacacgagctgagctcactcctccgagagaagcggcaggaggttgagggggaacatgaaaggagactcgataagatgaaagaggagcaccagcaagtgatggccaaggctagagagcagtatgaggccgaggaacgtaagcagagagcagagttgctgggccatctgaccggcgaactggaacgactccaacgcgctcatgagcgggagctggagaccgtcaggcaggagcagcacaagcgtctggaggacctccggcgccggcacagggagcaggagcgaaaacttcaggacctggagctggatctggaaactcgcgcaaaggatgtgaaggctaggctcgctctgctggaagttcaggaggagactgccaggagggagaagcaacagctcctagatgtgcagcgccaagtcgctttgaagagcgaggaggcaacggcaacgcatcagcagctggaggaggcccagaaagagcacacccatctgctgcagagcaatcagcagcttcgtgagatccttgacgagctacaggccagaaagttgaaattagaaagtcaagtggatctgttgcaagcccagtcccaacaacttcaaaagcatttctcttcgcttgaagcggaggcgcagaaaaaacagcatctgctgcgcgaggtcaccgttgaggaaaataacgcatcaccacactttgagccagacctgcacattgaggacctcagaaagtccctcggtaccaatcaaaccaaggaagtgagttcatcattgagtcagtcaaaagaggacctatatctcgactcgctgtcaagccacaatgtgtggcatttgctttccgccgaaggtgtggccctacgctcagcaaaagagtttctagtgcagcagaccagaagcatgcggcgacgccagacggctcttaaagccgcccagcaacactggagacatgagcttgccagcgcccaggaggtggccaaagatccaccagggattaaggccttggaggacatgcggaagaacttagaaaaggagactaggcatcttgatgagatgaaatcagctatgagaaaggggcacaacctactgaagaaaaaagaggaaaaacttaatcagctcgaaagcagcctgtgggaggaggcttccgatgagggcaccctaggcgggtcgcccactaagaaggccgtgacttttgatctgtcggacatggatagtctaagcagcgagagctccgaatctttttcccccccccaccgagaatggtggcgacagcagagaattgatagcactccttcgctgacctctcgaaaaatccacgggctcagtcattcgctgcggcagatcagttctcagctgagttctgtcctctctatcctagatagtttgaaccctcagtcccccccccctctcttggcttctatgccagcccagttacctccacgggaccctaaatcaactcctactccaacctattatggaagcctggcccggttctctgcgctgtcctctgccacaccaacttctacgcagtgggcatgggactctggacaaggcccacgtttgccctcgtcagtggcacaaaccgtggatgacttccttctcgagaaatggagaaaatactttccatcaggcatccctcttttgtccaactctcctactcctctggagtctaggctcggttacatgtccgcctccgaacagcttaggctgctccagcactcccattcacaagtgccagaagccgggtctactacttttcagggtataattgaggctaatagaagatggctggagagagtcaaaaacgacccgagactgccactcttctctagcacccccaaacccaaggccacactttctcttttgcagctaggcctggatgaacataatagagtgaaggtctaccgcttttag

SEQ ID NO: 14090 - DNA, 1881 bp, Artificial Sequence
  Description of Artificial Sequence: Synthetic coding sequence
atgatggcaaacgacgcgaaacccgacgtgaagactgtgcaggtattaagggacaccgctaataggttgagaatccactctattcgggcaacctgtgcaagcggttctggccagctcacttcttgttgttccgctgccgaggttgtcagtgtcctgtttttccataccatgaaatacaaacagaccgatccagagcatcccgataatgaccgcttcatcctgtcccggggtcatgctgcgccaattctttacgcagcttgggtcgaggtgggggatatcagcgagagtgaccttctaaaccttcgcaagctgcactccgacttggaaaggcatcccacccctcgcctcccctttgtggacgtcgccactgggagccttgggcagggtttgggaaccgcttgcggcatggcatataccgggaagtatctggataaagcttcataccgtgttttttgcctgatgggcgacggtgaaagttccgaggggagcgtgtgggaagcctttgcctttgctagccactacaatctcgacaacctcgtggccgtcttcgacgtgaacagactggggcaatctggtcctgcccccctcgagcacggggcggatatttatcaaaactgctgcgaggcttttggctggaatacctaccttgtggatgggcacgatgtggaggccctctgccaggcgttttggcaggcatcacaggtaaagaacaagccgacggctattgtggccaaaactttcaaaggcagggggatcccaaatattgaggatgccgaaaattggcacggtaaacccgttccaaaggagcgcgccgacgctatcgtgaaactcatcgagtcccaaatccagaccaatgagaatttaatcccaaaatctcctgttgaggatagtccccaaatctccatcacagatattaaaatgacttctccacctgcgtacaaggttggcgacaagattgccacccagaaaacctatggcttagccctggcaaagttgggaagggcaaatgagcgcgtgatcgtgctgtctggagataccatgaactctaccttcagtgaaatctttaggaaagagcatcctgaaaggttcattgaatgcatcatcgccgagcagaacatggtgtccgttgctctgggctgtgcaactagagggcgcactatcgcattcgcgggggcgttcgcagccttcttcactcgcgctttcgaccagctgcggatgggggccatatcacaagcaaacattaacctcattggttcacactgcggggtctccaccggagaagatggggtttcccagatggcccttgaggatttggctatgttcagaagcattccaaactgtacagtgttttacccttctgacgccatcagtaccgaacacgccatctacctggctgccaacactaaaggaatgtgtttcattagaacatcgcagccggaaaccgccgtgatttatacaccccaagagaacttcgagattggccaagctaaagtggtgaggcacggtgttaacgataaggtgacagtaataggcgccggcgtgaccttacatgaggccctggaagccgcagatcacctttctcagcaaggcataagtgtgagggtcatcgacccatttactattaaaccattagatgcagccaccataatcagctctgccaaagccacgggaggacgagttatcaccgtcgaggaccattacagggagggaggcatcggcgaagccgtgtgtgctgcggtttccagggaaccggatattctggtgcaccaattagccgtgagcggcgtgccccagcgggggaagacaagcgagctgctggatatgtttggtatctctactaggcacattattgctgccgtcaccctaacgctgatgaagtag

SEQ ID NO: 14091 - DNA, 999 bp, Artificial Sequence
  Description of Artificial Sequence: Synthetic coding sequence
atggccacaattaaatccgaactcattaagaacttcgccgaggaagaggcaattcaccacaataagataagcatcgttggtactgggtcagtgggggttgcttgcgctatcagcattctgctgaaaggcttaagcgatgaactggtgctggttgacgtggacgaaggtaaactgaagggagagaccatggacttacagcacggcagtcccttcatgaaaatgccaaacatagtgagcagcaaggactacctcgtcaccgcgaatagcaatctcgtgataatcaccgccggtgctcgtcagaaaaaaggagagacccggctggacctcgttcagagaaacgtgagcatctttaagctgatgataccaaatatcacacagtatagcccccactgtaagcttctgatcgttaccaaccccgtcgacatattgacttacgttgcctggaagctgtcaggctttccaaagaatagggtgattgggagtggttgcaatctcgactccgcgcgcttccggtacttcatcgggcagcgcctggggatccactccgagtcatgccatggcctgatcttaggagagcatggggattcctcagtccccgtttggtctggtgttaacatcgctggggtacctttgaaggacctgaatcctgatatagggacagacaaagatcctgaacagtgggaaaatgtacacaagaaggtgattagctccggctatgagatggttaagatgaaagggtacaccagctggggcatttcactgagcgtcgcggatttaacggagtctattctcaagaacctgcggcgtgtgcacccagtgtccaccctgagtaaagggctctacggcattaacgaggacatctttctctctgttccatgcatcctgggagagaacggaatcaccgacttaattaaggtaaaattaaccctggaggaggaggcctgcttgcagaagagcgcagagacgctatgggagattcaaaaggaactaaagctctag

SEQ ID NO: 14092 - DNA, 972 bp, Artificial Sequence
  Description of Artificial Sequence: Synthetic coding sequence
atgccagagatgcctgaggatatggagcaagaagaggtcaatattccgaatcggcgtgtcctggtgaccggagcgacggggctcctggggcgtgcagtgcataaggagtttcagcagaacaactggcatgccgtgggctgcggatttcgtagggctcggcccaagtttgaacaagtgaatctgttggactctaacgcagtgcaccatatcatacacgattttcagccccacgttatcgtgcattgcgcggcggagagaagacccgatgtagtggaaaaccaacccgacgcggcatcacagttgaatgtcgatgcttccggtaacctcgcaaaagaggccgccgccgttggcgctttcctgatttatattagttcggactacgtcttcgatggcaccaatcccccctatcgggaagaagacattccagcccccctgaacttgtacggtaaaacaaagttggacggtgagaaagcagtgttagagaacaaccttggtgctgccgttttgaggattccaattctgtacggggaagtcgagaaacttgaggagtccgccgtcacggtgatgtttgacaaagtccagttctccaacaaatcagccaacatggaccactggcagcaaagattccccacgcacgtcaaagatgttgccacagtgtgtagacagcttgctgaaaagaggatgctcgacccaagtatcaagggtacttttcactggtcggggaacgaacagatgactaaatatgagatggcctgtgcaattgcagatgcgttcaacctcccgtcttcccacctccggccaattaccgactccccagttctgggagcccagcggcccaggaatgcccagcttgattgctctaaactggaaaccctcggaatcgggcagcggactcccttcagaatcgggatcaaagagtctctgtggccttttctcatcgacaaacgctggaggcagacggtgtttcactag

SEQ ID NO: 14093 - DNA, 3285 bp, Artificial Sequence
  Description of Artificial Sequence: Synthetic coding sequence
atggcagagtcttcctccgaaagcgatcatttcaggtgtcgcgaccgactgtcaccctgggccgctaggtccactcatagaggtacacggagtctgcctaccgtggaagtgactgagaaggtgaacactattactagtacccttcaagacacttctcgaaatctgcggcaggtggatcaaatgcttgggagatatcgggaatacagcaatgggcaggcaggggccatagagcacctgaaggagagcctagaacaatccatcgatcagctaaggtcacagcgattactgaggaacagcggaggcaggtcaatcagcgtaacctcactgtctgcatctgatctagacggcgggaccggaagcgaactccaccacttccctcctacttctcctttgaaagactatggtgatccccaaggcatcaaaagaatgaggtctcgaacgggagtgcgctttgtgcaggaaacggatgatatgacccagctccatgggttccatcagtccctgagggatctgagcagcgagcagattagattgggagatgatttcaatagggaactgtcccgtcgaagccggtctgacgccgagacaaagagagccttggaggagctgactgagaagcttaacgaagctcagaaacaggaggttgtgtccgacagggtagaaagacggctgcaagagctcgagagagagatgaggacggagagggagttggtcgagcgcagacaggaccagctgggattgatgagtcttcagctgcaggaggctttgaagaagcaagaggccaaagcagacgagcatgagggagccataaaaaacaaactgagacaaaccgagacagaaaaaaaccagctggagcaggagctcgagctgagtcgcaggcttttgaaccagagcgaaggatcgagagaaacgttgctgcaccaggtagaagaactgcggacccagctcactaaggccgagggcgatagaaaggggctccagcaccaagtgagccaaatctccaaacagcagagcaactaccaggacgagcaaggcgaagactggaggttcaggagaggagtggagcgtgaaaaacaggatctggagaagcagatgtccgatctgagagtccaactgaacttctctgccatggccagcgagctcgaagaagtcaagaggtgcatggagcgcaaggataaggagaaagcccaccttgccagtcaggttgaaaatctgacaagggaattggagaacggagagaagcagcaactccagatgcttgatcggctgaaagagattcagaatcactttgatacttgcgaagctgaacgaaaacacgcggatcttcagataagcgaactaacacgccatgcggaggatgctactaagcaggctgaaagatatctcagtgagcttcaacagtccgaggcactaaaagaagaggcagaaaaaaggcgggaagaccttaagctcaaggcccaggaaagcatccgccagtggaaactgaagcacaagaagctcgaacgcgcccttgaaaagcagtctgagacagtggacgagctaaccggtaaaaacaatcagattcttaaagagaaggacgagctgaaaactcagctttacgctgccctgcagcagatcgagaacctgagaaaggagctcaacgatgtactgacaaagcgggccttacaggaggaagagctccactccaaggaggaaaagttgagagacattaaaagccaccaggccgatctggagctcgaggtgaaaaactccctggacactattcaccggctggaatcagaactcaaaaagcagagtaagatccaatcccagatgaaagtcgagaaggcgcacctggaagaggagatcgctgagttaaagaaatcccaagcgcaagacaaagctaaactgctggagatgcaggagagtatcaaggatctctccgctatccgggctgacttggcgaataaactggcggaggaagaaagggccaaaaaggccgtgctcaaggatctgtccgacctaacggctcaggctaaatcccgcgatgaggaaaccgcgaccattattacacagctgaaactcgaacgggacgtgcaccaacgcgagctgaaggacctgaccagttccctgcagtccgtgaaaacgaaacacgagcaaaatattcaggagcttatgaagcacttcaaaaaggagaagtctgaggccgaaaatcacatccggaccctgaaagccgaaagtctggaagagaagaatatggccaagattcatagaggccagctggagaagctcaaaagccagtgtgatagactcaccgaggagctaacgcaaaacgagaatgagaacaagaagctcaaactgaagtatcagtgcctcaaggaccaattggaagaacgggagaagcatataagtatagaggaggagcacttaaggcgcatggaagaggcccggctacagctgaaggatcagctgctgtgcctcgagacagaacaggagtctattctcggtgtgatcggaaaagagatagatgctgcttgtaaaacatttagcaaagactctgtggaaaagctaaaggtcttctctagcggaccagatatccattacgacccgcacaggtggctggccgaatcaaagacaaaattgcagtggctgtgcgaggaactgaaggagcgggagaatagagaaaagaatctgcggcaccagcttatgttatgccggcagcagttaagaaatctgactgagaacaaggaatctgaacttcagtgcctattccagcagattgaaagacaggaacagctcctggacgaaattcacagagagaaaagggatctgcttgaagagactcagcggaaagacgaggagatgggaagtctacaggaccgcgtgatagcacttgagacgtccactcaggtggcattggatcacctcgaatcggtgcccgaaaaactttctttgctagaggattttaaagacttcagggactcttgcagtagttcagaaagaacggatggacgctactctaagtatagggtgcggaggaattcactccagcaccaccaggatgacactaaatataggacaaagagcttcaaaggcgacaggacattcttagagggatcccatacaagaggattagaccacagcagtagctggcaagaccacagccgtttcctcagttcccctagattttcctatgtcaatagctttaccaaacgcactgttgccccggattcagcgagcaataaagaagacgccacaatgaatgggacatcctctcagcctaaaaaagaggaatacgggagctag

SEQ ID NO: 14094 - DNA, 1011 bp, Artificial Sequence
  Description of Artificial Sequence: Synthetic coding sequence
atgaagaaagagcacgttcttcactgccagttcagtgcctggtatcctttctttcgtggcgtcaccattaaaagcgtgattctccccctaccacagaatgtgaaggattacctgctcgacgatggtaccctagtagtgtcaggaagagacgatcctcctacacatagtcaacctgactctgatgatgaagccgaggaaattcaatggtccgacgacgaaaacacagcaactctgacagctccggaatttcccgaattcgctaccaaagttcaggaggccattaacagcctggggggctccgtctttccaaaattaaattggtccgcccccagagacgcctactggatcgcgatgaactccagtctgaaatgcaaaaccctgtctgatatttttttactgtttaagagtagcgactttataacccgcgactttacgcaaccttttatccactgcactgatgattcacctgatccctgtatagagtatgagctggtgcttagaaagtggtgtgagctgatccccggggccgaattcagatgttttgtcaaggagaataaactgattggcataagccaaagggactacacgcagtactacgatcacatcagtaaacagaaagaggaaattagaagatgtatacaggacttctttaagaagcacatccaatataagttcctggatgaggatttcgtgttcgacatttatcgggacagcagagggaaggtttggcttattgattttaatccctttggagaggtgaccgatagcctgctttttacatgggaggaactgatatctgaaaacaaccttaacggtgacttttcggaagtagatgcacaagaacaagattctccggcctttagatgcacgaactccgaggtaactgttcagcctagcccctacctgtcctatcgactgcccaaggactttgtggaccttagtaccggtgaagacgcacacaagctgattgatttcctgaaactgaaaagaaaccaacaggaagatgattag

SEQ ID NO: 14095 - DNA, 1248 bp, Artificial Sequence
  Description of Artificial Sequence: Synthetic coding sequence
atgaagctgtcgcttaccaaggtcgtgaacggatgtcgcctggggaaaataaagaatttagggaaaactggcgaccacactatggatattcctggttgtctcctttacacaaagaccggttctgcccctcacttgactcaccacacacttcacaatatccatggcgttccagccatggcccagctcaccttgagcagcttggctgaacatcacgaggtgctgacagagtataaggaaggcgtgggaaaattcattggtatgcccgaatctctactgtactgctcactccatgatcctgtgtccccttgcccagccggttacgtgacaaataagtctgtgagcgtgtggagcgtcgctggccgggttgaaatgaccgtcagcaagtttatggccatacaaaaggcgttacagcccgactggtttcagtgtctcagcgacggagaggttagttgcaaagaagcaacgtccattaaacgggttcggaaatctgtagatcggtccctcctgtttttagataattgcctgaggctccaggaagagagtgaggttctgcagaagagtgttatcatcggcgtgattgaggggggcgacgtgatggaggagcgcctgcgtagtgcccgggagactgctaagcggcccgtgggcggcttcttactagatgggtttcagggtaacccgacgaccttggaggcacgactcaggctgctatcctccgtgacggcggaactgccagaagataagccaagactgataagtggcgtttctaggcctgatgaggtgttagagtgcattgaaaggggcgtcgacctgtttgaatcttttttcccctatcaagtgactgagcgcggatgcgccttaaccttctcctttgactaccagcctaatcccgaagagactctcttgcagcagaacggcacccaggaggaaataaagtgtatggaccagattaaaaagatcgagacaaccggatgcaatcaggaaataaccagctttgaaataaacctgaaggaaaagaaataccaggaagatttcaatccacttgtgcgaggctgctcttgctactgctgcaagaaccacactagagcgtatatccaccacctgctcgtgacaaatgagcttctggccggagtgcttctgatgatgcacaactttgagcattactttggtttctttcactacattcgggaagccttgaaatcagacaagctggcgcagctcaaagaacttattcatagacaagcgtcttag

SEQ ID NO: 14096 - DNA, 1770 bp, Artificial Sequence
  Description of Artificial Sequence: Synthetic coding sequence
atgcccactgtgagcgtcaagagggacttactgtttcaggccctgggaaggacatacacagacgaggaattcgacgagctttgcttcgagttcgggcttgagcttgacgaaatcacaagcgagaaggagataatctccaaagaacagggcaatgtgaaggctgcaggtgccagtgatgtggtgttgtacaagatcgatgtcccagcgaatcggtatgacctgctgtgcctagagggcctcgtccgggggttgcaagttttcaaagagcgaataaaggcgccagtttacaaacgcgtaatgcccgatggcaagatccagaagctcatcataacagaggagaccgccaaaatccgaccattcgctgtggccgccgttctgcggaacattaagttcacaaaagaccggtacgactctttcattgagttacaggagaaactgcatcagaacatctgccgaaagagggcacttgtcgccatcggcactcacgacctcgacaccctaagcggtccttttacatacacggccaagcgcccctccgatattaaatttaagcccctaaacaaaaccaaagagtacaccgcctgcgaactgatgaatatctacaagacagacaatcacctcaaacactatctgcatataatagagaacaaaccgttgtaccccgtcatctacgacagtaacggtgttgtgctctctatgccccccattattaacggcgatcacagcaggatcactgttaacactcgcaacatttttatagaatgcaccggcacagattttaccaaagccaaaatcgtcctagatatcattgtcaccatgtttagcgaatactgtgaaaatcaattcaccgtggaagcggctgaagttgtgttccctaacggtaaaagccacaccttccccgagctggcataccggaaagaaatggtaagagccgatctgatcaacaaaaaagtggggatccgagagacaccagagaatctggcaaagcttctgacccgcatgtacttaaagagcgaagtgataggagacggaaaccaaatcgagatagagatcccccccaccagggccgatattattcatgcctgcgacattgtcgaggatgccgctattgcatatggctacaacaatatccaaatgaccttgcctaaaacatatacgatcgccaatcagtttccactgaataagttaacagagctgttaagacatgatatggcggccgccggctttaccgaagccttgacctttgccttatgttcacaggaggacattgctgacaagctgggtgttgatattagcgccacaaaagctgtgcatatcagcaaccctaaaaccgccgagtttcaggtggcaagaacaacgctgctacccggcttgctgaagactatagccgcaaacaggaaaatgccactcccactaaaacttttcgagatttctgatatcgtaattaaggattctaacacggacgttggggccaagaactaccgacacctgtgcgctgtttactataataagaatccaggattcgaaataatccacggactgctggatcgtattatgcagctgctggatgtacctcccggagaggacaaaggaggctatgtaattaaagcctcagaggggccggccttctttcccgggcggtgtgccgagatttttgctagagggcagtccgtggggaaactcggagtgcttcaccctgacgtcattaccaagtttgagctaacaatgccttgtagttctttggagattaatgtgggcccttttctttag

SEQ ID NO: 14097 - DNA, 477 bp, Artificial Sequence
  Description of Artificial Sequence: Synthetic coding sequence
atggccgcccagggcgtggggcctgggccgggctccgccgcacctccaggactcgaagctgcccggcagaagctggccctgcgacgcaaaaaggtcctcagcaccgaggagatggaactctacgagctggcccaggcagccggtggggccatcgacccagacgttttcaagatccttgttgacctcctgaaactcaatgtcgccccgcttgccgtgttccagatgttgaaatccatgtgcgctggtcagaggctcgcaagtgagccgcaagatccagctgcagtgagcctgccgacttcctccgtcccagagactaggggccggaataagggatctgcggccctaggcggggctctggcccttgccgagcgctcttcccgggaggggagctctcagaggatgcctagacagccttcagctactaggctgcctaaggggggcggtcctggtaaaagtcctacacgcggctcaacttag

SEQ ID NO: 14098 - DNA, 675 bp, Artificial Sequence
  Description of Artificial Sequence: Synthetic coding sequence
atggttgaggacgagcttgccctatttgataaaagtattaacgagttttggaacaagtttaaaagcactgatacctcctgccagatggccgggctgcgggatacgtacaaagatagtatcaaggccttcgccgagaagctgagtgttaagttgaaggaagaggagaggatggtggagatgttcctggaatatcagaaccaaatttctcgacagaataaactgatccaggaaaaaaaggataatcttctgaaactgatagccgaagtgaagggtaagaagcaggaacttgaggtactaaccgcaaacatacaagacctaaaagaagaatatagcaggaaaaaggagacaatcagtacagccaataaagccaacgccgagagattaaaaaggcttcaaaagagcgctgatctgtataaggaccggctgggattggagatcagaaagatctatggcgagaagctacagtttattttcactaatatcgatccgaagaaccccgagagcccgttcatgttctcacttcacctgaatgaagctcgagactacgaggtgtccgatagcgccccccatctggagggcctggccgagtttcaggaaaatgtccggaaaacaaacaactttagtgcatttctggctaatgttcgcaaagcatttaccgcaactgtatacaactag

SEQ ID NO: 14099 - DNA, 1728 bp, Artificial Sequence
  Description of Artificial Sequence: Synthetic coding sequence
atgaagctgacagactccactaaaggttggatagtctgggctgccctcgacagcagcatgaggggcatgtctcttagcgcaggatcatctcccctgcactcccccaaaatcacaccacacacgagcccggcaccacggaggcggtcccataccccaaatcccgcctcctacatggtgccatcatctgccagtacatccgtgaataatccagtgagccaaaccccctccagtggccaggtgatccagaaggagacggtgggcgggacgacatatttctacactgatactacaccggctcccctgacgggtatggtgtttcccaactatcacatttatcctcctactgctccccacgtcgcttacatgcagcccaaagctaatgcccccagcttctttatggccgatgagcttcgccaggaactgatcaataggcacctgatcacaatggcacagattgaccaggctgacatgccagctgtaccaaccgaagtggactcctatcactccctcttccctctagagccgctacctccacccaaccgcatccagaaatcctccaacttcggctacattacctcctgttacaaagctgtgaactcaaaagacgatcttccatactgtttgagacggattcacggctttcgcctggtcaacaccaaatgcatggttctcgtcgacatgtggaaaaaaatccagcactctaacattgtgaccttgcgtgaggtatttacaaccaaggctttcgctgaaccatctttagtgtttgcctatgattttcatgccggcggagaaaccatgatgtcacgccactttaacgacccaaatgctgatgcctattttaccaaacggaagtggggacagcacgagggtcctctgcccagacagcacgcaggactgcttcccgagagcctaatttgggcctatattgttcagctatcaagcgccctgagaacaatccatactgcagggctggcatgcagagtgatggatcctacaaagattttgataacaggaaagacccgccttcgtgttaattgcgttggtgtctttgacgtgttaacgttcgacaactcccagaataataatccgttagcactgatggctcagtatcaacaggcagacctcatctcactgggcaaagttgtgctggcactggcctgtaactctctggctgggatacaacgggaaaatcttcagaaagccatggaattagtgactataaactactcttctgatctgaagaatctgatactttacctgttaaccgaccagaatcgcatgcgctccgtaaacgatattatgcctatgattggtgcaagattttatacccagctggatgcggcgcaaatgcggaacgacgtgattgaggaggacctagccaaagaggtgcagaatgggagattattccggttactggcgaaactgggaacaataaatgagagacctgaatttcagaaggatcctacatggtctgagaccggcgaccggtatctcctgaaattgttccgcgaccatctcttccatcaggttaccgaggctggtgcaccatggatcgatctgtcacacattattagttgtcttaacaaacttgacgcgggagtccccgagaaaatcagtctgattagtcgcgatgagaagtctgtgcttgttgttacctactccgacctaaaacgctgttttgaaaacacatttcaggagctgatcgcggctgcaaacggacaattatag

SEQ ID NO: 14100 - DNA, 1785 bp, Artificial Sequence
  Description of Artificial Sequence: Synthetic coding sequence
atggagtccaaccacaagagtggagacgggctcagcggcacccagaaggaggccgccttgagagcgcttgtccaaaggactggatattcactcgtgcaggagaacggccagcgcaagtacggaggtcccccgccagggtgggatgccgcccccccggagcggggctgtgaaatatttataggcaaactcccccgagatcttttcgaagacgaacttatcccactctgtgagaagatcggtaagatttatgaaatgaggatgatgatggatttcaacgggaacaatcgtgggtacgcatttgtgacattttccaacaaagtggaggccaaaaacgctattaaacaactgaataactatgaaatccgtaatggcaggctcttgggcgtatgcgccagtgtggataattgtagattgtttgtcggagggattccaaagaccaagaaaagagaggagattctctctgagatgaaaaaagtgactgagggcgtggtggacgtgatcgtctaccccagtgcggccgataagacgaagaatcgagggttcgctttcgtggaatatgaatctcatcgcgctgctgctatggctcgaaggaagctgctgccagggcgcatccaactgtgggggcacggaattgctgtcgattgggccgagccagaagtagaggttgacgaggacactatgagcagcgttaaaattctgtacgtcagaaatctcatgctcagcacgagtgaagaaatgattgagaaagagttcaataacatcaaacctggagctgtagagagggttaagaagatccgtgactacgccttcgttcatttctccaatcgggaggatgccgtggaagcaatgaaagctctgaatggcaaagtgcttgacggatctcccatcgaggtgacactggccaaacccgtggataaagactcatatgtgagatacacacgaggaactggcggtaggggaacaatgctacaaggcgaatacacttacagcttgggacaggtgtacgatcccaccaccacctatctaggagctccggtcttttatgctccccaaacctacgctgctattcctagtctgcacttccctgctactaaggggcacctcagcaacagagcaatcatcagggccccctccgttcgcgaaatctatatgaacgttcccgtgggggccgcgggggtgcgtgggctgggaggccgcggatacctggcatatacaggcctgggcagagggtatcaggtgaaaggagataaaagggaagacaaactctacgatatcctgcctggaatggaactgaccccgatgaaccccgtgacccttaagccccagggcattaaactggccccccagattttggaggaaatttgccagaaaaacaactgggggcaacctgtctaccagttgcattctgccatagggcaggatcaacgtcagctttttttatataaaattaccattccagccctagccagccagaatccggcaatacacccattcactcccccgaaattgagcgcctttgtagacgaggcaaaaacctacgccgccgaatataccctacaaacgctaggcatcccaactgacggtggggacgggacaatggccaccgccgcagctgccgccacagcattcccgggatacgccgttcccaacgctaccgcccctgtgtctgcggcccagctcaaacaggctgtgactctgggccaagaccttgcagcctacaccacttatgaagtgtatcccacctttgccgtaaccgccaggggcgatggctatggaactttctag

SEQ ID NO: 14101 - DNA, 1167 bp, Artificial Sequence
  Description of Artificial Sequence: Synthetic coding sequence
atgctggagggaagctggatcaaccgaagggaggacaaactgggcgtgtactcactggttcatttctcgccgaagatgttgggatccgttgctactactcttccattgtcatctagcaacagttctgggatgccgttggggtactacctgtcatcaccacagatttcgcgagtcacgatcagcaccaccggacagctgacctccaaggccactgtgggctcctgcagtcgcgtagagaattctctggacgcaagtccattctccgtccctaagaaacaggacgaatctcccatgatcggcgatggagaagactatttcctctctctgttcggcgactctaagaaactgacagctcactccaactacacacaaaagacacttaagtactttagcatgattcttgaggaggtaggccagttcacctcatcatcacttggtgatgttgagattgctgaggtgaatgtcaagggactgttcgtaaagctgatcaactctagcctcgacaaagagatggcaatcggagatcatattctacagcagaatgttaatggtcagacaatctccctatatcggttcctgccaaatattgtcatgcaggccaatagcacagtaacagtgtgggctgctgcctctgaagcaaagcaccagccacctagtgatttcctgtggaaggagcaagataaattccgagcatctcctgattgtataaccatactctgtaagccaaatgggcaggctattgcatggtacacccccatccactggaaacaggcttgggaaaaattagacgccgatgtggaatttaacaggtgctctgtggtgagtcctactttcagaaagcgggtttttcaatggaccgcctctacggcgactatcacaaaggagaaacaagaccagccaaaaaaagatatctctaactaccaggtcgaacaggcccaggttctcctcaagcgagagaaggagatccctccgactgttttccccaatcgcagcccatggtgccagaatccctacgtatccgctcacccttactgtccactgatcgagcctcataatacatctacagccgggggtcgcttagataggcaacctaggacgcgatccaccaggcctaatcgtgctagcggcagcaagaaaaaaaagacatctgagtcccagaaacagtag

SEQ ID NO: 14102 - DNA, 744 bp, Artificial Sequence
  Description of Artificial Sequence: Synthetic coding sequence
atggaggagcagccccaaatgcaggacgctgacgagcccgctgatagtgggggcgaaggaagagcgggaggtcctcctcaggtggccggagcccaggcagcttgttctgaagacaggatgacattactgctgcgtcttcgcgctcagacgaagcagcagcttctggagtataaaagcatggtggatgcttcagaggaaaaaacacccgaacagatcatgcaagagaaacaaatcgaggccaagatcgaagacctggaaaatgaaatcgaggaagtaaaagtggcgttcgaaataaagaaactggccttagaccgaatgagactgagtacagctctgaaaaaaaatttagaaaaaatctccagacagagtagtgtgctgatggataatatgaaacacctgctggagctgaataagctgattatgaagagccagcaggagagttgggacctcgaggagaaattactcgacatcaggaaaaagcgcttgcagcttaagcaagcctcagagagtaagttgctggaaattcagaccgagaagaacaaacaaaaaattgatctcgatagcatggagaactctgaaagaataaaaatcattcggcagaacttgcaaatggagattaaaattaccacagtgattcaacacgtgtttcagaacttgattttaggatcaaaagtcaactgggccgaggatccagcccttaaagagatcgtgctgcagctagaaaagaacgtggatatgatgtag

SEQ ID NO: 14103 - DNA, 1458 bp, Artificial Sequence
  Description of Artificial Sequence: Synthetic coding sequence
atggaattcctgggcacgacccagactgcctcatattgcgggccaaagaaatgttgtgggctgaccagtctccccgcagttcaagctccggttattcaggagtgctatcagccctactacctgccaggttaccggtacctgaacagctggcgtccctccttattctataagattgccaacgtgcagacatgccccgatgagtctaccagcactcttcgccctccaaccattctaccaactctgcggtcggccctgttctcaagatacagtcctcacgattgggaccagagcaatcagcttcaggttagaggcgcggaagcctcccggctgtgggcaagcaggctgacagatgactcaatgaggctgttgcaagataaggatcagctgactcatcagatgcaggaaggaacctgcagaaacctgggtcagcggctgtccgatatcggattctggaaatctgaactaagctatgaactggaccggttgttgaccgaaaaccaaaatctggagaccgtcaagcggagattggagtgtgctgccaatgaggtgaattgccctctgcaggtagctctggaatgtctctatcacagggaaaagcggataggaatcgaccttgttcatgacaacgttgaaaagaatctgatccgtgaggtagacctacttaagtgttgccaggaacagatgcgcaagttggcccagcgcattgacatccagatgcgagacaatagggacgcccagcacgtcctcgagcgcgacctggaggacaaatcaagcgcccagtgtatcgatgagaaatgtttcaacctgcgaaatacaagtgactgtatcagtttcttccacggcatggaaaaaattgacggcaccatatctgtgcctgagacttgggccaaattctctaatgacaatatcaaacactcacagaacatgcgggccaacagtatacagctcagagaggaagccgaacacctctttgaaaccctcagtgaccagatgtggagacagttcaccgataccaacctggccttcaacgcaaggatcagcgaggtgaccgatgtaaaaaacaagcttcagactcagctggcgaaaaccctgcaagagatttttcaggcggagaacactatcatgctgctcgaacgatccattatggctaaagaaggccctttaaaagttgcgcagacccgcttggagtgccggactcgcagacccaacatggagctatgcagggatatacctcagttgaagctcgtgaacgaggtgtttaccattgacgatactctccaaaccttgaagctgcgcctgcgagaaacacaggatacattacagctgctggtgatgacaaaatgcaggttagagcacgagctggccattaaagccaacaccctgtgcatcgataaggaaaagtgtatgggaatgcggaagacctttccatgtacgcctaggctggtggggcacacctag

SEQ ID NO: 14104 - DNA, 837 bp, Artificial Sequence
  Description of Artificial Sequence: Synthetic coding sequence
atgggaaaatcttcagaatggtgtgagcgcattgccggaatccagaaattcgtcctcgagaaatggacaaagaaagccaaacccgaggacaccctcaatttgtgtcaactcctcaacaacgacttagcgtccacagtggtgagctatccgcgacgctttgtcgggcttggaacgctgcccatgcaggccccagagttggccgtgaaggaaatggaacgctgtgtgaaagagcttgggtttccaggagtacaaataggaactcacgtgaatgaatgggacctaaatgctcaggagctgttcccagtgtatgccgcagcagagagactgaagtgttccttgttcgtgcacccctgggacatgcaaatggatggtcggatggccaaatattggctcccttggctggtagggatgccagcagagacaacgatcgcgatctgcagtatgatcatgggtggcgtctttgaaaagttcccaaaattgaaggtgtgtttcgcccacggcgggggtgcattcccctttaccgtcggtcgcatctcccacggattctcaatgaggcctgacctgtgcgctcaggataaccccatgaatccaaagaaatatttggggtctttttataccgacgcccttgtccacgacccgctctccctgaaactcctcacagacgtgatcggcaaagataaagtgatactaggaacagactacccctttcccctgggcgagttggagccaggcaaactgatcgagtccatggaagaatttgacgaggagacaaagaacaagctgaaggctggcaacgccctggccttcctcgggctggagcgcaagcagtttgagtag

SEQ ID NO: 14105 - DNA, 2478 bp, Artificial Sequence
  Description of Artificial Sequence: Synthetic coding sequence
atgagttcttcccccgtcaacgtcaaaaaactgaaagtgagcgagttgaaagaagagctaaaaaaaaggagactgtccgacaaagggctgaaggccgaattgatggagagactccaggcagctctggatgatgaagaggccggaggacggcccgctatggaacctgggaatgggtcactcgatcttggtggcgatagtgcgggccgctctggcgccggactggaacaggaggcagctgctggaggagatgaggaagaggaagaagaggaggaagaagaggaagggatttctgccctcgacggcgaccagatggaactcggagaagaaaatggtgccgcaggagcggcagactctggtccgatggaagaagaggaggccgctagtgaggatgagaacggggacgaccagggcttccaggagggggaggatgagctgggcgatgaggaggagggagcgggcgatgagaacggtcatggagaacagcagccacagccccctgcaacgcagcagcagcagccccagcagcagaggggcgccgctaaggaggcagccggaaaatcttctgggcccacctcacttttcgcagtcacagtcgccccgccaggggcccggcagggacaacaacaagcgggaggcaagaagaaagcagaaggcggcggcgggggcggacgtcccggcgcccccgctgccggggacggcaagacagaacagaagggaggtgacaagaagcggggagttaagaggcctcgtgaagatcatgggcgcggatatttcgagtacatcgaagaaaataaatattctcgcgccaaatccccacagcctccagtggaagaagaggatgaacatttcgatgacacagtggtgtgccttgatacgtacaattgcgaccttcactttaaaattagcagggataggctgagcgcgagtagcctcacaatggagagtttcgccttcctgtgggccgggggccgggcctcatacggagttagtaaaggcaaagtctgtttcgagatgaaggtcacagagaagatccctgtgagacatctctacacaaaggacatcgacattcacgaagtaagaattggttggagcctgacaacttcggggatgcttctgggagaagaagagttctcgtacggttattcccttaagggtatcaagacttgtaattgtgaaaccgaggactacggggaaaaattcgatgagaatgacgttataacatgttttgctaattttgagtcggatgaagtggagttgtcatatgcaaagaatggacaggacctgggggtggcctttaagatcagcaaagaagtgctcgccggccggcctctgtttcctcatgtgctgtgtcataattgtgcagtggaattcaattttggacagaaggagaaaccctacttccctatcccagaagagtataccttcattcagaatgttcctctggaggatcgcgtgcgggggccaaagggtccagaggaaaagaaggactgcgaagtggtaatgatgatcggcctcccaggagccggcaagacgacctgggtaaccaagcacgcagccgagaatcctgggaaatacaacatcctcggaacaaatacaataatggataagatgatggttgcaggcttcaagaaacagatggccgacactggcaagctgaataccctgctgcagcgagcccctcagtgccttggcaaatttatagaaattgctgctcgaaagaaacgcaactttatcctcgatcagactaacgtgtccgcagccgcacaacggcgcaaaatgtgcctgtttgcagggtttcagcgcaaagccgtggtagtgtgtccaaaggatgaagattacaaacagaggacccagaagaaggcagaggttgagggcaaggacctgcctgagcacgccgtattgaagatgaaggggaattttaccttgcccgaagtggccgaatgctttgatgagatcacttatgttgagctacaaaaagaagaggcccaaaagctgctggagcagtacaaggaggagtcgaaaaaagccctgcctcctgagaagaagcagaacactggctccaagaagtccaacaagaataaatctggaaagaatcaattcaaccgaggcggaggccacagagggagaggtggatttaacatgcgcggaggtaatttcaggggaggagccccgggtaatcgcggtggttataacaggagaggcaacatgccccagagaggaggaggcggaggcggtagtggaggaatcggctacccatacccacgagcaccagtgtttcccgggcgtggctcgtatagcaacaggggcaactacaacagaggggggatgcctaacaggggcaactataatcagaattttcggggccgaggtaacaaccgaggatacaaaaaccagtcacaggggtataatcagtggcaacaggggcagttttggggccagaagccatggtcccagcattatcatcagggttattactag

SEQ ID NO: 14106 - DNA, 945 bp, Artificial Sequence
  Description of Artificial Sequence: Synthetic coding sequence
atgcaaaatgtaatcaatacagtgaaagggaaagccctggaagttgccgaatacctaactccggtattaaaggagtcaaagttcaaggagaccggggtgatcacaccggaggaattcgtcgcagccggtgatcacctggtacatcattgtccaacttggcagtgggcaaccggcgaagagttgaaagtcaaagcctatctgcccaccggtaagcagtttcttgtgaccaaaaacgtgccgtgctacaagaggtgtaagcagatggaatactctgacgaactcgaggctattatagaagaggacgatggggacggaggatgggtggatacttaccacaatactggtataacagggatcacagaagcggttaaggaaatcactttagagaacaaggacaacattcgcctgcaggactgcagtgccctctgcgaagaagaggaggacgaggacgaaggtgaggccgcggacatggaggagtatgaggagtcaggccttctcgaaacagacgaagccactctggatactaggaaaatcgtcgaggcctgcaaagcaaagacagatgcaggcggggaggatgccatattgcaaacccgcacttacgacctgtacataacatacgataagtattaccaaactcctcgcctgtggctgttcggctacgatgagcagcggcagccacttacagttgaacacatgtacgaagacattagccaagaccatgtgaagaagacagtcaccattgagaaccatccgcatctgcccccccccccgatgtgtagcgtccacccatgtcggcacgccgaggtcatgaagaaaatcatagagacagtggcagagggcggcggcgagctgggtgtccatatgtatctgctcatcttcctgaagttcgtgcaggctgttatacctactattgaatacgattacacaaggcacttcactatgtag

SEQ ID NO: 14107 - DNA, 900 bp, Artificial Sequence
  Description of Artificial Sequence: Synthetic coding sequence
atggtggacaaaaagctagtggtggtgttcggaggcactggcgctcagggcggaagtgtcgccagaacattgctcgaggacggcacttttaaggtgcgtgtcgtgacccgcaatcccagaaagaaggccgctaaggaactgcggctccaaggggcagaggtcgttcagggggatcaagacgaccaggtcattatggaacttgcactcaacggagcttacgcaacatttattgtaacaaactactgggagtcgtgctcacaagagcaggaagtgaaacagggcaagctgctcgcagatttagccaggcgacttgggctccattacgtcgtgtattcagggttggagaacatcaagaagctgaccgccggccgactggcagctgcccacttcgatggtaaaggagaggtggaagagtattttcgcgacatcggggtgcctatgacctcagtgcgtctcccctgttatttcgagaatcttctcagtcacttcctcccccaaaaggcccctgatgggaagagctacctattatcacttccaactggtgacgtgcctatggatggtatgagtgttagtgatctgggcccagtggtcctcagcctgcttaagatgcccgaaaagtacgtgggtcagaacatcggcctgtcaacctgtcggcacaccgcagaggagtacgcagccctgctaacaaaacacaccaggaaggtggtgcacgacgccaagatgacccccgaggactatgaaaaattggggttcccaggggcgagggatttggcgaacatgttccgcttttacgcccttagaccggaccgcgatatagagttgactctgcggctgaatcctaaggcgcttactctcgaccagtggctggagcagcataaaggggattttaacctgctttag

SEQ ID NO: 14108 - DNA, 2571 bp, Artificial Sequence
  Description of Artificial Sequence: Synthetic coding sequence
atggacattagcaaggggctgccgggtatgcagggggggctccacatttggatatccgagaatcggaaaatggtcccagtgccagaaggcgcctatggaaactttttcgaagagcactgctatgttatccttcatgtcccacaatccccaaaggccacccaaggagccagcagtgacctacactactgggtcggaaagcaggccggcgctgaggctcaaggagcagctgaagcctttcaacaacgcttacaagacgagctgggaggccaaacagtgctgcatcgtgaagcccagggacacgagagcgattgtttttgctcttactttagacccggtatcatctatcgcaagggaggactcgcctctgatctgaagcacgtggagacaaatcttttcaatattcagaggctgctgcatattaaaggacgcaagcatgtcagcgccactgaggtggaattgagctggaactcttttaataagggtgatatattcctcttagatctaggtaaaatgatgattcaatggaacggccctaagacatcaatttcagagaaggcgaggggcctagcgctaacttatagtctcagggatcgtgagcgtgggggcggtcgggcccagatcggagtggtagacgatgaggcaaaagcgccagatctgatgcagattatggaggctgtcttaggacgccgggtgggctccctccgggctgctaccccatctaaggacattaaccaactacagaaagccaacgttcggttgtaccacgtgtatgaaaaggggaaggacttggtcgttttggaacttgccacccccccgttaacacaagacctgctgcaggaagaagatttctacatactagatcaggggggatttaaaatttatgtttggcaggggcgaatgagcagcttgcaggagaggaaggctgcgttttctagagctgtgggatttattcaggctaaaggatatcctacctatactaatgttgaagttgtgaatgacggagcagagtccgccgcatttaaacagctgttccgcacctggtctgagaagcgcagaagaaaccagaagcttggcggaagagacaagagtattcacgtcaaactcgacgtgggaaaactacacactcaacccaaactggccgcccagctcagaatggttgacgatggtagcggaaaagtggaagtgtggtgtatacaggaccttcacagacagcctgtcgatccaaagcgccatggccagctctgtgccggtaattgctacctcgtcctctacacctaccagaggcttgggcgggttcaatacattttatatttgtggcagggacaccaagctactgctgacgaaatcgaggctctgaattctaacgccgaggaactggacgttatgtacgggggcgtgcttgtgcaagaacacgttacaatgggctccgaaccccctcactttctggctatctttcagggacagttggtcattttccaagagagagccggccatcatggtaaaggccagtctgcctcaacgacacgactgttccaagtccagggaacagattcccacaacacccggacgatggaagtgccagcacgagcgtccagcctgaattcatctgatatcttcctattggtcaccgcgtccgtgtgttatctttggtttggtaaaggatgtaatggagatcagcgagagatggccagggtggtggtgaccgttatatcacggaagaatgaagagacagtcttagaggggcaggagccacctcatttctgggaagccctcggtgggagagccccttatcctagcaacaaacgcctgccagaggaggtgccctcattccagcccagactgtttgagtgctccagccacatgggatgtttagtgctggcagaagtcggcttcttcagccaggaggatctggacaagtatgatattatgttactggatacctggcaagagatttttctttggctcggcgaggcagcatccgaatggaaggaggccgttgcgtgggggcaggagtatctgaagacccatcctgcaggtcgaagccctgctactcctatagtgttggtcaaacagggtcatgagcctcccacctttattggctggttttttacctgggatccttacaagtggaccagccacccctcccataaagaggtggtggatggcagcccagccgccgcctctacgatcagcgagataacagccgaggtgaataatctccggctatctaggtggcccggtaatggtagggcaggggccgtggccttgcaagccctgaaagggagtcaggacagttccgaaaatgacctggttagatctcctaaaagcgccgggagtcggaccagcagctcagtaagtagtacaagcgccacaattaacgggggattaagacgcgagcagctgatgcaccaagccgtggaggacctgcccgaaggagtggaccctgcaaggagggaattttatctgagcgatagtgactttcaagatattttcggcaaaagtaaagaagaattttacagcatggcaacgtggcgtcaaagacaagagaagaagcagcttgggtttttttag

SEQ ID NO: 14109 - DNA, 987 bp, Artificial Sequence
  Description of Artificial Sequence: Synthetic coding sequence
atggaggccaatggtagccagggcacatccggtagcgcgaacgactcacagcatgaccctggaaagatgtttatcggcggcctgagctggcagacttctcctgatagtctgagggactatttctcgaagttcggggagatcagagaatgcatggtcatgagagatccaacaacaaagcgcagcaggggattcggttttgtgactttcgccgatcccgctagcgtcgataaggtcttggggcagccccatcacgagctggattccaagacgattgaccccaaggtcgcttttcctaggagagctcaacccaaaatggtcaccagaacgaagaagatctttgtgggaggtctgagcgctaacacggttgtggaggatgtgaagcagtacttcgaacagttcgggaaagttgaggatgccatgcttatgttcgacaagactaccaatagacatcgcgggtttggattcgtcacatttgagaacgaggacgtcgtagaaaaggtgtgtgagatccactttcacgaaataaacaacaagatggttgaatgtaagaaagctcagcccaaagaggtaatgttcccccctggaactcgtggtagggctcgcggattgccctataccatggatgctttcatgctgggcatgggtatgttggggtaccccaatttcgtggccacatatggacggggttatcccggcttcgcaccaagttatggataccaatttcctggctttccagctgccgcttacgggccagttgctgccgctgcggtcgccgctgcccgcgggtctgggtctaacccggcccggccaggtggtttccccggagccaactcacccgggccagtggccgacctgtatgggcctgcctctcaggactctggtgtgggcaattatatctccgctgcttcgcctcagccaggatccggcttcggccacggcatagccgggccgctgatcgccacagcctttaccaacgggtatcactag

SEQ ID NO: 14110 - DNA, 654 bp, Artificial Sequence
  Description of Artificial Sequence: Synthetic coding sequence
atggagagcgttgctttgtatagctttcaagctaccgagagtgatgaactcgccttcaacaaaggcgataccttgaaaatcttgaacatggaagacgaccagaattggtataaggccgaactccgtggggtggaaggtttcatcccaaagaactacatacgcgtgaaaccccacccatggtattccggccgtataagcaggcagttggcggaggaaatccttatgaagaggaatcatctcggcgcgttcttaattagagagagtgagtcctctccgggcgagttttccgtttccgtcaactatggagaccaagtacagcatttcaaggtcctgagagaggccagcgggaaatacttcctctgggaggagaagttcaatagcctgaacgaacttgtagacttctaccgaaccacaactatcgccaagaagagacagatattcctgagggacgaggagcccctactgaaaagccctggcgcttgttttgctcaggcgcagttcgacttcagcgcgcaggacccaagccaactcagcttcaggagaggtgatattattgaggtgctggagaggcctgatccgcattggtggagaggacgttcatgtggaagagtggggttttttcctcggtcctacgtgcaacccgtccatctctag

SEQ ID NO: 14111 - DNA, 231 bp, Artificial Sequence
  Description of Artificial Sequence: Synthetic coding sequence
atggggctgaagatgtcatgtctgaagggtttccagatgtgcgtctcatctagctcatctagccacgacgaagcgcctgtattaaacgataagcatctcgatgtgcctgacatcataatcacgccaccgaccccgactggcatgatgcttccccgggatctgggcagcactgtgtggttagatgaaacaggcagttgccccgacgatggcgagatagaccctgaggcctag

SEQ ID NO: 14112 - DNA, 19863 bp, Artificial Sequence
  Description of Artificial Sequence: Synthetic coding sequence
atggaccagccacagttctctggagccccgcggtttcttacacgtcccaaagcctttgttgtgagcgttggcaaggacgccactctgtcttgccagattgttggtaaccccacgccacaggtcagctgggaaaaggaccagcaacccgttgccgctggtgcccggtttcgcctggcgcaggatggcgatctgtatagacttactatactggatctggcgctaggcgatagcggacaatatgtgtgtcgtgcaaggaatgccatcggagaagccttcgccgctgtgggtctccaggtggatgccgaggccgcctgcgctgagcaagccccccacttcctgttaagaccgacatctatccgggtacgagaaggatccgaggcgaccttcagatgtagagtggggggctcacccaggccggcagtatcttggtccaaagatggtcgccgcttgggtgagcccgacggccccagggttcgagttgaggagctaggagaagcctcggcgttgcgtataagagctgctaggccccgggatggcgggacctacgaggtacgcgccgagaacccattgggggcagcaagtgctgccgcagccctggtggtagattctgacgccgccgatacagcctcaaggcctggcacctctaccgccgcacttttggctcacctgcagcggaggcgcgaggcgatgagggctgagggggcccccgcaagtcccccttccacaggcacaagaacctgcaccgtgaccgaggggaagcatgccagactgagctgttatgttactggggaaccaaaaccagaaaccgtttggaagaaagatggccagttggtaacggaaggtcgcagacatgtggtttacgaagacgctcaagaaaatttcgtcctgaaaatcttattctgcaaacagagtgacaggggcctttacacttgtacggcgagtaacttagtcggccaaacgtatagctctgtgctggtcgtggtgcgtgagcctgctgtgccattcaaaaaacggttacaggacttggaggttcgggagaaagagtcagctactttcttgtgcgaggttcctcagccgagcacggaagccgcctggtttaaggaggaaacacgcctctgggcgtccgcaaagtacgggatcgaggaggaaggcacagagcgtagactgacagttcgtaatgtgtcagccgatgacgatgctgtgtacatctgtgagactcctgaagggtcccggacagtggcagaacttgcagtgcagggtaatctgcttcggaaactgcctcgaaaaaccgccgttagagttggggacaccgcaatgttttgcgtcgagcttgccgtgccggtgggtccggtacactggttgcgcaaccaggaggaggtcgtcgctggagggcgggtggctattagtgctgaggggacacgacatacgttaacaatttcacaatgttgtttggaggatgttggtcaagtggccttcatggcgggcgactgccagacgagcacccaattctgtgtgtccgcccctagaaaaccaccgctccagcctccagtagacccggtcgtgaaggctaggatggagagcagcgtgattctgagttggagccctcctccccatggggaacgcccagtaactatcgacgggtacctggttgagaaaaagaagttgggaacttacacctggatccgatgccacgaagccgagtgggttgccacccccgagctgactgtggccgatgtggctgaagagggcaactttcagtttagagtatctgctttaaacagctttggacaaagtccttatctcgaattccctgggaccgtacacctggctcccaagctggcagtgaggaccccgctgaaagccgtgcaagccgtagagggcggtgaagttacattttccgttgacctcactgtggcctcggcgggtgaatggttcctggatggccaggcacttaaggcctcatctgtttacgaaatccattgcgataggacacgtcataccctcaccatcagggaagttcccgcctcgctacacggtgcacaattgaagttcgtggctaacgggattgagtctagcatccgaatggaagtaagggctgctccaggactgaccgcgaacaagcctccagctgctgccgctcgcgaggtgctggcaaggctgcatgaagaagcccagctgttggctgagctttccgaccaagccgcagctgtgacctggctgaaagacgggaggaccctgagtcctggaccaaagtacgaagttcaggccagcgctggtagacgggtcctcttagtaagagacgtagcaagagacgatgcaggcctttatgaatgcgtctctaggggaggcaggatcgcctatcagctgtctgttcaggggcttgcacggttcctgcacaaggacatggccgggtcttgcgtggacgctgtcgcaggcggccccgcacagtttgagtgtgaaacgagtgaggcccacgtccatgtccactggtacaaggacggcatggagctgggccatagcggcgagagattcctccaggaagatgtagggacccggcaccgactcgttgctgcgaccgttacccgacaagacgaggggacctactcctgtcgcgttggcgaagattccgtcgattttcggttgcgagtgagcgaacccaaggtcgtattcgccaaggaacaactcgctcggagaaagctgcaggccgaggcgggcgcgtccgctacattgagttgcgaggtcgcgcaggctcagaccgaagtgacctggtataaggacgggaaaaaactgtcaagcagctccaaagtctgcatggaagctactggctgtactagacgtctggtggtacaacaggcaggccaggcagatgccggtgagtattcctgcgaagccgggggccagcgccttagtttccatctcgacgttaaagagcctaaggttgtgttcgccaaggatcaggtggcacattcagaggtgcaggctgaggctggggcttctgctaccctttcctgcgaggttgcacaggcccagaccgaggtgatgtggtacaaagatggaaagaagctttccagtagcctgaaggttcatgtcgaggcaaaaggctgtcgacggaggcttgttgtgcagcaagctggcaaaacagatgctggggattactcttgcgaggcccggggtcagagggtttcatttcgacttcatattactgagcccaagatgatgttcgcaaaagagcaatccgttcacaatgaggtgcaggccgaggctggagcttccgccatgctgagctgtgaagtggctcaggcacagactgaagtgacttggtacaaggacgggaagaagttaagtagctcatccaaggtagggatggaggtcaaggggtgtacgcggaggctggttttaccacaggcgggcaaggccgatgcaggggaatacagctgtgaggccggcggccagcgggtgtcttttcacctgcatataacggaacccaaaggcgtgtttgccaaagagcaatctgtgcacaatgaggttcaggcagaagcgggaacaaccgccatgctaagctgtgaggtcgcgcagccgcagactgaggtcacgtggtacaaagatggcaaaaagctgtcaagcagctccaaagtgcggatggaagtcaaaggctgtactaggagactagtggtgcagcaggtggggaaggcagacgccggcgagtatagctgcgaagccggcggacaaagagtatccttccaattgcatattaccgaacctaaagccgtattcgctaaagagcagctcgtgcataatgaggttaggacagaggctggtgcatctgccaccctgagctgcgaggtagcccaggcccaaacagaggtgacctggtataaggacggcaagaagttgagttcctcgagcaaggtgaggatcgaggctgcaggatgcatgcgacagctggttgtgcagcaggccggccaggccgatgctggagaatatacctgtgaggccggaggacaacgactttccttccacctcgatgtctccgagcctaaggccgtcttcgctaaggagcagctagcccacaggaaggtgcaagccgaggctggagcaatagctaccttgagttgtgaggtggctcaagctcagaccgaagtgacctggtacaaagacgggaagaagctgagtagttcctcaaaagtgcgcatggaggccgtaggttgtactaggagactggtagtgcaacaggcatgccaggccgatacgggggagtatagttgcgaagcaggaggtcagcggctgtcgttcagtttggacgttgctgagcccaaggtagtattcgccaaggaacagccagtacaccgcgaagtgcaggcccaggccggcgcttctactaccttgagttgcgaggtggcccaggcccagacagaggtcatgtggtataaggatggaaaaaaactgagcttttcctccaaagtgcggatggaggccgtagggtgcacgcggcgtcttgtcgtacaacaggcgggacaggccgtcgctggtgagtattcatgtgaagccggatcccaacgcttgtccttccaccttcacgtcgccgagcctaaggcggtttttgccaaggaacagcctgcctcccgggaagtccaagccgaagctggaacaagcgccaccctatcttgcgaggtcgcccaggcccagaccgaagtaacatggtacaaagacggcaagaagctcagctcttctagcaaggtgcgaatggaggcagtgggatgcaccaggcgcctggtggtgcaagaggccggtcaggctgacgctggtgagtacagctgcaaggccggggatcagagactgtctttccatttgcatgtagcagaaccgaaggtggtgtttgcaaaggagcagcctgcccatagggaggtgcaagcggaagccggggcatcggcgactctctcctgcgaagtagctcaggctcagaccgaggtaacgtggtacaaggatggaaagaagttgtccagtagctcaaaagtgagggtcgaggcagtgggatgcacgagaaggctggtggtacaacaagccggtcaggcggaagctggtgaatatagttgtgaggcaggaggccaacagctcagctttaggctccaggtagctgagttggagccgcagatatcggagaggccctgccggcgtgaaccccttgttgtgaaagaacatgaagacataatcctgacagccacactggccaccccgtcagcagccactgtgacctggctcaaggatggggtcgagatacgtcgaagcaagaggcacgagaccgccagccagggggatacccacacattgactgtacatggggcccaggttctggatagcgctatttacagttgccgagtgggcgccgagggccaggattttcctgttcaggtggaagaggtggcagctaagttttgccggttgctcgaaccagtgtgcggggaactaggcggaaccgtgactcttgcctgtgagctgtccccggcatgtgccgaggtagtgtggagatgtggtaatactcagctgagagtgggaaagcgatttcagatggtcgcagaaggccccgtccgcagcctgactgtcctcggactgcgagccgaggatgccggtgaatatgtgtgtgaatcccgcgatgatcacacaagtgctcagttgactgtgtccgtgcctagggttgtgaagttcatgagcggactgtccactgtggtagccgaagaggggggcgaagcgactttccaatgtgtggttagcccctctgacgttgctgttgtctggttccgcgacggtgctttgctgcagccgtcagagaaatttgcaattagtcagtctggcgcatctcatagcctgaccatctctgatctggtactcgaggacgccggacagatcaccgtggaagctgagggcgcaagctctagcgccgcactgagagtcagggaagcccccgtgctgttcaagaagaagctcgagccccaaacggtcgaagagcggagctcagtcacgttggaggtggaattgacccgaccttggccggaattgcgttggacccgaaacgcaaccgctctggctccaggcaaaaacgtagagatccatgctgagggggcaagacaccggcttgtattgcataacgtggggtttgcagaccgaggctttttcgggtgtgagacacctgatgacaagacgcaagcaaaactgaccgtggagatgcgccaagttagactggtccgcggcttacaagcagttgaagcacgagagcagggaacggctaccatggaggtgcaactttctcacgccgatgtggacggcagttggactcgcgatgggttgaggtttcagcagggcccgacatgtcatttagcagtgcgggggccaatgcatacgctgacactctcgggcctgagaccggaggactccggtctgatggtgttcaaggcagagggcgtgcacacctccgccaggctggttgtgactgaactgcccgtgtccttctctaggccgctacaagatgttgttacaacggaaaaggaaaaggtgacactggaatgcgagctatccagaccaaacgttgacgtaagatggctaaaggacggggtcgaacttagagccggcaaaacaatggccatagctgcgcagggggcctgcaggtctttaaccatttatagatgcgagttcgctgatcagggtgtgtatgtgtgcgatgctcatgatgcccagtctagcgcctccgtgaaagttcagggccggacctatactttgatctatcgaagggtgttagcagaagacgccggggagattcagttcgtggcagagaacgctgagtcccgggcccaactaagggttaaagaacttcccgtgacacttgtacgacctctgcgggacaagatcgccatggagaaacaccggggcgtcttagagtgtcaagtgagccgagcgtcagcacaagtcagatggttcaaaggtagtcaggaactccagcctgggcccaaatatgaactggtttccgacggactgtatcgcaagttgattatttctgatgtgcacgcagaggacgaagatacatacacttgtgatgcaggggatgttaagacttcagcccagtttttcgtagaggagcagagtattaccatagtaagaggactgcaagacgttaccgtgatggaacctgccccagcctggtttgagtgcgagacatcaattcccagtgtacgaccacccaagtggctcctgggaaaaactgtactgcaggctggtggcaacgtggggctggagcaggaaggaacagtgcatcgtctgatgttgcgaaggacatgctccacaatgaccgggcccgtacattttaccgtgggtaaatcgaggtcatcggcacgtttagtggtgtccgatattcctgtcgtcttgacccggccactggagcccaagacaggccgggaactccagtctgtagtcctatcgtgcgactttaggcccgcaccaaaggccgtccagtggtataaagatgacactcccctgtccccgtcagaaaaattcaaaatgtctctcgagggccaaatggcagaactgcgaatcctccggctgatgcccgccgacgcgggggtctacagatgccaggcggggtctgcccacagtagcaccgaggtaactgtcgaggccagggaagttacggtgaccggaccgctgcaggatgctgaggcgaccgaggagggctgggcaagcttttcttgcgaattaagccacgaagacgaggaggtggaatggagcctgaatggcatgccactttacaacgattcttttcatgaaatttcccataagggaaggcgtcacacattggtccttaaatctatacagcgcgccgacgccggcattgtgcgggcctcttctctgaaagtatccactagtgcccgactggaagtgagggtgaagcctgtggtttttttgaaggcattagatgacttgagcgcagaagagcgcggcactctagccctgcaatgtgaagtttcagaccccgaggctcacgtcgtgtggcggaaggacggggtgcagctggggcctagcgacaagtatgattttcttcatacggctgggactcgcggtttggtcgtgcatgatgtgtcacctgaggacgctggcctatatacatgtcatgtcggtagtgaagagacacgcgcccgggttagagttcacgacctccatgttgggatcaccaagagattgaaaaccatggaagttctggagggtgagagctgtagttttgaatgcgttctttcccacgaatcagctagcgatccggctatgtggacagtggggggaaagacagtcggctcttcgagccggtttcaggccacccgccagggaaggaagtacattctggtcgtgcgagaagcagcgccgagtgatgcgggggaggtggtgtttagcgtacgcggcctgacgagcaaagcgagtttgatcgttcgtgagcgaccagcggcaatcattaagcctctggaagaccagtgggtggcacccggcgaagacgtcgagctgagatgtgagttgtcaagggccgggactcctgtgcactggctgaaagatcggaaggccattcgcaagagccagaagtatgacgtcgtgtgtgaaggcaccatggccatgctcgtgattagaggcgcttccctgaaggatgctggagagtacacgtgtgaagtggaggccagcaaatcaaccgcgtcactccacgtagaggagaaagctaactgctttacagaggaactgacgaacctgcaggtcgaagagaagggaacagctgtattcacgtgcaaaacagaacatcctgctgcaactgtaacctggagaaaaggacttctcgaactccgggcgagtggtaaacaccagccctcgcaagaagggctcactttaaggctcactatctccgcattggagaaggctgattccgatacctacacttgcgacataggtcaggcgcagtctagagcccagctgctggtacagggtcgcagagttcacattattgaagatctcgaggacgtggatgtgcaagagggcagctcagccaccttcaggtgtagaatcagcccggcgaattatgagccagtgcattggtttctcgataagaccccgctgcacgcaaatgaacttaacgagattgatgcacagcccggcggttaccatgtactgacactgaggcagctggcgcttaaagactctgggactatttactttgaggcaggagatcaacgtgcttcggccgccctaagagtgactgaaaagcccagcgtgttctccagagagctgactgatgcaacaatcacagagggggaggacctgacccttgtgtgtgaaacatctacctgtgatataccagtttgctggactaaggatggcaaaactttgaggggatccgcacgctgtcaactgtcccacgagggacaccgcgctcaactgctgataaccggtgccaccctgcaagacagtggtaggtataaatgtgaagcaggaggagcctgttcaagcagcattgtgagagtccacgcaagacctgtacgtttccaagaggcgcttaaggatctcgaggtgctggaggggggcgccgccacattgcggtgtgtgcttagcagcgtggcagcccctgtaaagtggtgctatggtaacaacgttcttcgtccgggcgacaaatacagcctacgacaagagggcgcgatgttggaacttgtggtaagaaatctacgccctcaggatagtgggcggtactcctgctctttcggggatcagactacctcagctacactcacagtgacagcccttcctgctcagttcatcggcaagttgagaaacaaggaggctaccgagggtgctacggccaccctgcgatgtgagttgtccaaagctgccccggtagagtggagaaagggttctgagaccctccgagatggggatcggtactgcctgaggcaggatggggcaatgtgtgagttgcaaattcgcggattagcgatggtggatgccgctgaatattcttgcgtgtgcggcgaggagagaacttctgcatctctcactatcaggcctatgccggcccacttcattgggagactgaggcaccaggagtccatcgaaggcgctactgctaccctgagatgtgagctttcaaaggccgcccctgtggagtggcgtaaaggcagggagtccctgcgcgatggagataggcatagcttaagacaagatggggcagtgtgcgaactacaaatctgcgggctggccgtcgccgatgcgggtgaatacagctgcgtttgtggagaggaacggacatccgctacgcttaccgtaaaggcgcttcccgctaagtttacagagggacttcgaaatgaggaggccgtggagggagctaccgccatgctgtggtgcgagctgtccaaagtagcaccagtggagtggaggaaaggccccgagaatctccgcgacggcgaccgctatatattgagacaggaagggactaggtgcgagctgcagatttgcggtttggcaatggcggacgcaggcgaatatctctgcgtgtgcgggcaggagcggacctccgccacactaaccattcgcgcccttccagctaggttcatcgaggatgtgaagaaccaagaagcgagggagggtgccacggcggtgctccagtgtgaacttaactccgcggcccctgtcgaatggcggaaaggttctgaaactttgagagacggagatcgatatagtcttcggcaggatggaacaaagtgcgagctgcagatccggggactggcaatggctgacacaggagagtattcttgcgtatgcggacaggagaggacatccgcaatgcttaccgtgagagccctcccaattaagtttactgagggcctgcggaacgaagaagcaactgaaggcgccacagctgttctgcgctgcgagctgagcaaaatggctcccgttgagtggtggaagggacatgagaccctgagggatggcgaccgccatagcctccgccaggatggggctagatgtgaattgcagattcggggccttgtggcagaggatgccggcgaatacctctgcatgtgcggcaaggagcggacctctgccatgctgactgtccgggctatgccctctaagtttatcgagggcctgcggaacgaagaggcaaccgagggagacacagctacactgtggtgtgagctgagtaaggcagctcctgtcgaatggcgtaagggccatgagaccctacgagatggagacagacattctctgcgacaggacgggtctcgctgtgagcttcagatccgcggactggccgtagtggacgctggcgagtatagctgtgtgtgcgggcaggaacggacatccgctacactgaccgtcagagcattgcccgctcgctttatcgaagatgtgaagaaccaggaggcccgcgaaggggctactgctgtgctccagtgcgaactgtcaaaggcggctcctgtggaatggaggaagggcagtgaaacactgagaggaggggatcgctattctctgcgacaagatggaaccagatgcgaacttcagatccacggcctgtcagtggccgacaccggggagtacagctgcgtctgtggccaggagcgcacatccgcgactctgaccgttagggctccacagcccgtgttcagagaacccctgcagtcccttcaggctgaagaaggctccacagctactctgcaatgcgaacttagtgaacccacagccacggtggtttggagcaaggggggcctgcagttgcaggctaatggccgaagagaaccgaggctccagggatgcaccgcggagctggtccttcaggatctccaacgcgaggatactggcgagtatacgtgcacctgtggctctcaggcaacatccgccaccctgactgttactgccgctcccgtccgattccttcgagaactccaacatcaggaggttgacgagggagggacagcccacctatgttgcgaactctcaagagcgggagcttccgtggagtggcgtaaagggagtttgcaactgttcccatgcgcaaagtaccaaatggttcaggatggtgcagccgctgaactgctggtgcgtggagtggaacaagaagatgcaggagactatacctgcgataccggacacactcagagcatggctagcctgagtgtgcgcgtgcctaggccgaaatttaaaacacgactgcagagcttggaacaagagactggcgatatcgctaggctctgctgtcagctctctgacgcggagagcggagctgtggtgcagtggctgaaagagggcgttgagctgcatgctgggcctaaatacgaaatgcggtcacaaggagccacccgggaactgctgatccaccagttggaggcgaaggacacaggcgaatacgcatgtgtgaccgggggacagaagactgcagcttcacttcgagtgactgagcctgaagtcacaatagtgcgcggactggtggatgctgaagtaactgccgacgaagatgtggagtttagctgcgaggtctcccgcgctggtgcaacaggggttcagtggtgtctccagggattgcccctccagtcgaacgaggttacagaggtggctgtgcgcgacgggaggattcataccctccgtctgaagggcgtgacgccagaagacgctggcaccgtatcattccatctggggaatcatgcttctagcgcgcaattaactgtacgagctcccgaggtgaccattttggagcctctccaggatgtccagctctctgagggtcaagatgcttcctttcaatgtcgcctatctagagccagcggacaggaggcccggtgggccctggggggtgttcccctacaagcaaatgagatgaacgacatcaccgtggagcagggcaccttgcatctgctaactctgcataaagtgaccctcgaggacgccgggactgttagcttccacgtcggcacttgtagctcagaggctcagctcaaggtgactgctaagaacacagtggtccgcggccttgagaacgtcgaggctttggagggcggtgaagccctgtttgagtgccagttgagtcagcccgaagtggccgcccatacatggctcctggacgatgagccagttcatacctcagagaacgccgaagtggtcttcttcgaaaatggtcttaggcatttgcttctgctgaagaatctcagacctcaagactcatgtcgggtgacgttcctggcaggtgatatggtcacttccgcttttctcacagtcagaggatggaggctcgagatcctcgaacccttgaaaaacgcagctgtgcgagcaggcgcgcaggcctgctttacatgtacactcagtgaggcagtgccagtcggggaagcaagttggtacattaacggtgctgccgtgcagcctgacgattcagactggactgttaccgcagacgggtcccaccacgccctgctactgcgttctgctcagcctcatcatgccggagaggtgacctttgcatgtcgagacgcagtcgccagcgcccgtctcaccgttctcggcctgccggatcctcccgaagatgctgaagtcgttgctcggtcaagccatacggttaccctgagctgggccgctcctatgtctgacggcggcggaggtttgtgcggctaccgggtggaagtgaaggagggggccacagggcaatggcgactctgccacgaattggtcccaggacctgaatgcgttgtggatggtctcgcgcccggtgagacctaccgatttagggtggccgccgttgggcctgttggcgccggagagcccgtgcacctgcctcaaactgtgcgactggccgaaccacccaagccggtgccgcctcaaccatcagctcccgagtccaggcaagtggccgcaggggaagacgtgtctctggaactggaagtagtcgctgaagccggagaggtgatctggcataaaggcatggagcgaatccagccaggcggccgatttgaagtcgtgagtcaggggcggcagcagatgctcgtgatcaaagggttcacggccgaggaccaaggggaatatcactgcggccttgcccagggttcaatctgtcctgctgcggccacattccaggtcgcattgtccccagcctccgttgacgaggcaccccagcccagcctccccccagaagcagcacaggaaggggacctccacctgctgtgggaggcattggcccgaaaaagaaggatgtcacgagaacctacattggactctatcagtgaactgcctgaagaagacggacgcagtcaacgtctcccacaagaagcggaggaggtcgcacccgacctgtcggaggggtacagcactgctgacgagctggctcgcaccggtgacgcagacttgagccacacttccagtgatgatgaaagtagggcagggactcccagccttgtgacttacctgaaaaaggccggccgtcctggcaccagtcccttagctagcaaagtgggcgcacccgccgctcccagcgttaagcctcaacagcagcaagagcctctggcagcagtgagaccaccactgggggatctttccaccaaagacctgggcgacccctctatggacaaagccgccgttaagatccaggccgcattcaagggatataaagtgaggaaggagatgaagcagcaggagggcccaatgttttcacatacattcggcgatacagaggcacaggttggcgatgccctgcggctggagtgcgtggtcgcaagcaaggctgacgttcgagccaggtggcttaaggatggcgttgagctcactgatggccggcatcatcatatagaccagctcggtgatggtacctgtagcttgctgatcaccggcctggacagagctgacgcaggatgctatacctgccaggttagcaacaagtttggacaggtaactcatagcgcctgcgtcgtggtgtccgggagtgagagtgaagccgaatcttcatcaggcggcgaacttgacgacgccttccggcgtgccgccaggcgtttgcatagactcttccggactaagtcgcctgccgaagtgtctgacgaagagctgtttctgagcgccgatgagggaccagcagaacctgaggaaccagcagattggcagacctaccgcgaggatgaacactttatctgtatcaggtttgaggcactgaccgaggccagacaggctgtgacccggttccaggagatgttcgctactctgggcattggagtggagatcaagttagtcgaacaggggccaaggcgggtcgagatgtgtatatccaaggagacaccagcgccagtcgtgcctcccgaacctctccccagtctcctaacaagcgacgcagcccctgtgttcctcacagaattgcagaaccaagaggttcaagatgggtatcccgtttccttcgactgtgtggtcacaggccagccaatgccaagtgtcaggtggttcaaggacggcaaattgctagaggaagatgaccattatatgattaatgaagaccagcagggcggacatcaactgattatcaccgcagtggtgccagctgacatgggcgtataccggtgtctagcggagaacagcatgggggttagcagcacaaaagctgagcttcgggtcgacctaacctcaacagactacgacaccgctgccgacgcaacggaaagttcttcatatttctccgcccagggctacctctcttctagggagcaggaggggactgagagcacaactgatgagggacagctgccccaggtggtagaagaactgcgagacctacaggtcgcacccggaactagattggctaagtttcaattgaaagtcaaagggtacccagcaccccgcctgtactggtttaaagacggccagccccttaccgcatccgcacatatcagaatgaccgacaagaagatactgcatactttagaaataatctcagttacgcgggaagattccgggcagtatgctgcctacatctcaaacgccatgggcgctgcctattcatccgccaggctgttagtgcggggcccggacgagccagaagaaaagccagccagcgacgtgcatgaacagctcgttccgccccgtatgctggagcggttcacacccaagaaggtaaagaagggatctagcatcaccttttctgtaaaggtcgaaggccggccagtcccaacagtgcattggctccgggaggaagctgagagaggagtgctgtggatcgggccagataccccaggttatactgtcgcatcttcagcccagcagcactcactggtgctcctggatgtgggcaggcagcatcaggggacttatacgtgtatagcatcaaacgccgcgggacaggccctttgttccgcaagcctgcacgtctcagggctaccgaaggtcgaggaacaggaaaaggtaaaagaagcactcatctcaacgttcctgcagggtacaactcaggcgatatccgctcagggtttagaaaccgcaagctttgccgatcttggaggccagagaaaggaggagcccctggctgctaaagaggcattaggacacctatccctcgccgaggtcggcactgaagaatttctgcagaagctgacaagccagatcactgagatggtgagcgccaaaattacccaggctaaactgcaagttcccggaggcgactctgatgaagattctaaaacaccctcagccagccctaggcatgggaggtctcgtcccagcagttctatccaagagagctcatccgagagtgaagacggggacgctaggggcgagatcttcgatatttacgttgtcaccgcagattatctccctctaggagcggagcaggatgctataactctgcgggagggacaatacgtcgaggtgctggacgccgcccatcccctgcgctggctggtgcgtaccaagcccacgaagtcgtcaccttctagacaaggttgggtaagtcccgcttatcttgatcgaagactcaagctcagccccgaatggggcgctgctgaggcgcccgaatttcctggagaggccgtgtcagaggacgagtacaaagcacgattaagcagtgtgattcaagaactcctctcatccgaacaggcttttgtggaggagctacagtttcttcagtcgcatcacctgcagcacctagagagatgtccccacgtccctattgctgtagcaggacagaaggccgtgatctttcgcaatgtgagggatattggccgattccattcatccttcctgcaagaattgcagcagtgtgacacagatgacgacgtggcaatgtgtttcattaagaatcaggctgccttcgagcaatatctcgaatttttagtcggccgtgtgcaagctgaaagcgtggtggtgtccaccgctattcaggaattctataaaaagtatgctgaagaagcacttctagctggagacccatctcagccccccccccccccattgcagcattacctggaacagcctgtcgagcgagtacaacggtaccaggcactgctgaaggaactgattcgcaacaaggcccgtaaccgccagaactgcgcccttctcgagcaagcctacgccgtcgtctctgcactccctcaaagagcggaaaacaagctccatgtgagcctcatggagaattaccccggcacactgcaagccctaggggagcccatcagacagggccattttatcgtgtgggaaggggctcccggggcacgcatgccatggaaggggcataaccgacacgttttcttgttcagaaaccacctggtcatctgcaagccaaggagagactccagaacggatactgtttcttatgtctttagaaacatgatgaaattatcttcaatcgacctgaacgaccaggtcgagggcgacgacagagccttcgaagtgtggcaagagagagaagacagtgtccgtaagtacctgctgcaagcacgcacagccattatcaaaagttcgtgggtaaaagaaatctgcggcattcagcagcggctcgccctgcctgtgtggcgccccccggattttgaggaagaactcgcagattgcaccgccgagcttggagagaccgttaagctcgcatgccgagtcactggaaccccaaaacctgtgattagctggtacaaggacggaaaagcggtgcaagtagacccccatcacatcctgatagaagaccccgatgggagctgcgctctcattttggattccctgacgggcgtggacagcggtcaatacatgtgcttcgcagcctctgctgcaggcaactgtagcactctcggaaagattcttgtccaggtgccccctagatttgtaaacaaagtgcgagccagccccttcgtcgaaggagaggacgctcaatttacttgtaccatagagggcgcaccttaccctcagattagatggtataaggacggggcactactcacgaccggtaataagtttcagacattaagcgagccaaggtccggactgcttgtgcttgtgatccgtgccgccagcaaagaggacctgggactgtatgagtgtgaacttgttaaccggctcggttccgctcgagccagcgcagaacttaggattcagagtcctatgctgcaggcccaggaacagtgtcatcgggagcagctcgtcgccgctgttgaggtgactgaacaggagaccaaggtgcccaaaaagaccgtgataatcgaagagactataacaacagtcgtcaagagcccacgcggacagcgaagaagccccagcaaatcaccttcccgcagtcccagccgctgctcagcatcccccttgcgccccggactccttgctcccgacctcttgtatctgccaggtgcaggccagcctcgacggccagaggcggaacccggccagaaaccagtggtccctaccctgtacgtcacagaagctgaagcacattcccccgctttgccagggttatcagggccgcaacccaagtgggtcgaggttgaggaaaccatcgaggtacgcgttaagaaaatgggcccacagggggtgagccctacgacagaggtgccccgaagcagttctggacatctgtttaccctacccggagctactcccggtggagacccaaacagcaataattcaaataataagctcctggcgcaagaggcctgggcccaggggaccgccatggtgggagtgcgggaacctcttgttttccgagttgatgctcgtggttccgtcgactgggccgccagcggaatgggatcactggaggaggagggaacaatggaagaggccggtgaggaggaaggggaagatggagatgcctttgtcacagaggaatcacaggatacacactctctgggagaccgggatcccaagattcttactcataatggccggatgctgactctggccgacctggaggactatgtgccgggggaaggcgagacatttcattgtggtggaccaggccctggcgcccctgacgatcctccatgtgaggtctccgtcatccagcgagagattggcgagcccactgtgggtcagcccgtgttgctgagcgttggtcacgccctggggccgcgcggcccacttggtctgttcaggccagagccgagaggtgcaagcccgcccggcccacaggtgaggagcctcgagggaacatcattcttactgcgcgaagctcccgcgagaccagttggctctgccccttggacgcagagcttttgtacaaggattaggcgcagcgctgacagcggtcagtccagctttacgacagaactctcaactcagacagtcaactttggcaccgtgggcgaaacggtgaccctgcacatttgcccagatcgtgatggggacgaagcagcccaaccatag

SEQ ID NO: 14113 - DNA, 1407 bp, Artificial Sequence
  Description of Artificial Sequence: Synthetic coding sequence
atggcggcccctgatctctcaactaatttacaggaggaggccacctgcgcaatatgtttggattactttaccgaccctgtgatgaccgactgcggccataacttctgccgggaatgtataaggaggtgttggggccagccggaaggaccctatgcctgcccagagtgcagagagctctcgccccagaggaacttgaggcctaacaggccccttgccaagatggcggagatggctagaaggctccaccctcccagtcccgtcccacaaggcgtgtgtcctgcacaccgcgaaccacttgcagcattctgcggcgacgagctccgtctactttgcgctgcctgcgagcgttcaggggagcattgggctcacagggtcaggcccctccaggacgcagcagaggacctgaaagccaagctcgagaagagcctggagcacctgaggaagcagatgcaggacgctctcctattccaagctcaggcagatgaaacctgcgtactctggcagaaaatggttgaatcacagcggcagaatgtgcttggcgaattcgaacggctcaggagactgctcgcagaggaagagcagcagttacttcagaggctagaggaggaggaactggaagtgctacctagactgcgggagggcgctgcccatttagggcagcagtcagcacatctggctgagctgatcgccgagctcgagggtaggtgccagctacccgctctgggactgctccaggatattaaagacgccctccgccgggtccaggatgtgaagctacaacctcctgaggtcgtgccaatggaattgcgcaccgtatgtcgagtaccgggtttggtcgaaacgctccgcagatttcggggagacgtcaccttggaccctgacaccgcgaaccctgaactcatcctgtctgaggatagacgctccgtccagcgcggcgatttgcggcaggccctcccggattctcccgagcgctttgatccaggaccgtgtgtactcgggcaggagcggtttactagtggacgccactactgggaggtagaagtcggcgatcggacgtcttgggcactcggtgtatgtcgggagaatgtgaatcggaaagaaaagggtgaactgtcagctggcaacgggttctggatccttgtgttcctcgggtcatattataatagctccgaacgagcactagcacctctgagggatccccctcgtagggtcggcatttttctggactatgaggccgggcatctgagcttctacagtgccacggatggatcactgctgtttatttttccagagataccgttcagcggaaccctacgacctctattctcaccactgagcagcagcccgacaccgatgacaatatgtcgccctaagggtgggagcggcgacaccctggcccctcagtag

SEQ ID NO: 14114 - DNA, 813 bp, Artificial Sequence
  Description of Artificial Sequence: Synthetic coding sequence
atgagccctggttctggagtgaaatccgaatacatgaaaagatatcaagagccccgttgggaagagtatggcccatgctaccgggagcttctgcactaccggctcggccggcggttgcttgagcaagcacacgctccctggttatgggacgactggggtccagccggaagttcagaagatagtgcgagctccgaaagttccggggccggaggcccggctcccaggtgtgccccaccttctccccccccccctgtcgagcctgccacccaggaggaggctgaacgaagggccagaggtgctccggaagagcaggatgcagaggcgggcgacgcagaggctgaggatgctgaagacgccgccttaccagctctccccgtcaaagacgtagaggacaaacctgaacaacagacccggacaagagaaacagacaaatccccaaccagtactgaacccagacaacagccaagcgccctcttcgccaggggaaaccgtaaggccgtcaaatcaccacagcgctcttctagtaaaattaaggagaataaacacccttttgcgctgtacgggtggggagagaaacagaccgatacggggtcccaaaagacgcacaacgtgtgtgcatcggcccctgtgcacgagattcacgaaagcgccctgagggctaaaaataggcggcaggttgaaaagcgcaagctggtcgctcaaagacagcgagcccactctgtggatgtggagaaaaatcggaaaatgaaggcttcttctagcgagaatccttggatgactgagtatatgagatgctatagcgcccgagcttag

SEQ ID NO: 14115 - DNA, 2667 bp, Artificial Sequence
  Description of Artificial Sequence: Synthetic coding sequence
atggatgagtcagctcttctggacctcctggagtgtccagtgtgcctggagcgactggacgcaagcgcaaaggtgctcccctgccagcacactttttgtaaacgttgtctgcttggaattgtgggatcgaggaatgaactacgatgtcccgagtgccggaccctggttggatccggggttgaagagttaccatctaatattttgctggtgcggctgctggatgggattaaacaacgaccatggaagcccggtcctggagggggatctggcaccaactgcaccaacgctctcaggagccagtctagcacggtcgctaactgttcatccaaggatctgcagagctctcaggggggacaacaaccccgtgtacagagctggagtccccccgttagaggcatccctcagcttccttgtgcaaaagctctctataattacgaggggaaagaacctggtgacttgaaattctctaaaggcgatataattattctgagacggcaagtggacgagaattggtaccacggggaggtaaacgggatccatggtttctttccaacgaactttgttcagataatcaaacctcttccacagccaccgccgcagtgtaaggcattatatgacttcgaggtcaaggataaggaagctgacaaggactgcctgccttttgctaaggacgatgtactgacggtcatccgcagagttgatgaaaattgggccgaggggatgctcgcagacaagatcgggatctttccaatctcttacgtggagtttaattcggccgctaaacagctgattgagtgggataaaccccccgtacccggagtggacgccggggagtgttctagtgccgcagcccagtctagcactgcgcctaagcactcggataccaagaagaatacaaagaagcggcactcttttacaagtcttaccatggcaaataagagcagtcaggcatcccagaatagacactccatggaaatctctcctcccgtactgatctcctcaagcaacccaactgcagccgcacgtatctccgagctgtcggggctgtcatgctcggctccttctcaagtacatataagcactacaggactaattgtaacgcctccaccgagctcaccagtgactacagggccatcctttacattcccttccgacgtcccttaccaggctgcactcggcaccttaaacccacccctgcctcctccccccctgctggccgctactgtgttagccagcacaccccctggcgctacagccgcggcagccgcagctggcatgggtccgcgaccaatggcaggctctacagatcagatcgctcacctgaggcctcagacacgtccatctgtgtacgttgctatctacccatacaccccacggaaagaggacgagctggagctgaggaagggagagatgttcctggttttcgagcggtgccaggacggctggttcaagggtacatccatgcatacttccaaaatcggggtgtttcccggtaactatgtggctccagtgacccgtgcagtcacaaacgcttctcaggccaaagtccccatgagcactgctggacagacatcacggggagtgaccatggtttctcccagcaccgccgggggacccgcccagaaactgcagggaaacggggtggcaggttccccttccgtggtccccgctgccgtggtgagcgcagcacacattcagacatccccccaggctaaggtgctgctgcatatgacagggcagatgacggtgaatcaggcccgaaatgctgtgcgcacagtggcggcacataatcaggagcggccgaccgccgcagtaactccaatccaagtccaaaatgcggcagggctgtcgccagcttccgtgggactcagtcaccattcgcttgcgtctccccagcccgcccccttaatgccgggaagtgccacacacacagctgctatttccatcagccgggcctcagcccctcttgcttgcgccgcagccgcgcctctgacgtctccatcaattacatctgcaagcctcgaggccgaacctagcgggcggatcgttactgtcctgcccggactcccgacaagtccagattcagcatcatctgcgtgcggcaacagttctgcaacaaaaccggacaaagactcaaagaaggagaaaaagggactcctaaaactgctgtccggtgcctccaccaagcggaagccacgggtctcacccccagcatcgcccaccctggaagtggagctgggaagcgccgaattgcccctacagggtgctgtgggtccagagctgccccctggcgggggacacggcagggcaggctcttgccctgtggatggagatggtcccgtcaccacagcggtggccggtgccgctctcgcacaggacgcttttcatcgtaaggcctcatcacttgattccgcggtaccaatcgcacctccgcccagacaagcgtgtagcagcctgggccctgtcttaaacgaaagccgaccagtcgtttgcgagcggcatcgtgtggtcgtctcctaccctccgcagagcgaggccgagcttgaacttaaggagggagatatcgtgtttgtgcataaaaaacgtgaggacggctggttcaaaggaaccctacagagaaatggaaagaccggactgtttccaggcagcttcgtggagaacatctag

SEQ ID NO: 14116 - DNA, 570 bp, Artificial Sequence
  Description of Artificial Sequence: Synthetic coding sequence
atgccccaaacagtgattctgccaggccctgccccatggggattccgtctgagtggcgggattgacttcaatcaaccacttgtcattacccgtattacacctggaagcaaggcagctgccgccaacttatgtccaggagacgtgatcttggccatcgatgggttcggaaccgaatctatgacccatgctgacgcacaggatcgcattaaggctgctgctcaccagttgtgtctgaagattgatcggggcgaaacacatctgtggagcccccaagtgtctgaggatggcaaggcccaccctttcaagattaatctagagtcagaaccacaggaatttaaaccaataggaaccgctcataatcgccgggcccagcccttcgttgctgccgccaatattgacgacaagcggcaggtcgttagcgcaagttataactcgccgatcggtctttatagcacctccaacattcaggacgcattgcacgggcaactgcgaggactgatcccgagtagcccgcagaaaactggcactaccctcaacacctccattatttttggccccaatcttagctag

SEQ ID NO: 14117 - DNA, 1095 bp, Artificial Sequence
  Description of Artificial Sequence: Synthetic coding sequence
atgccacagactgtgatactaccaggaccggcaccctggggcttccgattgtcaggcggtatagacttcaatcagccccttgtgattacccgaatcacccctggctccaaagctgctgctgccaatctgtgtcccggagatgtcattctggccattgacggcttcgggacagagtccatgacgcatgccgacgcccaggacagaatcaaggcggccgcacatcagctgtgcctgaagatagaccggggggagacgcacctgtggtctccccaggtcagtgaagacggcaaagctcatccatttaagataaacctggagagtgagccccaggatgggaactattttgaacataagcacaacattcgacccaagccattcgtgatcccgggtaggtcatctggctgcagcactcctagcggcattgattgcgggagtggccgtagtaccccctctagtgttagcacagtgtctacaatttgccctggagacttgaaagtggccgccaagttggcaccaaacatccctctggaaatggagctgccgggggtcaaaattgtccacgcacagttcaacacccccatgcagttgtatagtgacgacaatatcatggagacactgcaggggcaggtctctacagctctgggagagacccccctgatgtctgaacctacggcctccgtgccacccgagtcagatgtctataggatgttgcatgacaatagaaatgagcccacacagcccagacaatcaggcagtttccgggtgctacaaggaatggtggacgatggttccgacgatagacctgccggaactaggtccgtgagggctccagtgactaaggtgcatggaggttcaggcggtgcccaaaggatgcctctgtgcgacaaatgcggtagcggtatcgtaggcgcagttgtgaaggcccgagacaaatatcgacacccagaatgcttcgtgtgcgcggactgtaatctcaacctgaagcaaaagggttacttcttcattgagggagaactctactgcgaaacacacgcccgtgctaggaccaaaccacctgaaggatacgatactgtgactctctaccccaaggcttag

SEQ ID NO: 14118 - DNA, 951 bp, Artificial Sequence
  Description of Artificial Sequence: Synthetic coding sequence
atgccacagactgtgatcctgcctgggccagccccctggggcttccgactcagcggggggatcgacttcaatcagcccctcgtcataacacgtattactccaggatccaaggctgccgccgcgaacctttgccctggtgacgtaatactggccattgacgggtttggaacagaatccatgacacatgctgatgcgcaggacagaattaaggccgcagctcaccagctttgcctgaagatagatcggggagaaacgcacctgtggtctccacaagtgtcagaagacggcaaagcccacccattcaaaattaatctcgagtcagaaccgcaggaatttaaacccataggcacggctcacaaccggagggcacaaccgtttgttgccgccgccaatatcgacgataagagacaggtggtgagcgcttcctacaactcacccatcggcctgtattcaacatctaatattcaggatgccctgcacggtcagttgcgcgggctgatcccttctagtccacaaaatgagccgacagcgtcagttccccccgagagcgatgtgtataggatgctgcacgataacagaaatgaaccgactcagccccgccagagcggctcttttagagttctgcaaggcatggttgacgatggatctgatgaccggccagccggcaccaggtctgttcgggcccccgtcacaaaagtccacggcggctccggcggtgcgcaaaggatgcccttgtgcgacaaatgtgggagtgggatcgtgggggctgtggtgaaagcaagggataagtatcgtcacccagaatgttttgtgtgtgcagactgtaacttgaatctcaaacagaaaggttacttttttattgagggtgaactgtattgcgaaacgcacgcgcgtgccaggaccaaacccccagaggggtatgacacagttacactgtaccccaaagcgtag

SEQ ID NO: 14119 - DNA, 3303 bp, Artificial Sequence
  Description of Artificial Sequence: Synthetic coding sequence
atgtcctattatcagcgcccgttttcacctagtgcatacagtctcccagcttcacttaattctagtattgtcatgcagcacggaaccagcctcgactctacggacacttaccctcaacatgcacaatctctagatggcacaacatccagctcaattcccctctatcgctcatcagaagaggaaaaaagagtgaccgtaatcaaagccccgcactacccaggcattggccctgtggacgaatctggcattccaaccgcgattagaacaactgtggacaggcctaaggactggtacaagaccatgttcaagcagatccatatggtccacaagcctgacgatgacaccgacatgtacaacactccatatacgtacaatgcaggactgtacaatcccccctattcggcacagagccacccagccgctaaaacgcagacctaccgacctcttagtaaatcacatagcgataatagcccgaacgcatttaaagatgctagctccccagtgccccctcctcacgtgcccccacccgttccgcccctgaggccgcgggaccgctcatccactgagaaacacgactgggaccctcccgatcggaaggttgatactcgaaagttcagatccgagccgagatctatcttcgagtacgaacccggcaaaagcagcattctgcaacacgaaagaccagcatctttgtatcagtccagcattgacaggagcctggaaaggcccatgagtagcgccagtatggcctccgactttcgaaaacggagaaaatccgagccagcggtcggccctcccaggggcctaggtgatcagagtgcatccagaacgagccctgggagagttgacctcccaggctcaagcactaccctgacgaagtctttcacatcatctagtccctccagccctagcagggctaagggcggtgacgattctaagatttgcccaagcctgtgcagttattctggactgaacgggaaccccagcagtgaactcgactactgttccacctacagacagcacctcgatgtgccccgagacagcccacgcgccatcagcttcaagaacgggtggcaaatggcgaggcagaatgccgagatctggagttccaccgaggaaactgtgtcgcccaagataaaatcgcggtcttgcgacgacctgctcaacgacgattgcgattcatttcccgatccgaaagtaaagtctgaatccatgggcagcctgttatgcgaagaagattctaaggagtcatgcccaatggcctggggatcaccatacgtacctgaagttcggtccaatggacgttctcgtattcgccaccggtcggccaggaacgcacccggattcctgaaaatgtacaaaaagatgcaccgaataaatcgcaaggacctaatgaatagcgaagtgatctgctctgtgaagagcagaattcttcagtatgagagcgaacagcagcacaaagaccttctgcgagcatggagccagtgttcgacagaggaggtacccagggatatggttcccacccgtatttccgaattcgagaagcttatacagaaatcaaaaagtatgcccaacctgggcgacgatatgctgagcccggtgactctagagccaccccagaatggtttgtgtccgaagcgcaggttcagcatagaatacttgcttgaggaagaaaatcaaagtggccctcctgcccgtggcaggaggggctgtcagagcaacgctctggttcccatccatatagaggtcacctccgacgagcagccacgggcccacgtggagttcagcgacagcgaccaagacggtgtagtgagcgaccattccgactatatccacctggaagggtcttccttctgtagcgagagcgactttgatcatttcagctttacatcttcagaatccttttacgggtcttcacatcatcatcatcaccaccatcaccatcaccaccggcacctaattagcagttgtaagggcaggtgccctgctagctacacccgcttcaccacgatgctcaagcacgagcgagctagacatgagaatactgaagagccccgccggcaggagatggaccccgggctctctaagttggccttcctggtgtcgcccgtcccctttagacgcaaaaaaaactccgctccaaaaaaacaaaccgagaaggccaagtgcaaggcttcagtctttgaggctctggacagtgcactgaaagacatctgtgaccagatcaaggcagaaaagaagaggggaagccttcctgacaactctatactgcaccgtcttatatccgagcttcttccagacgtgccagaaaggaattctagcttgcgggcgctgagaagatcccccctgcaccagcctctgcacccactacctccagatggcgccatccactgtcctccataccagaatgactgtggacgcatgcctcggtctgcttcgttccaagatgttgacacagcaaatagtagttgtcaccatcaggatcgggggggcgcactccaggacagggagtccccccggagctattcgagcaccttgacggatatggggaggtccgctccccgcgaaagacggggaacgcctgagaaagagaaacttccagccaaagctgtctacgactttaaggcccagacgagtaaagagctatcttttaaaaagggtgacacagtgtacattctaaggaagatcgatcaaaattggtatgaaggggaacatcacggccgcgtcggaatattccctatcagctacgtggaaaaattgactccccccgaaaaagcccagccagcccgaccacccccccctgctcaacccggggaaatcggagaagctatcgccaagtataattttaatgcagacaccaacgtggaattatctctgcggaaaggtgatcgagttatcttactcaaaagagtggatcagaactggtacgagggcaaaattcctggaactaatcgacagggcatttttccggtcagctatgtggaggtggtaaagaagaacaccaagggagcagaggattatccagaccccccaataccacatagctacagcagcgaccgaatccactccctgtcctcaaataaaccgcagagacctgtgttcacccatgagaacattcagggtgggggagaaccattccaggccctatacaactatactccaagaaacgaagatgagctggaactcagagaaagtgacgtgatcgatgtgatggagaagtgcgatgatgggtggtttgtggggacctctcggagaaccaagttcttcggcacgttccccggcaactatgtcaagcgactgtag

SEQ ID NO: 14120 - DNA, 4389 bp, Artificial Sequence
  Description of Artificial Sequence: Synthetic coding sequence
atgtttagaggtcccaaacccccgatcgctccaaaacctcgccttacagcgccaaacgaatggcgcgcctccgtgtacctgaacgacagcctaaacaagtgttcgaacggccgactgccctgtgtagaccgcgggcttgatgaaggaccacgctccatcccaaagtgttccgagagcgaaacagacgaagactatatagtggtgccgcgcgtcccattgcgcgaggatgaacccaaagatgagggaagcgtgggtaacaaagcgttggtgtcgcccgaaagctccgccgaggaggaagaggaaagggaggagggaggcgaggcttgtggattggagggaactggtgcgggagaggactccgttgcacccgctgccccaggggccggcgccctgagccgcgaaggcgaggagggtactgacctggcccttgaggatgagggcgagggttgcgccgacgaaccaggtacgctcgagcaggtgagcagaagtgaagaggaggaaaaattggtccagccccacagagaatgctctcttgaggacagcggaccttgggccggcgaaggggtgtttcaatctgatttactcctgcctcacatccatggtgaagaccaggaaccccccgacactcctggagaagctgaagaggatgatgaggagggctgcgccagcactgaccccgccggcgccgatgaggggagcgggcccgaccgccccacagaggatatgggacaggacgcagaagacacatccgaagagccccccgagaaggaagaactggcgggcgtccaggaggcagaaactgcaactgattgccccgaggtcctagaggaaggctgtgaggaggcaaccggcgtcaccggtggcgagcaggtcgacctgagcgaaccacctgatcacgagaagaagaccaaccaggaggtggctgccgctacactcgaagaccacgctcaggatgaatcggctgaggagtcttgtcagatcgtgcccttcgagaatgattgtatggaagatttcgtcacatccctcacgggcagcccatatgagttctttcccaccgagagcacttctttctgctcagagtcttgctctcctttgtcggagtcggcaaaagggcttgaatccgagcaagccccaaaactgggccttagagcggaagaaaacccaatggtcggcgcgctgtgcggacagtgcggatcactccaggggggagccgctgagggccccgctgcccccgacgtagtggtcgttctcgaggaagaggccctagatgacgctctcgcaaatccgtacgtcatgggagtcgggctgcctggacaggccgctcccggcgaggggggccaggccgcgtctgacgccctgggcggctacgggagtaaagaggagctgaactgcgaggctgaagggggactcgttccagctgaccgcaaaaatacttcgacccgggtgaggccacacagtggaaaggtcgccgggtacgtccctgagacagtgcccgaagaaactggtccggaggccggaagctccgccccaggtataggaggtgcagccgaagaagtcggaaagacactgttgtccctggagggcaaacctttagaagcgtcaagagcccttccagcaaagcctcgcgcttttacactctatccaaggagcttctccgtggagggcagggaaattccagtgagtgtttatcaggagcctgaaggctcaggcctcgacgaccataggatcaagagaaaggaggataacctttccctgtcttgcgtaatcgggagcagcggatccttttcacagagaaatcatttgccctcctctggcacaagcaccccgagtagcatggtggacatcccaccccctttcgacctggcttgtataactaaaaaaccaattaccaagagttctccctctctcttaatagaaagcgacagcccagacaaatataagaagaaaaagtccagctttaagcgctttttggctctcacttttaagaagaagacggaaaataagctccacgttgatgtcaatgtgtccagctcccggtcgtccagcgagagctcttatcatggccctagccggatcttagaagtcgatcggcggtccttatccaacagcccccagctcaaaagcagaactggaaagctcagggcctctgaatcgccttcaagccttatcttttatcgcgacggcaagcgaaagggggttcccttctcacgtactgtctcccgtgtggagtcattcgaggatcggagtagacctccctttcttcccctaccactcacaaagccgaggtctatatccttcccaagcgccgacacttctgattacgaaaatatccctgcgatgaactctgactacgagaatatacagatccccccccgccgtcccgcgagggctggtgcctttacgaaactgttcgaagaccagagccgagcattgagcaccgctaatgagaatgacgggtatgttgacatgagcagctttaatgcctttgagtccaagcaacagagcgcagaccaagacgctgaatccgcatataccgaaccctataaagtgtgcccaatttcaagtgccgcccccaaagaggacctcacttcagatgaagagcaacgctctagcgaggaggaggacagtgccagccgggaccctagtgtcacccacaaagtggagggacagtcccgggccctggtcattgctcaagaactgcttagcagtgagaaggcgtatgtggagatgctgcagcacctgaaccttgactttcacggtgccgtaatgagagctcttgacgatatggatcacgaagggcgtgacaccctggcccgggaggagctgagacaaggccttagcgagctcccagcaatccatgatctgcaccagggaatcctggaggagctagaagaaaggctgagtaactgggagtcgcaacagaaggtcgccgacgtgttcctcgcccgagaacaggggtttgatcaccacgctacacacattctgcaatttgatcggtatctgggactactgtccgagaactgcctgcattccccacgcctcgccgctgctgtgagagaattcgagcaatcggtgcagggaggctcacaaacagcaaagcatagactgctgagagttgtccaacgcctgttccagtatcaggtgctgctgacagattacctcaacaatctctgcccagattccgctgagtacgacaatacccagggcgcgctttccctgatcagtaaggttacagatcgtgctaatgacagcatggagcagggggagaatctgcaaaagctcgtgcatatcgagcacagtgtgaggggccagggcgatctactacaacccggtcgggaatttctgaaggagggcacactaatgaaggtgaccggaaaaaataggcggcccaggcatttgtttctgatgaatgacgttttgctatacacttatcctcagaaagatggcaaatacagactcaagaacaccctggccgttgccaatatgaaagtcagtaggcctgtgatggagaaagtgccctatgccctgaagatagagacctcagaaagctgcctgatgttgtcagcttcttcctgcgcagagagagacgaatggtacgggtgtctgtcacgagccttacccgaggactataaggcacaggcattagcggcttttcatcattccgttgagatccgtgagagactgggcgtcagcctcggcgagaggcccccgaccttagttccggtaacgcacgtgatgatgtgcatgaattgcggatgtgacttttctctgacattgcggagacatcactgtcatgcatgcgggaagattgtgtgccgcaattgctccagaaacaagtatccactgaagtacctcaaggataggatggccaaggtgtgtgacggctgtttcggagagctgaagaagcgcggccgcgccgtgcctggcctcatgcgggaaagacccgtttcgatgtcttttcccctgagctccccacgctttagcgggagcgctttttcatcagtatttcaatccataaatccctcaactttcaaaaagcagaagaaagtgccatccgctctgaccgaagtggcagcatctggcgaaggatccgctatcagtgggtatctgtccaggtgcaagaggggtaaacggcactggaagaaactgtggtttgtgattaaggggaaggtgctgtacacgtatatggcctcagaggataaggtggctctcgagtcaatgcctctcctggggtttactatcgccccagagaaggaggaaggcagctccgaagtcggcccaatcttccacctgtaccataaaaagactttattctactcattcaaagcagaggataccaatagtgcccagaggtggattgaggcgatggaggacgcctcagtgctgtag

SEQ ID NO: 14121 - DNA, 768 bp, Artificial Sequence
  Description of Artificial Sequence: Synthetic coding sequence
atggcgtccagcgatctggagcagctgtgcagccacgtcaatgagaagatcgggaatattaagaagactctcagcctccgaaactgtggtcaggagcctactctcaagaccgtgctgaacaaaataggagacgagatcattgtgatcaacgagctccttaataaactcgaacttgaaatccagtaccaggaacagaccaataattctctgaaggagttgtgtgagtctcttgaggaagactataaggatatcgaacaccttaaagagaacgttccctcgcacctgcctcaggtgacggttactcagtcatgcgtcaaggggtccgacctcgaccccgaagagcccataaaagtggaggagcctgagccggtcaagaagccgccaaaagagcagcgcagcatcaaagaaatgccttttatcacatgtgacgagttcaacggggtcccaagctacatgaaatcccgtcttacgtacaatcagatcaatgatgtgatcaaagagattaacaaggccgttataagcaaatataagatcctgcaccagcccaagaagagtatgaattccgtgactcgcaatttataccacaggttcattgatgaagagactaaagacactaaagggagatacttcatcgttgaggccgatatcaaggagttcactaccctaaaggctgataaaaaatttcacgtgcttctgaacatcctgagacattgcaggcggttgagcgaggtaaggggcggcgggttaacacgatacgtgattacttag

SEQ ID NO: 14122 - DNA, 627 bp, Artificial Sequence
  Description of Artificial Sequence: Synthetic coding sequence
atgtccgcaggtggtgatttcggcaaccccctgcgaaaattcaaactggtttttctgggagaacaatccgtcggaaagacttctcttataaccaggtttatgtatgacagcttcgacaacacttatcaggccactattggaatagatttcctgtcaaagaccatgtacctcgaagatcgaacagtgcgcctgcagctttgggacaccgcaggacaggagcggttcaggtctctgataccgtcctacatcagagactctaccgtggctgtggtagtgtacgatattactaacttgaactcttttcagcagacatccaaatggatcgatgacgtacgaactgagcgcggcagtgacgtgattattatgctcgtgggtaataaaacagacctggcagacaagaggcaaataactatcgaggaaggtgaacaaagggccaaagagctcagcgtcatgttcatcgagacctctgccaagaccggctataacgtaaagcagctgttccgaagagtcgcaagtgcattacccggcatggagaacgtgcaagaaaaatctaaggagggtatgatcgatatcaagttggataaaccccaagagccccccgctagtgaagggggttgcagttgctag

SEQ ID NO: 14123 - DNA, 3168 bp, Artificial Sequence
  Description of Artificial Sequence: Synthetic coding sequence
atgacggtggaacagaacgttctacagcagagtgccgcacagaagcaccaacagacctttctgaaccaattgagggagatcacaggaattaatgacactcagatcctgcagcaggctctaaaggatagcaatggaaatctcgagctggccgtggcttttctgacggccaagaatgcgaagacaccccaacaggaagaaaccacctactaccagaccgctttaccaggcaacgatcgctatatctcagtgggcagtcaggccgacaccaacgtgattgatcttactggtgatgacaaggatgatctgcagagggcaatcgctctcagcctggctgaatccaatcgcgcattccgcgaaactggcatcaccgatgaggagcaagccataagtcgtgtcctagaagcgagcatcgcggaaaacaaagcctgcctgaagcggaccccgaccgaagtctggcgcgactctagaaacccatacgacagaaagaggcaagacaaagcaccagttggccttaaaaacgtaggcaatacttgttggttcagcgccgttattcagagtttgttcaacttgctggagttccgtcggctggtactgaactacaaaccgcccagcaatgctcaagacttacctcgaaatcagaaggagcaccggaatttaccgtttatgcgggaactccgctaccttttcgccctgctggtagggacaaaacggaaatatgtggacccaagcagggctgtggagatcttgaaagatgcttttaaatccaacgacagtcagcaacaggacgtctctgaattcacacacaaactcctggactggctggaagatgccttccagatgaaggccgaggaagagactgatgaggagaaacctaaaaaccctatggtcgagctcttctatggacgctttctcgcagtcggcgtgctggagggtaaaaaattcgaaaataccgaaatgttcggacaatatcctctccaggtcaatgggttcaaggatcttcatgaatgcttagaagccgccatgatcgaaggagagatcgagtcactgcattccgaaaactcaggtaagtctggccaggaacattggttcaccgaactgcctccagtccttacatttgagcttagcagatttgaatttaaccaggccctagggcgaccagagaaaatccacaacaagttggagttcccccaggtcctgtacctggacagatacatgcacagaaatcgtgagatcactcgtattaaaagagaagaaatcaagagactgaaggactacctgacagtgctacaacagcgcctggaacgctacctatcttatggcagcgggcctaaaagatttccactggtggatgtgctgcaatacgcgctcgagttcgcatcgagtaagcctgtgtgtacttcacccgtagatgacattgatgccagcagcccgccctccgggtccataccaagccagacactcccaagtactaccgagcagcaaggggcactctcctctgaactgccatcaacatcgccttccagcgtggccgcaatctcctcaagatccgttatccacaaacctttcactcagtcacgaatcccaccagatctgccgatgcatcccgcccctcggcatataacggaggaagagctgtctgttctggagtcttgtcttcataggtggaggactgagattgaaaacgacaccagagacctgcaggagtctattagtcggatccacaggacaatagaactgatgtatagcgataagagtatgattcaggtcccttaccggcttcacgcagtcctggttcatgaaggacaggccaacgctgggcattactgggcttacattttcgatcaccgggagagcagatggatgaaatacaatgatatcgccgtgaccaagtcatcttgggaagagctcgtgagagattcatttggtgggtacagaaacgcaagcgcctactgcctgatgtatataaacgataaggcccaattcctcatccaggaggagttcaacaaggagacaggccagcctctagtcggaatagagaccctgccgcctgatcttagggacttcgtcgaggaagataatcagcggttcgaaaaagaattagaggaatgggatgcgcagttggcacagaaggcactgcaggagaaactgctcgccagtcaaaagctgcgcgaatcggaaacatctgtgactactgcacaagctgccggggatccagagtacttggaacagccctcaaggtctgacttttcaaaacacttaaaagaggaaacgatacagattatcaccaaggcctcccacgagcacgaagataagtctcccgagactgttctgcagtcagctatcaaactcgaatacgcgcgtctggtgaaattagcacaagaagatactccccccgagacagattaccgcctgcatcacgtcgtggtgtactttatccagaatcaggctccaaagaagatcatcgaaaagactttgttggagcagtttggcgacaggaatctgagcttcgatgagagatgtcataatattatgaaggtcgctcaggcgaaactcgaaatgattaaacctgaggaagttaatctcgaggaatacgaggaatggcaccaggactacaggaagttccgggagaccacaatgtatctcattataggccttgagaactttcagcgagagagttacatcgattcgctactctttctcatatgcgcataccaaaataataaggagttgcttagtaaaggcctatacagaggacacgacgaggaattgatttcacactacagacgcgagtgcctgctgaagctcaacgaacaggccgctgagctcttcgagtccggagaggaccgggaagtgaataacggtctgatcatcatgaatgaattcatcgttcctttcctgccgctcttactggtggacgagatggaggaaaaagacatcctcgcggtagaggatatgaggaatcgttggtgcagttacttgggacaggaaatggagccgcatcttcaggagaagctgaccgactttctgccgaagctactggactgttcaatggaaatcaaaagttttcatgaaccacccaaactgcccagttacagtacacacgagctgtgcgagcgctttgccaggatcatgctgtcgctgtctcggacccccgcagacggacggtag

SEQ ID NO: 14124 - DNA, 3264 bp, Artificial Sequence
  Description of Artificial Sequence: Synthetic coding sequence
atgacagtggagcagaatgtgctccagcagtccgccgctcagaagcatcaacagacctttctgaaccaactgcgcgagatcacagggattaacgatacccaaatcctacagcaggctctgaaagactccaacgggaacctcgagctcgcagttgccttcctcacagctaaaaatgctaaaacacctcagcaggaggagaccacctactaccagaccgccctccctggaaacgaccggtacatcagcgtcggctcccaggccgataccaatgtgatagatcttactggggacgataaggatgacctccagcgcgctatcgccctgtctctcgcagagtctaaccgtgccttccgcgagactgggattactgacgaggaacaggcaattagccgcgttctcgaggcttccatagctgagaataaggcgtgtctaaagcgcacgcccaccgaggtatggcgggatagccgcaatccttatgatcggaagagacaagacaaggccccagtgggccttaagaacgtaggaaatacatgctggttttctgcagtgatccaatcactgttcaacctgctagagtttagacggcttgtactcaattacaagccaccttctaacgcccaggacctgccgcggaaccagaaagagcaccgaaatcttcctttcatgagagagctgcgctacttgtttgccctccttgttggcactaagcggaaatacgtggatccatccagagctgtggagattctgaaagatgcgttcaaaagcaacgacagccagcagcaggatgtttctgagtttacccacaaattgctggactggttggaggatgcctttcaaatgaaggcggaagaagagacagacgaagagaagccaaaaaatccgatggttgagctcttctatgggcgtttcctggcggttggagtcttggagggaaagaagtttgagaacaccgagatgtttggacagtatccactccaagtcaacggcttcaaagacctgcatgagtgcctggaggccgcaatgatcgagggagagattgaatctttacattcagagaattcgggaaagtcaggccaggaacattggttcactgaactgccaccagtcctgacgttcgagctatctcggttcgagttcaatcaggcactgggccgacccgaaaaaatccacaataaacttgaatttccacaggtactttatctcgataggtatatgcacaggaatcgcgagatcacaaggatcaagcgtgaagagataaaacggttgaaagactaccttacagtactccagcaacgactcgagcggtatctgtcctatgggtcagggcctaagaggtttcccctcgtggacgtgttgcaatacgctctggagttcgcctcctctaaaccagtttgcacaagtccggtggacgacattgatgcatcctcccctccatctggaagtatcccaagtcagacacttccctctacgactgagcagcagggtgctctatcctctgagctgccaagcacaagcccaagctctgtggctgccatttcaagtcgcagcgtaatccataaaccttttacacaatccagaataccccccgacctgccgatgcaccccgcgcctcgtcatattacagaggaggagctttccgtgcttgaaagttgccttcatcgatggcgcactgagattgaaaacgatacccgggatctccaagagtctatctctaggatccatcgcacaattgagctgatgtatagcgacaaatccatgattcaggtgccttacagattgcatgccgtcctggtgcacgaagggcaggccaatgctggccattactgggcttacattttcgatcatcgcgagagccgctggatgaaatataatgacattgccgtgactaaaagcagttgggaggagctggttcgggactcgttcggaggctatcggaacgcctccgcgtattgtctgatgtatattaatgataaggcacagtttttgatccaggaggagttcaacaaggaaactggccaaccattggtggggattgaaaccctgccccctgacctgcgggattttgttgaggaggacaaccagaggtttgagaaggaactggaggaatgggatgcacagctagcacagaaggctctgcaggaaaaactgcttgcttcccaaaagctaagggagtcggagacatctgttacaaccgcccaggcagccggcgatcccgagtatttggaacagccttctcgttctgacttttctaagcacctgaaagaggaaacaatacagataataaccaaagcttcccacgagcacgaagataagagtccagagacagtgctgcaatcaatcatgatgaccccaaatatgcaggggattatcatggcgatcgggaagagccggtctgtttatgaccgatgcgggcccgaagccggtttcttcaaagccattaagctggaatatgccagactggtgaaactggctcaagaggacacaccacccgagactgactacaggctgcaccacgttgttgtttacttcatccagaatcaggctccaaagaagattatcgagaaaacccttctcgaacagtttggagaccgcaacctgagcttcgatgaaagatgtcacaacattatgaaggttgcccaggccaagctcgaaatgataaagccggaagaggtgaatttagaagaatatgaggagtggcaccaagactataggaaattccgcgaaacaacgatgtacctgattattggcctggaaaatttccaacgcgagagttatattgacagcctactcttcctgatatgtgcctatcagaataacaaggaactattaagcaaggggttgtacagaggccacgatgaggaactcatcagccactatcgacgcgaatgcctgcttaagctcaatgaacaggcagccgaactgtttgagagcggcgaggatagggaggtgaacaacggcttaattatcatgaacgagtttatcgtgccctttctgcctctcctgttggtggacgaaatggaggagaaagatatcctcgccgtggaagacatgcgcaatcggtggtgttcatacctggggcaggaaatggagccgcacctccaggaaaagctaaccgactttcttcctaagctcctggactgctccatggagattaaatctttccatgaaccaccaaagcttccctcgtattcaactcacgagctatgcgagaggtttgcaaggatcatgttgtcactctctcgaacccctgcagacggacgatag

SEQ ID NO: 14125 - DNA, 2559 bp, Artificial Sequence
  Description of Artificial Sequence: Synthetic coding sequence
atgtcaagcgtgagccctattcagataccctcacgcctgcctcttctgttaacacacgagggagtcctccttccaggcagtaccatgagaactagtgttgactccgcccgaaacttgcaattagttagatcaagactgctgaaagggaccagtctacaatccacgattcttggggtgataccgaatactccggaccctgcttccgatgcacaggatttaccgcccctacaccgaattggaaccgccgctctagctgtacaggtcgttgggagtaactggcccaaaccgcactatacgctgctcatcacgggtctctgtcgcttccagatcgtacaagtgctgaaggaaaagccgtaccccattgccgaggtagaacagctcgatcgtttggaggagttcccgaatacatgtaaaatgcgggaggagcttggggaattgagcgaacagttctacaagtacgctgtgcaattagtcgagatgctggatatgagcgtgcccgcggtcgccaagctgcggagacttttggattcacttccaagagaggcactgcctgatatccttacatccattatccgtacctctaacaaagaaaaactgcagatactggacgctgtcagtcttgaggaaagattcaagatgacaattccgcttctggttcggcagattgaggggctgaaactgctgcagaaaacacgcaagcccaaacaggacgatgacaaacgtgtgatcgctattaggcctatcagacggattactcacatctccgggacactcgaggacgaggacgaggatgaagataacgatgatatagtgatgctggagaaaaagattagaacatcgtccatgcccgaacaggctcacaaagtgtgtgtaaaggagatcaagcgactaaagaagatgccacagagcatgccagagtacgccttgacaagaaactatctggagctgatggtggaactcccatggaacaaatcgactacggataggctggatattagagccgctcgcatactgctggataatgatcattatgccatggaaaagttgaaaaagagagtgttagagtacctggccgtgagacagttgaaaaataacctgaaagggccaatcctctgtttcgtaggaccccctggcgttggaaagactagcgtgggtcgttctgtggccaagacactagggagagaatttcatcgcattgccttgggcggggtgtgcgatcaatccgatatcagaggccatcgtcgtacgtacgttggctcaatgcccggacgtatcatcaacgggctaaagactgtgggggtgaacaacccggtttttctcttggacgaagtggataagctggggaaaagccttcaaggcgacccagccgccgctctgctggaagtcttggatccagaacaaaaccacaacttcacagaccattatctgaatgtagcatttgatctgtcccaggtcctgttcatcgcaacagccaacactaccgctactatacccgccgctctgttagacagaatggagattattcaggtgccggggtacacacaagaagagaaaatcgaaatcgcacacagacaccttatccctaagcagctagaacagcatggtctgacgcctcaacagatccaaatcccccaagtcactacactggatataataacgcgctacaccagggaggcgggggtgcgcagcctcgataggaagctcggggctatctgcagagctgtggcggtcaaggtggccgagggtcagcataaggaggcgaaacttgatcgcagtgatgttactgaaagagaaggatgccgtgaacacattttagaagatgagaaaccagaatctatcagtgatacaactgaccttgcattgccgcctgagatgccaatcttaattgactttcatgccctcaaagatatcctgggacctcccatgtatgagatggaagtttcccagagactgagccagcctggagtcgcgattggtctcgcgtggacacctctcggcggggagatcatgtttgtggaggccagtcgaatggacggtgaaggacagcttaccttgactgggcaactgggtgacgtcatgaaggagagcgctcacctcgccatcagctggctccggtccaacgctaaaaaataccaactaaccaacgcgtttggcagctttgatctactagacaacacagatatccatttacacttccccgccggcgcagttactaaagacggacctagtgccggtgtgaccatagtaacatgcctcgctagcctgttttctggccgcctggtgcgaagcgatgtggctatgacaggggagatcaccctccggggtctggttttgcccgttggcggcattaaagacaaagtgctggccgcacaccgcgcaggcttaaagcaggtgatcattcctcgcaggaatgagaaggacctggagggaatcccaggaaacgtgcgccaggatctaagttttgtaactgcgtcctgtttagacgaggtcttgaacgccgccttcgacggcggcttcacagtgaagacacggcccggcttactgaatagtaagctctag

SEQ ID NO: 14126 - DNA, 390 bp, Artificial Sequence
  Description of Artificial Sequence: Synthetic coding sequence
atggcagatggcgggggtggtggaggtactggggcggttggcggcgggggaacttcacaagcaagcgccggggccgccacgggtgccaccggagcctccggcggcggtggtcctattaatcccgcttccctccctccaggtgacccacagttgattgctctgatcgttgaacagctgaagtcacgggggctgtttgatagcttccgccgagattgtctggccgatgttgacacaaagcccgcctaccagaacctgcgccagaaggtcgacaacttcgttagtacgcaccttgacaagcaggaatggaacccaaccatgaataaaaaccaactccgtaacggactgaggcagagcgtggtccagattagacagacaccctttgagtcatag

SEQ ID NO: 14127 - DNA, 1425 bp, Artificial Sequence
  Description of Artificial Sequence: Synthetic coding sequence
atggacgaggcagggtcctcggctagcggcgggggcttccggccaggagtcgatagtcttgacgagccacctaactcacgtatttttttagtgatctcaaaatacactcctgagtccgtgctgagagagaggttcagccctttcggcgacatccaggacatctgggtagtgagagataaacatacaaaagagagtaagggtattgcatttgtgaagttcgcccgctcctcacaagcatgtcgtgcaatggaggaaatgcacggccagtgcttggggcctaacgacaccaagcccatcaaagttttcattgcgcaatcccgctcttctgggagccatagggatgtcgaagacgaggagctgacacgtatattcgttatgattccgaaatcctacactgaggaggaccttagagagaagtttaaggtctacggcgatattgagtattgtagcatcatcaaaaacaaggtaacgggggagagtaagggactgggctacgtgcgctacctgaaaccctctcaggctgctcaggccatagaaaactgtgaccgttccttccgggccatcctggccgaaccaaaaaacaaggcatcggagtccagcgagcaggactactacagtaacatgagacaggaggcactgggccatgaaccccgagttaatatgtttcctttcgagcagcagtctgagtttagctccttcgataaaaatgacagcagaggccaggaggcaatcagcaagcgcctgtcagtggtgtctagagtcccgttcacagaggagcagctctttagcatcttcgatatcgtgcccggactcgagtattgtgaggtgcagcgcgatccgtattcaaactacggtcatggagtcgtgcagtacttcaacgtggcgagtgcaatctacgctaaatacaaactccatggcttccagtatcctcctgggaaccggatcggcgtctcttttatcgacgacggatccaacgcgactgatctgctcaggaagatggccactcagatggtggccgcccagttagcctctatggtctggaacaatccgagccaacagcagttcatgcaattcgggggatcttctggttcccaactgccacagattcagaccgacgttgtgttgccgtcatgtaagaagaaggccccagccgagacaccagtcaaagagaggctcttcatcgttttcaatccccatcccctaccgttggacgtgcttgaggatattttctgtaggtttggtaatctgatcgaggtctacctggtttccggtaagaacgtgggttatgctaagtatgccgaccggatcagcgcgaacgatgccattgccacactccacgggaagattttaaatggcgtgcggctcaaagtaatgttggctgatagccctcgcgaggaatctaacaagcgccagcggacttactag

SEQ ID NO: 14128 - DNA, 1938 bp, Artificial Sequence
  Description of Artificial Sequence: Synthetic coding sequence
atgaggccacggaaagctttcttgctattattgctgcttggcttagtccaactgttggctgtggctggggcggaggggccagatgaagattcctctaatagagaaaatgcaatagaagacgaagaggaggaagaggaggaggacgacgacgaggaagaagatgatttggaggtaaaagaagagaacggtgttctggtcctcaacgatgcaaatttcgacaattttgtggccgacaaagacacagtcttactggagttctacgctccttggtgcgggcactgcaaacagtttgctcctgaatacgagaaaatcgcgaatattctgaaagacaaggatccccccataccggtcgctaagattgatgcaacgtccgcaagcgtattggcttctagatttgatgtctctggatatccaacgatcaagatactgaaaaaagggcaagcggtggattacgagggttcacgcacccaggaggagatcgtggctaaggtccgggaggtaagccaacctgactggacacctcccccagaagtgaccctggtcctgactaaagagaacttcgacgaagtggtgaatgacgccgacattatcctcgtagagttctatgctccctggtgcggacactgtaagaagctcgcccctgagtacgaaaaagcggcgaaggagctcagcaaaaggtcaccgccaattcctctggctaaagtggacgcaaccgccgagaccgatttggccaaacggttcgacgtatctggataccctacgctgaagatattccggaagggcaggccctatgactacaatggccccagggagaaatacggtatcgtagattacatgattgagcaatccggacctccttctaaagaaattctgacgcttaagcaggtacaagagtttctgaaggatggggatgacgttatcataatcggagtctttaagggagagtcggatcctgcctaccagcagtatcaagatgcggctaacaatttgagggaggattataagttccatcatactttttctaccgaaatagccaagttcctgaaggtatctcagggccaactagtggtgatgcagccagagaaattccagtctaagtatgagccacgctcccacatgatggacgttcaggggagcactcaagattctgctataaaggactttgtgctgaagtatgccctgcccctggttggacaccgcaaggtttccaacgacgccaagcgatacactcggagaccactagtggttgtgtactactctgtggatttttcctttgattatcgggcagccacccagttctggcgatcaaaggtgttagaggttgcaaaggatttcccagaatatactttcgcaatcgccgatgaggaggactacgccggggaagtgaaggacctgggtctgagcgaatctggggaagacgtgaatgcagcgattctcgatgagtctgggaagaaattcgcgatggagccggaagaatttgattccgacacgctcagggagtttgtgaccgccttcaaaaaaggcaaactgaaacctgtcatcaaatcacagccggtccccaagaacaacaagggccccgtgaaggtggtggttggaaaaacctttgattcgatcgttatggatcccaaaaaagatgtgctcattgaattttatgctccctggtgcggtcactgtaagcagcttgagccagtgtacaactctctggccaaaaagtataaagggcagaagggacttgtgattgcaaagatggacgcgacagcgaacgacgtgccgagcgatagatataaagtcgaaggatttcccactatctacttcgcgccaagtggggacaaaaagaaccccgtgaagttcgaagggggagatagagatctcgagcacttatctaaattcatagaggaacacgccaccaagctgtcaagaactaaagaggagctatag

SEQ ID NO: 14129 - DNA, 1338 bp, Artificial Sequence
  Description of Artificial Sequence: Synthetic coding sequence
atgtacccaaatcctttgatttactgtacatgttgggacccatggaatctgggaccacggaagctgattaaaacaccacagctgccacgcaaaaacagtactggttcatcgaaactaactccgctggtgccagcccccaagaaccacaattaccttcagcccaccaagcccgtcgtcagccctaagatgaagattcactccgcaaggcaggaggagaccaacaaatcattctatgaagttattaacgtctcaccaggctaccagctcgtgagaaatagggaacagatctcagtgaccctgggcgatgaaatgttcgacaggaagaaacgctgggagagcgaaataccggataagggccgcttctcccgcactaacataatcagtgatctggaggagcagatctccgagctcaccgccatcatcgagcagatgaatcgagatcaccagagtgctcaaaagctgctgagcagtgagatggatctcagatgtgccgagatgaagcagaactttgagaataagaacagggagctaaaggaagctcacgaggccgaactgtcagaattggaaaacaactataaggccgctttaaaggccgagaaactggccgctcaggagaagctcgaggaaatggggaaggagtacaaatacctgaagaatatgtttcgcacctaccaggactctatctatgacgagatggaagagaagtggtccaagcagaaggctaagtggaaaaaagatgaaaaatttgagagggaaaacatcctcctgcaacagaagaaaaaaatgactaaaaaattcgaaatggaatccggcgaggaagataaaaagataaacgaatcatgttctgccgtgttcgagaactttattcaggaaaaggaagagttactgaaacagcaccagagcgacaccctccagctagaggaactcaggaaaactaaagaagtcccttggaggcgggatcagatcaatagacattggcacgatgtcctgcagcagctgctgttaatgcaggtcatgcaagaggaactccacgcgcaggcactgatcctcgagagtctgaatactaacctgtactatacacagctcgagctccagaaagaaaaagcaatagtgggcaacctggaaaagatgttgcaaaccaaatttgcagagacagaagaaaagtacaagcacacaatccaaatattgaccgaagagaatattcacctgaagcagaagataatttctaagaacgaagagatctgtgagggctgctctggacgccttgcaagtatcacagtcagtaaggatgactcggacaccgtccaggacggctccaagaaagggcaagaatcctag

SEQ ID NO: 14130 - DNA, 1872 bp, Artificial Sequence
  Description of Artificial Sequence: Synthetic coding sequence
atggaacctccacaggagaccaataggcctttcagtacattagacaataggtctggccaggtccaggtgctaagtgcgacgccattgctgcagcggaacccatactcttcacccgatatcatgcacataaaaggatcagaagccagttccgtgccctatgcactgaaccagggcacgacagcattaccaaagaacaagaaccaagagggcaccggccatcggttgctcaatatgctccggaagacgctgaaagaaagcgactcagaagagttagagatcacgcaggaaacccctaatctcgtaccctttggtgatgttgtggggtgtcttggcatacatattaaaaattgtcggcactttatgcccaagataagcttgcagcattacgctaacctcttcattaggatttctattaataaggccgtaaaatgcaccaaaatgtgcagcctgcttagcaagaatgatgagaagaatacagtcatcaagttcgacgaagtgaaatacttttctgtgcaggtgccaaggcggtacgatgataagcgcaacaacattctgctcgaactgatccagtacgacaatagagaaaaacgggcctttctgctcggtagcgtgcagattcacctttacgaagtgatacaaaagggttgttttatcgaggaagtgcaggtcttgcacggaaacattttcgtatgccgtcttgaggtggaattcatgttttcatatggaaatttcggttacggtttttcacaccagctcaagccactccagaagattactgaaccgtcaatgttcatgaatctcgccccaccccctgagaggaccgatcccgtgactaaggtgataacccctcaaacagttgaatatccggctttcctttctccagacctgaacgtgactgtcggaactcccgccgtgcagagctctaatcagccctccgtggtccgtctggagaagctccaacagcagccccgtgagcggctcgaaaagatgaagaaagaatataggaaccttaacacctggattgacaaggctaactatctggaaagtatcctgatgcccaaactcgagcacaaggactctgaagagaccaacatcgacgaagcctctgagaataccaagtccaaccatccagaggaagaactcgagaatatcgtcggagtagacatccctctcgtaaacgaggaggccgaaacaaccgctaacgagttgctggacaacgactccgagaagggactgaccattccaactctgaatcagtcggatcaagataactcaacggcagatgctagcaaaaacgatgaatctaccccgtcccctacggaagtgcattcactatgcacaataagcaatcaggaaaccatcaaggccggcaggattcctcccctgggggagaggcagagcgagtccatgccggaccgaaagatgaagaacgtttttttccccctggaggtgaagctcaaagataattaccccagcatcctgaaagccgactccagcctatccgaggtggccttctcacccaaggagtacaactctccttctttcagacccgagtacattgagtttaaacctaaattccaggattgttcagataagtttgaggatcttcacgacatgaccagcttcactcacctcaagaaagtgaaatcgaggtcaaggctcctggggaagtcatctgatgacatccataaccacgctagacacagtgccaggccatacactgcccccgaagtgaacaaacaacgagagtcctattcggggaaattcactagtcgaaggatggtgtcctcagggctcgtgcacatcaatgacaagacttccgactacgaaatgcacaaaatgagaccaaaaaaaattaaaagaggatactag

SEQ ID NO: 14131 - DNA, 3594 bp, Artificial Sequence
  Description of Artificial Sequence: Synthetic coding sequence
atgcacattaagtccattatcttggaagggtttaagtcttacgcgcagaggacagaggttaatggctttgaccctttgttcaacgccataacaggtctgaacggctctggtaaaagtaacatactcgattcgatttgtttcctcctgggaatctcaaacctcagccaggttcgggcatccaatttgcaggacctggtctacaagaacggacaggcgggcattaccaaggcctccgtgtccatcacatttgataactccgataagaagcagagccctctcggtttcgaagtgcacgatgagattaccgtcacgagacaggttgtaatcggcggacgcaacaaatacctgatcaacggggtcaacgccaataacacaagagtccaggacctgttctgctcagtgggtctgaacgtcaacaatccccattttctgattatgcaagggcgtattacaaaggtgctcaacatgaagccgccagagatcctcagcatgattgaggaggctgcaggcacccggatgtacgagtataaaaagatcgctgcacaaaaaaccatcgaaaagaaagaagcaaaactcaaggaaatcaagactattctggaggaggaaattaccccaaccatccaaaagctgaaggaagagagaagcagctacctcgagtaccagaaagttatgagggaaattgaacacctcagtagattgtacatcgcctatcagttcctgctggccgaagatactaaagtaaggtctgccgaggaactgaaagagatgcaggacaaggtaattaaattacaagaggagctgagcgagaacgacaaaaagattaaagctctgaatcacgagattgaggaactggagaagcgcaaagataaggaaaccggcggaatcctccgatctctggaagacgcgctggccgaggctcagagggtgaacaccaagagtcaatctgcattcgacctgaaaaagaagaatctcgcttgcgaagagtccaaacgaaaagagcttgagaaaaatatggtggaagatagcaaaacactggccgccaaggaaaaagaggtaaagaaaatcaccgacggtctgcacgccttgcaggaagcgagtaataaggacgccgaggccctggctgccgcccagcagcattttaacgccgtctcagccgggctctcctcaaatgaagatggggccgaggctactctggccggtcagatgatggcttgtaaaaatgacatctcaaaagcccagacagaagctaagcaggcccagatgaaactgaagcatgctcagcaggaactgaagaataaacaggcagaggtgaaaaaaatggattctggctacaggaaggatcaggaggctctggaagccgtgaagcggctgaaagaaaaactcgaagccgagatgaagaaactaaactatgaggaaaataaagaagaatcacttctcgagaaaagacgccagttatcccgagacatcgggaggttaaaggagacatacgaggcgctgcttgccagattccccaatctgcgcttcgcatacaaggacccagagaagaattggaatcgcaactgcgtaaaaggactggtggcctctctaatctcagttaaggatacgagtgccactacagcactcgagctcgtcgcaggcgaaagactctataatgtggtagttgacactgaagtgaccggcaagaagctgcttgagcgcggcgagcttaagagaagatacaccattattcctctgaataagatttccgcccgctgcatcgcccctgaaacattaagggtggctcagaacttggtgggcccagataatgttcatgtcgccctgtcactggttgaatacaagccagagctccaaaaggccatggaattcgtgttcggtacaacctttgtatgtgacaatatggacaatgctaaaaaggttgcctttgataagcgaataatgactagaaccgtcaccctggggggtgatgtgttcgacccacacggaacacttagtggaggagcccggtctcaagccgcctctatccttaccaagtttcaggaattaaaggatgtacaggatgaacttcggatcaaagagaacgaactgcgcgctcttgaggaggaactggcaggcctgaagaatactgccgaaaagtatcgccagttgaagcagcagtgggaaatgaagacggaagaggctgacctgttgcagaccaaactgcagcagtcgagttaccataagcagcaagaagaattggatgccctgaagaaaaccattgaagagagcgaagagaccctcaagaatactaaggaaattcagagaaaggccgaagaaaagtacgaggtcctggaaaacaaaatgaagaacgctgaagccgaaagagagcgagagctgaaggatgcccagaaaaagcttgattgtgctaagacgaaggccgatgcatcaagcaagaagatgaaggaaaaacaacaggaggtggaagccataacactggaacttgaggaactgaagagggagcataccagttacaaacaacaactggaagccgtgaacgaggcgattaagtcatacgagagccagattgaagttatggccgccgaggtagctaaaaacaaagagagcgtaaacaaggcccaggaggaagtgaccaaacaaaaagaagtcattacagcccaagacaccgtaattaaagccaaatatgctgaggtagccaagcataaagagcagaacaacgatagccagctgaagattaaggaactggaccacaatatatctaaacacaagcgggaggcagaagatggcgccgctaaagtgagcaagatgctgaaagactatgactggatcaacgccgagagacacctgtttgggcagccaaattccgcctatgatttcaaaactaataatccaaaagaggcgggacaaagacttcagaagctgcaagaaatgaaggagaaattgggccgaaacgtgaacatgcgggcaatgaacgtactcactgaagccgaagagaggtacaatgacctgatgaagaagaagcgtattgtcgaaaacgataagagtaaaattctcaccacaatagaagatctggaccaaaaaaagaaccaggctctcaatatagcatggcagaaagttaacaaggattttggctcaatcttctcgacactgctccccggggccaacgccatgctggcccctccagaaggacagaccgtgctcgatggattggaatttaaagtcgccctgggcaatacttggaaagagaacctaaccgagctctcagggggacagcgatcccttgtggctctgtcattgatactatcgatgctgctgtttaaacccgctcctatatatatcctcgacgaagtggacgccgcactcgatctgtcacatactcagaacatcggccagatgctcagaacccactttacacattctcagttcatagtggtgtcactgaaagaagggatgtttaataacgccaatgtgcttttcaaaaccaaatttgttgacggtgtgtctacagtagcgaggtttacgcagtgtcagaatggaaaaatttcaaaggaggcaaagtccaaagcaaagccacctaaaggggcccacgtggaagtctag

SEQ ID NO: 14132 - DNA, 1080 bp, Artificial Sequence
  Description of Artificial Sequence: Synthetic coding sequence
atgaggaccgccgacagagaggctagacctgggctgccatcattgctgctgctgttgctggctggtgctgggctgagcgccgcttccccacctgcagccccacgctttaatgtctccttagactctgtgcccgagctgagatggctacccgtgctacggcattatgacctcgacctggtccgagcagctatggcacaggtcatcggcgatagggtcccgaagtgggtccatgtgctgatcggaaaagtggtgctcgaattggaacgctttctgccccagccttttaccggcgaaattcgggggatgtgtgattttatgaacttgtctctggccgattgcctgcttgtgaaccttgcatacgagtctagcgtattctgtacctcaatagtggcgcaagactctaggggccatatctatcatggacgcaatctggactacccattcggaaatgtcctacgcaagctcactgtggatgtccagtttctaaaaaatggccagatagcattcaccggaaccaccttcattggctacgtaggcctgtggacaggacagtcaccccacaaatttaccgtgagcggcgatgagcgggacaaggggtggtggtgggagaatgcaatagccgccctgttccgacgacacatccctgtcagctggctgatacgagccacactctccgaatccgagaattttgaggcggctgtaggcaagctggccaaaacacctctgattgccgacgtctactatatcgttgggggaacatcacctcgcgagggggtcgtgataacacgtaatcgtgatgggcctgctgacatttggcctcttgatcccctgaacggcgcttggttccgggtggaaactaactacgatcattggaaacccgcgccaaaagaagacgaccgcagaacaagtgctattaaagccctgaatgcaaccggacaggccaaccttagtctggaagcactcttccagatcctttctgtcgtccccgtatacaataattttactatatatacgactgtgatgtcggccggaagccctgataagtacatgaccaggattcgcaatccaagcaggaaatag

SEQ ID NO: 14133 - DNA, 1647 bp, Artificial Sequence
  Description of Artificial Sequence: Synthetic coding sequence
atggcattgcacgttcccaaggctcctgggtttgctcagatgcttaaagagggcgccaagcacttctccggactcgaggaggccgtctatcgtaatattcaggcttgcaaagagcttgcccaaacgactcgcactgcatatggccctaacggcatgaacaagatggtaatcaaccatctcgaaaagctattcgtgactaatgatgccgccactatcctgagagagcttgaggtgcagcaccctgcagccaagatgattgttatggcttcccacatgcaggagcaggaagtgggagatggaactaatttcgtgcttgtgttcgctggggcattacttgaactagctgaagaactcctcaggatcggcctgtcagtgagcgaggtaattgaagggtatgaaatcgcatgtagaaaggcacatgaaatcctgcccaacttggtgtgctgctctgctaagaacttgcgcgatattgacgaggtgtcctcactcttaagaacctccataatgtccaagcagtacgggaatgaggtcttcctggctaagttgatagcccaggcctgcgtgtcgatctttcctgatagcggccattttaatgttgataatatcagagtgtgtaagatcttaggcagcggcatttccagttctagtgttctccatggcatggtttttaagaaggagactgagggcgatgtcacctccgtcaaggacgccaaaatcgctgtttactcatgtccgtttgacggaatgattactgagacaaagggcaccgtcttgattaagaccgctgaagaactcatgaatttcagtaaaggggaggagaacctcatggacgcccaggtcaaggcaatcgctgacaccggggctaacgtggtagtaacagggggcaaagtggccgacatggctctgcattatgccaacaagtacaatataatgctggtgagactgaacagcaaatgggacctaaggcgcttatgcaaaaccgtcggagccacagcgctgcctaggctcacccccccagttctcgaggaaatggggcactgtgattccgtgtacctgtcggaggtcggagacactcaagtggtagtgttcaaacatgagaaagaagacggggctatatctacaatcgttctgagaggatctactgataacctaatggacgacatcgagcgagcggtcgacgacggagtcaatactttcaaggtgctcactagagacaagaggcttgtgcccggtggcggcgccaccgaaatcgagctagctaagcagattacttcatatggcgaaacttgtcccggcctcgagcaatacgcaataaagaagtttgcagaagcatttgaggccattcctcgagccctagccgagaatagtggcgtgaaggcgaatgaggtgatttccaagctctatgctgtgcatcaggagggcaataaaaatgtgggtctcgacattgaggccgaggtccccgcagtcaaagatatgttagaggctggcatcctcgacacatacttgggcaagtattgggcaattaaactggctaccaatgctgcagtaaccgtcttaagagttgaccaaatcattatggccaaacctgcagggggaccaaagccccctagtggtaaaaaggattgggacgacgatcaaaatgattag

SEQ ID NO: 14134 - DNA, 690 bp, Artificial Sequence
  Description of Artificial Sequence: Synthetic coding sequence
atgaacatccgaaatgcccaacctgatgacctgatgaatatgcagcactgtaacctgctttgtttgcccgagaactaccaaatgaagtattatttataccacggtctctcatggccccagttgagctatatcgccgaggacgaggatgggaagatcgtggggtatgtgctcgcgaagatggaggaggagcccgatgacgtgcctcacggtcacatcacatctctagctgtgaagcgttcccacagacgcctgggattagctcagaagctaatggaccaggcaagtcgggccatgatcgagaatttcaacgcgaagtatgtgtccttgcatgttcggaaatcaaatagacctgcgctgcacctgtattccaatacactcaactttcaaatcagtgaagtggagccgaagtactatgccgacggagaagatgcctacgctatgaagagagacctgtctcagatggctgacgaattgcggagacagatggatttgaagaaagggggatacgtcgtgctgggcagcagagaaaatcaggagacacaggggtctactctaagcgatagcgaagaggcctgtcaacaaaaaaacccagcgacagaggagtcaggctctgactcaaaggagcctaaggaaagcgtcgaatcgacaaatgtgcaagattcatccgaatcaagtgactccacatcctag

SEQ ID NO: 14135 - DNA, 1374 bp, Artificial Sequence
  Description of Artificial Sequence: Synthetic coding sequence
atgagcgctcttagacgctccgggtacggaccctccgacgggccatcctacgggaggtattacgggccaggcgggggagatgtgcccgtacacccaccgcctcccttatatcccctgaggcccgaacccccccagccaccaatttcgtggcgcgtgcggggaggaggaccggctgagacaacctggctcggagagggaggcggcggagacggctattaccctagtggaggagcgtggcccgagcctggacgcgccggggggagccaccaggagcagcctccgtacccgagctacaatagtaattattggaacagcaccgctaggtcccgggccccttacccaagtacgtacccagtgcgacctgagctgcagggacagagccttaatagctatacgaatggagcctatgggcccacctatccccctggccccggagcgaacactgcgtcatactctggcgcatactatgctcctggttatacacagacatcgtattctaccgaagtgccgagcacctaccggtcttctgggaattctcctactcctgtgtcacgctggatttatccgcaacaagactgccagaccgaggctcctcccctgagaggccaagtcccgggctacccgccctctcagaacccagggatgacactcccacactatccctacggagatggcaatcggagcgttccgcagtcagggccaaccgtgcgaccccaagaagatgcctgggcctcccctggcgcttacgggatgggcggcaggtatccttggccttcctctgcgccaagcgctcccccaggcaatctgtacatgaccgaaagtactagcccgtggccatcttctgggtcaccacagagcccacctagcccaccggtgcagcagccaaaggatagtagctatccctactcccaatccgaccagtccatgaatcgtcacaacttcccctgctctgttcaccagtatgagtcctcgggcaccgtgaataatgatgacagtgacttactggacagccaggtccagtattccgcggagccccagctttatggcaacgcaacaagcgatcacccaaacaaccaggatcagagctctagccttccagaagaatgcgtgcccagtgacgaaagcaccccaccatctatcaaaaaaatcattcatgttctggaaaaagtacagtacctggaacaagaagtcgaagaattcgtcggtaagaagactgacaaagcgtactggcttctagaggaaatgctgaccaaagagctgctggaactggattctgtggaaaccggtggacaggactctgtgcgacaagcacgcaaagaggcagtgtgtaagatccaggctattttagagaagttagaaaagaagggtctttag

SEQ ID NO: 14136 - DNA, 3201 bp, Artificial Sequence
  Description of Artificial Sequence: Synthetic coding sequence
atgcaaagcaccgacttaggcaataaagaatccggcaagatatggcaccgcaaacctagccccgccacccgggacggcatcatcgtgaacattattcacaacacctccgattaccatcccaaggtgctccgctttcttaatgtggcatttgacggaaccggggattgtcttatcgccggggaccatcaaggcaacatttacgtgttcgacctgcatggcaataggttcaacctagtgcagcggactgcgcaagcatgtactgccctcgccttcaacttgcgcagaaaatccgagttcctggtcgccctggccgactattctatcaaatgcttcgacaccgtcacgaaggagcttgtgagttggatgagagggcacgagagcagtgtcttttcgatcagcgtgcatgctagcggcaagtacgctatcacaacatcatcagacaccgctcaattatgggacctcgacacgtttcaaaggaaaagaaagcttaatatccggcagagcgtcggtatccagaaggtcttctttctgcctctgagcaataccatcctgtcatgctttaaggacaatagtatcttcgcgtgggagtgcgacaccctgttctgcaaataccaacttccagcaccccccgaatcaagcagcatattgtacaaggtctttgccgtaacacgtgacggccggatcttagccgcaggggggaaatcaaatcacctccacttgtggtgcctggaagccaggcaattattccgcattatccagatgccaaccaaggttagggcaatcagacacctggagttcctgcccgattccttcgatgccggaagcaaccaggtgctgggtgtgctctcacaggacggaattatgcgcttcatcaacatgcagacctgcaaactcctcttcgagatcggttcactcgacgagggaattagctcgtccgccatcagtcctcacggccggtacattgcaagtattatggagaatggcagcctgaacatctactccgtgcaagccctgacccaggagataaacaagccgccccctcctctcgtgaaagtaatcgaagacctacccaaaaacaagttgtcctcttcagacttgaagatgaaagtaaccagcggcagagtccagcaaccagcgaaatcccgcgaaagtaaaatgcaaacgagaatccttaagcaagaccttacaggggattttgagtcgaagaagaacgaactgcctgatgggttgaataagaaacggcttcagattcttctgaaggggtacggtgagtatcccacgaagtacagaatgttcatctggcggtcactgttgcagttgcccgaaaaccacaccgctttttctacgcttattgataaaggtacgcacgtcgcctttcttaatctgcagaaaaaatatccaatcaagtcgcgcaagctgttacgcgtgttacaacgaacgctgtcagctcttgcccactggtcagtgattttcagtgatacgccctacctgccacttcttgcttttcccttcgtgaaactatttcagaacaatcagctgatctgcttcgaggtcatcgcaactctaattatcaattggtgccagcactggtttgaatacttcccgaatcctccaattaatattctgtccatgattgaaaacgtgctcgcattccacgataaggaactgctgcagcattttatcgaccatgacatcacttcccagctatatgcctggcccctgttggaaacggtgttctctgaggtgctgacaagagaggagtggctgaagttgttcgataatatcttctctaatcatccaagctttttactgatgactgtggtggcttataatatttgcagtcggacaccgttactgagctgcaatctaaaagacgattttgagttcttcttccaccatagaaacaacctggatatcaatgtggtgatccgacaggtgtaccatcttatggagaccactcctacagatatccacccagatagtatgctgaatgtgttcgttgccctgactaagggacaataccccgttttcaaccagtatccaaaattcatcgtggattaccagacgcaagagcgggaaaggataagaaatgacgagctggactacctgcgagagaggcaaaccgtagaggatatgcaggcaaaagtggatcagcaaagggtggaggacgaggcctggtatcagaagcaggaactgctgagaaaagcagaggagacccgcagggagatgctcctccaagaagaggagaagatgattcagcagagacaaagactggccgccgtcaagagagagcttaaagtgaaggagatgcacttgcaagacgccgcgaggcgccggttcctgaaactgcaacaagaccagcaggagatggaattgcgaagattggatgacgaaattggacggaaggtgtacatgcgtgacagggaaatcgcagcgacggcacgtgatctcgaaatgcggcagctggagttagagagtcagaagagactgtacgagaaaaatctgacagagaatcaagaagctttggccaaagagatgcgagcggatgccgatgcgtatagacggaaggtggatctagaagaacatatgtttcataagttgattgaggcaggcgagacccagagtcagaaaacacagaaggtgataaaggagaatcttgctaaagccgagcaggcctgcctgaacactgattggcaaatccagagcttgcacaagcaaaaatgtgatgatctgcaacgcaataagtgttaccaggaagtggctaagctcctgagagagaatagacgcaaagagatagaaatcataaacgccatggtcgaggaagaggccaaaaaatggaaggaagctgagggcaaggaattccgattacgttccgcaaagaaggcctcagcactttctgacgcatccagaaagtggttcctgaaacaggaaatcaacgcagccgtagaacatgctgagaatccctgtcataaagaggagcctcgtttccaaaacgagcaagactcctcatgtctccctaggacctctcagcttaatgactctagcgaaatggatcctagtactcaaatttcactgaaccgacgtgccgtagagtgggatacaacgggacaaaatctgataaagaaagttagaaacctgagacaaaggctaaccgcccgggcacgacacaggtgtcaaacgccacacctactggcggcatag

SEQ ID NO: 14137 - DNA, 618 bp, Artificial Sequence
  Description of Artificial Sequence: Synthetic coding sequence
atggagggtaatggccccgctgccgtccactatcagcccgcctccccaccgcgcgacgcctgcgtgtatagctcatgttattgtgaggaaaatatttggaaattgtgtgagtatataaaaaaccatgaccaataccccctggaggaatgttacgccgtgttcatcagtaatgaaaggaagatgataccaatttggaagcaacaagctagaccaggcgacggtcctgtcatctgggactaccatgtggtcctgttacacgttagcagcggagggcagaatttcatttatgacctagacacggtgttgcccttcccttgcctgtttgatacctatgtggaggacgcatttaagagcgacgatgatatccatccgcagttcaggaggaaattcagagtgatcagagcagactcatatttgaagaactttgcatcagacagaagccacatgaaagacagctcggggaattggagggaaccaccaccaccatacccatgcatagagaccggggactccaaaatgaacttgaacgatttcatctccatggaccctaaagtgggctggggggccgtgtatacgcttagcgaatttacccataggttcgggtccaagaactgctag

SEQ ID NO: 14138 - DNA, 1974 bp, Artificial Sequence
  Description of Artificial Sequence: Synthetic coding sequence
atgtcccaggtattatttcaccagctggtgcctttacaggttaaatgcaaagattgtgaagaaaggcgtgtgagtatcagaatgtcaatcgaactgcagagtgttagcaatcccgttcaccgcaaagacctggtgatccgactcactgatgacactgacccatttttcctgtacaatctcgtcataagtgaggaagactttcagagtctgaagtttcaacagggccttcttgtcgatttcctcgcttttcctcagaagttcattgaccttcttcagcaatgcacccaggagcacgcaaaggagattccacgattcctgctccagctggtgagcccagctgccatattggacaactcacccgcatttctcaacgttgtggaaaccaatcccttcaaacatctgacacatctctctctgaagctcctcccaggaaacgacgtggagatcaaaaagtttttggcgggatgtttgaaatgcagcaaagaggagaagctgtctttaatgcagtccctggacgacgctactaaacagctggattttacgaggaagactttggccgagaagaagcaggaattagataaacttagaaatgagtgggcgagccacactgctgcactgacgaataaacactctcaggaactaacgaatgaaaaagaaaaggccctccaggcccaggtccagtaccaacagcagcacgagcagcagaaaaaggaccttgagatcctgcatcagcagaacatccaccagctgcagaataggcttagtgagttggaggccgcaaacaaagatttaaccgaacgcaaatacaagggcgacagcaccattcgggaattaaaggcaaaactgagtggagtcgaggaagagctgcaacgtaccaaacaggaagtacttagcctgagacgtgagaattccactctagacgtggagtgccacgaaaaagaaaaacacgtaaaccaactgcaaacgaaagtagcggttcttgagcaggaaatcaaagacaaggaccaactggtgctccgtacaaaggaggccttcgacactattcaggagcagaaagttgtgttggaagagaacggggagaaaaatcaggttcagctgggaaaattggaagcaaccataaaaagtctgagcgctgaactcctgaaagccaacgaaatcatcaaaaagttgcaaggggacttaaagactttgatggggaaactgaaactgaagaacaccgttactatccagcaggagaaacttctggccgaaaaagaggaaaagctgcagaaggaacagaaggaactacaggacgtgggccagtcactgagaattaaggaacaggaagtttgcaagctacaggaacagttggaggcaacagtgaaaaaactggaagaatcaaagcagctgctcaaaaacaacgaaaaactgatcacctggcttaacaaggagctgaatgagaaccaattggtcagaaagcaggacgtcctggggccttctaccactccccccgcccatagtagtagcaataccatccgctcggggatttcccctaatctgaacgtcgtggatggccgcctaacataccctacctgcggcatcggctatcccgtctccagcgcctttgccttccagaatacatttccgcacagcattagtgccaaaaatacgtcacatcccgggtctggtacaaaagtccagtttaatctgcaatttactaaacccaatgcaagtctgggcgacgtccagtccggagccactatttctatgccatgtagtactgataaagagaatggggagaacgtcggacttgagagtaagtatctcaaaaagcgagaagacagtattccactgaggggcctgtctcagaaccttttttctaactccgaccaccagcgcgacgggacactgggtgcgttgcacacctcctccaaaccgacagccctgccaagtgcctcttccgcttatttccctggccagttgcctaacagctag

SEQ ID NO: 14139 - DNA, 237 bp, Artificial Sequence
  Description of Artificial Sequence: Synthetic coding sequence
atgcgctttatgatgatgcgagccgaaaatttcttcatcctccgccgaaagccagtcgagggctacgacataagtttcctaatcacgaattttcatacagaacagatgtacaagcataagctggttgactttgtcattcatttcatggaggagatcgacaaagagatctcagagatgaaacttagcgtaaacgccagagccaggattgttgctgaagaatttctcaagaatttttag

SEQ ID NO: 14140 - DNA, 933 bp, Artificial Sequence
  Description of Artificial Sequence: Synthetic coding sequence
atgcctctgctggtcgaagggaggcgcgttcgactgccccagtctgctggggacctcgtaagggcgcatcccccactggaggagcgggccagactcctccgcggacaaagcgtgcagcaggtgggtccgcagggtctgctttacgttcaacaacgggagctcgctgtaacaagcccaaaagacggtagcatctctattctggggtctgatgacgccaccacatgccacatagtggtgcttcgccataccggaaacggtgctacgtgtctgacccattgcgacggcaccgatacaaaagcggaggtgcctctaataatgaactctattaagtctttttccgatcatgctcaatgcggacgcttggaggtgcatcttgtaggagggttttccgatgacagacagctatctcagaaactgacccaccagctgctgagcgagtttgaccgccaggaagacgatattcatctggtgaccctgtgtgtcacggagctgaacgaccgggaggagaatgaaaatcacttccccgttatctacggcatcgctgtgaacattaaaacagccgagatctaccgtgcaagttttcaggatcgtgggcccgaggaacagctcagggccgcacggaccttggcaggagggcccatgatatccatctacgacgccgagacggaacagctaaggattggtccctattcctggacaccctttccccatgtggatttttggctgcatcaggatgataagcagattttggaaaacctgtcaaccagtcctttggctgagcctcctcatttcgtggaacacattcgatctacactcatgttcttgaagaagcacccttctccagcacataccctcttcagcggcaataaagcgctactgtacaagaagaatgaggatggcctgtgggaaaaaatctcatctcccggtagttag

SEQ ID NO: 14141 - DNA, 924 bp, Artificial Sequence
  Description of Artificial Sequence: Synthetic coding sequence
atgactgaaacaaccaagacgcacgtaatcctcctcgcctgtgggtctttcaatcccatcaccaaaggacacatccagatgttcgagcgggcacgggactatctacataaaacaggacgattcattgttattggaggtatcgtgtcccccgttcacgactcatacgggaaacaaggccttgtctcttcccggcatcgtctcatcatgtgtcagctggctgtgcagaattccgattggattcgggtggacccctgggagtgttatcaggatacttggcagacgacatgctctgtgctggagcaccaccgagatctgatgaaaagagtcactgggtgtatccttagtaacgtcaacaccccttccatgacccccgtcatcgggcagccccaaaacgaaaccccccaacccatttaccaaaactctaatgtcgctactaaacctaccgccgccaaaatcctgggaaaagtgggagaaagtctatccagaatctgttgtgtgcggccacccgtggaaaggttcacttttgtagatgagaacgccaaccttggaactgttatgcggtatgaagaaatcgaactacggattcttttactatgtgggtccgatttactggagtctttctgcattccaggtctgtggaatgaagcagacatggaggtaatagtgggagatttcgggatagtcgtcgtccccagagatgccgccgataccgaccgtatcatgaatcatagttctattctacgtaagtataaaaacaatatcatggttgtgaaagatgatatcaatcatcccatgagtgtggtcagttctactaaatcccggttggcactgcaacatggagacggacacgtcgttgactacctgtctcagcccgtaattgactatatactgaaatcccagctctatattaatgcatccggatag

SEQ ID NO: 14142 - DNA, 1476 bp, Artificial Sequence
  Description of Artificial Sequence: Synthetic coding sequence
atggaagagggcaagatggacgaaaacgagtggggatatcatggagagggcaacaagagtttggttgtggcacatgcgcagcgatgtgtcgttctacggttcctgaagttcccaccgaaccggaaaaagacatctgaagagatattccaacacctccagaatatagttgacttcgggaaaaatgtcatgaaagagtttctgggggagaattatgtgcactatggagaggtggtccagcttccattggagtttgtaaaacagctctgcctgaaaatccaaagcgagagaccggaaagccgctgcgacaaggacttggacactttgtccggttatgcgatgtgcctgccaaaccttacaagactgcagacatatcgtttcgccgaacatagaccgattttatgcgtggagatcaaaccaaagtgtggctttattcccttcagctcagacgtgactcatgaaatgaagcataaggtttgtcggtactgcatgcatcaacatctcaaggtcgccactggcaaatggaagcagatctccaagtactgccctcttgatctgtattctggcaataagcagcgcatgcacttcgccctgaaatccttgctgcaggaggctcagaacaatctaaagattttcaaaaatggggagctcatctatggatgtaaagatgcaaggtcccctgtggccgattggtctgaactggctcaccatcttaagccattctttttcccatctaatggccttgcatccggtccccattgcactagggcagtgataagagagctggtccatgtgattacacgtgttctcctctctggaagcgacaaggggcgtgccggcacactttcacctgggctcggtccccaaggtcctcgagtgtgtgaagcttcacccttcagccggagcctcaggtgccaggggaagaacaccccagagcggtctggacttcctaagggctgcctattgtataagacattgcaggtacagatgttggacttgctcgacatagaaggactgtatccactctataaccgcgtggaacgatacctcgaggaatttccggaagagcgcaaaacgttacagattgatgggccatacgacgaggcgttctaccagaagctcctggacttaagcacagaggatgacgggaccgtcgcttttgccctcaccaaagtgcagcagtacagagttgcaatgacagccaaagactgttcaatcatgatcgctctgtctccctgtctgcaggacgcgtcttctgatcagcgtccagttgtgccttcatcaagatccagatttgccttctcagtgtccgtgttagacctggaccttaagccatatgaaagcataccacaccaatacaagctcgacgggaagatagtcaactactattccaagactgtccgtgccaaggacaacgccgtgatgtcaacccgttttaaggagagtgaagattgtacgcttgtgctccataaggtatag

SEQ ID NO: 14143 - DNA, 2640 bp, Artificial Sequence
  Description of Artificial Sequence: Synthetic coding sequence
atgatgttctatagattgcttagtatagtcggaagacagagggcctcgcctgggtggcagaattggagttcagccaggaattccacatcggccgccgaagcccgctctatggccctgcctacccaagcccaggtggtaatatgtgggggaggcatcactggcacaagtgtggcctatcacctctccaaaatggggtggaaagacattgttctgttggagcagggtcggctggcagctgggtccactaggttttgcgctgggattttgtcgactgctagacacctcaccatcgaacagaaaatggccgattattctaataagctctattaccagctcgagcaggaaacagggatccaaacgggatacacacgtaccgggagcatctttctagctcagacccaggatagattgatttcacttaagcgcatcaatgctgggttaaacgttatcggaataccttccgagattattagccctaagaaggtggccgaacttcaccacctccttaatgtgcacgaccttgtcggcgccatgcacgttccagaggatgccgtggtaagtagcgcggacgtcgcgcttgctctggcctcagcagcttcacagaacggggtgcagatctatgaccgtacctccgtactacacgtcatggttaagaaagggcaggtcacaggagtggagaccgacaaaggccagattgagtgccagtactttgtcaactgcgccgggcagtgggcctacgaacttggactcagcaacgaggagcctgtttctatcccgctgcatgcctgtgagcacttctacctgctgacgcgacctctcgagacgcctctccagtcttccacccccacaattgtggacgccgatgggcgcatttatatccggaattggcagggcggaatactgtcagggggattcgagaagaatcccaagccaattttcacagaggggaaaaatcagctggaaatccagaacttgcaagaagactgggatcactttgagcccctactgagttcacttcttcggaggatgccagaactagaaactcttgaaatcatgaagcttgtgaactgtccggagacgttcacccccgacatgagatgcattatgggagaaagtcccgcggttcagggatactttgttttggccggtatgaacagcgccgggctcagttttggcggcggagcaggaaagtaccttgcagagtggatggtccatggttacccgagtgagaatgtgtgggaactggatttgaaacgctttggcgcactgcagtcatctcgcacctttcttaggcaccgtgtcatggaagtaatgcccctcatgtatgatctgaaagtgccacggtgggattttcaaacaggacgtcaacttaggacttctcccctctatgataggcttgatgcccagggggcccgatggatggagaagcatggttttgaaaggcccaaatacttcgtgccacctgacaaggacttgctggcactcgaacaatcaaaaaccttttataagcccgattggttcgatatagtagagtccgaggttaagtgttgcaaagaggccgtttgcgtgatagatatgtcttcctttactaagtttgaaatcacctcaaccggagatcaggcattagaggttctgcagtacctgttttccaatgacttagacgtgcctgttggccacatagtgcataccggcatgctgaatgagggcggtggctacgaaaatgattgtagcatcgctaggctcaacaagcgctcttttttcatgattagccctaccgatcagcaggtgcactgctgggcttggctcaaaaaacacatgccgaaggattccaacctactgctggaagacgtgacgtggaaatatactgctctgaatcttataggccctcgcgctgtcgatgtactctccgagttaagttatgccccaatgacgcctgatcactttcctagtttattctgtaaagagatgagtgttggatacgccaacggcatcagggtcatgtcaatgactcataccggagagcctgggtttatgctgtatatacccatcgaatacgcactgcatgtgtacaacgaggtgatgtcggtcggccagaaatatggaattagaaacgctgggtactatgcgcttcgatccctgcgaatcgagaaatttttcgccttctggggacaagacattaacaatttgaccacccctctcgagtgcggaagggagtcccgggtaaagctggagaaaggaatggacttcattggccgggatgcgttactgcaacagaagcagaatggagtttataaaaggttaacaatgtttatcttggacgatcacgactccgacctcgacctgtggccctggtggggcgagcccatctaccgcaacggccaatatgttgggaagaccactagttccgcctactcctacagccttgagaggcacgtgtgtctggggttcgtccataatttcagcgaggacactggggaagagcaggtggtaactgcggattttatcaatcgcggtgaatacgaaatcgacatcgccgggtacagatttcaagcaaaggctaagctttacccagtagcttctctgttcacccagaagcggcgtaaagatgacatggagctttctgatctccatggcaaatag

SEQ ID NO: 14144 - DNA, 1440 bp, Artificial Sequence
  Description of Artificial Sequence: Synthetic coding sequence
atggcaaccgactcgtgggcactggcggtcgacgaacaggaggcagcagcagaatcactgtccaacttacacttgaaggaagagaagatcaagcctgacaccaatggtgccgtggtcaagacgaatgctaacgctgaaaaaacagacgaggaggaaaaagaagaccgcgcagcccagagtctgctaaacaagctgattaggtctaacctcgtagacaacacaaaccaggtggaggtgctccagcgggacccaaactcgccgctttacagcgtgaagtcatttgaagagttacgactgaagcctcaactcctgcagggggtctatgcgatgggcttcaacaggcccagtaaaatacaggagaacgctcttcctctcatgctggccgaaccacctcagaacttaattgctcagagtcaatccggaaccgggaaaacggcagccttcgtcctcgccatgttatcacaggtcgaacctgccaataagtaccctcagtgtctgtgcctatcaccgacctatgagttggcgctccagaccggtaaagtaattgaacagatgggcaagttctatcctgaattgaagttagcctacgccgtgcggggcaataagctagaaagagggcaaaaaatatccgagcagattgtgatcggcacgcctggcaccgtccttgattggtgcagcaagttgaagttcatcgaccccaagaagataaaagtgttcgtactggacgaagcggacgttatgatcgcgacacagggccaccaggatcaatccattagaattcaaaggatgctaccacgtaactgccagatgctgctgttcagcgcgacattcgaggatagtgtttggaaattcgcccagaaggtcgttcctgaccctaacgttatcaaactgaaaagagaggaggagacactggacaccataaagcaatattacgtgctatgctcctctcgcgacgagaaattccaggccctgtgcaacttgtatggcgcgataaccattgcgcaggccatgatcttttgtcacacgcgaaaaactgcctcttggctggcagcagaattgtccaaggagggccaccaggtggcactcctgtcaggggaaatgatggtggaacagcgtgccgcggttattgaacggtttcgcgaaggaaaagaaaaggtgctggtaaccactaacgtatgcgcaagagggattgatgtcgaacaggtatccgtcgtcatcaacttcgacttgccagtcgacaaggatggcaatcccgacaatgagacatacctccaccggattggcagaaccggaaggttcggcaagcggggcttggctgtgaacatggtcgattcaaaacatagcatgaatatcctcaaccgcattcaggaacacttcaataaaaagattgaacgcctcgacactgatgatcttgacgagattgaaaagatcgccaattag

SEQ ID NO: 14145 - DNA, 3255 bp, Artificial Sequence
  Description of Artificial Sequence: Synthetic coding sequence
atggagcagcctaaaggcgtggattggacagttatcatactcacatgccagtataaggacagtgtccaagtgttccagcgcgagctcgaggtgcgtcaaaagagagagcaaatccctgcagggaccttactcctggctgtggaggatccagaaaaacgggttggctcaggcggcgcaaccctgaacgccttgttagtggcagctgaacacttgagcgcccgggccgggttcacggttgtcacctccgatgttttacattcagcatggatattgatactgcatatgggtagagacttcccttttgatgattgcggtcgcgcctttacctgtctacccgttgaaaaccctgaggctcctgtggaggcactcgtttgcaacctggattgcctgctagatatcatgacttatagactgggcccgggctcgcctccaggcgtatgggtgtgttctactgacatgttactgagcgtccctgccaaccccggtattagttgggatagtttcagaggagctagggtcatcgctttgccaggatcgcccgcctacgcgcagaatcacggagtttacctaacggacccccagggcctggtgctcgacatctattaccagggcacggaggctgagattcagagatgtgtacggcctgacggacgggtgcccctggtgtccggggtggtttttttttctgtggagacagctgagcggctattggccacacatgtgtctccacccttggatgcttgtacctacctggggctggatagcggagcccgtcccgttcagttgtcactgttttttgacatcttgcactgcatggccgagaacgtaaccagagaggacttcctcgtgggcaggccccccgagctgggacagggagatgccgacgtggccgggtacttacagtctgcaagagctcagctctggagggagctgcgagaccagcccttgacaatggcatatgtgtcttccggtagttactcatatatgacaagttcagcctcggaatttctcctgagtttaactcttcccggcgccccaggagctcagatcgtgcatagccaggtggaggagcagcagctccttgcggctggatcctctgtcgtgtcttgcctgcttgagggacctgtccaactgggaccaggatccgtgctccagcactgccacctacaggggccaatccacatcggtgcagggtgtctggtgactggtctcgacacggcccactcgaaggctttgcacggcagagagcttagagatcttgtgcttcagggccaccatacacggctacatggtagcccaggacacgcgtttaccctggtcgggaggttggactcttgggaacgtcagggtgctggcacttaccttaatgtgccgtggtccgaattctttaagcggaccggcgtccgcgcatgggacctgtgggatcctgaaacactgcccgcagagtactgcctgccatcagccagattgtttcctgtgctgcatccttcacgcgagttggggcctcaggatctgctgtggatgttggaccaccaggaagacggaggagaggcgctgcgggcatggcgtgcgagctggaggttgagctgggagcaattgcagccctgccttgatagagcagcaactcttgcttctaggcgtgatctgttttttaggcaggccctccataaagctcgccacgtgctggaagcccgtcaagacctgtctttaagacctctgatctgggccgctgtgagggaaggttgccccggtcccctgctggcgacactagatcaagtggcggccggggctggggatccgggcgttgcggcacgcgccctcgcctgtgtggctgatgtcctagggtgcatggccgaaggtagaggagggcttcggtctgggcctgcagctaatcctgaatggatgcgaccgttttcttacctcgaatgcggagatctggcagccggtgtggaggccctcgcccaggagagggacaagtggttgtcccgcccagctctcctcgtacgggccgcgcggcattacgagggagccggacaaatcctgataagacaagcagtgatgtccgcacagcactttgtgtccaccgaacaggtcgaactacccggtcccggccagtgggtagttgccgagtgtcccgcgcgcgtagatttttccggtggttggagcgatactccacctttagcatatgaactgggaggtgctgtgttaggtctggcagtgagagtggacgggagacgcccaataggtgccagggctcgacggatcccggaacccgagctctggctcgccgtgggacccaggcaggatgagatgactgttaagattgtttgtaggtgcctggcggacctccgagattattgccaaccccatgcacccggcgcactattaaaggctgctttcatttgtgcaggcattgtccacgtgcacagcgaactgcagctttcagaacaactcctgcgcacctttggcggcggttttgagctacacacttggtccgaactaccacacggttccggactggggacctcaagtatcctggcaggcacagcactggctgcgctgcagagagctgcagggcgtgtggttggcacagaggcacttatacacgcggtcctacacctggagcaagtcctaacaaccggtggcggatggcaagatcaggttggaggcctaatgcctggcatcaaggtcggcagatcccgcgcacaactgccactgaaagtggaggtggaagaagtgactgtgcccgaaggattcgttcagaaactgaatgaccaccttcttctggtgtacaccggcaaaacacgcctggcccgcaacttgttgcaggacgtgttacgatcttggtacgccaggctcccggcggtagtgcagaatgcccacagcctggtgcgccagacagaagaatgcgcagagggattccggcagggatcgttaccactgctgggacagtgtctgacaagctactgggagcagaaaaagttaatggcccctggatgcgagccacttactgtgaggaggatgatggacgtgctcgctccacacgtgcacggtcaaagtctggccggcgccggcggcgggggcttcctttacctcttaactaaagagcctcaacagaaggaagctctggaggctgtgctggcaaagaccgaaggcctgggaaactatagcatccacctggtagaggtggatacgcaaggccttagtttaaagctattggggactgaagcgagcacctgttgcccatttccatag

SEQ ID NO: 14146 - DNA, 2139 bp, Artificial Sequence
  Description of Artificial Sequence: Synthetic coding sequence
atgcagcccgggagtgcgcctcctcccgggaggatggatccttcagctcctcagccacgcgccgaaaccagtgggaaggatatttggcaccctggcgagagatgtcttgcaccctcaccggataacggcaagttgtgcgaagcctctattaagtccataacggtcgacgaaaacgggaagtcattcgccgtagtgctgtacgcggattttcaggagagaaagatcccacttaaacagctgcaagaagtaaaatttgtgaaagattgtccacggaacctgatctttgacgacgaggatctcgaaaaaccttattttcctaacaggaagttcccgagctcctcagtagcatttaagctcagcgacaacggagattccattccatacacaatcaaccgttacctaagggactatcagagggaggggactcgattcctatatgggcactacattcatgggggtggctgcattttgggggatgacatggggctgggcaagacggtgcaggtgatcagctttttggctgctgtcttgcacaagaagggcacccgggaggacatcgagaataatatgcccgaatttcttctacggtcaatgaagaaagaacccctgtcctcaaccgccaagaaaatgtttctgatcgtggctccactttctgtgttgtataattggaaggatgagctggacacctggggctattttcgagtgaccgtcctgcatggtaatagaaaggataacgagctcattcgcgtcaaacagaggaagtgtgaaatcgctcttaccacatacgagactctgcgcctctgcctggacgagctgaactcccttgagtggtcagctgtaatcgtcgatgaggcccatcggatcaaaaatcctaaggcaagggttaccgaggtgatgaaggcactcaagtgtaatgtaagaatcggcctgacaggaacaatcctccagaacaatatgaaggagctttggtgtgtaatggattgggctgtcccaggtctgttgggctccggcacgtatttcaagaaacagttcagcgacccagtcgagcatggacagcgacacactgcaacgaaaagagaacttgcaaccgggcggaaagccatgcagaggcttgcaaagaaaatgagcggatggttcttacgacgaactaagacactgataaaagatcagttacccaagaaagaggatagaatggtgtactgttctctaacagactttcaaaaagccgtttatcagactgtgctggaaactgaggatgtcactcttattcttcagagcagcgagccctgcacctgccggagtggccaaaagagaaggaactgctgttataagacgaatagccacggcgaaacggttaagactctgtacctatcctatctgacagtactgcaaaaagtggccaatcatgtggcactgctccaggcggcttcgacttctaaacagcaagagacactgatcaagcgaatctgtgatcaggtgttctcccgcttccccgacttcgtccagaaatctaaggatgccgcatttgaaacactctccgaccctaagtactctggtaagatgaaagttctgcagcagctgctaaaccattgtcgcaagaatcgtgacaaggtcctcctgttctctttctcaacgaagctgctggacgttctccaacagtactgtatggcttctggactggattataggagactggatggaagtacaaaatctgaagagagactcaagatcgtgaaggaatttaattcaactcaggatgtcaacatttgcctagtttctactatggccggggggctgggactgaatttcgtgggcgccaacgtggtggtcctttttgacccaacctggaaccccgctaatgatttgcaggcaatcgaccgtgcctatcgaatcggccagtgtcgggatgttaaagttctcaggttaatatccctgggcacagttgaagaaatcatgtatctccgccaaatctataagcaacagctccattgtgtggtagtgggctctgagaacgctaagagatactttgaagcagtgcagggcagtaaagaacaccagggagagttgtttggcattcacaatctttttaaatttcgctcccagggaagctgcctgaccaaagatatccttgaagtatag

SEQ ID NO: 14147 - DNA, 1212 bp, Artificial Sequence
  Description of Artificial Sequence: Synthetic coding sequence
atgaagcaaaggaaagggcagggatctgggggatcccgaggacgcaaaaaacgagggctgtctgatatctccccatcaacatctcttccacctttggtcgaggggcagttaaggtgcttcctcaagctcacagtcaatagagtaatctggaagatcgctaaacccccgacctgtgtgttagtgcgcgttcgatggtggggggaaacttctgacggcacacttttttgccctcgcgatgccctacaaacagaaccgaaagccgtaaggacaaccactcggtacgcgattcgatgcggccccaagcagtttacatcttatttaacagatatggctgtcctggttttggaggtaatcaccaagctggacggattgccaattggccgagtgcagataaacggcttagcccagctctcaccaactcatcagattaatggttttttcaccatcgtgagctcaacctctaaaaagcttggggagctccaggtatccctcgccctggagccactctcagagacatacgacagttaccaccccctgcctaccaccgacatgacagagaacgtcctactctctaaacagggttttagggagaatactgaaccttcatcaactcaattccaggtaccttcccgccctagggatatccacactatcaaaatcgacggaaaggaactggctgccaattcctctaggtccaccacgccacgggggaaagatcacgtatgttttgcggagaaccccgatacaataaaagattccagcttcgggttgcagcattccttgaactccggccagtccttggagtctgtgaccttgaagggtcgagcaccacgcaaacagatgtcactcctgaattccagcgaattccagccccagatccgtaccgtagcaaagtcacatagtgattcttgcattcttagcagtaataatttgcccactaaggatctgttatctgctctccttgaacaggggaacaaactgcggaatgctatggtgataagcgcaatgaagtccagcccagagacatctatgttactggaccaggtgcatcccctgctgatgaaaatcttgctggagcaccagcaccgtagcgagcctttcctgggtatcgggctgaaaactactctgaagattacctcctcactgcaactgcgcatccacttcggggatatgacacagaagctgatccccgagttatactcttgttactag

SEQ ID NO: 14148 - DNA, 3663 bp, Artificial Sequence
  Description of Artificial Sequence: Synthetic coding sequence
atggggaagaagcagaagaataaatccgaagactcgaccaaggatgatatcgaccttgatgccctggctgccgagattgaaggcgccggtgccgccaaggaacaggagccacagaagagtaaggggaaaaaaaaaaaagagaagaagaaacaggattttgacgaagatgacatcttgaaagagttggaagaactttcgctcgaggcccagggtataaaagctgaccgagagaccgtagccgtcaagccgaccgaaaataatgaggaagaatttaccagcaaggacaaaaaaaaaaaggggcagaaggggaaaaaacagagcttcgacgacaatgattcagaagagctggaagataaggactccaagagtaaaaaaacagccaagcctaaggtcgagatgtatagcggatctgacgatgatgatgatttcaataaacttccaaagaaggctaagggaaaggctcagaaatcaaacaagaaatgggatggctccgaggaagacgaagacaactccaagaaaattaaggagcgcagcagaattaatagctctggggagtctggggatgagagtgatgaatttttgcagtctcgaaagggtcagaaaaagaatcaaaagaacaaaccaggcccaaacatcgaaagcggaaatgaggatgacgatgcctcattcaaaattaaaacagtcgcccaaaaaaaagccgaaaaaaaggagcgcgaacgaaaaaaaagggacgaggagaaggctaagttgcgcaagctgaaggagaaggaggagctggaaacgggcaagaaagatcagtctaagcagaaagagtcccagagaaagttcgaagaagagactgtcaagtccaaagtcaccgtcgacaccggggtgatccctgccagcgaagaaaaggcagagacccccaccgctgcagaagatgacaacgagggggacaaaaaaaaaaaggacaagaaaaagaagaagggagaaaaggaggaaaaggagaaggagaaaaaaaaaggaccctccaaggcaactgtaaaagccatgcaggaggccctggctaagcttaaagaggaagaggagcgccagaagagagaggaagaggagaggatcaagcggttggaggagctggaggctaagcgcaaagaggaggagcgcctcgagcaagagaagagggaaaggaagaaacagaaggagaaagagcgcaaagaacgcctcaaaaaagagggtaagctgcttacgaagtcacagagggaggccagagcccgtgctgaagctacacttaagttgctgcaggcccagggtgtggaggtgccctccaaagactctttaccaaaaaagcgtcccatctatgaggataagaaacgtaaaaaaataccccagcagctggaaagcaaggaagtgtctgagtcgatggaactatgcgctgccgttgaagtaatggagcagggagtgcctgagaaggaagaaaccccccccccagtggagcccgaggaggaggaagatacggaggacgcgggcctagacgattgggaagccatggcatccgatgaggaaactgagaaggtggagggaaacaaggtccatatcgaagtcaaggagaaccctgaagaagaggaagaggaggaagaggaggaggaagaagacgaggaatcggaggaagaggaggaggaggaaggggagagcgagggctccgaaggcgatgaggaagacgagaaggtgtctgacgaaaaggacagcggtaagacactggacaagaagccctccaaagagatgagctcagactcagagtacgattcagatgacgataggaccaaggaggagagggcttacgacaaggccaagcggaggattgagaaaaggcgactggagcattctaagaacgtcaacacagaaaaactgagggcgcccattatctgtgtcctgggacatgttgacactggtaaaacaaagatcctcgacaagctgcgacatacacatgtgcaagacggcgaggcgggtggaattacacagcagatcggggccaccaacgtgccgcttgaagctatcaacgagcagaccaagatgattaagaatttcgatagagaaaacgtgaggattcctggtatgctgatcattgatacgccaggccacgagtctttctccaatctgcggaaccgcggatcgagtctgtgtgatattgccattctggtggtggacatcatgcacggactcgaaccacagaccatcgagagcatcaatctgctaaagtcaaaaaagtgccccttcatcgtcgcactgaacaagattgaccgcctatacgactggaagaagtcccccgacagcgatgtcgctgcaactctcaagaaacagaagaagaataccaaagacgagttcgaggagcgcgcaaaagccatcatagtggagttcgcccaacagggcttgaacgccgcactgttctatgagaataaagatccaagaaccttcgtctctctggttcctactagcgctcacaccggtgacggcatggggagcttgatttacctgctcgtggagctgacccagactatgttgtccaagcggttggcccactgcgaggagttaagggctcaggtgatggaggtcaaagcgctgcccggcatgggaacaacgatcgacgtcatcctgataaatggtcgcttaaaggagggggacactattatcgtgcccggcgtcgaggggcctattgttactcagatccgaggactccttctgccgccacctatgaaggagctgcgcgtgaaaaatcaatacgagaagcacaaagaggtggaagctgctcagggggtcaagattctcggaaaagacctggaaaaaaccctggccgggctccctctccttgtagcctacaaagaggacgagattcctgtgctgaaggacgaactgatccacgagctaaaacagaccctgaacgctattaaattagaggagaagggagtctatgtgcaggcttcgacccttggctcactcgaggccttattggaatttttaaaaacgagcgaagtgccttatgctggaataaacattggaccagtccacaagaaggacgtgatgaaggcctccgttatgctcgaacacgatccgcaatacgccgttattctcgccttcgacgtgcgaattgagagggacgcccaggaaatggcagatagtctcggtgtcaggatctttagtgcggaaataatctatcatctattcgacgcattcaccaagtaccggcaggactataagaagcagaagcaagaagaattcaaacacattgctgtgttcccctgtaaaatcaaaattcttccccagtacatctttaattcccgagaccctattgtaatgggcgttacggtggaagctggacaggtcaaacaaggcacccctatgtgtgtgcccagtaagaatttcgtagatattgggatcgtcacgtctatcgaaattaaccacaagcaggtggacgtagcaaaaaaggggcaagaggtgtgcgtaaaaatagagccaattccaggcgagtcccctaagatgttcggccgccattttgaggccacagacattcttgtgagtaagatatcccgacaatccattgacgccctgaaagactggttccgcgacgagatgcaaaagtccgattggcaactgatagtggaactaaagaaggtattcgagatcatatag

SEQ ID NO: 14149 - DNA, 138 bp, Artificial Sequence
  Description of Artificial Sequence: Synthetic coding sequence
atgtcagacaaaccagatttgtcggaggtcgagaagtttgatcgcagcaagctgaagaagactaatactgaggagaagaacaccctccccagcaaagagactatacagcaggagaaggaatgcgtccagacatcatag

SEQ ID NO: 14150 - DNA, 1533 bp, Artificial Sequence
  Description of Artificial Sequence: Synthetic coding sequence
atgccgggaggaggcgcaagcgccgctagcgggcggcttttgacagcggcggagcagaggggttctcgcgaggcagctgggagcgcttctcggtcaggatttggcgggagtggagggggacggggcggcgcctcggggcctgggagcggcagcggagggcctgggggacctgccggccggatgtctctgactcctaaagaactgtcgtccctcctcagcatcatcagcgaggaagcagggggcggcagcacatttgaaggcctaagcaccgcgttccatcactactttagcaaagccgatcacttccgcctggggtccgtgctagttatgctactgcaacagcctgatcttctcccaagcgccgcacagagactcacagcactttacctgctctgggaaatgtacaggacagaaccacttgcggccaatccctttgccgcttccttcgctcatctcctgaacccagcccccccagcccggggcgggcaggagcccgaccggcctccattatccgggtttttaccacccattactcccccagaaaaattttttctgtcacaactgatgcttgccccgccccgggagttattcaaaaagacaccgagacagattgcactgatggacgtagggaatatgggccagagcgtcgacatttcgggtctgcaactcgccctggctgagcggcagtcagaattacctacccagtccaaggcaagtttcccttcaattctttctgacccagaccccgattcttcaaacagcgggtttgactcatctgtagcgagccagattacagaagccctggtgagtggtcctaagccgcccattgaatctcactttagaccagagttcatacgccctccaccccccttgcacatttgtgaagacgaactcgcctggcttaaccctacggaaccagatcacgccatccagtgggataagagcatgtgtgtgaagaattcgactggtgtggaaattaaaagaattatggccaaagcttttaaaagccccctgtctagtcctcagcagacgcagctccttggggagctggagaaggatcccaagcttgtgtaccacatcggcctgaccccggctaagctgcccgatctggtggagaataatcctttggtggccatcgagatgctcctgaagttgatgcagtcctcacagatcacagagtatttcagtgtcttagtgaacatggacatgtctttgcactccatggaggtcgtaaaccgattgactacagctgtggacctccctccagaatttatccacttgtatatcagtaattgcatctctacctgtgagcagatcaaggacaaatatatgcagaaccggttagtgaggttagtctgcgtgttccttcagagcctgatcaggaacaagattatcaacgtgcaagacttgttcatcgaggtccaagctttttgtatcgagtttagtaggataagggaagccgccgggttgtttaggcttctaaagactctcgatactggcgagacgccatcggaaaccaaaatgtcaaaatag

SEQ ID NO: 14151 - DNA, 2184 bp, Artificial Sequence
  Description of Artificial Sequence: Synthetic coding sequence
atgtctggcagaaagcgatctttcaccttcggcgcatatggtggagtggataaatcttttacttctcgtcggtctgtatggcgcagcgatggacaaaaccaacactttccacaggccctcgatttgagtagggtcaacctggtcccgtcctacactccatcattgtaccctaaaaatactgatcttttcgagatgattgagaagatgcagggctcacgcatggatgagcagcggtgcagtttcccacctccactgaagaccgaagaggactatattccatacccgagcgtacatgaggtgctgggtagagaagggcccttccctttgattctgttaccacagtttgggggatattggatcgaaggtacaaaccacgagatcacaagcatacccgagacagaaccactccaatctcccaccactaaggtcaaacttgagtgtaatcctactgctaggatttataggaagcatttcttgggtaaggagcatttcaattactactccctggacgccgcacttgggcacctggtgttctcactcaaatacgacgtgatcggcgatcaggagcatctccggctattgcttcggaccaagtgtagaacttatcacgatgttattcccattagctgtctgaccgaatttcccaacgtggtccagatggccaagttggtgtgtgaggacgtgaacgtcgataggttctaccctgtgctgtatcccaaggcctctcgcctgatcgtcaccttcgacgaacacgtaatttctaacaatttcaaattcggcgttatttatcagaaattaggacagaccagtgaggaggagctcttttctacaaatgaggaaagcccggcctttgtcgagttcctcgagttcctggggcagaaagtgaaattgcaggacttcaagggcttccggggcggactagatgtgactcacggccagaccggtaccgagtccgtgtactgtaacttccgtaacaaagaaattatgttccacgtgagtactaagttgccttacactgagggagatgcccagcagctgcagcggaagcgccacataggcaatgacatcgtagccgtcgtgttccaggacgagaatacaccatttgtgcccgacatgattgcctctaatttcctgcacgcctatgtggtggtgcaagctgagggggggggccctgacggacccctttacaaggtgtccgtgaccgcaagagacgatgtgccgttcttcggcccccctcttcctgatccggcagtcttccgcaaaggaccggagtttcaagagtttctgctcactaaactgatcaacgccgagtacgcttgttacaaggcggagaagttcgcaaagctggaggagcgcacccgggcagcccttcttgaaacattgtatgaggagttgcacatacactcccagtcaatgatgggcttgggcggagatgaagacaagatggagaacggctctggaggtggtgggttctttgagagtttcaaacgcgtgataagaagccggtcacaaagcatggacgctatggggctgtccaacaaaaaaccaaacactgtgtcgacctctcatagtggttctttcgcccccaataatcctgatttagctaaggcggcaggaatctctcttatcgtgccggggaaaagtcctacacgcaaaaaaagtggaccctttggcagccggcggtcgtccgcaattggtatcgagaacattcaagaagtacaggagaaacgggagtctcctcccgccggccaaaagacccccgactcaggacacgtctcacaagaaccaaagagcgaaaactccagcacccagagcagccccgaaatgcccaccactaagaatcgggcagagaccgctgcgcaacgggccgaagcactcaaggactttagccgttcatcctcaagtgcgtcttcctttgcctctgtggttgaggagaccgagggcgtggacggcgaggatactggcctggagtcagtcagttcctccggcacaccccacaaaagagattcctttatctactccacttggctggaggactccgtctctactacctccggcggatcatcccccgggcccagcagatctccccatcctgacgccggaaaattgggagaccctgcgtgcccagagatcaagatccagctggaggcatccgagcagcatatgccccagctgggatgttag

SEQ ID NO: 14152 - DNA, 873 bp, Artificial Sequence
  Description of Artificial Sequence: Synthetic coding sequence
atggttttgttacacgtgaaaagaggggatgagagccagttcctgctccaggctccagggtcgacagagctcgaagagcttacggtgcaggtggccagggtctataatggccggctcaaagttcagagactgtgttcggagatggaagagcttgctgagcacgggatctttttgcctccaaacatgcagggcctcactgatgatcaaatcgaggaactgaaactcaaagatgaatggggcgaaaagtgtgtgccttcgggaggggcagtcttcaaaaaggacgacatcggccgaaggaatgggcaggccccaaatgaaaaaatgaaacaggttttgaaaaaaactattgaagaagccaaggcaataatcagtaagaagcaagtcgaagccggtgtgtgtgtcacaatggagatggtaaaggacgcactagaccaattgagaggagcagttatgatcgtatatccaatgggactcccaccgtacgaccccattcggatggaatttgaaaataaggaggatctttcagggacacaggcgggactcaacgtcattaaggaagccgaggcacagctgtggtgggccgctaaggagcttagaaggacaaagaaactctccgattacgtcggaaagaatgagaagacaaaaattattgccaaaatccagcagaggggccaaggcgcaccagctcgagagccaattatctcatctgaggagcagaagcagcttatgctgtactaccacaggagacaagaggagctgaaacgactggaggaaaatgacgatgacgcatatctgaactccccctgggcagacaataccgccttgaagcgacacttccatggtgtgaaagatataaagtggcgaccgcgctag

SEQ ID NO: 14153 - DNA, 567 bp, Artificial Sequence
  Description of Artificial Sequence: Synthetic coding sequence
atggagcccccccgcggacctccagccaatggtgccgagccttcaagggccgtgggcaccgttaaagtttatctcccaaataaacagcggactgtggtgaccgtgagggacgggatgtctgtgtacgatagccttgataaggccctgaaggtgcggggcttgaaccaagactgttgtgtggtgtaccgactgataaagggaaggaaaacagtcacagcctgggataccgctatcgctccactcgacggagaagaactgattgtagaagtgctggaggacgtgcccctcaccatgcataacttcgtgcgcaagacctttttctcactggctttttgcgatttttgtctgaaattcttgttccatggctttcggtgccagacctgcggctataagttccatcaacattgctcatccaaggttcccactgtctgtgtcgacatgtctactaaccggcagcagttctaccacagtgtgcaggacttatcgggcggctcccggcaacatgaggcacccagcaataggcccctcaatgaactcctgacgccacagggtccgagttgtagatag

SEQ ID NO: 14154 - DNA, 2034 bp, Artificial Sequence
  Description of Artificial Sequence: Synthetic coding sequence
atggacgatcccgactgcgatagcacttgggaggaagatgaggaggatgccgaagacgctgaggatgaggactgcgaagacggagaagccgccggtgcacgcgacgccgacgccggagatgaggatgaagaaagcgaagagccccgcgctgctagaccaagcagctttcagagtcggatgaccgggagccggaattggagggctaccagggacatgtgtcgctatcgacataactaccctgatctcgtagaacgggactgcaacggcgatacccccaacctgtccttttaccgcaatgagattcggttcctgccgaacggctgttttattgaagacattctacaaaactggacggacaattacgatctgctggaggataaccactcctacattcagtggttgtttcctttgcgggagcctggcgttaactggcatgccaaaccactgaccctacgggaagtcgaggtgttcaaatcttcccaggagatccaagaacggctcgtgagagcctatgagctgatgttgggattttacgggatcagattggaggacagaggcactggaacagttgggcgtgcccaaaactatcagaagagattccagaacctgaattggcggagccacaataatctgcgaatcacccggattttaaaatccctcggagagctcggtttggagcactttcaggccccgctagttcggttcttcctcgaagagacgctcgtgcggagagagctaccaggtgtccggcagtccgccttggactatttcatgtttgccgtcaggtgccgtcaccaaaggcggcaactagtgcactttgcctgggaacactttcggccacgctgtaagtttgtgtggggcccacaggacaagctgcgcaggtttaaaccctccagcctgccccatccacttgaagggagccgcaaagttgaagaggagggcagccccggggatcctgatcatgaggcatccactcaagggcggacctgtggaccagaacattctaaaggcgggggccgcgtggacgaggggccccagcctcggtctgttgagccacaagacgcaggtccactggaaagatcccagggtgacgaagctggtggacacggcgaagacagaccagagcctctgtcccccaaggagtcaaagaaacggaagttagagctgtctaggagggaacagcccccaaccgagcccgggccccagtcagcaagcgaggttgaaaagattgctctcaacctcgaggggtgtgctcttagtcagggctcgctgcggacaggaacacaggaagtcggcggccaggaccccggagaagctgtgcagccgtgcagacagccgctgggcgcgcgggtggccgataaagtgaggaaacgcaggaaggttgatgagggcgctggagactccgctgctgtcgcatcaggtggagcgcaaaccctcgctctggcagggtccccagctcctagtggacacccaaaggcaggccatagcgagaacggtgttgaggaggacaccgagggccgcaccggtccaaaggagggaacgcctggcagtccctctgaaacacctggccccagtcccgcgggacctgctggagacgagcccgctgagtctccatctgagacacctgggccacggcctgcaggccccgcaggtgatgagccagccgaatcaccatcggaaacccctgggccccgccctgctggaccagcaggagatgagcccgccgaatctccaagcgagaccccaggcccgtcaccggccgggccaacaagggatgaaccggccgaaagcccatcagagacaccagggccaaggccagccgggcccgccggggacgagccagccgaatccccctccgaaacccccggccctcgccccgcagggcccgcaggtgatgagcctgctgaatctccatcagaaaccccgggtccttcccccgctggtcccacacgtgacgagccagccaaggctggtgaagctgcggaactccaggacgctgaagttgagagctcagccaaaagcgggaaaccgtag

SEQ ID NO: 14155 - DNA, 735 bp, Artificial Sequence
  Description of Artificial Sequence: Synthetic coding sequence
atgggactcgagctgttcctcgacctagtctcccaaccatccagggccgtttacatctttgcaaaaaaaaacggcatcccacttgagctgaggaccgtcgacttagtgaaagggcagcacaaatcaaaagaattccttcagattaacagcctgggcaagcttcctacactgaaggatggcgattttatcctgacggagtcttctgccatcttaatctacttatcctgtaagtaccagacacctgatcattggtacccttccgatctgcaggcccgcgctcgggtacacgagtacctcggttggcacgccgactgcatccgcgggacattcggcattcccttatgggttcaagtattaggcccgctcatcggtgtgcaagtaccggaggaaaaggttgagcggaaccgcaccgcgatggatcaagcactgcagtggctggaagacaagtttctgggggataggccctttctcgctggtcaacaggtcacactggctgacttgatggctttagaggaactgatgcagccagttgccctggggtacgagctgtttgaggggcgcccaaggcttgcagcgtggagagggcgggtcgaagcctttctgggggcagagctatgtcaggaagcacattccatcatcctctctattctagagcaagccgccaaaaaaacgctgccgactccaagccccgaggcctaccaggcaatgcttttgcggatagccaggattccttag

SEQ ID NO: 14156 - DNA, 531 bp, Artificial Sequence
  Description of Artificial Sequence: Synthetic coding sequence
atggctgcaagcaccgacatggccggcctagaagaatcttttcgtaagttcgctattcacggtgacccaaaagcctcggggcaggaaatgaatggcaagaactgggccaagctgtgcaaggattgtaaggtggctgatgggaagtccgtgactgggacagacgtggatattgtgttctccaaggtcaaaggaaagagtgcccgcgtcatcaattacgaggagttcaaaaaagcactcgaagagttggccaccaaacgcttcaaaggcaaaagcaaggaagaagccttcgacgccatttgccagctggtcgcaggcaaggagccggcaaatgtgggcgtgacaaaggcaaagacagggggcgccgtcgatagattgacagacacgtcacgctacactggctcacacaaggagaggtttgacgaatcgggaaagggaaaggggatcgccgggcggcaggacattttggacgatagtgggtatgtttctgcgtacaagaatgctgggacctatgatgcaaaggtcaagaagtag

SEQ ID NO: 14157 - DNA, 930 bp, Artificial Sequence
  Description of Artificial Sequence: Synthetic coding sequence
atgtccgatctggggtcagaagaacttgaagaagagggagagaatgacataggtgagtacgagggagggaggaatgaggcgggcgagcggcacggtcgagggcgagcacgcctgcccaacggcgatacctatgaggggtcctacgagtttggcaagcgacatggccaagggatttataaattcaagaacggcgctagatacatcggcgaatacgttcgcaacaaaaagcacgggcagggaactttcatctacccagatgggtctcgatatgagggggaatgggccaatgacctgagacatggccatggagtgtattattatattaataatgatacttacaccggagaatggttcgcccaccagcggcatgggcagggtacgtatctctatgccgagactggctcaaaatatgtcgggacctgggtcaacggtcagcaagaaggcactgccgagctcatacacctcaaccaccgttaccaaggaaagttcctcaataaaaatcccgtcgggcccggaaaatacgtcttcgacgtgggttgtgaacagcacggcgagtatcggctcacagatatggagcgcggcgaggaggaggaagaagaagagctagttaccgtggtgccaaagtggaaggcaacccagattaccgagctagccttatggacccctaccctcccaaagaagcctaccagcacagatggccccggccaggacgctccaggtgctgaaagtgccggagaacctggggaggaggcccaggctttactagaggggtttgagggcgaaatggatatgagaccgggagacgaggatgcagatgttttgcgggaagagtctagggaatacgatcaagaagaattccgttacgatatggacgaaggcaatataaatagtgaagaggaggagacaagacagagtgatctgcaagattag

SEQ ID NO: 14158 - DNA, 5943 bp, Artificial Sequence
  Description of Artificial Sequence: Synthetic coding sequence
atgaaccccaccaacccgttttccggacaacagccctcggcatttagcgccagttcgtcaaacgtgggaacgctgccttccaagccaccgtttcggtttggccagccaagcctgtttgggcagaactctacacttagtgggaagagctccggattcagtcaggtcagtagcttcccggcgagcagcggggttagccactcctcaagtgtgcaaacgctcggttttacccagactagctccgtcgggccattcagcggcctagaacatacctccacctttgttgctaccagcgggccctcttctagctccgtcctgggcaacaccggattctcctttaaaagccctacctcagtcggggctttcccctccacttccgccttcggacaggaggccggagaaatcgtaaattctggctttggaaagactgagttctcctttaaacctctggaaaacgccgtatttaagcccatactcggggccgagtctgagcccgaaaaaacccaatcacagatcgcatcaggatttttcacattcagccacccaatcagcagcgctcctggtggtctggcacctttcagttttcctcaggtgacaagctccagtgccacaacatccaatttcacgttttctaagcctgtttcctcaaacaactccctctctgcgttcactcctgccttgtcaaaccaaaacgttgaggaggagaagcgcgggcccaagagcatcttcggctcaagtaacaatagtttctcttccttccccgtgtcctcagcggtcttgggagaacccttccaagctagtaaagcaggcgtgcgacagggttgcgaagaagccgtgagccaagtcgagcccctgccttccctcatgaaaggattaaagcgcaaagaagaccaggaccgaagtccacgacgccacggccacgaacctgcagaagacagcgatccgcttagccgtggtgaccatcctccggataaaagaccagttcgtctgaataggccacgaggcgggaccctattcgggagaaccatccaagacgtttttaagtctaataaagaggtcggtcggctagggaacaaagaagctaaaaaagagacaggtttcgtcgaatcagcagagagcgaccacatggccattcctggtggtaaccagtcggtcctcgctccaagtagaatacctggagtgaacaaagaggaggagacagagtcacgggaaaagaaagaagactctttacgcggaactccagcacgccaatcaaaccggagcgaatccactgacagtcttggaggcctgtctccaagcgaggtgactgcgatccagtgcaagaacattcctgactatctgaacgaccgtacaatactggagaaccactttggaaagatcgcaaaggtccaacggatattcacgaggcggtccaaaaaactggccgtggtgcatttcttcgaccatgctagcgcagccttggccagaaaaaaagggaagtccctgcacaaagacatggccatcttttggcaccggaaaaaaataagccctaacaagaagcccttctctctcaaggagaagaagcccggcgacggcgaggtatctcctagtaccgaggatgctccattccagcatagcccacttggaaaggcagccggtaggaccggagcatcaagcctgttaaataagagttctcctgtgaagaagccctccctattaaaggcccaccagtttgagggtgattcgttcgattcagcgtccgaaggctctgaaggacttggaccctgcgtattaagcctgtctacactcattgggacagtcgcagaaacaagtaaggagaaataccgccttcttgaccaaagggaccggatcatgagacaggcccgggttaagaggaccgatctggacaaagcccggacctttgtaggaacatgtttggacatgtgtccagaaaaagagaggtacatgcgagagactcgatcccagttatccgttttcgaggtcgtaccgggcactgatcaggtcgaccatgccgctgcagtgaaggagtactcacgtagctccgctgaccaggaggagcccctgccacacgagctgagaccactcccggtccttagcagaactatggattacctggtaactcaaattatggaccaaaaagaaggctccctacgggattggtacgatttcgtttggaatagaacccgcgggatacggaaagacattactcaacaacatctgtgcgatccgctgaccgtgagcctgatcgaaaagtgcaccaggtttcatatccattgcgctcacttcatgtgcgaggagcctatgagcagtttcgatgcaaaaattaataatgaaaatatgactaaatgtctacagtccctcaaggaaatgtaccaggacctgaggaataagggagtgttctgcgctagcgaagctgagttccagggatataacgtcctcctgagcctgaataagggcgatattttgagggaggtccaacagttccatcccgcggtgaggaactcctctgaggtgaaattcgccgtgcaggcattcgcggcacttaactctaataactttgtgaggtttttcaagctggtgcaatcagcctcctacctgaatgcatgcttactacattgctattttagccagattcgaaaggacgctttacgggcacttaatttcgcgtacactgtatctacacagagaagcactatttttccactcgacggtgtggtgcgtatgctgctctttagggactgcgaggaggcaactgactttcttacgtgccatggcttaacagtaagcgatggctgtgtagagctaaacaggagtgccttcctcgagcctgaaggtttgtctaaaaccagaaaatcagtcttcattaccagaaagctaactgtgtccgtgggagagattgtgaacggaggacccctgcctcccgtccctcgccacacacccgtgtgctcattcaatagccagaataagtatatcggggagagtctcgctgctgagttgcccgtgtcaacacagcgcccgggtagcgatactgtgggaggcggtcggggggaagagtgcggagtagagcccgacgcccccttgtccagtctgccccagagcctgcccgcccccgcgcctagcccggtgcctctacctcctgtcttagccctgacgcctagcgtggcaccttctctgtttcagctgtctgtgcagcctgaacccccacccccagaaccagtcccaatgtactcagacgaagatctggcccaagttgtagacgagctcatacaagaggccttacaacgtgactgcgaggaagtagggagcgctggggcagcctacgctgccgcagcactgggagtgtcaaatgctgcaatggaggacctgctcactgccgcaacaacaggaatcctccgacatatcgcggcggaagaggtatccaaagagagggaacgacgcgaacaagaaaggcagagagccgaagaagagcgcctcaagcaggagagggaactggttctgtctgagttatcccaaggcctagctgtagagctgatggagagggtgatgatggaatttgtgcgcgagacatgcagccaggaattaaagaacgctgttgaaaccgatcagcgcgtacgcgtagccagatgctgtgaagacgtgtgcgcccacttagtggatctctttctggtggaggagatcttccagaccgcgaaggagaccctccaggagctccagtgcttctgcaaatatctgcagcgatggagggaagcagtgacggctcgaaaaaagctccggcgacagatgagggccttcccggccgccccctgctgcgtggatgtcagtgatagactgcgggccctggccccatcagccgagtgtcctatagcagaggaaaatctggcccgcggcctgttggatcttgggcatgctgggcgactggggattagctgtacgcgcttgagaagactgcgcaataaaaccgctcatcagatgaaagtccagcatttttatcaacagctcctgagcgacgttgcctgggccagtttagacttacccagtctggtggccgagcatctccccggtcgccaggaacacgtcttttggaagctggtgctggtcctccccgacgttgaggagcagagccctgagtcatgcgggcgaatcctggccaactggcttaaagtgaagttcatgggtgacgaggggtcagtagacgataccagctcagacgcaggcgggattcagacactatccctttttaatagcctctcttcaaagggggaccaaatgatatctgtcaatgtctgcatcaaagtggctcatggagccctgtcagacggagctatagacgccgttgaaacccagaaagacctgctgggggcaagtggtttaatgcttctgctacctcctaagatgaaaagtgaagacatggccgaagaagatgtgtactggctgtcggcactcctgcagcttaagcagctcctgcaggccaagcctttccagcccgcgctgcctttagtggtactggtaccctcgcctggaggagacgctgtggaaaaagaggtagaggatgggctgatgctccaggacctggtgagcgcaaaactgataagcgactataccgtgacagaaattcctgataccattaacgatctccagggctccaccaaggtgctgcaagccgttcaatggctggtgtcccactgtcctcattccttggacctatgctgccagactctcatacagtacgtggaagatggcatcggccacgagttttccgggaggttcttccatgaccgacgggaaaggcgccttggcggcctcgcgtcccaggagcccggggcgatcatcgaacttttcaattcagtcctgcaattcttagcctctgtcgtgtcctccgaacagctgtgtgacttgtcctggccagtgaccgagttcgctgaagcaggtgggtcaagacttttgccccacctgcattggaatgcgcctgagcatctcgcctggctcaaacaagccgtcctcgggttccagctgccacagatggacctgcccccactgggggctccctggttacctgtttgtagtatggtagtacagtacgcttctcagattcctagttcaaggcagacccagcctgtactacagagccaagtggagaacttgcttcacaggacttactgcaggtggaaaagcaagtccccatcacccgtgcacggtgctggcccctccgtcatggagatcccgtgggatgacttgatagcgctgtgcattaaccataagctgagggattggacccctcccagattgcccgtcacgtctgaagcgctctccgaagacgggcagatctgtgtttatttcttcaagaacgatctgaaaaaatacgatgtgccactgagttgggaacaagcacgcctccagacccagaaagagcttcagctgcgagaaggtcggctggccattaagccctttcatccaagcgcaaacaatttcccaatccccctgctgcatatgcatagaaattggaaaaggtccaccgaatgcgctcaggaggggagaatccctagtacggaagatctcatgcggggagctagcgctgaagagctactggcccagtgcctgtccagcagcttgctgcttgagaaggaagaaaataagaggttcgaagatcaactccagcagtggctgtccgaggattcaggcgcattcacggaccttacttcacttccactctacctgccacaaacattggtgtctctcagccacaccatcgaacccgtcatgaagacaagcgttacaacatccccccagtcggatatgatgcgggagcagctgcagctgtctgaggccacaggtacctgcttaggagagcgcctgaaacatctcgaaagactgattcgttcatctagggaagaagaagttgcaagtgagctgcacctctcagccctgctggatatggtcgacatctag

SEQ ID NO: 14159 - DNA, 3147 bp, Artificial Sequence
  Description of Artificial Sequence: Synthetic coding sequence
atgtcagatgtcaaccccccttccgacactccgatccccttttcaagttcctcaacccactccagccatatccctccctggacattttcatgctaccccgggtcaccctgtgagaacggggttatgctttacatgcgcaatgtttcgcatgaggagctgcagaggtttaaacagctgctgcttacagagctgtccacaggtaccatgccaatcacatgggaccaggtggaaacggcttcatgggccgaagtcgtgcatctactcattgagcgctttcctggacgtagggcctgggacgtcacttccaacatttttgccattatgaactgcgacaaaatgtgcgttgtggtccgtcgagagatcaatgcaatcctgccgacactggagccagaggacttgaatgtaggggaaacccaagtgaatctcgaagaaggcgagtcgggcaagatcaggcggtataaatctaatgtcatggagaaatttttcccaatctgggacattaccacctggccaggcaaccagcgggactttttttaccagggcgtgcaccggcacgaggaatacttgccatgcttactgctgcccaaacgaccacagggtcgccagccgaaaacggtagccatccaaggagctcctggcatcggcaagaccatcttagccaagaaggtcatgttcgagtgggcacgcaataagttttatgcccacaaaaggtggtgtgcattctactttcactgccaagaggtgaatcaaacaacggaccagtcattttctgaactcatcgagcagaagtggcctggaagtcaggacctagtgagtaaaatcatgtctaaaccagaccaactcctattgctgctggatggctttgaagaattgacctcgactttgatcgatcggcttgaggatctgtcagaagactggaggcagaaactgcccgggtcagtactgctctccagcctgctgagcaagaccatgctgcctgaagccactctgctcatcatgatcagatttacctcctggcaaacgtgcaaaccattgctgaaatgcccctccctggtgacccttcccggatttaacacaatggagaaaatcaagtactttcagatgtacttcggacacactgaggagggagaccaagttttgtcttttgcaatggagaatactatactcttttctatgtgcagagtgcccgtggtctgttggatggtctgctctggcctgaagcagcagatggagcgcggtaacaacctgacccagtcatgccccaacgctacatctgtgtttgtccgctatatttctagcctattccccacgagggcagaaaatttcagtcgtaagattcatcaggcacaactggagggcctctgtcatcttgccgctgattccatgtggcacaggaagtgggtcctgggcaaagaagatcttgaagaggcaaaactggatcaaacaggggtaaccgcattcctcggcatgagcatattgcgccggattgcaggggaggaagaccactacgtcttcaccctcgtgacgttccaggagttcttcgcagctcttttttatgtactgtgcttccctcagagactgaaaaatttccacgttctctcccatgtgaacatacaacggctgattgcctccccccgtggttctaaatcgtacctcagccacatgggcctatttttgttcggcttcctgaacgaagcatgtgcctcagcggtggaacagagctttcaatgcaaggtctcattcggaaataagcggaaactgttgaaagtcatcccccttcttcacaagtgtgatcccccttcccctggcagcggcgttccccagctgttttattgcctgcacgaaatccgcgaagaggccttcgtgagtcaggccctgaatgactaccataaggtggtgctgaggatcggtaacaataaagaggttcaggttagcgctttttgtctcaagcgctgccaatacctacatgaggtcgagttgaccgtgactttgaatttcatgaacgtatggaaactgtcctccagcagccacccagggtccgaggcgcccgagagcaacggcttgcaccgatggtggcaggacctttgcagcgtcttcgcaaccaacgacaagctcgaggttctcacgatgacaaactccgtgctgggccctccattcttgaaagccttggccgcggcactgcgacatccacagtgcaaacttcaaaagttgctcctgcgcagggtaaacagtactatgctcaatcaggacctgattggggtgttaaccgggaatcagcaccttagataccttgagatccagcacgtggaggttgaaagcaaggctgtgaagcttttgtgcagagtcctgcgctcaccgcggtgccgccttcagtgcctgcggctggaagactgcctggctactccaaggatctggacggatctcggtaacaacctgcagggcaatggccacctaaaaaccctgatcctaaggaaaaacagcctggagaactgtggggcctactatctcagcgtcgcgcagctggagcgcttgagcattgagaactgcaacctcacgcagctgacctgtgaaagtctggcatcgtgcctcaggcagagtaaaatgctcacacaccttagcctggctgaaaacgcccttaaggatgaaggcgccaagcacatatggaacgccctaccacatctccgctgccctctacagagattagtgttgaggaaatgtgacctaacctttaactgttgtcaggatatgattagcgcgctgtgtaagaacaaaaccctcaagtccctcgatctgtctttcaatagtctaaaggatgacggagtgatcctactgtgcgaagcactaaaaaatcccgattgcactcttcagatcttggagctggaaaactgtctctttaccagtatatgttgtcaggcaatggcctctatgctcagaaaaaatcagcatctgcgccatctcgacctgagcaagaacgccattggagtgtacgggatcctcaccttatgtgaggcattctcttcccagaaaaaaagagaagaggtgatcttttgcattcctgcttggactaggattacaagtttcagtcctacgcctcatccccccgacttcacaggcaaaagtgactgcctgagccagattaacccatag

SEQ ID NO: 14160 - DNA, 3792 bp, Artificial Sequence
  Description of Artificial Sequence: Synthetic coding sequence
atgcctgctagaatcgggtattacgagatagatcgaacaatcggcaaggggaattttgccgtcgtgaaacgggctacccatctggtgacaaaagccaaagtagctatcaagattatagacaaaacccagctggatgaagaaaacttgaagaaaatttttagggaggtgcagatcatgaagatgctctgccatccccatataatcagactgtatcaggttatggaaactgagaggatgatctatctcgttactgagtacgcgtcaggcggcgaaatcttcgatcatctggtggctcacgggaggatggccgagaaggaggccaggagaaagtttaaacagattgtgacagcagtatatttttgtcattgccggaatattgtgcaccgcgatctaaaggctgagaacctgctgctggatgctaacctgaacatcaagatcgctgatttcggatttagtaacctgttcacaccaggtcagctgctgaagacctggtgcggaagccctccgtacgcggcaccagaattgtttgaaggaaaggaatacgacggaccaaaagtggacatatggtctcttggagttgtgctgtacgtcctggtgtgcggagccctgccatttgacggatcaactctacaaaacctccgggcaagagtcttgtctggaaagttccgaattcctttctttatgagtaccgagtgcgagcatctaatccggcacatgcttgtactggatcccaataaacggctttcaatggaacagatctgcaagcataagtggatgaaactaggagatgcagaccccaatttcgataggttaatagcagaatgccaacagttaaaagaggagcgtcaggtcgaccctctgaatgaggatgtgttactagccatggaggatatgggcctagataaggaacaaaccctgcagtctttgcgtagcgatgcctacgatcactattccgccatttactcgctgctttgcgacaggcacaagcggcataagactctgcgtctgggggcattgccttcaatgccacgggcgctggccttccaagctcccgttaacattcaggccgagcaggccggcacagctatgaacatttctgttcctcaggtgcagctgattaacccagagaaccagatcgtggaacccgacggcaccttaaacctcgacagcgatgaaggtgaggagcctagccctgaggccctggtgagatatttgtcaatgaggcggcatacagttggagtagcggatccacggactgaggtgatggaggacttgcagaagctcctgccaggcttcccgggcgttaaccctcaggctccatttctgcaggttgcacccaatgtgaacttcatgcataatctgttgcccatgcagaaccttcagccaacaggccagttggagtataaggaacagtctctattgcagcctccgacgctgcaattgcttaatggtatgggacctttgggccggagggcctcagacgggggggctaacattcaacttcatgcccagcaactgcttaaaaggcctaggggccctagtccgcttgtcacgatgactcctgctgtgcctgccgtaacacccgtcgacgaggagagttccgacggagagcccgatcaggaggcagtgcagtcttctacatataaagatagtaataccctgcatctccctactgagcggtttagcccggtgcggagattctccgatggggccgcttccatccaggctttcaaggctcacctggagaaaatggggaataacagctccattaaacagctgcagcaggagtgcgaacagctccaaaaaatgtacggcggtcaaattgatgagcggacactggaaaaaacgcaacaacagcatatgctgtatcagcaggaacagcatcatcagattctgcagcaacaaatccaggattcgatatgtcctcctcagccaagccctccactccaagccgcatgcgagaaccagcccgccctgctgacccatcaactgcagcggctcaggattcagccgagcagtccacctcccaaccatcctaacaaccatctatttagacaaccctctaacagcccaccacctatgagtagcgctatgatccagccccacggagctgcctcatccagccagtttcagggactgccatcccggtcagctatctttcagcaacaacctgagaactgttcaagtcccccaaacgtagcactcacttgtctggggatgcaacagccggcacagtcacagcaggtcaccattcaagtccaggaacccgtggacatgctgtctaacatgcccggaaccgcggcagggagcagcggccgcgggatctccatctcgccatcagcaggacagatgcagatgcagcaccgtactaacctcatggccaccttgagttacggccataggcccctgagtaagcaactgtctgctgattccgccgaggcccatagcttgaatgttaacagattctcacccgcaaattacgatcaggctcacctccatccacacttattctctgatcagtctcgaggctctccgtcttcctatagtccgagcacgggggttggtttcagtccaacccaggcactgaaggtcccgcccctcgaccagttcccaacattcccgccaagtgcacatcaacagcccccacattacactactagtgccctgcagcaagcgctactgtctcctacccccccggattacactcgacaccaacaggtcccccatatcctccaagggctgcttagccccagacattccctgacaggacattccgatatccgcctgcctccgacagagttcgcccaactgattaagcggcagcagcaacagcgccagcagcagcagcaacagcagcagcagcaggaataccaggagctattcaggcacatgaatcagggcgatgcagggagtcttgctcctagcctgggcgggcagtcaatgaccgaaagacaagccctttcatatcagaatgctgactcataccaccatcacacgagtcctcaacatctccttcagatccgggcacaggaatgtgtgagtcaagcgagttctcctacccctccgcatggatatgctcatcagccggcgttgatgcactctgagagtatggaggaggattgcagttgtgaaggggccaaagacggcttccaggactccaaatcctcctcaacactcactaagggctgccacgactccccgcttcttctgtccacaggaggaccgggagatcctgagtcacttctcggcacagtgagccacgcccaggaactggggattcatccgtacggccaccagcccaccgccgctttctctaagaataaggttccctcacgggagcccgtgattggcaattgtatggatcggagtagccccggccaagctgtggaactgcctgaccacaacggcctgggctacccagccagaccttcagtacatgagcatcataggccgagagctctccagcgtcaccacaccatccagaatagtgacgacgcctatgttcagcttgataacctacccggaatgagtctggttgctgggaaagctctctcatccgccagaatgtcagacgccgttctctctcagtcgtcactaatgggctcccagcagttccaggatggggaaaacgaggagtgcggggccagtttgggcggtcatgagcacccagacctatctgatggatctcagcacctaaactcctcatgctatcctagtacgtgtatcacagacatattgctatcctacaaacacccagaagtctctttcagtatggagcaagcaggggtctag

SEQ ID NO: 14161 - DNA, 4395 bp, Artificial Sequence
  Description of Artificial Sequence: Synthetic coding sequence
atgtaccagccagaagatgataataacagtgatgtaacgtccgacgatgatatgacaaggaataggagggaatctagtcctccccattccgtccactcattcagtggggaccgtgattgggaccggcgcggccggagccgcgacatggagccccgggacaggtggagccacacacgcaatccaagatccaggatgcccccgcgggatttgtccttgcccgtagtggccaagacctccttcgagatggaccgtgaggatgatagagactcccgcgcatatgaatctcggtcacaggacgccgagagctaccaaaacgtggttgacctggccgaagataggaagccacataatacaatccaagacaatatggaaaattacaggaagctgctgtccttaggagtccaactcgcagaggacgatggccacagtcacatgacacaggggcacagctcacggtcgaagagaagcgcctatccctccacgtcccgtggtctgaaaaccatgccagaggctaaaaagtcaactcataggcggggaatctgtgaagacgagagctcccacggggtcataatggagaaattcatcaaagacgtcagcaggtcatctaaaagcggacgagctagggagagctctgaccgatctcagcgcttccccaggatgagcgatgataactggaaagatattagtctaaacaagcgggaatcagtgatccagcagagggtgtacgaaggtaacgctttcagaggtgggtttcggttcaacagtaccctggtcagcagaaaaagagtgctggaaagaaaacggcggtaccactttgacaccgacggaaaaggatcgattcatgaccaaaagggctgtcctagaaaaaagccgtttgaatgcggttcggaaatgcgtaaagccatgagcgtcagttccctgagttcgctcagtagcccctctttcaccgaaagtcaaccaatcgatttcggggcgatgccatacgtttgcgatgagtgcggccgctcctttagtgtgatatccgagttcgtggagcatcagattatgcataccagagagaacctctacgaatacggcgagtctttcattcactcagtggccgtgtctgaggtacagaaatcccaggtgggcgggaaacgttttgaatgcaaggattgtggagaaaccttcaataagagcgctgctctggctgagcatagaaagattcacgctcgtgggtacctcgtggagtgtaaaaaccaggagtgcgaagaggccttcatgccctctcctacatttagtgagttacagaagatttacggcaaggacaaattctatgagtgcagggtatgtaaggaaaccttcctgcactcaagtgctctcatcgaacaccaaaaaatccacttcggtgacgacaaggataatgagcgggaacatgagcgcgagcgggagcgggagaggggcgagacctttagaccaagccctgcactgaatgaattccagaagatgtacggcaaggaaaaaatgtacgagtgtaaagtctgcggggagacattcttgcattcaagttctctcaaggaacaccagaagatacacacccgtggtaatcccttcgagaacaagggcaaggtttgcgaggagactttcatccccggtcagagccttaaacgtcgtcagaagacatacaataaagagaaactgtgcgattttacggacgggcgtgacgcctttatgcagtcctctgagctgtctgagcaccagaaaattcactcacggaagaacctgttcgagggtcgcggctatgaaaaatcagtgatacactccggacctttcaccgagagccagaagagccacactatcactcggcctctggagagtgatgaggatgagaaagctttcactatctccagtaatccgtatgagaatcaaaaaatcccaacaaaggagaacgtgtacgaagcaaagtcgtacgagcgaagcgtgattcacagtctagcctcggtggaggctcagaaatcacatagtgtggcaggcccgtcaaaacctaaggtgatggctgagtcgaccatccagtcctttgacgcaatcaaccaccagagggtgcgggccggcggcaatacctctgagggccgggagtactcccgaagcgtcatccattctctggtagcttccaagcctccccggtctcacaatgggaacgagcttgttgaatcaaatgaaaaaggcgagtcaagcatttatattagcgacttgaatgacaagcgacagaagatccctgctcgggagaatccctgtgaagggggtagcaaaaatagaaactatgaagattctgtcattcaatctgtgttccgcgcgaagccccaaaagagtgttcctggtgaaggatccggtgaatttaaaaaggatggtgagttctcagttcctagcagtaacgtgcgcgagtaccagaaggcgagggccaagaagaagtatatcgaacatcggagcaatgagacaagcgtaattcactctctgccatttggggagcagacgttccgccctaggggaatgctttatgagtgtcaggagtgtggagaatgttttgctcatagcagcgatttgaccgagcatcagaagatccacgacagggaaaagccaagtggcagtaggaattacgaatggagcgtcatcagatcacttgcgcctaccgatccgcaaacctcttacgcacaggaacagtatgcaaaagagcaggcccgtaacaaatgtaaggacttcagacagtttttcgcaacctcagaggatcttaacacaaatcagaaaatctatgaccaggagaaaagccacggggaggagtcacagggtgaaaacaccgatggcgaagaaacccactcagaggaaactcacggccaggagactatcgaagatcccgtgatccagggatccgatatggaggatccccagaaagatgaccccgacgacaaaatttacgagtgtgaggattgtggacttgggtttgtcgaccttacagacctgacggatcatcagaaagtccattctaggaagtgcctcgtcgatagtcgcgagtacacccactctgttatacatacccattccatatctgagtaccagcgggattatactggcgagcaactgtatgaatgccccaagtgtggagagtcgttcatccattccagcttcctcttcgaacatcagaggatccatgaacaagaccagctgtacagcatgaaaggctgtgacgatggctttattgcactgttacctatgaagccacggagaaatcgtgccgccgaaagaaaccccgccctcgctggaagtgcaattaggtgtctactttgcggacaaggcttcattcactccagcgcgttgaatgagcatatgcgactgcaccgggaagacgatttgttagagcagtctcaaatggccgaggaggcaatcattcctgggctggcactcaccgagtttcagcgcagtcaaaccgaagaaaggttgtttgagtgtgctgtgtgtggagagtccttcgtgaatcccgctgaactggctgaccatgtcaccgttcacaaaaatgagccttacgagtatgggagtagctacactcataccagctttctgacagaacccctgaaaggggccatccccttctatgaatgcaaagattgtggcaagtcgtttattcactccaccgtcctcactaaacataaggagcttcatcttgaggaagaggaagaggatgaggccgcagccgcggctgccgccgccgctcaggaggtggaggctaatgtccacgttccccaggtggtgttgcggatccagggattgaacgtggaggcagccgaaccggaagtggaggctgcagaacctgaggtagaagccgccgaacctgaggttgaagccgcagaaccaaacggcgaggccgaagggcctgacggcgaagccgccgagccaattggggaagccggccaacctaacggtgaagccgagcaacccaatggagacgctgacgagcctgatggagccgggatagaagaccccgaagagcgcgctgaggaaccagagggcaaagcagaggaacccgaaggagacgccgacgagccagacggcgttggtatagaggacccagaggaaggagaggaccaggaaattcaggtggaagagccgtattacgactgccacgaatgcactgagactttcacgtcaagcactgctttctctgaacatctgaagactcacgcgagtatgattattttcgagccggccaatgcctttggtgaatgttccggctacatcgagcgcgcttctacttccaccgggggtgctaaccaagctgatgaaaagtacttcaagtgtgatgtctgcgggcaattgtttaacgaccgtcttagcttggctcgccatcaaaatacccacacagggtag

SEQ ID NO: 14162 - DNA, 1302 bp, Artificial Sequence
  Description of Artificial Sequence: Synthetic coding sequence
atggcagaagcccaatcaggaacggggcagctgcaagaacagaaaaagggtctgctcatagccgtgtccgtttccgtggacaagatcatttcacacttcggtgcagctcgaaatttggttcagaaagctcagctgggggactctcggctttctcctgatgtcggccatttggtcctgacgacactctgtcccgccctgcacgccctggtagccgacggcctcaagccttttcggaaagatctgatcactggtcagcggagatcctctccttggagcgtcgttgaagcgtcagtaaaacctggaagttctacccggagcctgggaactctgtattcacaagtctccaggctggcccctctgtcgagttcgcgctcccgctttcacgccttcattctgggactcttaaacacaaagcaactagagctgtggttttccagcctgcaggaagatgccgggctcttgagtctactgtatcttccaacagggttcttcagccttgcacggggcggttgcccctctctatctactgagttgttgctgctgcttcagccccttagcgttctgacattccacttggaccttctattcgaacaccaccatcacctccccctggggccaccacaagcacccgccccacccggtccgccgcctgccttgcaacagactatgcaggctatgttacatttcggcggccgcctggctcagagtctacgggggacgtcaaaggaagccgccagtgaccccagcgatagcccaaaccttcccacaccaggctcctggtgggaacagctgacgcaggcaagcagagtgtacgcaagcggcggcactgaaggatttcctctcagccgctgggctccgggacgccacgggaccgccgcagaggagggcgcgcaagaaaggcctctgcctactgacgaaatggccccaggcagagggctctggttaggccggctctttggggttcctggaggaccggcagaaaacgagaatggggcactgaagagccgcagaccctcctcttggctcccgcctacagtttctgttctggccctggtaaaaagaggcgcccctccagaaatgccttcgcctcaggagcttgaggcttctgctcctcgcatggtgcaaacacacagagcggttcgcgccctctgtgatcacacagcagcgcggcctgaccagctaagttttcgccggggcgaagtactacgtgttatcaccaccgtcgatgaggactggttgaggtgcgggcgggatggcatggaaggcctagtgcccgtagggtacacatcccttgtgctttag

SEQ ID NO: 14163 - DNA, 1584 bp, Artificial Sequence
  Description of Artificial Sequence: Synthetic coding sequence
atggcccaaacactgcagatggagattcctaattttggcaacagcatcctggagtgcttgaacgaacaacggctacagggtttgtattgtgatgtaagtgtagttgtaaagggacatgccttcaaagctcaccgggcggtccttgccgcctcttcctcatatttcagggatctgtttaacaatagtcggagtgcggtggtggagctgccagcagccgtgcagccccagtctttccaacaaattctgtctttttgctacaccgggcgcttgtctatgaacgttggagatcagttccttctcatgtacactgctggattcctgcagatccaagaaatcatggagaaagggactgagttctttctaaaagtttcttccccctcgtgtgactcgcagggactgcatgccgaggaggcgccatcttctgagccacagagtcccgtggctcagacgtccggatggccagcttgttccacacctcttcctttggtttctcgggtaaagacagagcagcaagaaagtgatagcgtgcagtgcatgcccgttgctaaaagattgtgggacagtggtcagaaggaggccggaggcggaggaaacggcagtagaaaaatggccaaattctctacgcctgacctggccgctaaccggccccatcagcctccaccaccccagcaggcacccgtggttgccgcagcacaacctgctgtggccgctggggccggccaaccggccgggggagtggccgccgctgggggggtggtatcaggcccgtctacgtcagagagaacctccccaggaacatcgtcagcatatacaagcgattctcctggatcataccataacgaagaggacgaggaagaggatggaggtgaagagggcatggacgagcagtacaggcagatctgtaatatgtacactatgtactccatgatgaatgtaggccagaccgccgaaaaagttgaggccctgccagaacaggtggctccagaatctaggaatcgtatcagagtacgtcaggacctggcttcactgccagccgagctcatcaaccaaatcggcaatcgatgccatcctaagctttatgatgagggagatccatcagaaaagctcgaactcgtcactggcactaacgtctatataacgcgcgcgcagctgatgaattgtcacgtgtctgccgggacaaggcacaaggtactcctgcgtaggctgcttgccagttttttcgaccgtaacactctggctaacagttgtggcacggggattcgttcatcaacaaatgatcccaggaggaaacctttggactcccgtgtgttacatgccgtgaaatattactgccagaactttgcacctaactttaaggaatcagagatgaatgccattgcggcagacatgtgtactaacgctcggagggtcgtcagaaagagttggatgcccaaggtcaaagttctgaaggcagaggacgatgcttacaccacttttatatctgaaacaggaaaaatcgagcccgatatgatgggcgtggagcacgggttcgagactgctagccacgagggagaagctggccccagtgcagaggcacttcagtag

SEQ ID NO: 14164 - DNA, 672 bp, Artificial Sequence
  Description of Artificial Sequence: Synthetic coding sequence
atggaggtacagaaggaagcacagaggatcatgacactgagcgtgtggaaaatgtaccactcaaggatgcaaagggggggtctaagattgcataggtccctgcagctcagcctggtgatgcgctctgcaagagagctctatttgagcgctaaggtggaggcattagagcctgaagtgagcctgcccgccgctctgccatcggaccctagactacacccaccgagagaggccgaatcaacagcagagacagctacacccgacggagaacacccatttcctgagccaatggacactcaggaggctccaaccgcagaggaaacgtccgcctgttgtgccccacgtcccgcaaaggtttcccgtaagcgcagatccagctcattgtccgatggcggggacgctgggctggttccatcgaagaaagcacgcctggaggaaaaggaagaagaagagggggcatccagcgaggtggctgacaggcttcaaccccccccagctcaggctgagggcgcctttcctaacttggcaagggtgctacagcgcaggttctccggattactgaattgctccccagccgcgcctccaaccgcccctcccgcctgtgaagccaagccggcctgtaggccggcagacagtatgcttaatgttctggtacgcgccgtggtggccttctag

SEQ ID NO: 14165 - DNA, 1500 bp, Artificial Sequence
  Description of Artificial Sequence: Synthetic coding sequence
atgcgggtcctggtgccccccgccgagcgatctcaggacacccgcgtgggagctccagcctggagagaggccgctcaggctatggctcgcaccgcccacatcctaacagaccgctgcggccaggaagccgtcacaatgtggcagccaaaagacagcgtactcgatcctaacgtggcccatcatctgggcagggccgcctatatccagccctggagattcagggtggagatgattaagggaggagggacactcgagaaacccccaccaggtgagggtgtcacgctgtggaagggaaagatgaaaccacccgcttggtatgcgcggctgcctctgccactccacagaaaagcccgcgcacttcagaccacagaggttgtgcacgcacatgccaggggcgccaggctcacggctgccaggctgggtcgtgctcaacaccagattaatggaagagtacgtcagctcttgagacagagggaggtgacggatcacaggttgagcgaggtgagaaagggcctgctaattaatcaacagtcagtgaaacttagggggtaccggccgaaaagcgagaaggtgcccgacaaggcagactcgatgctcacatgggaaaaagaagaactcaagagcatgaagcgtaaaatggagcgggacatggaaaagtcagaagtcctacttaaaacgttggcttcttgcagggatactctgaacttctgttttaaggaaaggcttcaggccgtggacctgatgaatcagccactggataaggtgctcgagcaggcccgacggcattcatgggttaatctcagtagggcccctacccctcggacgcagggccaaaagactcctcccccagatcccgtcggtacgtataacccagcatgcgccctggccttgaacgaagcgaaaagactcttggtagagtccaaagacaccctcgtcgaaatggccaaaaatgaagttgacgtgagggaacaacagctgcaaatctctgaccgggtttgcgccagcctggcacagaaagcctcggagacactcgaacttaaagaaaggctgaacatgactctcggcctgatgcgtggtacaattctgaggtgcaccaaatacaatcaggagctgtacacaactcacggactgatcaaaggcccattgtctaaagtgcacctggaaactgccgaaaaactggaccgccccctggtgcgcatgtatcagagacacgtcggtacacaacttcccgaggctgcacgcctagcacagggcaccgataagcttcaatgtcatatcacctatctcgaaaagaacctggacgaactgctggccacacacaaaaacctttcttggggcttgaactgtaaaaatattggtcacgaagtcgacgggaatgtggtgagactccggctgagacaacgtcagccgcacgtctgttacgaacaggcccagcgactcgtgaaggattgggatcctaggaccccaccacctagaagtaaatcctctgccgatccatag

SEQ ID NO: 14166 - DNA, 1827 bp, Artificial Sequence
  Description of Artificial Sequence: Synthetic coding sequence
atggagatggagtcagcagctgctagcacacgctttcaccagccacacatggagagaaaaatgtctgctatggcctgtgagatctttaacgaactaagactcgagggcaagctgtgcgacgtggtcataaaggttaatggcttcgagttcagcgcccacaaaaacatcttatgttcatgctcctcctatttccgggcactgttcacatcaggctggaataatactgagaagaaagtctacaacatccctgggatttcccctgacatgatgaaattaataattgagtacgcatacaccaggaccgttcctataacaccggacaacgttgaaaaattgctggccgctgcagatcaattcaatatcatgggaattgtgcgcggctgttgtgaattcctcaaaagcgaactgtgcctagacaattgtattggtatctgtaagtttacagactactattattgccccgagctgcggcagaaggcttacatgtttattctgcataatttcgaagaaatggtcaaggtatctgccgagtttttggagttatctgtcactgaactgaaggacatcatagagaaagacgaactgaacgttaagcaggaggacgctgtctttgaagccatcttgaaatggatttcacatgaccctcagaatcggaaacagcacatatccatcttactgcctaaagtaagacttgccttaatgcacgccgagtactttatgaataacgtcaagatgaatgactatgtcaaggatagtgaagagtgcaagccagtgatcattaacgcgttaaaggccatgtacgacctgaacatgaacgggcctagcaacagcgactttacaaatccactgactcgccccagacttccatacgccattttgtttgctataggtggctggagcggcggctcccctacaaacgctatcgaagcatacgatgccagggcagaccgatgggtcaatgtgacgtgcgaggaagaaagcccacgcgcatatcacggagctgcctaccttaaaggctacgtgtacatcattggtggatttgactccgtcgattactttaacagtgtgaagcggtttgatcccgtgaagaaaacctggcatcaggtcgccccaatgcattcccgacgttgctatgtttcagttacagtccttgggaatttcatatacgctatgggcgggttcgatgggtacgttcggctgaataccgccgagagatatgagcccgaaactaatcagtggactctgattgcacccatgcatgagcagcggagcgacgccagcgccacaacactgtacggaaaggtttatatctgtggaggcttcaatggcaacgaatgcctgtttaccgccgaagtgtataacactgagtccaatcagtggactgtaatcgctccaatgagaagccgcagaagtggaattggcgtcatagcctatggcgagcacgtgtacgcggtcggcgggttcgacggcgcaaacaggctccgcagtgccgaggcatactccccagttgctaacacatggagaaccattccaacaatgtttaacccgcgcagtaatttcggtatcgaagttgtggacgatctcctgttcgttgtaggtggctttaacggtttcactacaacctttaatgtggagtgctacgacgagaagacggatgagtggtatgacgctcacgatatgtccatataccgttccgcactcagctgttgcgtagtacctggcctggctaacgtggaagagtatgccgctaggagggataactttcccggtctggccctgcgagatgaggtgaagtacagtgcatccacgagtacactgcctgtttag

SEQ ID NO: 14167 - DNA, 942 bp, Artificial Sequence
  Description of Artificial Sequence: Synthetic coding sequence
atggctgcccttaccgacctttccttcatgtaccggtggtttaaaaactgcaacctggtcggcaacctgtctgagaaatatgtcttcatcaccggatgtgactctggctttggaaatctgctggctaagcagctcgtagacagaggaatgcaggtcttggccgcgtgcttcacagaggaaggcagtcagaagttgcagcgcgacactagctaccgcctgcagaccacactactcgacgttaccaagtcagagtccataaaggctgcagcacagtgggtgcgtgacaaagtcggggaacaaggcttgtgggccctagtgaacaacgccggagttgggctccctagtgggcctaatgagtggctgacaaaggatgatttcgtgaaagtgatcaacgttaatctcgtgggcttaattgaggtcactttgcacatgttgcccatggtgaagagggccagaggccgggttgtaaacatgagctcttcagggggacgggttgccgtgattggcggaggctattgcgtcagcaagtttggtgtggaagcttttagcgattcgatccgaagggaactgtactacttcggcgtcaaggtttgcattattgagcctggaaattacaggaccgccatcctcggaaaggagaatctggaatccagaatgcgtaagctgtgggagcgcctccctcaggagactagggactcatatggcgaggattacttcagaatctatacggacaagctgaaaaacataatgcaggtcgcagagcctagagtcagggacgtgattaactcgatggaacacgcaatagtgtcacgctcgcctcggattagatacaacccagggttggatgccaagctgctgtacattcctctggccaagctgccgactcccgttaccgattttattctctccagatacctgccgaggcccgccgacagcgtatag

SEQ ID NO: 14168 - DNA, 1461 bp, Artificial Sequence
  Description of Artificial Sequence: Synthetic coding sequence
atgacctgtggaagttattgcggcggtcgcgcatttagttgtatctcagcttgcggtccaagaccgggtcgttgctgtatcaccgcagccccttaccgggggatctcttgttatcgagggctgactggcggctttgggtcccacagtgtgtgtggggggttcagggcgggcagctgtggacgctcttttgggtatcgctcggggggcgtttgcgggccgtcccccccttgcatcacaacagtgagcgtcaacgagtccctgttaacaccacttaatctcgagattgacccgaacgcccagtgcgtgaaacaggaagagaaagagcagattaagtctcttaacagtaggttcgcagcgtttattgataaggtcaggtttctggagcagcagaacaagcttctggagaccaagcttcaattttatcagaatcgcgagtgctgtcaatcaaatctcgaacctctgttcgaagggtacatcgaaactctaagacgggaggcagaatgtgtcgaggctgacagcgggagactggcgagcgagctgaaccatgtacaagaggtgctcgagggttacaaaaagaagtatgaagaagaggtgtctctgcgcgcaactgctgagaatgaatttgtcgctctgaaaaaggacgtggattgcgcatacctacggaagagcgatctggaggccaacgtcgaagctctgattcaggagatcgatttcctgcgacggctgtatgaagaggagatccgggtgttacagtcccacattagcgatacctccgtggtggttaaactggataattctcgcgatctgaatatggactgtatcatcgcagagattaaagcccaatacgatgacattgtgacaaggagccgtgccgaagccgaaagttggtacagaagcaaatgcgaggaaatgaaagcgactgtgattcggcatggagagacacttcgacgtactaaagaggagataaatgagctgaaccgcatgatccagagacttacagcggaggtggagaatgctaaatgccagaactccaagcttgaggccgccgttgcacagtccgagcaacagggcgaggccgcactgtcagatgcaaggtgtaaactcgctgaactagagggagccctccaaaaagccaaacaagacatggcctgtctgatccgggaatatcaggaagtaatgaattccaaactgggtttggacatcgagatagccacatacaggaggctcctggagggcgaggagcagcgcctgtgtgaaggggttggatcggtgaatgtgtgcgtgtccagcagtcgcggaggggtggtctgtggtgacctatgcgcctctacaactgcccccgttgttagcacacgcgtgtcctcagttccgagcaatagcaacgtcgtggtgggtacaaccaatgcttgtgctccttctgctcgggtcggtgtctgtggcggctcctgtaaaagatgctag

SEQ ID NO: 14169 - DNA, 939 bp, Artificial Sequence
  Description of Artificial Sequence: Synthetic coding sequence
atggccgagctcaccgctctggaatcgctcattgagatggggtttccaagagggcgtgcggaaaaggctctggccctcaccggtaaccagggtatcgaggctgcaatggattggttaatggagcatgaggacgatccagacgtcgatgagcccctcgaaacacctctcggccacatcctcgggcgggaacccacctcaagtgaacagggggggctggaaggatcaggctctgccgccggcgaagggaaaccagctctaagtgaggaggaaaggcaggagcagacgaagaggatgctggagctggtggctcagaaacagcgcgagcgcgaggaaagagaggagagagaggccctggagcgcgagcgacagaggagacggcagggccaggagttgtcggctgctcggcagcgacttcaggaagacgagatgcgacgggcggctgaggagagacggcgtgaaaaggccgaagaacttgccgcccgccagagagtgcgggaaaaaatcgagcgagacaaagctgagagggccaaaaaatatggaggctctgttggctcacagccaccccccgtggcacccgagcctggcccggtcccatcaagccccagccaggagcccccgactaaacgtgaatatgaccaatgccggatccaagtgcgacttccagatgggacatccctgacccaaaccttccgggcaagggaacagcttgcagccgtgcgcctgtacgtagagctgcatcgcggagaggagctgggcggcggacaagaccctgtccagttgttgtccggctttcctcgaagagcgttctccgaggctgatatggagagaccactccaagaactaggcatggccgcccgccttgaaacccgaaccaggaattgggggtcacgcgaggcttgcctgggaaagggcgggatgcagagagaaggcgccttgtag

SEQ ID NO: 14170 - DNA, 405 bp, Artificial Sequence
  Description of Artificial Sequence: Synthetic coding sequence
atgcccgccgatctgtcagggacttggacactcctgtccagtgataatttcgagggatatatgctggccctaggaatcgattttgccacccgcaagatcgctaaattgcttaagcctcagaaggtgattgagcagaatggcgactcctttaccatccacactaactctagccttcggaattacttcgtgaaattcaaggtcggggaggagtttgatgaggacaatcgggggctggataacaggaagtgcaagagtctcgtgatctgggacaatgacagattgacctgcattcagaaaggagaaaaaaagaataggggatggacacactggattgagggagataagttgcacctggaaatgttttgcgaagggcaagtgtgcaagcaaaccttccaaagagcctag

SEQ ID NO: 14171 - DNA, 1383 bp, Artificial Sequence
  Description of Artificial Sequence: Synthetic coding sequence
atggctggctacctgtctgagagtgactttgtgatggtggaggaagggttttcaaccagggacctgctgaaggagctcactttaggggcctcgcaggcaactactgatgaagtagctgccttcttcgtggctgacctgggagccatcgttcggaaacacttctgtttccttaaatgtctgccccgggtccgacccttttacgcagtgaagtgcaactcatctccaggggtgctaaaggtgctggcccagcttggcctcggctttagttgtgcaaacaaagctgaaatggaacttgtgcagcacatcgggatccccgcatctaagatcatttgcgcaaacccatgtaaacagatagctcagattaagtatgcagcgaagcatggtatccagcttctatcctttgataatgagatggagctcgcaaaggtggtaaagagccatccgtctgccaagatggtgttgtgtattgctacagatgattcacattctctcagctgtttaagtttgaaattcggggtgagcctgaaaagctgccgacacctgctggagaatgcaaagaagcatcacgttgaggtcgtaggggtttcttttcacataggcagtggttgtccagatcctcaggcctatgcccaatctatcgccgacgcgcgcctcgtgttcgaaatgggcacggagctagggcacaagatgcacgtgctcgacctcgggggcggctttccggggaccgagggcgccaaggtcaggtttgaagaaatcgcctctgttataaacagcgcgctcgacttatactttcctgaaggctgcggcgtagacattttcgccgagctggggcgctattacgtgacatccgcctttacagtggcagtgtccatcattgccaagaaggaagtgctgctagatcagcctggaagggaagaagaaaacggatccacaagtaagacaattgtgtatcatctagacgaaggcgtgtacgggatcttcaatagtgtcctgtttgataatatttgccccacccctatcctccagaaaaagccctccactgaacagcctctgtatagcagcagcctatggggccccgctgtggacgggtgtgactgcgtcgcggagggactctggctgccacagcttcatgttggtgactggctggtgtttgataacatgggagcatatacagttggaatggggtcaccgttctggggaacacaggcctgtcacatcacatacgccatgtcccgcgtggcttgggaggccctgcgtcggcaactgatggctgcggagcaggaggacgatgtcgagggcgtgtgtaagcccctgtcatgtggctgggaaataacggacacactgtgtgttggaccagtgtttacccctgcttcgatcatgtag

SEQ ID NO: 14172 - DNA, 1209 bp, Artificial Sequence
  Description of Artificial Sequence: Synthetic coding sequence
gggggaccacgagggagcggtagcgctgcggagaccatgccagaaatcagggtgacaccgcttggcgcaggtcaggacgtgggccgttcatgcattctggtatcaattgctggaaaaaatgtgatgctggattgcggcatgcatatgggttttaatgacgatagacggttccctgacttcagctacattacacaaaacgggaggctcaccgacttcttggattgtgtgataattagtcatttccacctcgatcactgcggggcactcccctacttctccgaaatggtcgggtacgatggacccatttatatgactcaccccacccaggctatatgcccaatcctgctcgaggattaccggaagatcgctgtggacaagaaaggagaggccaacttcttcaccagtcagatgattaaggactgcatgaatttactggagacattctgggagcgaatgaacctgaaggtaccaatatactttagcactggcctcactgagaaggcaaaccactattataaactgttcattccatggactaatcagaagatcaggaagacattcgtacagaggaacatgtttgaattcaaacacataaaggctttcgatagagcttttgccgacaaccccggacctatggtcgtcttcgctacccccggaatgttgcatgccggacagtcccttcagatcttccgcaaatgggccgggaatgaaaagaacatggtaattatgcctgggtattgcgtccagggaactgtgggccacaaaattctgtctggccagcggaagctcgagatggaagggcgacaagtactggaagtaaaaatgcaagtcgagtacatgagtttttccgcccacgctgatgccaaaggcattatgcaactcgtctcctcagaacaggccctgaaagaactcggactagccgaacatcaactgcggttcacatgcagagtgcatcttcacgatactcgcaaagaacaggaaaccgccctcagagtctattcccaccttaagtctgtgctcaaggatcattgtgtgcagcacctgcccgatgggagcgttacggttgagtcggtgctcttgcaggcagccgcaccttccgaggaccccggaacgaaggtgttactcgtgtcatggacctaccaggacgaagagcttggcagcttccttacgtctctactgaaaaagggcctcccccaggcgccgagctag

SEQ ID NO: 14173 - DNA, 1863 bp, Artificial Sequence
  Description of Artificial Sequence: Synthetic coding sequence
atggaaaaggccgtcaatgacgggtcacactctgaggagttgttctgtcatcttaaaaccatctccgaaaaagaagatttaccaagatgcacctccgagtcacacctgtcatgtctgaagcaggacatcctgaacgaaaaaactgagttagaggccacgctcaaggaagcagaactggtcacccacagtgtggaattgctgctgcctctgtttaaggatactatcgagaagatcaacttcgagaatgccaacttatctgctctgaacctgaagattagtgagcagaaggagatactcataaaagagttggacacattcaagagcgttaaactcgcccttgagcatctgctccggaagcgtgattacaagcagacaggtgataatcttagctccatgctactggagaatttaacagataacgaatccgagaacacaaaccttaagaagaaagtcttcgaaaaggaggctcatatccaagagctcagttgtctctttcaatccgagaaagccaatacgctcaaggcgaatcggttttcacagagcgtgaaagtggtgcatgaacgcctccagattcaaattcataagcgtgaggcagaaaatgataagttgaaagaatacgtcaagtcactggagaccaaaatcgccaaatggaatcttcaatctagaatgaataaaaatgaggctatcgtgatgaaagaggccagtcgccagaagacagtcgccttaaaaaaagcttccaaagtatataagcagagactcgaccactttactggggctatcgagaagctcacctcgcaaattcgcgatcaagaggccaaactttctgagaccatatctgcctccaatgcctggaagtctcactacgagaaaattgtgattgagaaaacagagctggaggtgcaaatcgaaacaatgaaaaagcagatcatcaatctcctggaagacttgaagaagatggaagaccatggaaaaaatagttgtgaggaaatactccggaaggttcacagcatcgaatacgaaaatgagacgttaaacctggaaaacactaaattaaagaccactctggctgcgctcaaggacgaagttgtcagtgtcgagaacgaactgtcagaactacaggaggtcgagaagaaacagaagacccttatagagatgtacaaaactcaggtacaaaagctccaggaagccgccgaaattgtgaagagccgctgtgaaaacctgttgcataagaacaatcagatcaccaagaccaagaacaagaatgtggagaaaatgagggggcagatggagagtcacctcaaagagctcgaaagagtgtgcgattccctaaccgcggcggagaggaggttgcacgaatgtcaggagagcctccaatgctgcaaggggaaatgcgcagaccaggagcacaccataagagagctgcagggacaaattttgaagcagtgggaggagtacagcgtactggcttgggttgatggcaatcataatctgcttaccaagttgagcctggaagaggagaattgcttgattcagctcaagtgtgagaatcttcaacagaaactcgagcaaatggatgccgagaataaggagctagagaagaaactagctaaccaagaggaatgcttgaagcactctaatctcaagtttaaagagaagagcgctgagtacactgccttggccagacaactcgaagctgctctggaggagggacggcagaaggttgccgaggaaatcgagaagatgtctagccgagaaagcgccctccaaatcaagatcctggacctcgagactgaactaagaaagaagaatgaggaacagaatcagctggtgtgcaaaatgaactctgatcctgaaaccccttag

SEQ ID NO: 14174 - DNA, 465 bp, Artificial Sequence
  Description of Artificial Sequence: Synthetic coding sequence
atgtccaagaacacagtgagcagtgctcggttcagaaaggtagatgtggacgagtatgatgagaataaattcgtcgatgaggaggatggcggcgacggacaggccggacctgatgaaggtgaggtcgattcttgcctacgacattcaatcactgggaatatgacagccgctctgcaggctgctctgaaaaacccacctatcaacacgaaatcacaggcggtgaaggaccgcgccggcagtatcgtgctgaaggttttgatttcgttcaaggccaacgacatagagaaggccgtgcaatccctggacaagaatggcgtggacttactgatgaaatatatctacaagggatttgaaagcccttccgataactctagcgccatgctgctccagtggcacgagaaagccttggcggcgggcggagtgggttcgattgtccgcgtgcttacggcccgcaagactgtctag

SEQ ID NO: 14175 - DNA, 2946 bp, Artificial Sequence
  Description of Artificial Sequence: Synthetic coding sequence
atgagcgagcaggaacgaatccaggagtgcctgagaaaagaaattcggagccttctgatctcaactaaggacgggttatctcctcaagagctggagaaagaatacttactgatggtgggtaaccatctgccactcaggatactgggataccgatctacaatggaactagttctggatatgccagatgtcgtcagggtgtgcccaggcgcagggggaactgtgatacttaaagccattcctgatgagtcaaccaagggcattgcctcactggtcgccaagcagagaagcagtcataaactgagaaattccatgcacaaagggaggccctctatctatagtgggccgagatcccacaggagggtgccatatcgaggacgcgtcgctcctatcctgccggcggtagtgaaatccgagctgaaggacctcttagccctgtcaccagtcttgctatctgatttcgagaaagcgttcgcaaaacgcttcgggcggtcattccaatacatgcagtatgggtttctaagcatgttcgaggtgctgaatgcggcgagtgacgtcatttccgttgagcagacacgcgccggtagtttgctgatgttgaagaagagtgtgaccgaggagaaacctagaggctgccctgctgggaagatctttacccaaccgtttcgcatgaagcaaggctcttacagtaccggttttccagttgcgaaaccctgcttctctcagcctacatcaaacatggaaccccccaaacagattatgtccatggagaagacttctaagcttaatgttgtggagacgtctcggctgaatcatacggagaagttaaaccagctcgagaatacttttaaatccgtgatagcccagatcggtcctggaggaacgatttcctccgagctgaaacataaaatcaagtttgtggtctcgaaattccctgaagggttattcataagtaaacttcttggagagtatgaggtgatcttcaaagagcaactctcaccaaagaagttgggcttcttaaacgtcacggaattagtgggcgctttatctgacattctgcacgtagagttccgcaaggggcaccaggatctgctggtcttcgatgctgataaaaagccactgcccccagttcagagcgacaagaagatcgaggctaaggcttgcgtgtccagccctccccgcaatagcctctctacggccgcggtgaaagagaccgtgtggaattgtccctctaagaagcagaaggaaccacagcagaaaatttgtaaaaaacccaaccttgttgtgaagccactacagctgcaagtggagaccaataaatccgaattgaatctggcgatggcaaaccatgatattccaccagacgccgtccccaataagaaactgtgtcgtcttccgcccctggacacctcttctctcattggtgtgtttgtggaatacattatctctcccagccagttctatatccgaatttactcccgggactcctcggaattgctggaggacatgatgattgagatgcgcagatgctactccaaccaactagtgagtgacagatacgtaatgccagaatgttttatacagcctggccacctatgttgcgtgcgtatctccgaggacaaatggtggtacagggtgataattcaccgggttctggagaaacaagaggtggaagtcttctaccccgacttcggcaacatcggtatagtgcaaaaaagctccctgcgatttctgaagtgttgctacactaagttacccgctcaagccatcccatgtagtctggcttgggtccgacccgttgaggagcactggacctcaaaagccatcctccaatttcaaaagctttgcgggctgaaacccttggtcggagtggtcgatgaatacgtcgacggcatactgaatatcttcctgtgtgatacttctagcaatgaggacgtctacttccaccacgtactgaggaccgaggggcatgcaattgtctgcagagaaaacatttcttccaagggcttctctgagctgaatcctttggccctgtacactaccagtagcggcggaccggaagatatcgtgctgaccgaactgggctacccatctcagcagcattactttaatgaagatcggaaaattagtccgcaatccaaggagagtgagctgaggatcttggatgagattcccaccgggatgccctgcctggaatcagtgaccattggggacgacatatgggacgaaaactggctgcccctgcaggcgaagatggggaagggcggtgacgcggccagccacctgttcaccgccagcctggggggaaaaaaccagtacagttcctgtaaggaaatgccccagaaagactggtgtttctctacccctaaggatacctgggacgattcctggcagcccagtggcttggtaaatggaacaaaagtcgaagttcataagcctgaggtgctcggagcccaggaaaagaatacagggacgaataggactcagaagcagctggatatcaatggttcttccgatagttccaccttgccaaagctggaagagttctgtacttcactgacccagtccgagcagtctgccgacggtagtcaatccgagcccaataactctcagacacagcccaaacagattcagttgagtacagccgctccttgctctaccacagcggtcgatgacagcgctgaaaagcctagcggaagtgttgaaagcagtcctgaaatcctgaaaaatgaggacttctcatcatcccgagccatcaccttgtacaaggacaagcggcaggaatccgtggatcagctctctcttatactgagctatgagtgtcaaatcagtcagaaactctacattccacgttcaaccgccacagcggctctgggggccgctgcaagactcgcgacctctcggtcattgctccactggtatcccagcgtcaagcgcatggaggcatag

SEQ ID NO: 14176 - DNA, 909 bp, Artificial Sequence
  Description of Artificial Sequence: Synthetic coding sequence
atggagatccaggagctggaggagatccaagcctgtcagggactctgggaggttttcgtgaccttgtccgagcgcgcccgggactatctacataagacaggccggtttatcgtgattggtggaattgtgtcccccgttcacgatagttatggcaaacaggggctggtcagctcccgccataggttgattatgtgtcagctcgccgttcagaattctgactggataagagtggatccctgggaatgttatcaggatacttggcagacgacgtgctcagtgttggagcatcatcgagacctgatgaagcgggtcacaggttgtattctgtcaaatgttaacaccccctctatgacaccggtcatcggacaacctcagaacgagacaccccaacccatataccagaattctaatgtggccactaaaccaacggctgccaaaatattagggaaggttggcgagagcctttctaggatctgctgcgtcagaccacccgtcgaacgcttcactttcgtggatgagaatgccaatctcggcactgtcatgcggtatgaggaaatcgagctgaggatcctcttgctttgtggctctgatctactggagtcattttgcataccgggactgtggaacgaggctgatatggaagtcattgtgggcgattttggcattgttgtagtgcccagggatgccgcggacacagataggattatgaaccacagcagtatactgcggaaatataagaacaacataatggtcgtaaaggatgacattaatcaccccatgtctgttgtgtcatcaaccaaaagcaggctcgcactgcagcacggggacgggcacgtcgtggactacctctctcagcccgtgattgattatatactgaaaagccagctgtatattaacgcctctggttag

SEQ ID NO: 14177 - DNA, 861 bp, Artificial Sequence
  Description of Artificial Sequence: Synthetic coding sequence
atggagagacgactcggagtgcgcgcgtgggtaaaggaaaatcggggctcttttcagcctccggtttgtaacaaacttatgcaccaggagcagcttaaagtcatgttcatagggggtcctaatacacgtaaagactatcatatagaggagggcgaagaagtcttctaccaactcgagggggacatggtcctccgggtgctcgagcagggtaagcacagggacgtcgtgatccgccagggcgagatattcctgctccctgccagggtgcctcattccccccagcgattcgccaacaccgtgggcctggtcgtggaaaggcgcagattggagactgagctcgatggactacggtattacgtgggagacactatggatgtgttgttcgaaaaatggttttactgtaaagaccttggaactcagttagctcctatcatccaggagttcttctcgagtgagcagtataggacaggaaagccaatcccagaccagctcttgaaggaacctccatttccactctctacacggtcgattatggaaccaatgagtttggatgcatggctggattctcaccaccgcgaattacaggccgggactcccctgtcattgtttggagacacctacgagacgcaggtaattgcctatggacaaggttctagcgagggtcttaggcagaacgtggatgtgtggctatggcagctggaaggcagctctgttgttaccatgggcggccgacgactgtccctggctccggatgattccctgctggttcttgctggcacatcatacgcctgggaacggacccagggaagcgtcgccctgagtgtcacacaagaccctgcatgcaaaaagcccctgggctag

SEQ ID NO: 14178 - DNA, 1545 bp, Artificial Sequence
  Description of Artificial Sequence: Synthetic coding sequence
atgcaggagtctggatgcagactggagcacccttccgctactaagttcagaaaccatgtgatggaaggcgactgggacaaagccgaaaacgatttgaacgagcttaagccactcgtgcattctccccatgccatagtagtacggggtgcccttgagatctcccagactctgttgggaatcatcgtgaggatgaaatttctcctgctgcaacagaagtatcttgaatatttggaggacgggaaagtcctggaagcactgcaggtgttgagatgcgagctgacccccctgaaatataacaccgagagaattcatgttctctccggctatctgatgtgctctcatgctgaggacttgcgagcaaaggccgagtgggaaggtaagggaactgcctcaaggagtaaactgctggacaagttacagacttatctgccaccctctgttatgctgccacctaggcgcctgcagaccctgctccgccaagccgtggagctgcagagggaccgctgtttgtatcataatacaaaactggacaacaacttagacagtgtgtctcttttgatcgaccacgtgtgctcccgtagacaatttccttgttacacacagcagatcctaactgaacattgtaacgaggtttggttctgtaaattcagcaatgatggtactaaattggccaccggcagtaaggacaccactgttattatctggcaggtggatccagatactcaccttttaaaattgttgaagacactggagggccacgcatacggagtgagctatattgcatggtccccagacgataactacctcgtggcctgtggcccggatgactgctccgagctctggctgtggaacgtccagaccggcgaactccggaccaaaatgtctcaatcgcacgaagacagtctgacatcagtggcctggaatccagacggaaaacgtttcgtcaccgggggccagagagggcagttctaccaatgcgatctcgacggaaatctgttagactcatgggagggggtccgtgtccagtgtttatggtgcctcagcgatggtaagactgtcctggcctccgacactcatcagcgaattcgtgggtataacttcgaagatctgactgaccggaatatcgttcaagaagatcatcctatcatgagcttcaccatatccaagaatggccgcttggctttgctcaatgtggctacacagggcgtccacctgtgggacctccaggatagggttctggtgagaaaatatcagggggttacccagggcttctacacaattcacagctgttttggagggcataatgaggactttatcgctagcggttctgaggatcataaggtatatatttggcataagagatcggaactgccgattgccgagctgaccggccatacccgcaccgttaactgtgtgagctggaaccctcagattccctctatgatggcctcagctagcgatgatgggactgtcagaatctggggccctgcaccttttatagaccaccagaacatcgaggaggagtgtagtagcatggatagctag

SEQ ID NO: 14179 - DNA, 540 bp, Artificial Sequence
  Description of Artificial Sequence: Synthetic coding sequence
atgggcatattgtttactcgaatatggcgtctgttcaatcaccaggaacataaagttattattgtggggctggataacgccggcaaaacaacaattctataccagttttcaatgaacgaggtggtgcacacctcccctaccatcggctctaacgtggaggagatcgtcataaataatactcggtttctgatgtgggatattggggggcaggagtctctgcggtcttcctggaacacctactacacaaacacagagttcgtgatcgtggttgtggacagtaccgatagggaacgcatttctgttacacgagaagagctatacaagatgctggcccacgaagatctgcggaaggccggccttctcatcttcgcaaacaagcaggacgtaaaggagtgcatgactgtcgccgaaattagccagtttctaaaactgactagcattaaagaccaccagtggcacatacaggcatgttgtgccctgactggcgagggcctgtgccagggcttagagtggatgatgtctagactgaaaattaggtag

SEQ ID NO: 14180 - DNA, 1428 bp, Artificial Sequence
  Description of Artificial Sequence: Synthetic coding sequence
atgcagaagtctactaactctgatacttccgtcgaaaccctcaactcaacaagacaggggactggcgccgtgcagatgcgcatcaaaaatgccaatagccaccatgacaggttgtcacagtcaaagagcatgattctaactgacgtgggcaaagtcactgaacctatctctcggcaccggagaaaccattctcagcatattcttaaagacgttataccccccctcgagcaactgatggtggagaaggagggctacttacagaaggccaaaatcgccgacgggggtaaaaagctgaggaagaattggtccacgtcttggattgtgctttcctctcgcagaattgaattttacaaagagagcaagcaacaggccctgtccaacatgaagacagggcacaaaccagagtctgtggacctgtgcggtgctcatattgagtgggccaaggaaaaaagcagccgaaagaatgtcttccagattactaccgtgagcggcaacgaatttcttttgcagagcgacattgactttataatccttgattggtttcatgcaataaagaatgctattgaccgcttacctaaagactcctcatgcccaagcaggaacctggaattattcaaaattcagcgcagctcttccactgagctcctgtcacactacgattcagatatcaaagaacagaagccagagcacaggaaaagcttaatgttcagactccatcacagtgcatctgacactagcgataagaatcgggtcaagtccaggcttaagaagttcatcacaagaagaccctcactaaaaacgctacaagaaaagggattgattaaggaccagattttcgggtcacacctgcacaaagtgtgcgagcgagaaaactcaacagttccttggtttgtcaaacagtgcattgaggccgttgagaaaagaggacttgacgtggatggcatctaccgggttagtggcaatcttgcgacaatccagaaactgcgatttattgtcaaccaggaagagaagttgaacttggacgacagccagtgggaagatatccatgtggtgaccggcgctctgaagatgtttttccgcgagttgcctgagcctttattcccatacagcttcttcgaacagttcgtggaggccattaagaaacaggacaacaacaccagaatagaggccgtcaaaagcctcgtgcagaagctgccacctcctaatagggataccatgaaggtgctgttcggacacctgactaaaatcgtcgccaaggcatccaagaacttaatgtctacccaaagcctcggaatcgtgttcgggcctacactcctgcgggctgagaacgaaactggcaacatggcaattcacatggtttatcagaatcaaattgccgaacttatgttatctgagtatagcaagattttcggaagcgaagaggactag

SEQ ID NO: 14181 - DNA, 1308 bp, Artificial Sequence
  Description of Artificial Sequence: Synthetic coding sequence
atggctcagacagtacctccgtgcgaactgccttgtaaagaatacgatgtagcacgcaatacaggtgcttatactagctcaggccttgcaacagcctcctttaggacctctaagtatttgctggaggaatggtttcaaaactgttacgcgaggtaccatcaggcctttgccgatagggaccagagtgagcgtcaaaggcacgaatcacaacagctggccaccgaaacccaggctctggcgcagcgaacccaacaggacagcacacgcaccgtgggggagagattgcaggacacccactcctggaagtccgagctgcagcgggagatggaggcccttgctgcagaaacaaatttgctgttagcgcagaagcaaaggctggaaagggctctagacgccactgaagtacccttttcgattactaccgataatctgcagtgtagggagcgccgggagcacccgaatctcgtgcgcgaccacgtggaaactgagctccttaaggaggccgagctcataagaaatatacaggagctgctcaaacgcaccattatgcaggcggtctctcaaatccggctcaatcgagagcataaagagacgtgtgagatggactggtccgataaaatggaagcttacaatatcgatgaaacctgcggcagacaccattctcaatccacagaagtccaggcacatccatattcgaccacatttcaggaatcagcttcaaccccagagacaagggccaaattcactcaggacaacttatgcagagctcagcgggaacggttggcctccgcaaacctccgcgtgctggtggattgcattctgcgggatacatcagaagacttgagacttcaatgtgacgcggttaatctagctttcggccgccggtgtgaggagctggaggacgctagatacaaacttcaccatcatttgcacaaaactctgagagaaattaccgatcaggaacataatgttgctgccctaaagcaggccataaaggacaaggaagccccacttcatgtggcacagaccaggctttatctgcggtcacacaggcctaacatggagctttgccgggatgccgctcagttccggctcctctccgaggtggaggaactcaatatgtcactgaccgccctgcgcgagaaactgctggaagcggagcagtctctccgtaatttagaggatattcatatgagccttgagaaagatattgcggccatgacaaattccctttttatcgatagacaaaagtgcatggcccatagaacccggtaccctaccattctgcaactggcagggtaccagtag

SEQ ID NO: 14182 - DNA, 828 bp, Artificial Sequence
  Description of Artificial Sequence: Synthetic coding sequence
atgcgcaagcgactgagtgcaccggagctgcgcctgagcctaacaaagggtcccggaaacgacggcgcgtcacccactcagtcagcaccgagctcacccgacggctcctccgatttggagatcgacgagctggagacacctagtgacagcgaacaactggattcaggacacgaattcgagtgggaagatgagctcccgcgcgctgagggactcggaacttccgaaactgctgagcgcctaggtagaggatgcatgtgggatgtgacaggagaggacggtcatcactggcgagtttttaggatggggccgcgagagcagagggtggatatgaccgtcattgagccctataagaaggtgctatcacacgggggatatcatggggacgggctgaatgcagtgattctgttcgctagctgctatttgcctcggtcctcaatcccaaactacacatatgttatggaacatctgtttagatatatggttgggactctggaactgctggtggctgagaattacctgctggtgcacctctccggaggcacaagtagggcacaggttcctccgctgagctggattcggcagtgctatcgtacccttgacagacgtttacgtaaaaacctgagggctctcgttgtggtccacgctacgtggtacgtcaaagcatttcttgcgttactccggccctttatcagctctaaatttacccgcaagattagattcctggactccttaggcgaactggcccagctgattagcctagatcaggttcatataccagaagccgtccgccagttggaccgcgacctccatgggtccggaggcacatag

SEQ ID NO: 14183 - DNA, 2391 bp, Artificial Sequence
  Description of Artificial Sequence: Synthetic coding sequence
atggaagaagaggcttcaagaagtgccgccgcgactaaccccggaagtaggctaacccggtggccccccccagacaaacgagagggatctgctgtggaccccgggaaaagacgcagcttggccgccacccctagctcgtctcttccctgtaccctgattgccctcggcttacggcatgagaaagaagctaacgaattaatggaggatttgtttgagacttttcaggacgagatgggtttttctaatatggaggatgacggaccagaagaggaggagagagtggccgagccacaggcaaattttaatacaccacaggcacttaggtttgaagagctactcgccaacttgctgaacgagcagcatcagatcgctaaagagctcttcgaacagctgaaaatgaaaaagccaagtgctaagcaacaaaaagaggtagagaaggtgaaaccccagtgcaaggaagtccaccaaacactgatcttagacccagcccagcggaagaggcttcagcagcaaatgcagcagcacgtacagctcctgactcagatccacttactcgcaacatgcaatccgaatctaaatccagaggccagcagcaccaggatctgcctgaaggaattaggcacatttgctcagagcagtatagcgctccaccaccagtacaaccccaagttccagaccttatttcagccctgtaaccttatgggcgccatgcagttgatcgaggacttttccacacacgtgtcaattgactgttcccctcacaagactgtgaaaaagacggctaacgaatttccttgcctgcccaagcaagtcgcctggatattggcgaccagcaaggtcttcatgtaccccgagctgttgccagtttgtagcttgaaggccaaaaacccccaagacaaaattctatttaccaaggctgaagataataagtacctcctgacttgcaagacagctcgccaactgacagtaaggatcaaaaatttgaacatgaaccgggccccagacaacataattaaattctataagaagactaaacagctgccagtgttggggaaatgctgcgaggaaattcaacctcaccagtggaagccccccatcgaaagggaggaacatagactcccattctggctgaaagctagcctgcccagtatccaagaagaattacgccacatggcggacggcgcaagggaggtcgggaacatgaccggcactacagaaattaattcggaccaggggctagagaaagataacagtgagctaggttcagagaccaggtacccgctcctcttgcccaagggagtggtgctcaaattgaaaccggtagccgatagattcccaaagaaggcttggaggcagaagcgttccagcgtgctgaaaccactgctgattcagcctagtccttcactgcaacctagtttcaaccccgggaagactcctgcccaatcgacccattccgaggccccaccatcaaagatggtgctgcgaattcctcacccaatccagccagccacagtcttgcagaccgttcccggagtcccacctttgggcgtatccggtggagaaagcttcgaaagtcccgcagccttaccagccatgccccccgaggccaggacctcgtttcccctctcagaatcacagacattattaagcagtgcccctgttcctaaggttatgatgccttctccagcatcttccatgttcaggaaaccttacgtgcggcggagaccgagtaaacgaagaggtgcccgcgcctttcggtgcataaagcccgcaccagtgatacatccagccagcgtgatcttcacagttccagcgaccacagtcaaaatcgttagcctcggcggcggctgcaacatgattcaaccggttaacgcagccgtggcccagtcaccccagactattcccatcgcaactctgctggtgaacccaacctccttcccttgcccattgaaccagcctttggtggcaagctcagtgtcaccactgatcgtttcggggaatagcgttaacttacccataccatccacgcctgaagacaaggcacatatgaacgtcgacatcgcttgcgccgttgccgacggcgaaaatgcctttcagggtctggagccaaagctggaacctcaggaattgtcccctctcagtgccaccgtgtttccgaaggttgaacattcccctggaccaccccctgtggacaagcagtgtcaagaggggttgtcagaaaacagcgcctaccgatggaccgtggtgaagaccgaggaaggacgacaggcactcgaaccccttcctcagggaatccaggaatccctgaataacagttcccccggggatctggaggaggtagtgaagatggaaccagaagacgccaccgaggagatcagtggatttctctag

SEQ ID NO: 14184 - DNA, 1380 bp, Artificial Sequence
  Description of Artificial Sequence: Synthetic coding sequence
atggcagccagcgcttctgcggcagccggtgaggaggactgggtcttaccgtcggaggtggaggtactcgaatccatttatctcgatgagctccaggtgatcaaagggaacgggagaactagtccatgggagatctatattacattgcatcctgcaacggccgaggatcaggattcccagtatgtttgcttcacactggtgttgcaggtgccagccgaatatccacacgaggtcccacaaatttccattcgcaatcctcgagggctctcagatgagcagattcacacgattctgcaagtacttggccacgtagcaaaggctggcttgggcaccgccatgctgtatgagcttatcgaaaaaggaaaggagattttgaccgataataacattccccacgggcagtgtgtgatctgtctctacggattccaggagaaggaagcctttaccaagactccctgctaccactattttcattgccactgtcttgctcgatatatacagcacatggagcaggagttgaaagctcaggggcaagaacaggaacaggagcgccagcatgccaccaccaagcaaaaagcagtgggcgtccagtgccccgtgtgcagagaacctctggtgtacgatctcgcctcactgaaggccgctcctgaaccacagcagccgatggagctgtaccagccaagcgctgagagtctccggcagcaggaggaacgaaagcggttgtaccagcgccagcaggagaggggcggaattatagatctggaagctgagcggaataggtactttatctctttgcagcagcccccagctccagccgaacccgagtccgcagtggacgtttcaaagggctcacagccaccgtctacccttgccgccgaactttccactagcccagccgtacaaagcactttaccacctccactaccagttgcaactcagcatatatgtgaaaaaattcctggcacacggagcaaccaacaacgactgggcgagactcagaaggctatgctggatccacccaagccctctcggggtccttggagacaacctgaacggcggcatccaaagggaggggaatgccacgcccccaagggaacccgtgatactcaagagctccccccacctgagggcccgctgaaggagccaatggatctcaagccggagccccatagccaaggagtggaggggcccccacaagagaaggggcctggttcatggcagggaccacctcctcgaagaacccgcgattgtgtgagatgggagcggagtaaggggagaactccgggctcaagctaccctcggcttccacgaggacagggcgcatacaggcccgggaccaggagagaaagcctcggactggagtcgaaggatgggagctag

SEQ ID NO: 14185 - DNA, 2079 bp, Artificial Sequence
  Description of Artificial Sequence: Synthetic coding sequence
atgggaagcgccgctgacgtccgctttagcttgggcaccaccacacacgccccccccggcgtacacagacggtattcagctctccgagaggaaagtgccaaggattgggaaacatcccccctgccgggtatgctagccccagccgccggtcccgctttcgattccgatcccgagatttccgatgttgacgaggacgaacccggaggcctggttggtagcgccgatgttgtgagtcccagcggacactctgacgcacagacgttagccatgatgttacaggaacaattggatgcgataaacgaggaaatcaggatgatacaggaggagaaagaatcaacagaactaagagcagaagagatcgaaacacgggtgacctctggatcaatggaagcccttaacctgaaacaactgcggaagcgcggaagcattcccacatctctgacagcactctcgctcgcttcagcatcccctccactgagcggccgtagtacccccaaactcactagcaggtctgccgcccaggacttggacagaatgggagtcatgacgttaccaagcgatttaaggaaacaccggcgcaagctgctcagccccgttagcagggaggagaatagagaggacaaggcaactattaaatgcgagacttcccctccatctagtccccgcaccctacggctggagaaactgggccaccccgccctctcccaggaagagggaaagagcgcattggaagaccagggctcaaacccttcgtcttccaacagctcacaggattcactgcacaagggggcaaagcggaagggtatcaagtctagtataggccggctcttcgggaagaaggagaaggggagactgatccagttgtcaagagacggcgccacaggccacgttctgctgactgactcagaatttagcatgcaggagcccatggttcccgcaaagctgggtactcaggccgagaaagacaggcgcctgaagaaaaaacaccagctgcttgaagacgcccggcgaaaggggatgcccttcgctcagtgggatggtcccaccgtggtctcctggctggaactgtgggtcgggatgcccgcttggtatgtggcagcctgtcgagctaacgtaaagtcaggggcaatcatgtctgctctgtcagatactgagattcagagggaaataggcatcagcaacgctctccatagactgaagcttcggctcgctattcaggaaatggtttctctcacatccccatctgcccccccaacctcccggacctcatcagggaatgtttgggtgacacacgaggagatggaaacgctggaaacctcaaccaaaacaacgctggcatatggggacatgaatcacgagtggatcggcaatgagtggctaccatctttgggccttccccaatacagaagctattttatggaatgcctcgtcgacgccagaatgcttgaccacctgacgaagaaagatctgcgggtacacctgaagatggtagacagtttccaccggacgagccttcagtatggaataatgtgcctcaaaaggttaaactatgaccggaaggaacttgaaaaaaggagggaagagagtcagcacgagattaaagacgtgctcgtgtggacaaacgatcaggtggtgcactgggtacagagcatcggactgcgggactatgcaggcaacctacatgagagtggagtacatggggccctgctagccctggacgaaaactttgatcacaatacactggctctgatcctacaaataccaacacaaaacacccaagcccgtcaagtgatggagagagagttcaataatttactggcgctcggtaccgatcgtaaactcgacgacggggatgataaggtgtttcgacgagctcccagttggagaaaaaggtttagaccacgagaacaccacgggagaggaggcatgttgagcgcttctgccgagacattgcccgctggtttccgagtgtctaccctaggtacgctccagccacctcctgcacccccaaaaaaaataatgcctgaggcgcactctcactatctgtacggacacatgttgagcgcattccgggactag

SEQ ID NO: 14186 - DNA, 369 bp, Artificial Sequence
  Description of Artificial Sequence: Synthetic coding sequence
atggcgcctcagaaggaccgcaaacccaagaggagtacatggagatttaatctggacttgacccacccggtcgaagacggtatttttgattcagggaattttgagcagttcctgcgagagaaagtgaaagtcaatgggaagacaggcaacctcggtaacgtggtgcatattgagcgattcaagaacaagatcaccgttgtcagcgaaaaacagttctccaagagataccttaaatacctcacaaagaagtatctcaagaaaaacaatctgagggactggttacgggtggtcgctagcgacaaagaaacctacgagttacggtatttccagatttcccaggatgaggacgagagcgagagtgaggactag

SEQ ID NO: 14187 - DNA, 936 bp, Artificial Sequence
  Description of Artificial Sequence: Synthetic coding sequence
atgcagtacatctcacacattttcggcgttataaactgcaatgggtttaccctgtctgatcaacgcggtttgcaggccgtgggtgtaggaatcttcccgaatctgggactggtcaatcacgactgttggccaaactgtacggtgatatttaataacggcaagatcgaattgcgcgctctgggcaaaatctctgagggggaggaactaactgtctcctatattgattttctaaatgtgagtgaggaaagaaagaggcagctcaagaaacaatattactttgactgcacctgcgaacattgtcaaaaaaaacttaaagatgacctcttcctgggtgtcaaggacaatcctaagccgtcccaggaagtagtaaaagaaatgattcaattctccaaggacaccctggagaaaatcgataaggcccgtagtgagggcttgtatcacgaagtcgtgaagctatgccgagaatgccttgaaaagcaagaacctgttttcgccgacaccaatatctacatgctgaggatgctgtctatcgtgagcgaggtcctctcctacctccaggcatttgaagaggccagcttctatgctcgccggatggtcgatgggtacatgaaactgtaccacccaaacaacgcgcagctgggcatggccgtgatgcgtgctggcctgactaactggcacgcaggcaacattgaggtgggccacggaatgatctgtaaggcttacgcgatcctgttagtcacccacggacccagtcaccccatcacaaaagacctcgaggcgatgagagtgcagaccgaaatggagctcaggatgttccgccaaaacgaattcatgtattacaagatgcgggaggccgctctcaacaatcagccaatgcaagttatggcggagccttccaatgagccctcccccgcactcttccataagaaacagtag

SEQ ID NO: 14188 - DNA, 1542 bp, Artificial Sequence
  Description of Artificial Sequence: Synthetic coding sequence
atggcggaactacagatgctcctggaagaggagatcccaggcggcaggagggccctgttcgactcatacactaatttggagcgcgtggcagactactgtgagaataattacattcagtctgccgataaacaaagggccctcgaagaaacaaaggcttatacaactcagtctcttgcctctgttgcctacctgattaataccctggccaacaacgtgctgcagatgctggatatccaggcatctcagctccgcagaatggagtcatcaattaaccacataagccagacagtcgacattcataaagagaaagtggcacgtagagaaatcggcattttaaccaccaataagaacacctccagaacccacaaaattatcgccccagccaatctcgagaggccggtgcggtatatacgcaagcctatagattacacgatccttgatgatattggtcacggagtgaaatggctgctacggttcaaagtttctactcagaacatgaagatggggggtctgccaaggaccaccccgcctactcagaagcccccaagtcctcctatgtccgggaagggaactctggggcggcattcaccctatcggaccttggaacccgtcaggccacctgttgtgccaaatgactatgttccctcccccactcggaacatggcacccagccagcagtcccccgttcgtaccgctagcgtcaaccaacggaatcggacgtacagttccagcggcagctcaggcgggtcccatccaagctctcggtcatctagccgggagaactcgggaagcggatcagtcggcgttcctattgccgttcccactccatccccaccctccgtgttcccagccccagctggatcggctggtactcccccccttcctgctactagcgcctcagcaccagcgcctctagttcccgccacagtgccatcttcaactgcacctgatgcagcggcagggggcgcccagaccctggctgacgggttcaccagtcctactcctcctgtcgtgtcaagcacccctccaactggccaccctgttcaattctatagcatgaataggcccgccagcaggcatacaccaccaactataggcggatccctgccatatcgtcggcctccctcaataacgtcgcagacttcgctgcagaaccagatgaacgggggacccttctattctcaaaaccccgtttcagacactccccctcctcccccgcccgttgaggagcctgttttcgatgagtctccaccgcctccccccccccctgaggactacgaagaagaagaggctgcagtggtcgagtactctgatccatatgccgaagaggaccctccctgggcccccaggagttaccttgagaaagtggtggcgatctacgattacaccaaggacaaggaggacgagcttagcttccaggagggggccatcatatatgtcataaagaaaaacgacgacgggtggtatgagggagtgatgaacggcgtgacagggctattcccaggcaactacgttgagagcatcatgcactattcggagtag

SEQ ID NO: 14189 - DNA, 1170 bp, Artificial Sequence
  Description of Artificial Sequence: Synthetic coding sequence
atgcccctggaaaatctcgaggaggaggggctgccaaagaacccagatctccgcatcgcccaactgagatttctgctctcattaccagagcataggggagacgcagcagttcgagatgagctaatggccgctgtgcgcgataataacatggcgccatattacgaggccctttgcaaaagtctcgattggcagattgatgttgacctgctcaataaaatgaagaaagcgaacgaagacgaacttaaacggctggacgaggagctggaggacgccgagaaaaatctgggtgaatcggaaattcgggacgccatgatggccaaggccgaatatttgtgccgaattggagataaagagggcgccctcacagccttcagaaaaacttacgacaaaaccgttgcccttggacatcgactcgatatcgtgttctatctgctgaggatcggactgttctacatggataacgatctaattactcgtaataccgagaaagccaagtccctgatcgaagaggggggggattgggaccggcgcaaccggctgaaggtttaccagggcttatattgcgtggccatccgggactttaaacaggccgcggaactgtttctcgataccgtttcaacttttaccagttacgagcttatggattacaaaaccttcgttacctacactgtgtatgtgtctatgatagctctggaacggcccgacctccgggaaaaggtgataaagggtgccgagatactggaagtgctgcattcgctcccggcagtccggcagtatcttttttctttatacgaatgccggtacagcgtttttttccaatctctggctgtagtcgagcaggagatgaagaaagactggttgtttgccccacactataggtactacgtgcgagaaatgaggatacatgcttattcccaactgctagaatcataccggtcactgacactcggctatatggctgaggctttcggcgtaggcgttgaatttattgaccaggaactaagtcggttcatcgctgccggaaggcttcattgcaagattgataaggttaatgagattgtggagacaaaccgccccgattctaagaactggcagtaccaggagaccatcaagaagggtgatctcctgttgaaccgcgtacagaaactgtcccgcgtcatcaatatgtag

SEQ ID NO: 14190 - DNA, 420 bp, Artificial Sequence
  Description of Artificial Sequence: Synthetic coding sequence
atggctaacattgctgtgcagcgtatcaaaagggaattcaaagaggtgctcaagagcgaagagacctctaaaaatcagatcaaagtcgacctcgtggatgagaatttcaccgagctgagaggtgagatcgcaggaccccccgatactccctacgaaggagggagataccagctggagattaagatccccgaaacctacccgttcaatcccccaaaatataagcagaatccagaaatgtttaagcagacggcccgattgtgggcacacgtctacgccggtgccccagtttctagtcctgaatacacaaagaaaattgagaatctctgcgccatgggcttcgaccgtaatgcggttatagtggcactcagcagcaagtcttgggacgtggagaccgccacagaactactgttgtcaaactag

SEQ ID NO: 14191 - DNA, 1203 bp, Artificial Sequence
  Description of Artificial Sequence: Synthetic coding sequence
atgaacttcacagtcgggtttaagccactcctcggagatgcacacagtatggataatctggagaaacagctcatttgtcccatttgcctcgaaatgttcagtaagccagtggtcattttgccatgtcagcacaacctgtgcagaaagtgcgcaaacgacgtgtttcaggccagcaacccactctggcaatcgagaggcagtacgactgtctcttccggaggaaggttccggtgtccaagctgcaggcacgaagtggtacttgatcgccacggagtttatggcttacagcgcaatcttctggttgagaacattattgatatctataaacaggaatcaagccgtccattgcactctaaggccgagcagcatctcatgtgcgaggaacatgaggaggagaagataaatatctattgccttagttgtgaggtccctacctgcagtctgtgtaaggtcttcggcgcccataaagattgcgaagtcgcccccttgcctactatctacaagaggcagaagaaacaggatctgaccttgcttccaaggctggaatgctctgggaccaacactacctattgttctttggaccttcctagttcctctgatccaccgattttggcatcacaaaataccaagatcatcgactcagaactgagcgatggaatcgcaatgctggttgccggcaatgatagggtgcaggctgtcatcacacagatggaggaagtgtgccaaacaattgaagacaactcacgtcggcagaaacagttgctgaatcaacgtttcgagagcctctgcgccgtgctcgaagagaggaaaggagaactgctccaggcactcgcccgggagcaagaggagaagttacagagagtccggggactgatccgccagtatggtgatcaccttgaggcttcctcaaagctcgtagagagtgccatacagtcaatggaagagcctcaaatggctctgtatctgcagcaagccaaagagctcataaacaaggtcggtgcaatgtccaaagtggagttagcgggacgcccggagcctggttatgagtccatggagcagtttacggtaagggtggagcatgtcgctgaaatgctgagaaccatcgacttccagcccggagcctctggggaggaagaggaggttgccccagatggtgaagagggctccgcaggacctgaggaggagcggcccgacgggccctag

SEQ ID NO: 14192 - DNA, 198 bp, Artificial Sequence
  Description of Artificial Sequence: Synthetic coding sequence
atgttcctttccgctgttttctttgcgaagagcaagtcaaagaacatcctggtcagaatggtgagtgaggccggtaccgggttctgcttcaataccaagagaaatcgcctgcgggagaagctgacactgctgcactacgatccagtagtgaagcagagagtcctgtttgtcgaaaagaagaagatacgcagcctttag

SEQ ID NO: 14193 - DNA, 2919 bp, Artificial Sequence
  Description of Artificial Sequence: Synthetic coding sequence
atgcggccagaaggagccggaatggagttagggggcggggaggagcgattacctgaggaatcaaggagagagcactggcagctgctggggaacctgaagactaccgttgagggcctggtgtctaccaactcccctaatgtatggtccaagtatggcggcttggaacggttgtgtcgcgacatgcagtctattttatatcatggtctgatcagggatcaggcctgccggcgacaaaccgactattggcagttcgtgaaggacattcgttggctgtctccacatagtgccctgcatgtggagaagttcatctccgtgcacgaaaatgaccagtccagcgccgatggcgccagcgagcgggcggtggctgagctttggcttcagcactccctgcagtaccactgtttgtctgcccagctgaggcctctgcttggtgatagacagtacatcagaaagttttatacagacgcagcattcttgttgtcggatgcacacgtcactgcaatgctccagtgtttggaggcagttgagcagaataacccaagactgttggctcaaattgacgcatcaatgtttgccaggaagcacgaatcccctctgctggtcaccaagtcccaatctttaactgccttaccctctagcacctacaccccccccaacagttatgcacagcactcctacttcggctccttcagttccctacaccaaagcgtgcccaacaacggctccgagaggaggtccacaagttttcctctgagcggtccacccagaaagccacaggagtctagaggacatgtctcccccgccgaggaccaaaccattcaggctccgcccgtcagcgtgtcagcactggccagggattctccactaactccaaatgagatgtcttcgtcaacgctgacttcaccaatagaggccagttgggtcagttcacaaaatgactctccgggcgatgccagcgagggccccgagtacctagccattggtaatcttgatccaagagggagaactgcgagctgccagtctcacagtagcaatgcagagagttctagctctaacctcttcagttccagtagctctcagaaacctgattctgcggccagctcgttaggagatcaggagggaggcggcgagagtcaactcagtagcgtcctgcggcgctcatctttctccgaaggtcaaaccctgacagtgacatctggcgctaagaaaagccacatccgcagccacagtgacacttctattgcgtcgcgcggagcaccagagtcatgtaatgacaaggcgaaattgcgaggccccctcccatatagcggacagagtagcgaagtatccaccccttcttctctttacatggagtacgagggaggccggtacctgtgttcgggcgaagggatgttcagaagacctagcgaaggtcagtccctcatctcttatctgtccgagcaggattttggttcatgtgccgacctggagaaagagaatgctcatttctcgatatctgagagcttgattgctgcaatagagctcatgaagtgcaatatgatgagccagtgtctggaagaggaggaggtggaagaggaggattcagacagggaaattcaggaactgaaacaaaaaatccgtctgcggcggcagcagatccggaccaagaacctactgccaatgtaccaggaggcagaacacggctcttttcgcgttacttcgtctagttcccagttcagctcccgcgattccgctcagctctccgattcaggttcagccgatgaggttgacgagttcgaaattcaagatgccgatattcgaagaaataccgccagctcaagcaagagtttcgtgagctcccagtctttctcacactgctttctgcatagcaccagcgctgaagccgtggccatgggtctgttgaagcagttcgaaggcatgcagctccctgctgcatcagagttggagtggctcgtcccagagcatgatgccccacagaagctcctcccaattcctgactctctgcccatctcaccagacgatgggcagcacgccgacatctacaagctgcggatacgggtgcgaggtaacctagagtgggctccacctcgcccacagatcattttcaatgtacaccccgctcccactaggaagattgcggttgcaaaacaaaactacagatgcgctgggtgcgggataaggacagaccccgactacatcaaaagactgcgttactgtgagtacttagggaagtatttttgtcaatgttgccatgagaatgcccagatggcaataccaagtagggttctcaggaagtgggacttcagtaagtattatgtgagcaacttcagtaaagatctgcttatcaaaatatggaacgaccccttgttcaacgtgcaggacatcaatagcgctttatacaggaaagtgaaattgctgaatcaagtccgcttgctcagggttcaattgtgccacatgaagaacatgttcaaaacctgccggttggcgaaggaattgctggattcgtttgacactgtgccaggccacctgaccgaagatctacatctgtattcccttaacgatctgacagctactagaaaaggagaattgggtcccaggctcgcggaattgacacgtgctggtgcaacccacgtcgagcgttgtatgctgtgccaagctaaggggtttatttgcgaattctgtcagaatgaggatgacattatttttccattcgaattacacaagtgtcgaacgtgtgaggaatgcaaagcctgttatcacaaggcttgtttcaaatcgggttcatgtccgaggtgtgaacgtctgcaggcaaggagagaggctctggcacggcagtcccttgagagctatctgtcagactacgaagaggagccagctgaagctctggcacttgaggccgcagtactggaggctacgtag

SEQ ID NO: 14194 - DNA, 1161 bp, Artificial Sequence
  Description of Artificial Sequence: Synthetic coding sequence
atggcagctgtggagaccagagtttgtgagacggacggctgctcctccgaagccaagttgcagtgcccaacatgtattaagcttggcattcagggatcatacttttgttcccaggagtgttttaagggctcctgggctacacacaaactgttacacaaaaaagctaaggatgaaaaagctaaacgagaggtgtccagttggaccgtggagggagatatcaataccgacccatgggcaggataccgctacaccggaaaactgagaccccattatcccctgatgccgaccaggcccgtcccttcgtacatacagagacctgattatgctgatcatccccttggcatgagcgagtcagagcaggccctcaaaggcacctctcaaatcaagctcctgtcctctgaggacatcgaaggcatgagactggtttgccgcctcgctcgcgaggtcctggatgtggctgccggaatgattaagcccggcgtgaccaccgaagagatcgaccatgcggtccacctggcctgtattgccagaaattgttacccatcaccgcttaactactacaattttcccaagagctgttgtaccagcgtgaatgaagtgatatgccatggtattccagataggcggcctttgcaggagggtgacatcgtaaacgtggacatcaccttgtaccgaaatggctatcacggagatctgaatgaaacgttctttgtcggtgaggtggacgacggcgcccggaagcttgtgcagactacttatgaatgtctgatgcaggctattgatgccgttaagccaggcgtgaggtatcgagaactcggtaacattatccagaaacacgctcaagcgaacggcttttcagtcgtgaggagttattgcggccacgggattcacaaactgttccacacagcacccaatgtccctcattacgccaagaacaaagccgtaggagttatgaagagcggtcacgtgttcaccattgagcccatgatctgtgagggtgggtggcaggatgagacttggccggatgggtggactgctgtaacccgcgatggcaagaggtcggcgcagtttgagcacaccctgttagtcacagacactggctgtgagattctgacacgcagattggactccgctcgtccccacttcatgagccagttctag

SEQ ID NO: 14195 - DNA, 738 bp, Artificial Sequence
  Description of Artificial Sequence: Synthetic coding sequence
atgggacgtctggatgggaaagtcattatactcacagctgcagcccaaggcatagggcaggctgcagccctggccttcgcccgagaaggggctaaggtcatcgcgaccgatatcaatgaatccaaactccaagagcttgagaaataccccgggatccagacccgcgtgcttgatgtgacaaaaaaaaaacaaattgaccaattcgcaaacgaggtcgagcggctggatgtcctgtttaatgtagcaggctttgtgcatcacggaacagtacttgactgcgaagaaaaagactgggatttcagcatgaaccttaacgtgcgctccatgtatctgatgataaaggctttcctccccaagatgcttgcccagaagagtggtaacattataaacatgagcagtgtcgcctcgagcgtcaagggggtcgttaacagatgtgtatacagcacaacgaaagctgccgtcattggcctcaccaaatctgtggcagcagatttcattcagcagggaataagatgcaattgtgtttgcccaggaaccgtggacaccccctccctgcaggagcggatacaggctcgaggcaatcccgaggaagcccgtaacgactttctgaagcgtcagaaaaccgggcgttttgctacagcagaggagatcgccatgctgtgtgtgtacctggcatctgacgagagtgcttatgtgactggcaaccccgttattatcgatggcggatggagcctgtag

SEQ ID NO: 14196 - DNA, 2520 bp, Artificial Sequence
  Description of Artificial Sequence: Synthetic coding sequence
atgagcgtcgtggggattgacttggggtttcttaattgttatatcgccgtggcccgctctggggggattgaaacaattgccaacgagtattccgatcgctgcacacctgcatgtatctctcttggatctcgcactagagccatcggcaatgccgctaaatcgcagatagtgaccaatgtcaggaacacaatccacgggttcaaaaagctgcacggtcgttcattcgacgacccaattgtccagactgaaaggatcagactcccttatgagctccagaaaatgcctaacgggtcagcaggggttaaggtgaggtacctagaggaggaaaggcccttcgcgatcgagcaagtcaccggcatgctcctggcaaaactaaaagagaccagcgagaacgcgctgaaaaaaccagttgcggactgcgttatctcaatcccctccttctttactgatgcagagaggcggtctgtgatggcagccgctcaagtcgccggccttaattgtctgagactgatgaacgaaaccaccgcagtagcactggcctatggcatctacaaacaggacctgcctcccctcgacgaaaagcccagaaatgttgtctttatcgatatgggccatagcgcctaccaggttctcgtatgtgccttcaacaagggtaagctgaaggtgctggctacgacatttgatccctaccttggggggcggaactttgacgaggcgcttgtggactacttttgcgacgagttcaagactaaatacaagattaacgtgaaagaaaacagccgtgccctgctgcggctgtatcaggagtgcgaaaaactgaagaagctcatgtcggctaatgcctctgacctgcctcttaatatcgaatgcttcatgaacgacctggacgtttccagcaaaatgaaccgggcccaatttgagcagctgtgcgctagtcttctggcacgagtcgagcccccattgaaagctgtgatggagcaggccaacctacagagagaagatatctcatcaattgaaatcgtaggcggagctacccgaatccctgcagttaaggagcagataactaagtttttcttaaaagatatttctaccaccctcaatgctgacgaagccgttgcccggggctgtgccctccagtgcgctattctgtctcccgccttcaaagtccgtgagttttcgataactgatcttgttccctattccataacactgcggtggaaaacaagctttgaggatgggtccggagagtgcgaagtcttttgcaaaaatcacccagctcccttttcaaaggtaatcacatttcacaagaaagaacccttcgagttggaggctttttacactaaccttcacgaagttccctatcccgatgccaggatcgggtcctttaccatacaaaacgtgttcccgcagagtgacggcgattcctccaaggtaaaggtgaaagtaagggtgaatatacatgggatcttttccgtcgcctccgcttcagtgattgaaaaacaaaacctcgagggcgatcattctgatgcgcccatggagactgagacctctttcaaaaatgaaaataaggacaacatggataagatgcaagtggatcaagaggagggccatcagaaatgtcatgcagagcataccccagaagaggagatagatcatacaggagccaaaactaagagtgccgtgtctgataaacaggatagactcaaccagaccttgaaaaaaggtaaggtgaagtccattgacctgcccatccaatctagcctgtgcaggcagttgggtcaggaccttttaaacagctacatcgaaaacgagggtaaaatgataatgcaggataagctcgaaaaggagagaaatgacgctaaaaacgctgtggaggagtacgtgtacgatttcagggatagactgggaaccgtctacgagaaattcattaccccagaggatctgtccaagttgtccgctgttctggaagacacggagaattggctgtatgaagacggtgaggatcagcctaagcaggtgtacgtggacaagctgcaggagcttaaaaaatacggccaacctatccagatgaagtacatggaacatgaggaacgccctaaagccttaaatgacttgggtaagaagatacaactagttatgaaggtgatcgaggcttatagaaacaaagatgagcgatacgaccatctggatccaactgagatggagaaagtggagaaatgcatctccgatgcgatgtcttggcttaatagcaagatgaatgcgcagaataagctttctctcacacaggatccagtggttaaagtgtcggaaatcgtggctaagagtaaggagctcgataatttttgtaacccaattatttacaagccaaaacccaaagcagaggtcccagaggacaagccgaaggccaacagcgaacacaacggtccaatggacggacagagcgggactgagactaagtccgacagcactaaggactctagtcagcatactaagtcctccggagagatggaagtagactag

SEQ ID NO: 14197 - DNA, 1224 bp, Artificial Sequence
  Description of Artificial Sequence: Synthetic coding sequence
atggctgcaccatgtgccgaggacccatccttggagagacacttcaagggtcaccgtgatgccgtgacttgcgtggactttagtataaacacaaagcagctggcctctggttccatggactcatgtctgatggtgtggcatatgaaaccacaaagcagggcttacagatttacaggccataaggacgctgttacatgcgtcaatttttctccttcaggacatctgctcgcttccggctccagggacaagacagtaagaatctgggtgcccaacgtaaagggcgaatctactgttttcagggcccataccgcaacggttagatccgtacacttctgttctgatggccaatcttttgtgacagcctccgatgacaaaactgtgaaggtctgggccacacataggcaaaagttcctcttttctctgtcccagcatatcaattgggttcggtgtgcgaagtttagcccggacggaagattaatcgtgagcgcttccgatgataagaccgtgaagctttgggataaaagcagcagagaatgcgtccactcttattgtgaacatgggggatttgtaacatacgttgatttccacccctctggcacctgtattgccgcggccggcatggataatacggtgaaggtatgggacgtccgtactcatcgacttctgcagcattatcaactgcacagcgcagcggttaacggattgagttttcacccttccggcaactacctgattaccgcatcatccgactctacactcaaaatcctggacctgatggaaggccgtctcctgtacacactacacggccaccagggtcctgccacaaccgtggcctttagtcgcacgggagaatacttcgctagcggcggatcagatgagcaggtcatggtttggaaatccaacttcgatatcgtggaccatggcgaggtgacaaaggttccgaggcctcccgcaaccctggcatcatctatgggtaacttgccagaagtggacttccctgtgccccccggaagaggaagaagtgtcgagagcgtgcagtcacagccacaggaaccagtcagtgttccccaaacactgacctccacccttgagcacatcgtgggacagctggacgtgctgactcagacagtctccattctcgaacaacgcctgaccctaactgaggataagcttaagcaatgcctggagaatcagcagctgattatgcagcgtgccacaccctag

SEQ ID NO: 14198 - DNA, 1173 bp, Artificial Sequence
  Description of Artificial Sequence: Synthetic coding sequence
atggcgaccggtgacctcaagcgctcactcagaaatcttgagcaggtgttacgcctgctgaactacccagaggaggtggactgcgttggccttatcaagggagaccccgctgcctccctgcccattatttcctattcattcacttcatacagtccgtacgtgacggaactgatcatggaatccaacgttgaactgattgccaaaaatgatctgcgcttcatagatgcagtgtacaaactcttacgagatcagtttaattataagcccattctgacaaagaagcagtttattcagtgtggcttcgccgagtggaaaatccagatagtgtgcgacatcctcaactgtgttatgaagaaacacaaagaactctcatcgctgcaaaaaatccctagtcagcagagaaaaaaaattagctccggaaaaagcgagcctcccctagggaacgagaagatatccgccgaggctgttggggtggacatctcaggtcgtttcatgacatcgggaaagaagaaagctgtcgtcatacgccacctgtacaatgaggacaatgttgatatttctgaggataccctctcccccatcacagatgtaaatgaggctgtggacgtctctgaccttaatgctactgaaatcaaaatgcccgaagtgaaggttccagaaattaaagcggagcagcaggacgttaatgtcaaccccgaaatcacagctttacagaccatgctggctgagtgtcaggaaaatctcaaaaaactgacttcaattgagaaacggttagactgcctggaacagaagatgaaaggaaaagtgatggtcgacgagaatacgtggaccaatctgctgagtagggttacccttttggagacggaaatgcttctgagcaagaaaaatgatgaattcattgagttcaatgaagttagcgaagactatgcctcttgttctgatatggacctcttgaaccctcatcggaaatcagaagtggaacgcccggcatcaattccactctcttcaggttactcaacggccagctccgatagcacaccaagagcctcaacagtgaattattgcgggctgaacgaaatatctgaggagacaactattcagaaaatggagaggatgaaaaagatgtttgaggagactgctgaattacttaaatgtcccaaccattatctctag

SEQ ID NO: 14199 - DNA, 2601 bp, Artificial Sequence
  Description of Artificial Sequence: Synthetic coding sequence
atgcccgccgtcagcttgccaccaaaagaaaatgccctttttaaacgcattctgaggtgttacgagcataaacagtatcggaacgggctgaagttctgcaaacagattctgtcaaaccctaagtttgccgaacacggggagaccttagccatgaaaggacttacacttaattgtcttggaaagaaggaggaagcttatgaactggtgcgcagaggcctgaggaatgatctgaaaagccacgtctgttggcacgtgtatggtttgctgcagcggtcggacaagaagtatgatgaggctatcaagtgctatcgaaacgcgctcaaatgggacaaagacaatctccagattctcagggatctcagcctcctgcagatacagatgagagaccttgagggctacagggagaccagataccagctgttgcagctgagacccgctcagagggcttcctggatcggatacgcgattgcttatcacctgctggaggactacgaaatggctgctaaaattcttgaggagttccgaaaaacccagcagaccagccccgacaaggtagactacgaatacagcgagcttctgctctaccagaaccaggtgctgagggaggctggtttgtacagagaagctctcgagcatctctgtacttatgaaaagcaaatctgcgacaagttggctgtagaagaaaccaagggagagttactactgcaactgtgtcgcttggaagacgccgcagacgtttacagagggttgcaggaacgaaatccagagaattgggcatactacaaaggcctggaaaaggcgctcaagcctgccaacatgctagagcgcctaaagatatacgaggaggcatggaccaaatacccgcgcggcctggtgccacggcgactccccctaaatttcctgtcgggggagaaatttaaggagtgcttagacaaatttctgcggatgaacttctcgaagggatgccccccggtctttaatactctcagatcactgtataaggacaaggagaaagtggccatcatcgaagaactcgttgtggggtacgagacatctctgaagtcttgccgtctctttaacccaaatgatgacggtaaggaggaaccccccaccacactgctgtgggtgcagtattatctcgcgcagcactacgataagattggacagccgtccatagccctcgaatatattaacactgcgatcgaatccacacctacactgatcgaattattcctggtgaaagccaagatttataagcacgccgggaatataaaggaagcagccagatggatggatgaggcccaggccctcgacacggccgaccggttcatcaattcaaaatgcgcaaaatacatgttgaaggctaatcttattaaggaagctgaggaaatgtgtagcaagtttactcgtgagggaacttcagcagtagagaacttaaatgaaatgcaatgtatgtggttccagactgaatgtgcccaagcctataaggctatgaacaagtttggagaggctcttaaaaaatgccacgaaatcgagaggcatttcatcgaaatcacagatgatcagttcgacttccatacctactgcatgcgtaagattactctccggagctatgttgacctgctgaaattggaagacgtgcttcgccagcaccccttctattttaaggcagcccggattgcgatcgagatttatctaaaactgcacgacaaccccctcaccgatgaaaacaaggaacacgaggccgacactgccaacatgtccgacaaggagctgaagaaactccgaaataagcagaggcgggcccagaagaaggcccaaatcgaggaggagaagaaaaatgcagaaaaggagaagcaacaaaggaatcaaaaaaagaaaaaggatgatgacgacgaggagataggcggtcccaaagaagagctgatccccgagaagctggctaaagtagagacaccactggaggaggcgatcaagttcctcacacccctcaaaaacctggtgaaaaacaaaattgaaacccatctcttcgctttcgaaatttatttcagaaaggagaaatttctcctcatgctgcagtcagtaaaacgcgcatttgccatcgatagctcgcatccctggcttcatgagtgtatgatcagactcttcaacactgctgtgtgtgaaagcaaggatctgtctgacacagtgaggacggtgctgaaacaggaaatgaacagactgttcggtgccacaaaccctaagaacttcaatgaaacattccttaagcgtaattcagacagcttaccccaccgtctgtcggctgcgaagatggtgtactacttggacccctcatcccagaagagggccatcgaactagcaaccacgctggatgaatccctcaccaaccgcaacctccagacctgcatggaggtcctcgaagctctgtatgacggatccttgggggactgtaaagaggccgcagaaatatacagggctaactgtcacaaactgttcccgtacgctctggctttcatgcctcccggatatgaagaggacatgaagattaccgtaaatggggactcctccgccgaagccgaagaactggccaacgagatttag

SEQ ID NO: 14200 - DNA, 1293 bp, Artificial Sequence
  Description of Artificial Sequence: Synthetic coding sequence
atggccagtagcgccaagagtgccgagatgccgaccatctccaagacagtgaatccgactccagatccacaccaagagtatcttgatccccgcatcacaattgccctgttcgaaattggtagtcacagcccgagcagttgggggtctctcccgtttctgaaaaattcaagccatcaagttaccgaacagcaaacagctcagaaattcaataatctcctgaaagaaataaaagacatcctgaaaaatatggccggtttcgaagaaaagattaccgaagccaaggagctgtttgaggagaccaatatcacagaggatgtttctgcacacaaggagaatattaggggtctagataagatcaatgaaatgctgagtactaacttacccgtgtccctggctcccgagaaagaagacaacgagaaaaagcaggagatgattctggagaccaacatcacggaggatgtctccgctcacaaggagaacattcggggcctggataaaattaacgagatgctgagcactaatctccctgtgagtctcgcccctgaaaaggaagataatgagaagaagcagcagatgataatggaaaaccagaactcagaaaataccgcccaggtgttcgcccgtgatctggtaaaccgattggaggagaaaaaagttctgaacgaaacacaacagtctcaggaaaaggccaagaacagactgaacgtgcaggaggaaacgatgaagatacgcaataacatggaacagttgttacaagaagccgaacattggagcaaacagcatacagagctgtcaaaacttatcaaatcctaccagaaatctcagaaggatattagcgaaactttggggaataatggggttggattccagacgcagccaaacaatgaggtctctgccaagcatgagctagaagagcaggtgaagaagctctcccacgacacatactccctgcagctgatggccgcactgctggagaatgagtgtcagatccttcaacaaagggtggagatccttaaggagctccaccaccagaagcagggcacgctgcaggaaaaaccgatccaaatcaactataaacaggacaagaagaatcagaagcctagtgaagcaaaaaaagtcgagatgtataagcagaacaagcaagcaatgaagggtaccttctggaaaaaggacaggagctgccgaagccttgatgtgtgcctgaacaagaaggcgtgcaacacccaatttaatatccatgtggctcgaaaggccctcagaggaaagatgagatctgcatcaagtctgcggtag

SEQ ID NO: 14201 - DNA, 5199 bp, Artificial Sequence
  Description of Artificial Sequence: Synthetic coding sequence
atggccgccatcggtcgcggacggagtctcaaaaacctgcgggtccggggtcgtaatgatagcggcgaggaaaatgtgcccctggatctgactcgagagccatcagacaacctgagagagatcctccagaacgttgccagacttcaaggggtatcaaacatgaggaagctaggccatctcaacaatttcactaaactcttgtgcgacattggtcatagcgaggaaaagcttggttttcattacgaggatattattatctgtctgcgtctggctctactgaacgaggccaaggaagttcgcgctgctggccttagagcattgaggtacctcatccaagacagtagcatcttgcagaaggtcctgaaactgaaggtggactacctcatcgcaagatgcatagacatccaacagtctaacgaggtggaaagaacccaggcccttcgcctggtgaggaagatgatcacagtgaacgcctcccttttcccatccagcgtgacaaattcacttatcgctgtcgggaatgacggactccaggagcgtgacagaatggttagggcttgcatcgccattatttgtgagcttgcgttgcagaacccagaggttgtggccctgaggggcggtttgaacaccatattgaagaacgtgatcgattgccaacttagccggataaacgaggcgttgataaccaccatcctccacctgctgaaccatccaaagacccgacagtacgtgcgagctgacgtggagcttgaaagaatactggcaccttacacagacttccactaccggcactcacccgacacagcggaggggcagctgaaggaagatagggaggcccgctttctggcatctaaaatgggcattatcgccacattcaggtcctgggctggtattatcaacctctgtaagcccggcaattccggcattcagtctctgattggtgtgctttgcattccgaatatggaaattcgccggggactactggaggtgctatatgatattttcaggctccctctacctgtcgtaaccgaggagttcattgaagccctgctctcagtggatcccggaagatttcaggattcatggcgtctgagcgacggattcgtcgccgctgaggctaagaccattcttcctcaccgcgcccgctctaggccggatctaatggataattatctggcccttattcttagtgctttcatcaggaacggcctgctggaaggcctggttgaggtcataacaaacagtgacgatcatatatccgttcgggcaaccatcctattgggcgagctgttacatatggctaatacaatactcccacattctcattctcatcatttacactgccttcctacgttgatgaacatggctgcaagttttgatatcccaaaagaaaaacgtcttcgagcaagtgcggccctcaactgtctaaaacggttccacgaaatgaagaagcggggcccaaaaccgtatagccttcacctggatcacatcatccagaaggcaatagcgacacatcagaaaagagatcaatatctgcgggtgcagaaagacatcttcatactgaaggatacagaggaagccctcctcattaatttgcgcgattcccaggtgctccaacataaagagaatctagagtggaactggaatctcatcggcaccatactaaaatggccgaatgtaaacctgaggaattacaaggatgagcagctccataggtttgttaggcgtctgttgtacttttacaagcccagttccaaactgtacgcaaacctggacctggacttcgccaaggctaagcagctcacagtggtcgggtgccagtttacagaattccttctcgagtccgaggaggacggtcaaggttacctcgaagacttagtgaaggacattgtgcaatggctcaacgcatcctctggtatgaaaccggaacggtcactgcaaaataacggtctcttaaccaccctgagccagcattattttctatttatcggcactctttcctgccacccgcacggcgttaaaatgctggaaaaatgcagcgtcttccagtgtttactcaacttatgctcgctgaagaatcaagatcacctgctgaaactcaccgtgtctagcctggattactctcgggatggactggccagagtgatcttgagtaagatactcaccgctgctaccgatgcctgcaggttgtatgcgacaaagcacctgcgcgtgcttctgcgtgccaacgtggagttcttcaacaactggggcattgagctactggtcactcagctacatgacaaaaacaagaccatcagtagtgaggcacttgacattctggacgaagcgtgcgaggacaaggccaatctgcatgctcttatccagatgaagccagctctttcccatctgggggacaagggtttactgctcctgctgagattcctcagcattccaaaaggattctcatatttgaacgagcgtggatatgtggccaagcagttggagaaatggcacagggagtataacagcaagtatgtcgatctgatagaggagcaactgaacgaagcccttactacctacagaaaacccgttgatggcgacaactacgtgaggcggtccaaccaacggctgcagcgtcctcacgtttatctccccatccacctctatggccagctcgtccatcacaaaactggctgtcacctgcttgaagttcagaacattatcacggagctctgtcgcaatgtgaggactcctgacctggacaagtgggaggagatcaaaaaactgaaagcttccctctgggccctgggaaatatcggctccagcaactggggtttaaatctcctgcaagaagagaacgtcattcctgacattcttaaacttgcaaagcagtgcgaagttttatccatccgaggcacgtgcgtatatgtgctcggcctgatcgcaaagacaaagcaaggctgcgacatactcaaatgtcataactgggatgccgtgaggcacagtagaaagcatctctggccggtagtccctgacgacgtcgaacagctgtgcaatgaactgagctccatccccagcacactgagtttgaattctgaaagcactagtagccgccacaactccgagagcgagtccgtgccttccagcatgttcatcctggaagacgacaggtttggcagtagttctacttccacgttctttctggacataaacgaagacaccgagcctactttttatgaccggagcggcccaattaaagataaaaattccttcccattttttgccagttctaaactggtgaagaataggatcctcaacagcctgaccctgccgaataaaaagcacaggagctctagcgatccgaaagggggcaagctgtccagtgagtcgaaaacttccaatcgcagaatcagaacattgacagagcccagcgtggactttaaccatagcgacgacttcacccccatttcaaccgtccagaagactctccaacttgagacttccttcatggggaataagcacatcgaggacacaggcagtacaccgtctatcggagaaaacgatctgaagttcactaagaatttcggtacagagaaccatagagaaaacacctccagggaacggctggtcgtagaaagttctacctcttcccacatgaagatccgctcccagagcttcaacactgacactacgacaagcggtatttcctcgatgtcaagctcccctagccgggaaactgtaggagttgatgcaacaactatggatacagattgcggctcaatgtctacggtcgtctcaacaaaaaccatcaagacaagccactatctgaccccacagtcgaatcacctgtccctgtctaagtcaaactccgtgtccttggttccgccaggatcaagccacaccctcccccggcgtgcacagtctcttaaggctccctctattgctacgatcaaaagtctggctgattgtaacttttcttatacctcttcccgagacgctttcggatacgccactctgaagcgacttcagcagcaaaggatgcatccatcattgtcccacagtgaggcgcttgcctccccggccaaggacgtgttgttcaccgacacgatcacaatgaaagccaatagcttcgaaagtcgactgactcctagccggattgactttaaaaagaagcacgttggtggcattagatcactgcgcccgacaatcaccaacaacctgtttcggttcatgaaggccttgtcatacgctagcctcgataaggaggacctactttctccgattaaccagaacaccttgcagaggagttcctccgtcaggtcaatggtatcgagcgcaacatacgggggtagcgacgattacatcggcttggccctgcccgtggatataaacgatatattccaggtgaaagatatcccatatttccagacgaagaacatccccccccacgatgacaggggagcccgggcattcgcacatgatgctggcggcctgccctctggcaccggcggtctggtcaaaaactcattccacctgctgcgacagcagatgagtctgactgaaatcatgaattcaatccatagtgacgcgagcctgtttctcgagtctactgaagacacaggactacaggaacacaccgacgacaattgtctgtattgtgtctgcatcgagattctgggctttcagccttcaaatcagctaagtgctatctgctcacactccgacttccaggatatcccatattccgattggtgcgaacagactatccacaatcctctggaagtcgtgcccagcaagttctcaggaatatctgggtgcagcgatggcgtaagccaggagggatccgcctcctccacgaagagtacggagctgctgctgggagtgaagaccatccccgatgataccccaatgtgccggattctgctccgcaaggaagtccttcgcctggtgataaacctcagctctagcgtctctacaaagtgccatgaaacaggcctgttgacgattaaagagaaatacccccaaacctttgatgacatctgtctgtactccgaagtgagtcacctcttatctcattgcacctttcgcctgccatgccgcagattcatacaggagttgtttcaggacgtccaattcctgcagatgcacgaggaagctgaagcggttctagcgaccccgcccaagcagcccattgtcgacacatcggccgagtcctag

SEQ ID NO: 14202 - DNA, 1761 bp, Artificial Sequence
  Description of Artificial Sequence: Synthetic coding sequence
atgagcgctaccgttgtggacgctgtgaacgccgccccgctaagtgggtccaaggagatgagcttagaagagccgaaaaagatgaccagggaggactggcggaagaaaaaagagttggaagaacagcgaaagttgggcaatgcacctgcagaagttgacgaggagggcaaagatataaatccgcatatcccccagtacatatctagcgttccatggtacattgatccatcaaagcgtcccactcttaagcaccagcgtcctcagcctgaaaagcagaagcaattctcatcatccggagaatggtacaagcgcggcgtgaaggaaaatagcatcataacaaagtatcgaaaaggtgcctgcgagaattgtggtgctatgacacacaagaaaaaggattgtttcgagcggccaagacgagttggggccaagtttaccgggaccaacatagcccccgatgaacacgtgcagcctcaactgatgtttgattacgatggcaagagggatagatggaacggatataatcccgaagaacatatgaagatagtggaggaatatgctaaagtggacttagctaagcgtaccctcaaggcccagaagctgcaagaggagttggcgtccggcaagttggttgagcaggctaattctcctaagcatcagtggggagaagaggaacccaatagtcagatggagaaagatcacaatagcgaggatgaggatgaggataaatatgcagacgatattgatatgccaggccagaattttgatagtaaaaggagaatcactgtgcgcaacttgcgcatcagagaagacatagctaaatatctgcggaacctcgatcctaattctgcatattatgatcctaaaacacgcgctatgagagagaatccatacgcaaatgcaggtaagaaccccgatgaggtaagttatgccggggacaacttcgtgaggtacacgggggatacaatctccatggcgcagacacagttgtttgcctgggaggcatatgacaaaggtagcgaggtgcacttacaagccgaccccacaaagttagaactgctctacaagtcttttaaagtcaaaaaagaggatttcaaggaacagcagaaggaatcaattctggaaaaatacgggggacaggaacacctggatgcacccccagcggagctgttgttagcacagaccgaagattacgtcgagtactctagacacggtacagtgatcaaaggtcaggaaagggccgtcgcctgttccaagtatgaggaagatgtgaagatccataaccatacccacatctggggcagctattggaaggaggggcgctggggctataagtgttgtcacagcttcttcaagtactcatactgcacaggtgaagccggtaaggagatcgtcaactccgaggagtgtatcataaatgagataactggtgaggaaagcgtgaagaagcctcagacccttatggagctacaccaggagaaactgaaagaggaaaagaaaaaaaagaaaaagaagaagaagaagcaccgaaagagcagcagtgatagtgatgatgaggaaaagaagcatgaaaagctcaaaaaggccttgaacgcagaagaggccaggttgctgcatgtgaaggagaccatgcaaatcgacgaaagaaagcgaccctacaatagcatgtatgagactcgggaaccaactgaggaggaaatggaggcctaccggatgaagcgacagaggcccgacgatccgatggcgagcttcctgggccagtag

SEQ ID NO: 14203 - DNA, 1185 bp, Artificial Sequence
  Description of Artificial Sequence: Synthetic coding sequence
atggccctggaagtgggagacatggaagatgggcagctgagcgattccgacagcgacatgaccgtggctccaagcgatcgtcccctgcaactgcctaaggtgctgggcggagacagcgcaatgcgagcattccagaatacagcaaccgcttgtgctcccgtgagccactaccgagcggtcgagagcgtcgatagtagtgaggagtccttttctgactcagatgacgactcatgcctatggaaacggaagagacaaaaatgctttaaccctccacctaagccggagcctttccaatttgggcagtcgagccaaaagccaccagtggctggtggtaaaaagataaacaacatctggggggctgttctgcaggaacagaatcaggatgcagttgcaactgaactaggcattctgggaatggaaggcacaatcgaccgtagccgacagtcagagacctacaattacttactggccaagaagctacggaaggagagccaggaacacaccaaggacctggataaggagctggacgaatacatgcacgggggaaaaaaaatggggtctaaggaagaggaaaacgggcaagggcacttgaaacggaagcgacctgtaaaggatagactcggcaataggcctgagatgaactacaaaggtaggtacgagataactgcagaggatagccaagagaaagtggcggacgagatttcattccgactacaggagcctaagaaagacctgattgcgagagtggtgagaatcattggcaacaaaaaagccattgagctacttatggagacagcagaggttgaacagaatggggggctgtttataatgaatggtagccgcaggagaactcccgggggagtttttttgaacctgcttaagaacacgcctagtatctcagaggagcagattaaggacatcttttatattgaaaatcagaaagaatacgagaataagaaagccgctaggaagcgtaggacacaggttcttggcaaaaaaatgaagcaagccattaagtctctcaactttcaggaggacgatgacacatctagggaaacttttgcttccgacaccaacgaggccctagcttctctagatgaaagccaagaaggccacgccgaggccaaacttgaggcagaagaagccattgaggtggaccattcccacgacttggacatcttctag

SEQ ID NO: 14204 - DNA, 789 bp, Artificial Sequence
  Description of Artificial Sequence: Synthetic coding sequence
atgttcctctttagtcggaagactcgtactcctatttcaacctatagcgatagctatagggctccgactagtatcaaagaggtctacaaggatccgcccctctgcgcatgggaggccaacaaattcctgacaccgggcctgacacacacaatggaacgccacgtggatcccgaggctcttcagaagatggccaagtgcgcggttcaagactacacatacagaggcagcatcagcggacacccttatctcccggagaaatattggctcagccaggaagaggccgataaatgcagtccaaattatctggggagcgactggtacaatacctggaggatggagccatacaactcaagctgctgcaacaaatacactacctatttacccaggctcccaaaagaggcccgcatggaaaccgctgtccgggggatgcctctcgagtgtcctccccgtccagagcgcctgaatgcttatgaacgcgaagtaatggtgaacatgctaaattcactgtcaagaaatcagcagctgcctaggattacaccgaggtgcgggtgcgtcgacccactaccaggtcggcttcctttccatggttatgagtctgcctgctccggtagacactactgcttgcgcgggatggattactatgccagcggggccccctgtactgataggcgcctcaggccgtggtgtcgcgaacagcccactatgtgtacctctctgcgtgcgcctgctcgaaatgcggtttgttgttataatagtcccgccgtgattttgcccataagtgaaccttag

SEQ ID NO: 14205 - DNA, 4206 bp, Artificial Sequence
  Description of Artificial Sequence: Synthetic coding sequence
atggaggagattcctgtgaaagtggccgttcggattcggcctcttctgtgcaaggaagccctgcacaatcatcaagtgtgtgtccgggtcatcccaaattctcagcaggtaattatcggacgcgaccgggtctttaccttcgactttgtattcggcaaaaattcgacacaggatgaggtgtataacacgtgcattaagcctcttgtgctttccttgattgaagggtacaatgcgactgtgttcgcctatggccagacagggagcggcaaaacgtacaccatcgggggagggcacatcgcttctgtggtggaaggtcaaaaagggattatcccacgggccatccaggagatatttcagagcattagtgaacacccgtcaatcgattttaatgtgaaggtcagttatattgaagtgtacaaggaagacctcagggacctcctggaactagagacatccatgaaagaccttcatattagagaggatgagaaagggaataccgtgattgtgggtgccaaagagtgccatgtcgaatctgccggggaggtgatgtcattgcttgagatgggaaatgcggcccggcacaccggaacaacccagatgaacgaacattcaagcagatcacatgcgatttttacaatcagcatatgtcaggtgcataagaacatggaggctgctgaggacggaagttggtactcacccagacatatcgtgtctaaattccatttcgtggacctcgccggaagcgagcgcgtgaccaagacagggaacaccggggaacgctttaaggagtcaatccaaattaactcgggcctcctggccctggggaacgtaatttctgccttaggcgatcctcgaaggaaatcctcccacataccctatagagatgctaaaataactagactcctgaaagatagcctcggaggtagcgctaaaaccgtgatgattacatgtgtatcaccaagcagttctaatttcgatgagagtctgaattctctgaagtacgctaatcgggccaggaatattagaaacaagccaacggtgaatttctcccccgagtctgataggatcgatgagatggaatttgagatcaagttgcttagagaggccttgcagtcccaacaagcgggcgtgtcccagaccacacagattaaccgagaaggctcccctgatacgaaccggatccacagcctcgaagaacaggtagcacagcttcagggggagtgcctgggctaccagtgttgtgtggaagaagcttttacctttctcgtcgatctaaaggatacggtcaggttaaatgagaagcagcagcataaactgcaggaatggttcaatatgatccaggaggtgcgcaaggcagtgctgacgtcgttccgaggaattggcggtacggcaagtttagaagaggggccccagcatgttaccgtgcttcagctaaaaagggaattaaaaaagtgccagtgtgtgttggctgccgatgaggtggtttttaaccagaaggaactcgaagtaaaagaactgaagaatcaagtccagatgatggtccaagaaaacaaaggacacgccgtctcactcaaggaggctcaaaaggtgaatcgccttcagaacgaaaagattatagagcagcagttactagtggaccaattgtctgaagaactgacaaaactgaatctttctgttacgagttcggccaaggaaaactgcggtgatggccctgatgcacggatcccagagagacgaccgtacacagttccctttgacacccatcttggccactatatatacataccttcccggcaagattcacggaaggttcatacctccccccccatgtactctcttgatcgcattttcgccggtttcaggacacgtagtcagatgctgctaggccatattgaagagcaggataaggtcttacattgccagttcagtgacaacagcgatgacgaagaatccgagggccaggagaagagcgggactcggtgccggtcaaggtcctggatacagaagcccgattctgtttgtagtctcgttgaactgagtgatacccaagatgagactcagaaatccgacctggagaatgaagatctgaaaattgattgccttcaggaaagccaagaactaaacctccagaaattaaagaattcagaacgcattctcaccgaagctaaacagaagatgcgagagctaacaattaacataaaaatgaaggaggacctcataaaagagctgattaagacaggcaacgacgccaagtccgtgtcaaagcagtattcgttgaaggtgaccaagttagagcacgatgccgagcaggccaaagtggagctcattgagacccagaagcagttacaggagctggagaataaagatttgtcagatgttgcgatgaaggtgaagctgcagaaggagtttcgcaagaaaatggatgcagcaaaactccgtgtccaggtgttgcagaagaagcagcaggacagcaaaaaacttgcctctctgtcgattcagaacgaaaagcgggccaacgaacttgaacaatctgttgatcatatgaagtaccagaaaatccagttacagaggaagctgcgcgaggaaaacgaaaaaaggaagcagctcgacgccgtcattaagagagaccaacagaagataaaggagattcagttgaagaccggccaggaagagggactcaagccgaaagccgaagacttagacgcttgcaatcttaaacgccgaaaagggtcatttggtagtatagatcacctgcagaagcttgacgaacagaaaaagtggctcgatgaagaggttgagaaggtacttaaccaaaggcaggagctcgaagaactggaagccgatttgaagaagagggaggctatagtcagtaagaaggaggccctgttgcaagaaaaaagccatctggagaacaaaaagctgcgctcttcccaggctttaaacactgattctcttaagatttcgacaaggctcaacctcttggaacaggagctgagtgagaaaaatgtgcagttgcaaacatcaaccgccgaggaaaagacaaagatttcggagcaggtggaggtcctacaaaaggagaaggaccagctgcagaagaggaggcacaatgttgatgaaaagctgaaaaacgggagggtgctgagtccagaggaagagcacgtattgtttcagctagaggaaggcatcgaggcactggaagccgcgatagaatacagaaatgaaagcatccaaaatcgccaaaagagcctccgcgcttctttccacaacctgagcaggggcgaagccaacgttctggagaagttggcatgtctgtcccctgtggaaatcaggacgatactcttccgttattttaataaggtggtcaatctccgggaggccgagagaaagcagcagctttacaatgaagagatgaagatgaaagtactggagcgcgacaatatggtacgcgagcttgagtctgccttggaccatctgaagcttcagtgtgatcggagactcaccctgcagcagaaggagcacgaacagaaaatgcagcttctcctgcaccattttaaggagcaggatggagaggggattatggagacctttaaaacctacgaggacaaaatccaacaattggagaaggatctgtacttctacaaaaagacctcaagagaccataagaaaaagttaaaggagctagttggcgaggcgatcaggcgccaacttgccccaagtgaatatcaagaggctggcgacggcgtcctgaagccagagggaggcgggatgctgtcagaggagctgaagtgggcttcaagacccgagtcgatgaaactaagtggcagagagagagagatggacagctctgcctcatctcttaggacccagcctaaccctcagaagctatgggaagatatacccgagttgccacccattcattcttccctcgcacccccatccggccacatgctgggcaacgaaaataagaccgagacagatgacaatcaatttactaagtctcattctaggctgagcagtcaaatccaagttgtaggcaacgtgggtcggctgcatggcgtgacccccgtgaagctctgcaggaaggaactgcggcagatctccgccctggaacttagtcttcgacgatcctcacttggagttggaattgggtcaatggctgccgattctattgaagtgtcgagaaagccacgtgacctgaaaacctag

SEQ ID NO: 14206 - DNA, 768 bp, Artificial Sequence
  Description of Artificial Sequence: Synthetic coding sequence
atggttaagggggagaagggacccaaggggaaaaaaatcaccctgaaggtcgccagaaactgtatcaaaataaccttcgacggaaagaagagactggacctttccaagatgggcataacaacattccctaagtgcatactcaggctaagcgatatggatgagctggatctgtcccgcaacctaattagaaaaattccggactccatttctaagtttcagaacctgcgatggctcgacctgcattccaactacatcgacaagctccccgagtctataggacagatgacaagccttctctacctgaatgtatctaacaacagattaaccagcaacggtctgccagtagagctcaagcagttaaagaatattagagccgtgaatcttggcctcaaccatctcgactctgttcctaccacccttggtgcactcaaggaacttcatgaggtggggctgcatgacaatctgctgaataacatcccagttagtatctctaagttgcctaagcttaagaagctgaacattaagcggaatccattccctaaacctggcgagagcgagatctttatcgattccattaggcgcctcgaaaacctctacgtggtcgaagaaaaagatctctgcgccgcgtgtctgagaaaatgtcagaacgcccgggataatctaaaccggataaaaaatatggccaccacaacaccccggaagaccatcttcccgaaccttataagtcccaattcaatggctaaggactcctgggaggactggaggtag

SEQ ID NO: 14207 - DNA, 645 bp, Artificial Sequence
  Description of Artificial Sequence: Synthetic coding sequence
atgggccgtcgtcccgccaggtgctacagatactgtaagaacaagccttaccctaaatctcggttctgtagaggggttcccgacgctaagatacgtatttttgaccttgggaggaaaaaggccaaggtggatgagtttccgctggggggccatatggtctctgatgagtatgagcagctgtcctccgaggcattggaggcagcccgtatctgtgctaataagtacatggtcaagagctgtggacgcgatggattccacatgagggtgagactgcatcccttccatgtgatcaggatcaacaaaatgctcagctgcgccggtgccgatcgactgcaaacaggcatgaggggagcctttggaaagccacaaggaaccgttgcaagggtgcacatcggccaggttattatgagcatacgcacaaaactgcagaacgaggaacacgttatcgaagctttgcgaagggcaaagtttaaatttccaggtaggcaaaagattcatataagtaaaaagtggggtttcacaaaattcaacgcagacgagttcgaagatatggtggcgaaaaagtgtctcatcccagacggatgcggggttaagtatgtgcccagccacgggcccctggacaagtggcgcgttctgcactcctag

SEQ ID NO: 14208 - DNA, 3231 bp, Artificial Sequence
  Description of Artificial Sequence: Synthetic coding sequence
atgaagtctagattttccactattgacctgagggctgttctggcagaattgaatgcttctttactggggatgagagttaataacgtgtacgatgtcgacaacaagacctacctgataagactgcagaagcccgacttcaaggcaactctgctgctggaatccggcatcaggattcataccacagagtttgagtggcctaagaatatgatgccttccagctttgccatgaagtgccggaagcatcttaagtcgaggagattagtgtccgccaagcagctgggtgttgatagaattgttgacttccagttcggatccgatgaggcagcctatcacctgattatcgagctgtacgacaggggcaacatagtgctgaccgattacgagtacgtcatcttaaacatactccggttcagaaccgatgaagccgatgacgttaaattcgcagtgagagaacgataccctctggaccacgccagagctgccgaacccctgctgaccttagagcggctgaccgaaatcgtggcctccgccccaaagggggaactcttgaagcgagtgttgaaccctctcctgccttacgggcccgcgcttatcgagcattgccttttggagaacggcttcagcgggaacgtgaaagtggacgaaaagctcgagaccaaggatatcgagaaggtgcttgtgagcctgcagaaggctgaggactatatgaagaccacatccaacttttccggaaaaggctatatcatacagaaaagagagatcaaaccttcattggaggctgacaaacctgtggaagacatactgacatatgaggaatttcatcctttcctgtttagtcagcactcccaatgcccctatatcgagttcgagagtttcgacaaggcggtcgatgaattctactctaagattgaggggcagaagattgacctgaaagccctccagcaggagaagcaggctctgaagaaactcgataacgtcagaaaagaccacgagaacagactggaagccttgcagcaggctcaggaaatcgataagctgaagggcgaactgatcgagatgaatctccagatcgtggatagagcaatccaggtggtccggagcgcgctggctaatcagattgattggacggaaatcggcttgattgttaaagaagcccaggcccagggtgatccggtggccagtgcaattaaagagctgaagttacagaccaaccacgtcactatgctcctccgcaatccgtaccttttgagcgaggaggaagatgacgacgtcgacggagatgtgaatgtcgagaagaacgaaacggagcccccaaagggtaagaagaaaaagcagaaaaataaacaactccagaagccgcagaaaaacaaacctctactggtggatgtggatctgtcactttccgcctacgcgaacgcgaagaagtactatgaccacaagcggtacgccgcaaagaaaacccagaaaacggtcgaagcagctgagaaagcttttaaatcagcagagaagaaaaccaagcagacattgaaagaagtccagacagtcacatccatccagaaagctaggaaagtctactggtttgaaaagtttttgtggttcataagctcagaaaattacttgattattggcggtcgggatcagcagcagaatgaaataatcgtgaagcggtaccttacaccgggtgacatctacgtgcatgccgatctacatggggccacctcttgcgtgataaaaaatcctacaggggaacccatccccccccgcactcttactgaggcgggtactatggcattgtgttacagcgctgcctgggacgcaagggtgataaccagcgcatggtgggtgtaccaccaccaggtgtccaagaccgccccaacgggcgagtatcttaccacaggcagctttatgattcgagggaagaaaaattttctgcccccatcctacctcatgatggggttctcctttctctttaaggtggacgaatcttgtgtgtggcggcaccaaggagaaaggaaggtgagagtgcaggatgaagacatggagaccttggcttcgtgcacatcagagctgatttcggaggagatggagcagttggatggaggggacacttctagtgatgaggacaaggaagagcatgaaactccagtggaagtcgagttgatgacccaggtcgatcaggaagacattacactgcagagcggcagggatgaactgaatgaggagctaattcaggaagaatcctccgaagatgaaggagagtacgaagaggtcagaaaagaccaggacagcgtgggagaaatgaaggacgagggagaagaaacacttaattatcccgatacaaccatcgatctttcccaccttcagccacagagaagtatccagaagcttgctagtaaagaggagtcatccaactcctctgattctaaaagccaaagccgcagacatctgtctgcgaaggagaggcgggaaatgaagaagaagaagctgccaagtgactcaggggacctggaggcactggagggaaaagacaaggaaaaagagtcaactgttcacatcgaaacacaccaaaatacttccaagaatgtcgcagccgtacaacccatgaaaaggggccaaaagtctaaaatgaagaaaatgaaggagaaatacaaagatcaggatgaggaagatagagagctgatcatgaagctcctgggaagtgcaggtagtaacaaagaagagaagggaaaaaagggcaagaagggcaagacgaaagatgagcccgtcaagaagcagccccagaagcccagaggaggtcagagggtcagcgacaatatcaagaaagagacaccattcctcgaagtgatcacacacgaactgcaggacttcgcagtggacgatcctcacgatgataaggaagagcaggacctggatcagcaggggaacgaggaaaacctctttgacagccttacggggcaaccccatccagaagacgtgctgttgttcgcgatccccatttgtgccccctacacaacaatgacaaactacaagtacaaggttaaactgacacccggtgtacagaaaaagggcaaagcggctaaaactgcgttaaattctttcatgcactcaaaggaagccacagccagggagaaggatttgttcaggagtgtcaaagatacggacctttcacgtaatataccagggaaggtcaaagtgagtgcaccaaatctcctgaatgtcaaaagaaagtag

SEQ ID NO: 14209 - DNA, 963 bp, Artificial Sequence
  Description of Artificial Sequence: Synthetic coding sequence
atgggggacattcctgcggtggggctctcttcatggaaggcttccccaggcaaagtgaccgaggcagtgaaagaggccattgacgcaggctatcggcattttgactgtgcttatttttatcataacgaacgagaggtgggagcgggtattaggtgtaaaattaaagaaggagcagtaaggcgcgaagacctctttatagctactaaattatggtgcacttgccacaagaagtctttggtggagacggcctgtaggaaaagcttgaaggccctgaagctaaactacctggatctgtaccttattcattggccaatgggcttcaagccacctcatcctgagtggattatgtcctgttcagagctctctttctgcttatcccacccgcgagttcaagatcttcctctggatgagagtaatatggttatcccgtctgacacagactttctcgacacttgggaagccatggaagacctcgtgatcacaggcctggtgaagaacattggtgtgtcaaactttaatcacgaacagctggagcgcctgctgaacaaacccggcctgcgtttcaaaccactgactaaccaaattgaatgtcatccttacctgacccagaagaacctgatcagcttttgccagagccgggatgtttctgtgacagcttacaggcccttgggcggcagttgtgagggcgtggacctgatcgataaccccgtcattaagcgaatagcaaaggagcacggaaagtctcctgcccagattctgatccgcttccagatacagaggaacgtcatcgttattcctggtagcatcactccttcccacattaaagaaaacattcaagtgtttgatttcgagttgactcagcacgatatggacaacatcctttcattgaatcggaatctccgcctggctatgttcccaattaccaagaaccataaggattatccgtttcatattgagtactag

SEQ ID NO: 14210 - DNA, 1239 bp, Artificial Sequence
  Description of Artificial Sequence: Synthetic coding sequence
atgtctgggtaccaaaggaggcctggagccacgcctctgagtagagctcgctctctagctatccctgatgcccctgcgttctacgaacgccgatcctgcctaccccagctcaactgtgaaaggccccacgggagagacctcgactccccattttttgggattcgccccgcgtttatgtgctatgtgccgtcccccgtcctggcttccgtaggcgacactgatgacagatttgaggacttggaagaggcgaaccccttctcctttagagaattcctcaaaaccaagaatctcggactctcaaaagaagaccctgccagtcgtatatacgccaaagaggccagcaggcacagtttaggcctggaccacaatagtccccccagccaaaccggaggttacggacttgagtaccaacaaccattcttcgaagaccccaccggcgccggtgatcttctcgatgaggaagaggatgaggatacaggatggagtggcgcatatctcccatctgccattgagcagacgcatccggaacgagtgcccgccggcacctcaccctgcagcacttacttgtccttcttctctacgccgagcgaattggccggtccagagtcccttccatcctgggccctctccgacactgattctcgggtaagtcctgcaagtcctgccggatcacccagcgcggacttcgcggtccacggcgagagccttggagaccgacatctgcggacacttcagataagttacgatgcactgaaagatgagaactccaaattgagaagaaaattgaacgaggttcagagcttctctgaagcccaaactgagatggttagaaccctcgaacgaaagctggaagcgaagatgataaaggaagaatccgactatcacgatcttgaatccgtggtgcagcaagtggaacagaacctagagctcatgacaaaacgcgccgtcaaagccgagaaccacgtggtcaagttgaagcaagagattagcttactgcaggcacaggtgagtaattttcagcgcgaaaacgaagctttgagatgcggacagggcgcctcccttaccgtagttaagcagaacgcagatgtggcgctccagaacctcagagtggttatgaattcagcgcaggcctctattaagcaactggtgagcggcgcggaaactctgaatctggttgccgagatacttaagagcatagatcgtatctccgaggtgaaagatgaagaggaggactcgtag

SEQ ID NO: 14211 - DNA, 1440 bp, Artificial Sequence
  Description of Artificial Sequence: Synthetic coding sequence
atggatgcgaccattgctcctcatcggataccgccggagatgcctcagtatggggaggagaaccacatcttcgaactgatgcaaaatatgctggaacagcttctgatccaccagcctgaggaccctatcccctttatgatacagcatctgcatagggacaatgacaacgtaccccggattgtgatacttggtcctcctgcatctgggaaaactacaattgctatgtggctgtgtaagcacctgaactccagtctgcttacgttagaaaatctgatcctgaacgaattttcctacaccgccaccgaggcacgccgcctctacctgcaacggaaaaccgtgccaagcgctctgctggtccagttaatacaggaaaggttggctgaggaggactgcattaaacagggatggatcctcgatggaattcctgagacccgcgagcaggcccttaggatccagaccctcggaataacaccacgccatgtgattgttctgagcgccccagataccgtgctgatagaacgaaacctcggaaagagaattgatccccagacaggagaaatttaccatacaactttcgactggcctcctgagtccgaaatccaaaacaggctgatggtccctgaagatatcagtgagttagaaaccgcccagaagctgttggagtatcatcgaaacatcgtaagagtgatcccttcataccctaaaatcctcaaggtgatttccgccgatcagccgtgtgtggatgtgttctaccaggcactcacctatgtgcagtccaaccatagaaccaacgcaccattcacaccacgcgtactgctgttggggccagtcgggagtggcaaaagtcttcaggctgcccttcttgctcaaaagtatcggctagtcaacgtctgctgcggacagctattgaaagaggccgtggccgataggaccacatttggagaactaatccaaccttttttcgaaaaggagatggcagtgcctgattcactactgatgaaagtgctcagccaacgtctcgatcagcaggattgtatccagaagggctgggtgctgcatggcgttccgcgagacctcgaccaggcccacttgctcaacaggcttggttacaatccgaatcgagtgttcttccttaacgtgccgtttgacagtataatggaacggctgactctcagaaggattgatccagtgacaggtgagcgataccaccttatgtataagcccccacccaccatggagattcaagccagacttctacagaatcctaaagatgcagaagagcaggtcaagttgaaaatggatttattctacaggaacagcgcagatttggaacagctttacggctctgcgattacacttaatggagatcaggacccatatactgtcttcgagtacattgagagtggtatcattaatcccctgcctaagaaaatcccttag

SEQ ID NO: 14212 - DNA, 432 bp, Artificial Sequence
  Description of Artificial Sequence: Synthetic coding sequence
atggcacacgagatgatcggtactcaaatcgtcacggagcgcctggtagccttgctcgagagcggaactgaaaaagttctgctgatcgatagtcgaccatttgtcgagtacaataccagtcacattctcgaagcaatcaatatcaattgttcaaagctgatgaagaggaggctccagcaggataaagtgctgataaccgaacttattcagcactccgccaagcataaagtagatattgattgcagccagaaggtcgtcgtctacgatcagagttcgcaggatgtggcctccctcagttccgactgttttttgactgtacttttggggaagttggaaaaatcattcaatagcgtgcaccttcttgccggtgccgatgcagccgaatgggattggctgtgcgtgaagtgccagcagtatctgtccaaagcttag

SEQ ID NO: 14213 - DNA, 1191 bp, Artificial Sequence
  Description of Artificial Sequence: Synthetic coding sequence
atggctagcctctccagagccctacgggtagcagcagcacatccacgtcagagccctacacggggtatgggcccgtgcaatcttagctcagcagccggacctacagccgaaaagtctgtcccctatcaacggactctcaaggaaggccagggtacaagcgtggtggcccagggtccaagtagacctctcccttctacagcaaatgtggtggtcatcggcggcggatcacttggctgtcagacactctatcacttggcaaagctcggaatgtctggcgccgttctgctcgagcgggagagactcacttccggaaccacctggcacaccgctggcctcctctggcagctgcgcccaagtgacgtggaggtggagctgctcgcccacactcgccgagtggtctccagagagttggaggaggaaacaggtttgcatacaggatggattcaaaacggagggttatttatcgcttctaacagacagcggctagatgagtacaaacgcctgatgtcactgggaaaagcttacggtgtggagtcccatgttctgagccccgcagaaaccaagactttatacccattgatgaacgtggacgatctgtacggtaccctgtatgtcccacacgacgggaccatggacccggcaggcacatgtaccacactcgctagggctgcttctgccaggggggcccaagtgattgaaaactgccccgtgacaggcattagggtctggaccgatgatttcggcgtgaggcgcgtcgcgggggtggagacccagcatggttccatacaaactccttgcgttgtcaactgtgcaggcgtgtgggcctcagctgtcgggagaatggcaggcgtcaaggtcccccttgtggctatgcaccacgcctacgttgtgacggagcggatcgagggcatacagagcttcaccctgttgcctacactggaatactccggtactgtctccgcccactgtaacttgagactcccagggagctctaattcaagagcttcagcttcccacgttgcgggaatcaaatgcgctaggcaccacactcgcttaatcttcttctgtatccttgtggagactgagttccaccacgtggccaaggcaggcctggaactcctgtcttccgggaacccacccatcagcgatttccaatcagctaggatcaccggagtgagccaccatgcttag

SEQ ID NO: 14214 - DNA, 4416 bp, Artificial Sequence
  Description of Artificial Sequence: Synthetic coding sequence
atggagcccgagccggtggaggattgtgttcagagtacccttgccgcgctgtatcctccatttgaagcaacagctccaacgctcctagggcaggtgttccaagtcgtggagaggacatatcgggaggatgctctgagatacaccctcgacttcctggtccctgccaaacatttgttagcaaaagtccaacaggaagcctgcgcccaatatagtggcttcttgttcttccatgaaggttggccactgtgcctgcacgaacaggtcgtcgtgcagttggctgctcttccatggcagctactccgccccggcgacttttatttgcaggtggtgcccagtgctgcacaggccccaaggctggccctaaaatgtcttgcacctggtggaggccgggtccaggaggtccccgttcctaacgaggcctgcgcttacctgttcacacctgaatggttgcagggcatcaacaaagataggcccaccggccgactgtccacctgtctcctgtcggccccttcagggattcaaagactgccttgggcagagctgatttgccctagatttgtgcataaggaagggctcatggtggggcaccagccaagtactctgccaccagaactgccaagcgggcctccaggactgccaagccctcctctgcccgaagaggccttaggaactcgctcaccaggtgacggacacaacgcaccagtagagggcccggaaggcgagtacgtcgaactgctcgaggtgacactgcctgtccgcgggagcccaacagatgcggaaggaagcccaggtctgtcgagggtgcgtacagtaccaacacgaaagggcgccggcggtaagggaaggcaccgtcggcaccgggcttggatgcaccagaagggccttggcccgcgtggccaggacggcgcacgacccccaggagaagggagctctacaggggccagtcccgaatcccctccaggtgccgaggccgttccagaagcagctgtactggaggtttctgagccccctgcagaggccgtgggggaagcctccggctcctgtcccctccgacctggcgaactgcggggtggggggggggggggacagggcgccgagggcccacccggcacacccagaaggacaggcaaggggaatcggagaaaaaaacgggcagctggccgtggcgccctttcccgtggcggagactctgcgccactgtcccctggcgacaaggaggacgcttcccaccaagaagcccttgggaatctgccctctccctctgagcataaattaccggagtgtcacctggtgaaggaggaatacgaaggctccgggaagcctgagtctgaaccaaaagagctcaaaactgcaggggagaaagagccgcagttatcagaggcttgcggcccaaccgaagagggggccggcgagcgagaactagaagggcccggactcttatgcatggcaggtcatacaggacccgagggtcccctgagtgatacaccaacgccacccctcgagactgtgcaagaagggaagggcgataatataccagaagaagccttagccgtgtctgtgtccgatcaccccgatgtggcatgggacctcatggcatcgggtttccttatattgactgggggggttgaccagagcggcagagctcttctgactataaccccaccatgtcctcccgaggagccaccaccctcccgggacacactgaatactactttgcactaccttcattcattgctccggcccgaccttcaaactctgggtctgagcgtgctcctggacctccggcaggccccccctttaccacccgctctcatcccagccctgtcccagcttcaggactcaggggaccctcccctggttcagcgtcttctgattctgatccacgacgatctgcccactgaactgtgtgggtttcagggggcagaggtgctttccgaaaacgacctgaaaagggttgccaagccagaggagcttcaatgggaactcggggggcacagagatccttcacccagtcactgggtggagatccaccaggaagtggtccggttgtgtagactgtgccaaggagtgctcggatctgttaggcaagccattgaggaactggagggcgccgctgagcccgaagaggaggaggccgtcggcatgccaaaacccctccagaaagtcctcgctgaccctagactgacagcactgcagagagatggcggtgccatcctaatgcgcctgaggtctaccccgagctccaagctcgaaggacagggcccagccactctctatcaggaggttgatgaagcaattcaccagctggttcgactctccaatttgcacgtacagcagcaggaacaacgacagtgcctccgccgactgcagcaggtgttgcagtggctttcagggcccggtgaggaacaattggctagttttgcgatgccgggggataccctctccgctctgcaggaaacagaactaagatttcgcgccttttcagccgaagtgcaggagcgactggcacaggccagggaagcgctggcactggaggaaaacgccacttctcagaaggttctggatatctttgagcagaggctcgaacaggtggagagtggattacacagagccctgagattacagaggttttttcagcaggcacacgaatgggtggacgagggttttgcgcggctggccggcgccggaccaggcagagaagcagtactggctgccctcgccctcagaagagctcccgagccctccgcaggaactttccaggaaatgagagctttggctctggacctcggctccccagccgccttgcgtgaatggggtcgatgtcaggcgagatgtcaggagcttgaacgcagaattcagcagcacgttggggaggaagctagccctcgaggttacagaaggaggcgtgcggacggggcatcaagcggaggcgcccagtgggggcctaggtctcctagcccaagcctgagctccctcttgttacctagtagcccaggccctcggccagctcccagccattgttctctggcaccctgcggtgaggactatgaagaagagggcccagaactggctccagaagccgaaggacgaccacccagggctgtgttgattcgcggtctggaagtgacaagtacggaggtggttgatagaacatgctctcctcgggaacacgtccttctgggacgcgcccgcggtcccgacggcccgtggggggtcggaaccccaagaatggagagaaagaggagcattagtgcacagcagagactcgtgtccgaattaattgcctgtgagcaagactacgttgcaaccctctctgagcctgtgcccccgcccggccctgaactgaccccagagctgaggggaacatgggcagccgcgctctccgcgagagaacggttgcgcagcttccatcggacacacttcctcagagaactccaagggtgcgctacccacccacttcgcattggcgcttgctttttgaggcacggagatcagttctccctctacgcacagtatgtcaagcaccgacataaactcgagaatggcctggcagccctgagtcctttgtctaagggaagcatggaagctgggccctacctgccacgggctctccagcagccgctcgagcagctgacccgctacggacgattgctggaggaactcctgagagaagctggtcccgagctgagcagtgaatgcagggcactgggcgcagctgttcagctccttcgagaacaggaggccagaggccgtgacctccttgctgtggaagcggtgagagggtgcgagatagacctgaaagagcaaggtcagttgctacacagagatccttttaccgtcatctgcggccgaaagaagtgcctaagacacgtcttcctcttcgagcatcttctgctgttcagcaaactgaagggaccagaggggggttccgagatgttcgtgtataaacaggcattcaagaccgccgacatgggcttaacagagaacattggagacagtggcttatgcttcgaactctggttcaggcggcgcagagctagagaggcctacaccctgcaggccacttcccccgaaatcaaactcaagtggacttcctcaatagcacaactcctgtggcggcaagccgctcataacaaggagctgagggtccagcaaatggtgagtatggggatcggaaataagccatttcttgatattaaggcactgggggagcgtactctaagcgcgctcctgaccggaagagcaccggagactttagactcctctggggatgtgagccccgggcccagaaattccccgtctcttcaaccgccccaccctgggtcgagcacgcccactttggcttcaaggggtattctcggccttagtcgacagtcccatgcacgagctctgtccgatcctactacacccctgtag

SEQ ID NO: 14215 - DNA, 4560 bp, Artificial Sequence
  Description of Artificial Sequence: Synthetic coding sequence
atggagccagaaccagtcgaggattgcgtccagtcgaccctggccgctctgtacccacccttcgaagccactgccccaaccctgctgggtcaagtattccaagtggtggagcgaacatacagagaggatgctctcaggtatacgttggacttcttagtacccgcaaaacatcttctggccaaagttcagcaggaagcatgtgctcagtacagtggattcttgttttttcacgagggctggcctctgtgcctgcacgagcaggttgtcgttcagttggccgccctgccctggcagctccttcgccccggggacttctatctgcaagttgtaccttcggctgctcaggcaccacggctggcactgaagtgtctggcccccggaggaggcagggtgcaggaggtgccagtcccaaacgaagcttgcgcgtacttattcacaccagagtggctgcaagggattaacaaggatcgaccaacggggaggctgtcaacatgtttgctctctgcaccctcaggaattcagcgcctgccctgggcagaactgatctgtcccaggttcgttcacaaagaagggctgatggtcggtcaccagccgagcaccctgccccctgagctacccagcggccctcctgggttgcctagccctcctctccccgaggaggctctcggaacaagaagccctggcgacggccacaacgccccagtagagggcccagagggggagtacgtggaactccttgaagtaaccctccccgtcaggggatccccaacagacgccgaggggtcacccggactgtccagagtcagaactgtgcctactagaaagggcgccggtggtaaaggccgtcatagacgacatcgtgcatggatgcatcagaaagggctgggcccacgaggtcaagatggagctcgaccccctggtgaagggagttccacaggtgcctcacctgaatcacccccaggcgccgaagctgtgcccgaagccgcggtgctggaggtgtcagagcctcctgctgaagccgtgggagaagcctcggggagttgcccacttagaccgggagaactccggggcggcggggggggaggacagggagctgagggaccaccagggactcccaggcgaacagggaaaggaaacaggagaaagaagagggctgccgggcgcggggcattgtcaagagggggggacagtgccccactatctcccggcgataaggaagatgcctctcatcaggaggctttagggaacctgccctcaccaagcgaacacaagctgccagaatgtcacctggtgaaggaggagtatgaagggagcggtaaaccggaaagcgagcctaaagagctgaaaactgcaggcgagaaggagcctcagctgtctgaggcctgcggaccaacagaagagggagctggtgagagggagctagaggggccagggctgttgtgcatggcgggccacaccgggcccgaaggccccttgtccgacaccccaactcctcctctggagaccgtgcaagagggcaaaggggataatattcctgaagaggctttggctgtgtctgttagtgatcatcctgacgtggcctgggatctgatggcttcggggtttctgatattgacaggcggggtcgatcaatctggtcgggcgctgctgaccatcacccccccatgcccccctgaggaacccccccctagccgggatacgctcaatacaaccttgcactatctgcattctcttcttagacctgacctgcagactctaggcctcagcgttctgctagacctgagacaagcccccccactcccccccgcccttatccccgcattgagccagctccaggatagcggtgatcctccccttgtgcagcgcctgttgattctaattcatgacgatcttcctaccgaactctgtgggtttcagggggcagaggtgttaagtgagaacgacttgaagagagttgccaagccggaggaactgcagtgggagttaggggggcacagggatccctcacccagccactgggtggaaatccaccaggaagtcgttcggttgtgtcgtctctgtcagggagtgttagggagcgttaggcaggctatagaagaactagagggggctgccgagccagaagaggaggaggctgtcggtatgcctaaaccactgcagaaagtgctggctgatccaaggctcaccgccctgcaacgagacggcggggccatactgatgcgtctaagatccacaccatcgtcaaagctggagggccaagggcccgcaactctctaccaggaggtcgacgaggctattcatcagttggtgaggctgtctaacctgcatgttcagcagcaggaacagaggcagtgtttgcgtagactccagcaggtactgcagtggctgagtggtcctggagaggaacagctggcatcctttgcaatgcccggagacaccctgtccgcgctccaggagaccgagctgcgatttcgggcgtttagcgctgaggttcaggagcgcctagctcaggctcgagaggccttggctctggaggaaaatgcaacgtcacagaaggtgctggacatattcgaacagaggctcgagcaggtggagagcggcttgcatcgggcattacgcctccaacgcttcttccagcaggcacacgaatgggtcgatgaaggttttgctcgactggctggcgcaggcccagggagagaggccgtgctagccgccctagctcttcggagagctcccgagccctccgccggcacctttcaggagatgcgagcactcgccctcgatctgggcagccccgcggcgctcagggagtggggaagatgccaggcaaggtgccaggaacttgaacggcggatccagcaacatgtgggcgaggaagcctccccccgcggttatcgccgacggcgcgcagatggcgccagctctggaggagcgcagtggggtccccgtagtccatcaccatctttgtcttcactcctgctgcccagttctcccggcccaaggcctgccccaagtcattgctctctagctccttgtggcgaggattatgaagaagagggcccagaactggcaccggaggcagaagggaggccccccagggcagtgttgatacggggcttggaagttacctccacagaggtcgtggaccgaacttgcagtccaagggagcacgtgctgctcgggcgcgctcggggcccagacggcccctggggcgtgggtacacccaggatggagaggaagcggagtatatctgcacagcaaaggctcgtcagtgaactgattgcatgtgagcaggactacgtggccactctcagcgaaccagtgcccccgcccggcccagaactcaccccagaactgagaggcacgtgggcagccgccctttcagcccgggagcggctgcgctcattccacaggactcattttttaagggaactgcagggatgtgccacccatcccctgagaattggcgcatgtttcctcagacatggagaccagttctcgttgtatgcacagtacgttaagcatcgccataaactcgagaacggcctggccgctctcagccctctgtccaaaggctctatggaggccgggccctatctgccccgagcactgcaacagcccctcgaacagctgaccaggtacggtcgtcttctcgaagaacttctgagagaagctggacctgaactgtcaagtgagtgccgggcactgggggccgccgtacagctattaagggaacaggaggcccggggccgggacttgttggctgtggaggctgtgagagggtgtgaaatcgacctcaaggagcagggccaactccttcatagagatcccttcaccgtgatatgtgggagaaaaaaatgtcttcgccacgtctttctattcgaacacctcctattattctctaagctcaaaggcccagaaggcggctccgagatgtttgtgtacaagcaggcctttaaaacagccgacatgggattgaccgaaaatatcggagatagcggcctttgcttcgagctgtggtttcgcaggcggagagctcgagaagcatatactcttcaggccacttctccggagatcaagctgaaatggaccagctccatagcccagcttctctggagacaagccgcgcacaataaagaactgcgcgtacagcagatggtgagcatggggatcggcaacaaaccttttttggatattaaggctcttggagaacggacattgtctgccctgcttaccggcagagctgctagaacaagagctagtgtcgctgtctctagctttgagcacgccggaccatcgctgcccggtcttagccctggcgcttgttccctccccgcccgggtggaggaggaagcctgggatctggatgttaaacagatctcactcgctcccgaaaccttggactccagcggggacgtgagccctggcccccgcaactcccccagcttgcaaccaccacacccagggagttctactccaactctggcaagccgggggattctggggcttagtcgtcagagccacgcacgcgcgctgtctgatcccaccactcccctgtag

SEQ ID NO: 14216 - DNA, 2709 bp, Artificial Sequence
  Description of Artificial Sequence: Synthetic coding sequence
atgtttcctgccctggagacccacttgaagcagactatcccagatccctatgaagatttcatgtatcgccacctccagtattacgggtattttaaggctcagaggggcagcttaccgaactccgccacccaccagcacgtgcggaagaataacccacagtgccttttaaacggctcactcggggagaaagacgacctgatccctgacaccctgcagaaggagaaactcctgtggcccatttccctctcctcagcagtccatcgccaaatcgaggccatcaatcgcgacttccatagctgcttagggtggatgcagtggcgcgggctttctagcctccagccaccccccccacgatttaaagactccccggcttcagctttccgtgtggctgggattacagactcacacatgctctcgcttccacacctgcgatctagacaattactgtatgacgaacttgatgaggtcaacccccgcctaagagagccacaggaattgttctccattttaagtacaaagcgcccattgcaggcaccgagatggcccatagaatgtgaggtgatcaaggaaaatattcaccatattgagtgggctccccctcagccggagtatttttaccaacctaaaggcaatgagaaggttcccgagatcgtgggcgagaagaaaggaaccgtcgtgtaccagctagactcagtgcctattgaggggtcatacttcacctcctccagagtggggggtaagcgagggattgtcaaagagcttgcggtgacattgcaaggccctgaggataataccctgctatttgaatctagatttgagtccgggaacctgcaaaaagcagtgcgcgtcgacacctatgagtatgagctgacattgcgtaccgatctgtatacaaacaagcatacgcagtggttttactttagggtgcagaatacgcgcaaggacgctacttaccggttcacaattgtaaatttgctgaagcctaagagcctctacaccgtcgggatgaaaccattgttgtactcccagctggatgcaaacaccagaaacattggctggcgtcgggagggaaatgagatcaagtactacaagaataataccgacgatggtcagcagcccttctactgtctgacatggactattcaattcccatacgatcaggacacctgcttctttgcccacttctatccctacacgtataccgacctgcagtgttacctgctgtcagtcgctaataacccaattcagtctcagttctgcaagttacaaacactgtgcaggtccctggccggcaatacggtgtacctcttgactatcactaaccctagccagacacctcaggaggcggccgctaagaaagccgtggtcttgagcgcaagggtccatcccggagagagtaatggtagctgggtgatgaaaggtttccttgattttattttgagcaattcaccagatgcccagctgttaagggatatcttcgttttcaaagttctgccaatgctcaatccagatggagttatcgtggggaattatcgctgctccctggctggccgcgacctgaacaggcactacaaaacaatactcaaagagagttttccttgcatatggtacacaagaaatatgattaaaagactattagaggaaagggaggtgcttctgtactgtgattttcacggtcatagccggaagaacaatatcttcttatacggctgtaacaataataatcggaaatactggttgcacgaacgcgtttttccgttaatgctctgcaaaaacgcccccgataaattttcattccacagttgtaatttcaaggttcagaagtgtaaggaagggacgggccgggttgtcatgtggcgcatgggcatcctgaattcatatacaatggagagcacctttggcggctccacactcgggaacaagcgcgacacccatttcaccatcgaggatctaaagtctctcggctatcacgtgtgcgatactttactggatttctgcgaccctgaccagatgaagtttacgcagtgtctggcagaacttaaggaactgcttcgacaggagatccataagaaattccatgagctcgggcaggacgtggacctggaggggtcgtggagtgacatttccctctcagacatagagagttcaacgtctggcagtgatagttcattgagtgacggactgcccgttcacttggcaaatatagccgacgaacttacccagaagaaaaagatgttcaagaaaaagaaaaagaaatctttacagacacgaaaacagcgcaacgaacagtatcaaaagaagaacctcatgcagaaactaaagctgaccgaagacacttccgaaaaagcgggatttgcatctaccttgcaaaagcagcccacattctttaagaattcagagaacagcagcttcctcccaatgaaaaatgagaaccccaggctcaacgaaactaacctgaacaggcgcgataaagatacccctctggacccatcaatggctacacttattcttcctaagaataagggacggatgcaaaacaaaaaacctggcttcaccgtctcatgctcacctaaacggaccattaacagcagccaggagcccgcgccaggcatgaaaccgaattggccacggagccgatatcccgccactaagagaggatgcgcagcaatggcagcttacccttctctgcatatctacacttacccatag

SEQ ID NO: 14217 - DNA, 3234 bp, Artificial Sequence
  Description of Artificial Sequence: Synthetic coding sequence
atggaagtgcaggtttcccaagcttccctaggattcgagttaacttccgttgagaaaagtcttcgtgagtggtcccggctgtctagggaggtgatagcctggctgtgtccatcttcccccaatttcatcttgaattttccccctccaccttccgcgtccagcgtaagcatggtccagctatttagcagcccgttcggataccagtcgccatcggggcacagcgaggaggaacgggaaggaaatatgaaatccgcaaaaccacaggtgaaccattcccagcatggagagagtcagcgtgctctttccccgctacaatcaaccctgtcatccgcagcctctccttcacaggcctacgagacttacatcgaaaacggcctgatttgtctgaaacataagatccgaaatatcgagaagaaaaaactgaagctagaagattacaaggatagactaaagagtggagagcatttgaatcccgatcagctggaggccgtcgaaaagtatgaagaggtcctgcacaatctggagtttgctaaggagctgcagaagacattctccgggctgtccttggacttgctgaaagcccagaaaaaagcacaaagaagggaacacatgctaaaattggaggctgagaaaaagaaattgcgtactatcttgcaggtccaatatgtgttacaaaatctgactcaagaacacgttcagaaagactttaagggaggactgaacggggccgtttatttaccttctaaggagctggattatctgatcaagttcagtaagctgacgtgccctgaaagaaatgagtcactgagtgtcgaagatcagatggaacaaagtagcctgtacttttgggacctgttggagggaagcgagaaggcggtagtggggaccacttacaagcatctcaaggatcttctctctaagttgctgaacagcgggtattttgagtctattcctgtgcccaagaatgctaaagaaaaggaagtccctctggaggaagagatgctcatacagtcagaaaagaagacacaactgtctaagaccgaaagcgtgaaagaaagcgaatccctaatggaattcgcccagcccgaaatccagccacaggaatttttaaatcgccggtatatgaccgaggtcgattattctaataagcagggcgaggagcagccttgggaagccgattatgcaagaaagcccaatttgcccaaacgatgggacatgctcactgagccagacgggcaggagaagaagcaggagagctttaagagctgggaggctagcggcaaacatcaggaagtgtccaagccagccgtgagcttggagcagcgcaagcaggacactagtaagcttcgttccactttgccagaggagcaaaagaagcaagagatcagcaaaagcaagcccagcccgagtcagtggaagcaggacacccccaagtctaaagccggatacgttcaggaagagcaaaaaaaacaggagacgcccaagctgtggcctgtccagctgcagaaggagcaggaccctaaaaagcagacaccgaagtcatggacccctagcatgcagtcagaacagaacaccactaaatcctggactacgccaatgtgtgaggagcaggattcgaaacagcctgagacgccaaagagttgggagaacaacgtcgagagtcaaaaacacagcttgacaagccaatcacagatctcacctaagtcgtggggagttgctactgcttctctgatccctaatgaccagctactgcctcgtaagctgaataccgagcctaaggatgttcccaagccagtgcaccagcctgtggggtcctcttcaacccttccaaaggatcctgtgcttcggaaggaaaagctgcaggatctgatgacacagattcaagggacatgtaatttcatgcaggagagtgtgctggactttgataagccttctagcgcaattcctaccagtcaaccaccatctgccactcccgggagcccagtcgcgtctaaggagcagaacctgagctcacaaagcgattttctacaggagcctcttcaggccacctcttcacccgtaacgtgttcttccaatgcttgcctggttactaccgatcaagcttcatccggaagcgagactgaatttatgacatcagagacccctgaagtgtttaacgtgaatgctcctcttcccccacggaaagagcaggaaattaaggagtccccttacagccctggttataatcagtccttcactactgctagcacacagacccctccccagtgtcaactgccaagcatacacgtggaacagaccgttcacagtcaggagaccgcgaactatcaccctgatggaaccatccaggtatctaatggatctctcgccttctacccagcccagaccaacgtgttccctagacccacccaaccatttgttaattcaaggggcagtgtgaggggctgcacccgcggggggcggctcattaccaattcgtatagatcacccgggggctacaagggattcgacacttataggggactcccctctatctccaacgggaattatagccagctccagtttcaagctcgggagtattctggtgcaccctactcccagagagacaatttccaacagtgctacaagcggggaggaacatcgggaggtccacgcgccaattctagagccgggtggtcagatagctcacaagtgagtagccctgaaagagataacgaaactttcaactccggtgattcgggacagggcgatagcaggagcatgaccccagttgatgtgccagtgacaaatcccgccgcaacgatactgcccgtccatgtctatcctctgcctcagcagatgcgcgtcgcattctctgctgcccggacgagcaacctggcaccgggaaccctggatcagccaatcgtcttcgatctcctcctcaataatctcggcgagaccttcgacttgcagctgggacgctttaattgtccagtgaatggcacatatgtgtttattttccatatgctgaaactggccgtgaacgtccctctctacgtgaacttaatgaagaacgaagaggttctcgtaagtgcctacgcgaacgacggggcccctgaccatgagacagcttccaaccacgctattttacaactcttccagggcgaccaaatttggctgagactgcacagaggcgcaatttacggctcctcctggaaatatagcaccttttccggttacctgctgtaccaggattag

SEQ ID NO: 14218 - DNA, 1056 bp, Artificial Sequence
  Description of Artificial Sequence: Synthetic coding sequence
atgaccttgagactcttggaagattggtgcaggggaatggatatgaatccccgtaaggcattgctgattgccggaataagccagagctgttctgtagccgagatcgaggaggccctgcaagcaggtctggcacccctcggagagtaccgcctgctgggtcggatgtttaggcgggacgagaaccggaaagtcgcattggtcggactcacggcggaaacgtcccatgcattggtacctaaggaaatcccaggcaagggtgggatatggagggtgattttcaagccacctgatccggacaacaccttcctctcccggctaaacgaattcctggcaggcgagggcatgaccgtaggtgagctatctcgcgctctaggccacgagaacggttccctggaccccgagcagggcatgattcccgagatgtgggcgcctatgctagcacaggcgctcgaggctctgcagcccgcgcttcaatgtctcaagtacaaaaagctgagagtgttctccggccgtgaaagccccgagccgggcgaagaagaattcggacggtggatgttccatacaacacagatgataaaagcatggcaggttcctgacgttgagaagcggcgaagactactcgagtcacttaggggccccgcattggacgtcatccgggtactgaagataaacaaccctcttatcacagtagacgaatgcctgcaggcactggaggaggtgtttggagtgactgacaaccctcgcgaactgcaagttaaatacctcacaacgtaccaaaaggacgaagagaagctgtctgcgtatgttctcaggctggaaccccttctccaaaaattggtgcagcgaggggccattgaaagagacgccgtcaatcaggctcggttggatcaggtgattgcaggcgctgttcacaaaacaattaggcgagagctcaacctcccggaggatggcccggcccctggatttctgcagctccttgttctaataaaggactacgaggcagcggaggaggaagaagcactgttgcaggcaatcctggagggcaatttcacatag

SEQ ID NO: 14219 - DNA, 2559 bp, Artificial Sequence
  Description of Artificial Sequence: Synthetic coding sequence
atgagcggtagggccagagtgaaagctaggggtatagcccgatccccaagtgccaccgaagtcggccgcatacaagccagccctctgccacgaagcgtggacctgtcaaacaacgaagcctcaagctcaaacgggttcctgggcacatccagaatcagcacaaacgacaaatatggcatctcttccggcgatgcgggcagtaccttcatggagcgcggggtcaagaataagcaggattttatggatttaagcatttgtacgcgcgaaaaacttgctcacgtgagaaactgtaagactggtagctccggtatccctgttaagctcgtcacaaacctctttaatttagactttcctcaagattggcaactttaccagtatcacgttacctacattcccgatctggcatcccggcggctcagaattgccctgctatacagccacagtgagctttcgaataaggccaaggcatttgacggcgctatcctatttctgtctcagaagctggaggagaaagtgacagaattgtccagtgagacccagaggggggagactattaagatgaccataacactgaaacgggagctccctagttcttccccagtttgtatccaggttttcaacattatcttcaggaaaatattgaagaaactgagcatgtaccagattggccgtaatttctataacccatcagaacccatggagataccccagcataaattgtctctttggcccggcttcgccatttccgtctcttatttcgaacgtaaattactcttcagcgccgacgtctcttataaggtccttcgcaacgagaccgtcctggaatttatgactgcattatgccaacggactgggctatcatgctttactcaaacctgtgaaaaacagctcattggactcattgtgctgactagatacaacaaccggacctactccatagatgacatcgattggtcggtcaaacccacacacacctttcaaaaacgagatggaactgagattacttacgtagattactataagcagcagtatgatatcacagtttccgacctgaatcaaccaatgctggtttccttacttaaaaaaaagaggaatgataattctgaagcacagctggctcacctcatacctgagctctgcttcttaaccggcctgaccgatcaggctactagtgattttcagttgatgaaggctgttgcagagaagacccgcctgagtccgtctggacgccagcaacgtctagcacgtctggtagacaacattcagaggaacactaacgccagattcgagctcgagacatggggtctccatttcgggagccaaatctccctcacagggcgcatcgttcccagtgaaaagatcttgatgcaggaccacatctgccagcccgtttctgccgccgactggagcaaggatatacgtacctgcaagattctgaacgcacagtccttgaacacatggcttatcctgtgttcagatagaacagaatacgtggcagaaagcttcttaaattgtctgaggagggtcgcgggatctatggggtttaatgtggactatccaaagataatcaaggtacaggaaaaccctgctgcatttgtccgcgcaattcagcagtatgtagaccctgacgtgcagctagtgatgtgtatcctcccttccaatcagaagacctactacgactccataaagaaatatctgtcctccgattgccctgttccaagccagtgtgtcctggctcggaccttgaacaagcaggggatgatgatgtctattgccacgaaaattgccatgcagatgacatgcaagctgggtggtgaactatgggccgtcgagataccactgaagtccctgatggtcgtcggcatcgacgtgtgtaaagacgccctgtccaaagatgtcatggtggttggctgcgtagcttcagtgaaccctagaataaccaggtggttcagtagatgtattctccagcggacaatgacagacgtagcagattgcctgaaagtctttatgactggcgccctaaataagtggtataagtataaccacgacttgcccgctcgcatcatcgtctatcgggccggtgtgggagacggacagcttaagaccctgatcgaatacgaggtgccacagcttttgtcttccgtggctgagtccagctcaaatacatcaagccgactaagcgtgatcgtggtcaggaaaaagtgtatgccgcgctttttcacagagatgaatcgtactgtacagaatcctcccctgggcactgtcgtggactctgaagccacccgcaacgagtggtacgacttctaccttatctctcaggtcgcctgtcgcggtacggtctcacccacctattataacgtcatctacgacgataacggactaaagcccgaccacatgcagcgtttgaccttcaaactctgccatttatactacaactggcctggcatcgttagtgtgcccgcaccttgccagtatgcccacaagctcacatttttggtggcccagtctattcacaaggagccttccttagaactggccaatcacctcttctacctgtag

SEQ ID NO: 14220 - DNA, 2163 bp, Artificial Sequence
  Description of Artificial Sequence: Synthetic coding sequence
atgtacggttctgctagatctgttggcaaggtcgagcccagctctcagtcacctggaaggtcacccaggttgccaagatccccccgattggggcaccggcggaccaattccaccggcggctcatccgggagctccgttggggggggatccggaaaaaccttatcaatggaaaatatccagtcactgaacgccgcatatgccactagcgggccaatgtacctaagcgaccatgaaaacgtagggtctgagacccctaaatcaacgatgaccctcggcagatcggggggtaggctgccctacggcgtccgcatgacagcaatgggcagttcgcctaacattgctagctccggtgtggcaagcgacacgatcgccttcggtgagcaccatctgcctcccgttagcatggcttccacagtgccccatagtctacgtcaggcccgtgataacacaatcatggacctgcagacccagctcaaggaggtgttacgggaaaacgaccttttgcgcaaggacgttgaagtgaaggaatctaaactgtcgtccagcatgaacagcatcaagactttttggtcgccggagctgaagaaggaaagagcactgcgcaaggacgaggcctctaagataactatctggaaagagcagtacagagtagttcaggaggaaaatcaagtcgacgccttacgactaagactcgaagagaaggagaccatgcttaacaagaaaaccaagcaaatccaggatatggccgaagaaaaaggtactcaagcaggcgaaattcacgacctcaaagacatgctggatgtgaaggagagaaaagtgaacgttctgcagaaaaagattgagaacctgcaggagcaactgcgggataaagagaagcaaatgagtagcctcaaagagagagtcaagtccctgcaggctgacactactaacactgacaccgccctgacgacgttggaggaggcactggcggagaaagagaggacaattgagcgtcttaaggagcagcgagaccgtgacgagcgggaaaagcaggaagagattgacaactacaaaaaggatctcaaagacctgaaggaaaaagtaagcctgctgcaaggggatctgtccgaaaaagaggcaagcctgttagacctcaaggagcatgcttcctctctggccagttccggactgaaaaaggactccagacttaaaactctagagatcgccttggagcagaagaaggaagagtgcctgaagatggagtcccagctgaagaaggcccatgaagcagctttggaggctcgcgcatcacccgaaatgtccgatcgaatacagcatctggagcgtgagattacgaggtataaggacgaaagttctaaagctcaggccgaggtggacaggctgcttgagatccttaaggaggtggagaatgaaaagaacgacaaggataagaaaatcgccgagctggagtcgctgttttcgaggcaggtgaaggaccaaaacaaaaaggtggcgaacctcaagcacaaggagcaggttgagaagaaaaagtctgcgcagatgttggaagaagcccggaggcgagaagataacctcaacgacagctctcagcagctgcaggattcgctgcgaaaaaaggacgatcgtatcgaggagctcgaagaggctctgcgggagagcgtccagatcaccgccgagcgggagatggttcttgcacaagaggaaagcgccaggacaaatgccgaaaaacaggtggaggagctgctgatggctatggagaaagttaagcaggagcttgagtctatgaaggcaaagctgtctagcacgcagcagtctctcgctgaaaaggagactcatctgaccaacttgcgggccgaacgccgaaaacacctggaggaggtccttgaaatgaaacaagaggccctcctcgccgcaattagtgaaaaagatgccaacatcgcccttctcgaactgtcttcatctaagaaaaaaactcaggaagaagtagccgcactcaagagggaaaaagatcggttggtccagcaacttaagcagcaaacccaaaacaggatgaaactgatggcagataactatgaggacgatcacttcaagtcaagccattcaaaccaaacaaatcacaaacctagtcccgaccaagacgaggaagaaggcatctgggcttag

SEQ ID NO: 14221 - DNA, 1344 bp, Artificial Sequence
  Description of Artificial Sequence: Synthetic coding sequence
atggatatgggtaatcagcatccttccatttccagactgcaggagatccagaaagaggtaaaatccgtcgagcaacaagtaattggattttccggtctttctgacgacaagaattataagaaactggagcgaattcttacaaagcagcttttcgagattgattccgtggacacggagggcaagggcgacatacagcaggccaggaagcgagcggctcaggaaaccgagcggttgctcaaggaactggagcaaaacgccaaccatccccacaggatcgaaattcagaacattttcgaagaggctcagagcctcgtcagagaaaaaatagtaccattctataacgggggcaactgcgttacagacgagttcgaagaaggaatccaggacattatactcagattgacccatgtgaagacaggggggaagatctctttgcgaaaagctcgataccatactctaactaagatctgcgcagtccaggaaatcattgaggattgcatgaaaaaacagccctccctgcccctgagcgaggatgcgcatcccagcgtggccaagattaactttgtgatgtgtgaggtgaacaaggccaggggggtcttgatcgcactattgatgggagtgaacaataatgaaacctgtagacacctaagctgcgtcctgtcaggcctgatcgccgacctcgatgctttagatgtttgcggaaggactgagattcgaaactatagaagagaagttgttgaggacataaacaaactgctcaaatacctggacctggaggaagaagccgatacaacgaaggcatttgatcttcgccagaaccactcaatactcaagatcgagaaagtgttgaagagaatgagagagatcaaaaatgagcttctgcaggctcagaacccctctgagctctacctcagcagtaaaaccgagctgcagggactgatagggcaacttgatgaggtctctcttgagaaaaatccctgtatcagggaggccagaaggagggcggtcatcgaagtgcaaactctgattacatatattgatttaaaggaagctttagagaaaagaaaacttttcgcgtgtgaggagcatccctcccacaaagcagtatggaacgtcctggggaatctgtcagagattcagggcgaggtgcttagcttcgacggtaatcgaacagataaaaactatattcggctggaggaacttctgacgaagcaacttctggccctcgacgcagtcgacccacagggcgaggagaaatgcaaggctgccagaaaacaggcagtccgcctggcccagaacattctgagttaccttgacctgaaatccgatgagtgggagtattag

SEQ ID NO: 14222 - DNA, 1476 bp, Artificial Sequence
  Description of Artificial Sequence: Synthetic coding sequence
atggcccagagtggaggtgaagcccggccgggccccaagaccgccgtgcagattagagttgcaatccaagaagcggaagacgtcgacgaactagaagatgaggaggagggcgctgaaactcgcggagctggggacccagcccgctacctatcacctggctggggaagcgccagtgaggaggagccttcccgcggccactccggtactactgcttcaggtggcgagaacgaaagagaggacctggagcaggaatggaaacctcctgatgaagagcttattaagaagctggtcgaccagattgaattctatttttccgatgaaaacctggagaaggacgcctttcttctcaaacacgttaggcgtaacaagctcgggtatgtcagcgttaaactccttacaagttttaaaaaagtgaaacatctgactagggattggaggacaaccgcccacgctctgaaatattcggttgtgctggagttaaacgaagaccaccgaaaggtccgtaggactacacctgttcctttattcccaaacgaaaacctgccgtcaaagatgttgctggtgtatgatctctacctgtcccccaaactttgggcgctggccactcctcaaaagaatggacgtgtacaggaaaaggtaatggagcatctgctgaaactgtttggtacttttggtgtcatcagctctgtgcgtatcctgaagccaggacgagagctgcctcccgatatccggcggatttcaagccgatactctcaggtgggaacccaggaatgcgccattgtggaatttgaagaagtggaggccgccataaaagcgcacgaatttatgattacagagtcacaaggtaaagaaaacatgaaagccgtgctaatcggaatgaagcctcccaagaagaagccagccaaggacaaaaaccacgacgaggagcctaccgcatcaatccatctgaacaagagcctgaataagcgtgtggaggagctgcagtatatgggcgacgagtcgtccgcaaacagttctagcgatcccgagagtaaccccacgagcccgatggctggaaggaggcacgcagctaccaataaactttcaccctccggtcaccagaacttgttcctgagtcctaatgcatccccctgcacgtccccctggtcgtctcccctcgcccagcggaagggcgtaagccgcaaaagtccactggctgaggaaggccgattaaactgttcaacctcgccagagatttttagaaagtgtatggactactccagcgattcatccgtgactcccagcggcagcccctgggtcaggagaagaagacaggcagaaatgggcacacaagaaaaatctcctgggacaagcccattgctgagcagaaagatgcaaacagctgacggactccctgtcggggttcttcgtctcccacgcggccctgacaacactagaggatttcacggacacgagaggtctcgtgcctgtgtttag

SEQ ID NO: 14223 - DNA, 315 bp, Artificial Sequence
  Description of Artificial Sequence: Synthetic coding sequence
atggccggcaaggcacaccgactgtccgccgaggagcgagaccagctgctgccaaacctgcgcgccgttgggtggaatgaactggagggacgggacgccatctttaagcaatttcacttcaaagatttcaaccgcgctttcgggtttatgactagagtggctctgcaggctgaaaagctagaccaccacccagagtggtttaatgtgtacaacaaggtccatatcacactgagcacccacgaatgtgccggcctctccgagcgggatattaatttggcctccttcatcgagcaggtggctgtgtcaatgacctag

SEQ ID NO: 14224 - DNA, 738 bp, Artificial Sequence
  Description of Artificial Sequence: Synthetic coding sequence
atgattggagttagctttgaagaagcaaaatctatcattacaggggctaagctttccacgcggcttgaatccgcctgggagattgcatttattcgccagaagtcggataatatccagcccgaaaatttgtcttgcacgtccctgatcgaggcctccggcgagtatggtccccaagcatccacattaagcctcttttcctctccacctgagatcctaattcccaagacgagctcaacccctaaaacaaacaatgatattctgtcttcttgcgagattaaaacaggctacaacaagactgtacagattcccatcacttctgagaacagtactgtgggattgtcaaacaccgatgtggcctccgcttggacagaaaactacgggctgcaggagaaaatttcactgaatccttcggtcaggttcaaagctgagaagttggaaatggcgctgaactatctcggtattcagcctaccaaggagcagcatcaggcattacggcaacaggtccaagctgatagtaaaggcactgtcagcttcggcgacttcgtccaggtggcacgcaatctgttctgcctccagctagacgaggtaaacgttggagcacacgagatcagtaacatcctggatagccagctgcttccctgtgactcttcagaggccgacgaaatggagcggctcaaatgcgagagggacgacgctctaaaggaggtgaatacgctgaaatggccaggccagaattag

SEQ ID NO: 14225 - DNA, 849 bp, Artificial Sequence
  Description of Artificial Sequence: Synthetic coding sequence
atgggcggcgcggtgagtgcaggagaggacaatgacgagctgatcgacaatctaaaagaagcccagtatatccgaacagaactggttgagcaggctttccgcgcaattgacagggctgattactacctagaagaatttaaagagaacgcatacaaagatctggcatggaagcacgggaatatacatctgtctgcaccgtgcatctacagcgaggttatggaggcactggatttgcagcctggcttatcctttcttaacctgggttcaggcaccgggtatctatcctcaatggtgggattgattctcgggccctttggcgttaatcatggcgtcgaacttcacagcgacgtcatcgaatacgctaaacagaagcttgatttcttcatccgcactagcgacagcttcgacaaattcgatttttgcgaaccaagctttgtgaccggcaattgtctggaaatatctccagactgttcacaatatgacagggtgtattgtggcgcaggcgtccagaaggaacatgaggaatacatgaagaacctgctcaaagtgggaggcattttggttatgcccctggaggagaaacttactaaaattaccaggactggcccctccgcatgggaaactaagaagatcctggctgttagctttgcaccactcatccagccatgccactctgagagtggtaagtctcggctcgtccagctgcgctctccttccttcgtacagggttggagcgtggtggttctcagtcagctgaccgctgccagtaccttccaggctgaggccatcctgcccagtcaatccccaacttggctgacccttcaagtcctcgccaccatgccaaactag

SEQ ID NO: 14226 - DNA, 612 bp, Artificial Sequence
  Description of Artificial Sequence: Synthetic coding sequence
atggccaggcccaggccaagagagtacaaggccggcgaccttgttttcgctaagatgaaagggtatccacactggcctgcaaggatagatgagttaccagagggagctgtgaagcctcccgctaataagtacccaatcttcttcttcggtacacatgaaactgctttccttggcccaaaggatttatttccctataaagaatataaagataagtttggcaagtctaataagcggaagggctttaacgagggcctgtgggagattgagaacaacccaggcgtaaaatttactgggtaccaggccattcagcagcagtcttcgtccgaaacggaaggtgaaggaggaaacacggcagatgccagtagcgaggaggagggtgatcgcgtggaggaagacggaaagggaaaacgcaagaatgaaaaggccgggtctaaacgcaagaagtcctacacctctaagaagagcagtaaacagagcaggaagagccctggggacgaggatgacaaggactgcaaagaagaggaaaataaaagctcaagcgaaggaggtgacgccggcaatgatacgcgtaataccacttctgatttgcaaaaaacgagcgagggtacctag

SEQ ID NO: 14227 - DNA, 540 bp, Artificial Sequence
  Description of Artificial Sequence: Synthetic coding sequence
atgaagactccggtggaactagcagtttctgggatgcagactctggggcttcagcaccgttgtagaggtggatacagggtgaaagcacgcacctcctacgtagatgagacactgtttggcagccccgccggaaccaggcccactccccctgacttcgatcccccctgggtggaaaaggccaacagaactcggggcgtaggaaaggaagcgagcaaagccttgggggccaagggatcctgtgaaacaacgccttccaggggcagcacacccacactgacgccacgaaaaaagaataaataccggcctatctcccatacaccttcatattgtgatgagagcctttttggatctcggtccgaaggggcttcctttggagccccccgtatggctaagggggacgccgccaaacttagagccctcctgtggacccctcccccaactccacgtggctcgcattcccccagacctagggaggcccctcctccagtcccacctactcagatgggcttgagaatttccgggctgccaaggcaggggtag

SEQ ID NO: 14228 - DNA, 1104 bp, Artificial Sequence
  Description of Artificial Sequence: Synthetic coding sequence
atggatggtgaagacatccctgatttttcttccctgaaagaagagactgcttactggaaggagttgtctttgaagtataaacagagttttcaagaagcccgagatgaactggtcgaattccaggagggctctcgagaactggaagccgagttggaggcacagctggttcaagccgaacagcggaatagagatctgcaggcagacaaccaacggcttaagtatgaggtggaagctctcaaagaaaagctggagcatcagtatgcccagtcctacaagcaggtgagcgtgctcgaggacgacttgtctcaaacaagagccataaaggaacagctccacaagtatgtgcgcgaactcgagcaggcaaacgacgatctggagagggcaaaacgggccacaatagttagtttggaggacttcgagcagagactcaatcaggccatcgagaggaatgccttcctcgaatccgagcttgatgagaaagaatcattactggtctccgtccagagacttaaggatgaggcccgcgatctcaggcaggagctggctgtcagagagagacagcaggaggtaactcgaaaaagcgcgcccagttccccgactttggactgcgaaaagatggattctgcagtgcaggcctccctaagtttgcccgccacgccagtaggaaagggaactgagaacacttttccatctcctaaggctatccctaatggcttcggcacgagcccacttacacccagcgcacgcattagtgctcttaatatagtgggagacctcctccggaaggttggcgccctcgagtcaaaactcgctgcttgccgtaatttcgccaaagatcaggcatcacggaagtcctacatctctggtaacgtcaactgtggtgtgctgaacggcaacggtactaagttttcacggtccgggcacaccagcttttttgacaagggaagttcatcatcttgcgccataagagccagccgccggaggttttctagttcaagcgcagaccttgccggtcggggcggcggtgatgggagtatcccagcacagcatagtacaggcgcctccggtaaggcccctccacccactctcctgctcgagacctag

SEQ ID NO: 14229 - DNA, 591 bp, Artificial Sequence
  Description of Artificial Sequence: Synthetic coding sequence
atgggtagcagaagcagccatgctgctgtgatcccggacggcgatagtatcagaagagagacagggttcagccaggctagtctgctgagattgcatcatcgcttccgggccctggatcggaacaaaaaaggctatctgagtcgaatggacctgcagcagataggagcgctggccgtgaatccccttggggacaggataatcgagtccttttttccagatggatctcagcgcgttgattttccgggcttcgtgagagtcctggctcattttcggcctgtcgaggatgaggacaccgaaactcaagatcctaaaaagcctgagccactcaacagccgaagaaataaattgcactacgccttccagctgtatgatctcgaccgcgatggaaagatctctcgacacgaaatgttacaggtcctgagactgatggtcggggtgcaggtgaccgaggaacaactagagaacatagcggaccggactgtgcaggaggccgatgaggacggcgacggagcggtatctttcgtggagttcaccaagtcccttgaaaagatggacgtggaacaaaaaatgtccatccgcattttgaagtag

SEQ ID NO: 14230 - DNA, 2313 bp, Artificial Sequence
  Description of Artificial Sequence: Synthetic coding sequence
atgttcaggtacgagagcctggaagactgtcctctggatgaggatgaggatgcctttcagggtctgggggaggaagatgaggagattgatcagttcaatgacgacacctttggatctggtgcagttgacgacgattggcaggaggcacacgagaggctggccgaattggaagagaaactcccagtggcagttaatgagcagactggaaacggagaaagggacgagatggacctgctgggcgaccatgaggagaaccttgccgaacggctgagcaagatggtaatcgaaaacgaactggaagatcctgccattatgcgagccgtacagaccaggccggtactgcagccccagcccggctctctgaactcctccatctgggacggaagtgaagtcctcaggaggatcaggggtcctctgttggcgcaagagatgcctactgtctccgtccttgagtacgcactgcctcagcgcccccctcagggccccgaggacgacagagacctgtccgagcgggcactgccacgcaggagcacgtcacccattatcgggtccccccccgtgcgcgcagttccgatcggaactccccctaagcagatggcagtgccgtcttttacacagcagatcctttgtcctaagcctgtccacgtgcgccccccgatgcctccccggtatcccgccccatatggcgagagaatgtcacccaatcagttatgttccgttcctaacagcagcctactgggccacccttttcccccttccgtgcctccagtactttctcccctgcagcgcgcccagttgctgggcggtgcccagttgcaacccggcagaatgagtccatcacagtttgccagggttcccggatttgttggaagtcccctagcagcaatgaaccccaagctactgcaggggcgagtggggcaaatgcttcctcccgcgcccggattcagagctttcttttccgcgcccccatcagccacacccccaccgcagcagcaccccccagggccgggcccccatctgcagaacttgcggtctcaggctccaatgttccgccccgacaccactcacctacatccccagcatcgacggttactgcaccagaggcagcaacaaaaccggagccaacataggaacctgaatggcgcaggggacaggggctcgcacagatcttcccatcaggaccacttgcggaaagatccatacgccaacctgatgttacaacgcgagaaggactgggttagcaagatccagatgatgcagctgcagtccactgacccttacctggacgatttttattatcagaactacttcgagaaattggagaagctcagcgcagctgaagaaatccagggtgacggccccaaaaaagaaagaaccaaacttattactccccaggttgcgaaacttgagcacgcatacaagcccgtccagtttgagggaagcttgggcaaactgacagtgagcagcgtgaacaatcccaggaagatgatcgacgcggtggtaacctccagaagcgaggacgatgaaaccaaagagaagcaagtgcgggacaagaggcgaaaaactctcgtcattattgaaaagacttactctttgctcctcgatgtggaggactatgagagaaggtacctcctcagtctggaggaagagaggcctgccctgatggatgatagaaaacataagatttgtagcatgtatgacaatctccgcggtaaattgcccggccaggagcgccccagtgatgaccacttcgttcagatcatgtgtatccgcaaaggaaaaagaatggtggccagaatcctgccctttcttagcacggaacaggccgcggatatcctgatgacaaccgcccgcaatctgccttttcttatcaaaaaagacgcacaggatgaggtcttgccatgcctgttgtctccatttagcctgttactctaccatcttccatcagtgagcatcacctcccttctgaggcagctcatgaacttgcctcagagcgcagccacacctgccctgagcaacccccacctgacggctgtgctacaaaataaatttggcctaagcctgctcctgatcctgttgtcaaggggggaagacctccagtcctccgatcccgccacagaaagtactcaaaataaccagtggactgaagtgatgtttatggccacaagagagctcttacggattccacaggccgccctggcgaagccaattagtatacccaccaatctggtgagcttatttagtagatacgtagaccggcagaaactgaatcttctagagaccaagctccagttggtgcagggaatacgatag

SEQ ID NO: 14231 - DNA, 1518 bp, Artificial Sequence
  Description of Artificial Sequence: Synthetic coding sequence
atgcgtcttaggcgcctcgccctctttccaggcgttgcgctcttgctcgcagccgcgagacttgccgcagcgtccgatgtgcttgaactgaccgacgacaactttgagtccagaataagcgacaccgggagtgccgggctgatgcttgtggagtttttcgccccgtggtgtgggcactgtaagcggctcgcacccgagtacgaggccgcagctaccagactgaagggtattgttccattggcgaaagttgactgtacagccaacacaaacacttgcaataaatatggagtgagcggatatccaactctaaagatttttagggacggggaagaggccggcgcctacgatgggccaaggacagctgatggaatagtctcacacctcaaaaaacaggccgggccggcctctgttcctctgagaacggaggaggagtttaagaaattcatttcagacaaagacgcatccatagtgggattctttgacgatagcttctccgaggcccacagcgagttcctgaaagccgcttcaaacctccgggataattaccggttcgcacacaccaatgttgagtctttagtaaatgagtacgacgacaatggagagggcatcattcttttccgaccctctcacctcacaaacaaattcgaggataaaacggtagcgtatacagagcagaagatgaccagtggaaaaattaagaagttcatccaagaaaatatctttggcatttgtcctcatatgacggaggacaacaaggacttgatccagggaaaagacctcttaatcgcctactatgacgttgattatgaaaagaacgcgaaaggctctaattactggagaaatagggttatgatggtcgctaagaaattcttggacgcgggccataagctgaacttcgctgttgcctcccgaaagaccttttctcatgaactgagcgatttcgggttggagagcactgcaggcgaaattcctgtggtcgccattcgaacggcgaaaggtgaaaagtttgtgatgcaggaggagttttctagggatggaaaagctctcgaaaggtttctgcaagactacttcgatgggaacctgaagagatacctgaaatccgaaccaattcccgagtcaaatgatgggcccgtaaaggtggtggttgcggagaattttgatgaaatcgtcaacaatgaaaacaaagatgtattaatagaattctacgctccctggtgcggacactgtaagaatctggaacccaaatataaagaactcggcgagaagctgagcaaggaccctaacatcgtgatcgccaagatggacgcgactgcaaatgacgttccgtcaccatatgaggtgcgcggtttcccgacgatctacttctcgcctgcaaataagaaactgaatcctaagaaatacgagggcggccgagagctcagcgattttattagctacctgcagagagaagccacgaaccctccggtgattcaggaggaaaaaccaaagaaaaagaaaaaagctcaggaagacctgtag

SEQ ID NO: 14232 - DNA, 684 bp, Artificial Sequence
  Description of Artificial Sequence: Synthetic coding sequence
atgagcgttgtgcctccaaaccgctcccagacgggatggcccagaggggttacccagttcggcaataaatacatccaacaaaccaaacccctcaccctcgagcgcaccattaatctgtatcccctgaccaactacacgtttgggacaaaagaaccactgtacgagaaagactcatcagtggccgctcgctttcaacgcatgagggaagagtttgacaaaatcggtatgagacgcacggtagagggggtcttgattgtccatgagcacagattaccccacgttttgctcctacagcttggtacaacattcttcaaactccctggcggagagctcaatcccggagaggacgaagtggagggtctcaaacgcctcatgactgagattctcggcaggcaggatggggtcctgcaggattgggtaatagatgattgcatcggtaactggtggagaccaaatttcgaaccacctcagtacccatatattcccgcgcacattactaaacccaaggaacacaagaagctgttcctggttcagctgcaggaaaaggctctgttcgccgtgccgaagaattacaaactcgtggctgcccccctgtttgagctgtacgataacgctccagggtacggccctattatatcaagtctccctcagctcctgtctcgattcaacttcatttacaattag

SEQ ID NO: 14233 - DNA, 2244 bp, Artificial Sequence
  Description of Artificial Sequence: Synthetic coding sequence
atgtcccaggtaaagagctcatactcttacgatgctcctagtgactttattaattttagcagccttgatgacgaaggtgatacacagaatattgattcctggtttgaggagaaagctaatctggaaaacaagcttctcggcaaaaacgggaccggcggcctgttccaaggcaaaacgccactcaggaaagcgaacttgcagcaggccattgtgacgcctctcaaacccgtagacaatacttactataaggaggccgaaaaggagaatctcgtggaacaatccatcccctcaaacgcgtgctcgtctctggaagtggaagcagcaataagccggaagactcctgctcagccccaacgcagaagcctcagattgagtgcacaaaaagatctcgagcagaaggagaagcaccacgtcaagatgaaagcaaagcgatgcgccaccccagtcataatcgatgaaatcctgccatccaagaaaatgaaagtctccaacaacaaaaagaagcccgaggaggaaggctccgcacatcaagatactgctgagaaaaatgctagctcaccagagaaggccaaaggcagacacaccgtgccatgtatgccaccagcaaaacaaaagtttttgaagtccaccgaagaacaggagttggaaaagtctatgaagatgcagcaagaggtggtcgagatgaggaagaaaaacgaggaatttaaaaaactggctctcgcaggaatcgggcagccggtgaagaagtcagttagtcaggttacaaaatcagtagatttccacttcagaactgacgagcgaataaagcagcacccgaagaatcaggaagagtacaaggaggttaacttcacttctgaattaagaaagcacccctcttctccagcgcgtgtgacaaagggctgtacaattgtaaagccctttaatctcagccaaggcaaaaagcgcacatttgacgagaccgttagtacctacgtccctctcgcgcagcaggtagaggatttccacaagcgaacgccaaatcgctaccatctgcggtctaagaaggatgacataaacctactgccgagcaagtcatccgtgactaaaatatgccgggacccccagaccccagttttgcagacaaagcaccgcgcccgcgccgtgacgtgcaagagcaccgcagaactggaggccgaggaactggagaaactgcaacagtacaaatttaaagcacgggaattggaccctagaattttggagggggggcccatcctccctaaaaaaccaccagtcaagccaccaaccgagcctattgggtttgatctcgaaatcgagaaacggattcaggaacgcgagtcaaaaaagaaaactgaagacgagcattttgaatttcatagtcgaccctgcccgacaaagattttagaagatgtggttggcgtgcccgagaaaaaagtgctgcctatcacagtacccaagagccctgcattcgctttgaaaaaccggattagaatgccaacgaaggaagatgaagaagaggatgaacctgtggtgatcaaagcccagccagtgccccattatggagtaccatttaaaccccagatcccagaagctcgcaccgttgagatttgccccttcagcttcgactcccgcgacaaggaacggcagctgcaaaaggagaagaaaattaaggagctgcagaaaggcgaggttcccaagtttaaagcactaccgctcccccacttcgacaccatcaacctccccgagaagaaggtaaagaacgtcactcagatcgagccgttctgtttagagacagaccgacgaggcgcgcttaaggcccagacttggaagcatcagctagaggaggagctccgccagcaaaaggaggctgcctgttttaaggcaaggcccaatacggtgatttctcaggaacctttcgtgccgaaaaaagagaagaagtctgtcgccgaggggctgtccggatcactggtgcaggagccctttcagttagcgacagagaagcgagctaaagaaagacaggagcttgaaaagcgcatggccgaagttgaggcccagaaagctcaacagttggaagaagcaagattacaagaggaggagcagaaaaaggaggaactcgctcggttgcgcagggaactggttcacaaggccaatccaataaggaaatatcaaggtttagagatcaagtcctccgatcagccccttaccgtgcccgtcagtcctaagttttccacgcgattccattgttag

SEQ ID NO: 14234 - DNA, 360 bp, Artificial Sequence
  Description of Artificial Sequence: Synthetic coding sequence
atgaaactcgtgcgttttctgatgaagctgtcccatgaaactgtaaccatcgagctgaagaatggaacccaagtacacggaacaattactggcgtagacgtttcaatgaatacacacctgaaggcggtaaaaatgactctaaagaaccgggaacccgtgcaactggagactctttccatcagaggcaataacatccggtactttattttaccagacagcctcccgctcgatacgttattggtggatgtggagccgaaggtgaaatcgaaaaaacgagaggccgtagcagggaggggccggggccgtgggagagggcgcggacgaggacgtggcagagggagaggtgggcccaggaggtag

SEQ ID NO: 14235 - DNA, 555 bp, Artificial Sequence
  Description of Artificial Sequence: Synthetic coding sequence
atgatgggcgccagtaccctacaggaacctgccctcagccctggccggtgcccacgacagcctctgcgcagcaaatttgggcatcaaggctccaccgtccagcgtaagtgcagtaaaaccaacgccctgaacgtgtcgcaaaagatgatagagatgttcgtgcgcacaaagcataaaatagacaagtcccacgagtttgccctggtagtggtgaatgatgacaccgcctggctgtccggtctgacttcagacccacgcgagttatgcagttgcctgtacgacctcgagactgcctcatgctctactttcaatatctcgggagcgagcccggcccggcagcagaaaactgagctgcctgtgaccgaaaatgttcagaccatccccccaccgtacgtcgtacggaccatcttggtctacagccgacccccttgtcagccacagttcagcctgactgagcccatgaaaaaaatgtttcagtgcccgtatttcttctttgatgtggtatacatccacaatggcacggaagaaaaggaggaggagatgtcatggaaatag

SEQ ID NO: 14236 - DNA, 1203 bp, Artificial Sequence
  Description of Artificial Sequence: Synthetic coding sequence
atggctagcgagaaacccttggctgcggtcacatgtactgctccggtgaatatcgctgtcatcaaatactgggggaaacgcgatgaggagttagttcttcctatcaacagttccctttcagttactctgcatcaggatcagcttaagaccaccaccaccgcggttattagtaaggactttacggaagatcggatttggcttaacgggagagaggaggatgtggggcagccccgactacaggcatgcctgagggaaattcgctgtctggcgaggaagcgtagaaatagtcgtgacggcgatccacttccctcatctctgtcatgtaaggtccacgtagccagtgttaataactttcctaccgccgccggactagcctcttctgctgcggggtacgcctgcctagcctacactctcgcccgcgtgtacggagtggaatctgacctcagcgaggtcgccagacgggggagtggatcagcctgtagatctctctacggcggcttcgtagaatggcagatgggagagcaagccgatgggaaggactccattgcccgccaggtcgccccagagtcccattggcccgagcttcgggtgctaatcctcgtggtaagcgcggagaagaaactgacaggctctacagtcgggatgcgcgcctctgtggagacttcccctctcctgcgctttagagcagagtctgtggtgcctgcgcgcatggccgagatggcacggtgcatacgtgagagggacttccctagtttcgcacaacttacaatgaaagattccaaccagttccacgcaacctgcctggatacgtttccacctatttcctacttgaacgccatttcatggcgaatcatccacttggttcatagattcaacgcccatcatggtgatactaaggtcgcctatacgtttgacgccggacctaatgctgtcattttcacattggacgacactgttgcagaattcgtcgcagccgtgtggcacggattccctcccggctccaatggggacactttccttaagggattgcaggttcgacctgcaccattatccgcagagctgcaggctgccctggccatggagccaaccccggggggggtgaaatacatcatcgtcacacaggttggccctggccctcagatattagatgatccctgtgctcacctgctggggcctgacggccttccgaaaccggccgcctag

SEQ ID NO: 14237 - DNA, 1350 bp, Artificial Sequence
  Description of Artificial Sequence: Synthetic coding sequence
atgagagaatgcattagcattcacgttggccaggccggcgtgcagatcggaaatgcctgttgggagctgtactgtcttgaacatgggatccagcccgacgggcagatgccctcagacaagaccatcgggggaggagacgacagttttaacaccttcttctccgagaccggcgcagggaaacatgtgccgagagccgtgttcgtcgatctcgaaccgacagtcattgacgaagtacggacgggcacttatcgtcagctattccacccagaacagttaataactggaaaagaggacgctgccaataattatgcccggggtcactatacaatcgggaaggagataattgatctcgtcttagatagaatcaggaaactggccgaccagtgtacaggactgcaggggttcctcgtttttcactcttttgggggtggtaccggatctggatttacgtccctgcttatggagcgcttgtctgtagattatggcaagaagagtaagctggaattcagcatctaccccgcccctcaggttagcaccgccgtcgtcgaaccttataattccatccttaccacccatactaccctcgagcactccgactgtgcattcatggtagataacgaagcgatctacgacatatgtcgacgaaatctagatatcgagcgacccacctatacgaaccttaatagactgattagccaaattgtgagtagcatcactgcaagcctgcgcttcgacggtgctttaaatgtcgacctgacagagttccagactaacctggtaccttatcctcgtatccattttcccctagcaacctacgccccggttatttctgctgagaaggcataccacgagcaattaacagttgccgagataacgaatgcttgttttgaacccgcaaatcagatggtgaagtgtgacccacgtcatggtaaatacatggcctgctgcctgttgtataggggagacgtcgtgcctaaggacgtcaacgccgctatcgcaacaattaagactaagaggactattcagttcgtggactggtgccccacagggtttaaagtcgggattaattaccagccaccaaccgtggtgccagggggagatctagctaaagtgcaacgggccgtgtgcatgctgtcaaatactaccgctgtggccgaggcatgggcacggcttgaccacaaattcgatctgatgtacgcaaaacgagcttttgttcattggtatgtgggcgaaggaatggaggagggcgaattctctgaagctagggaagatatggcagccctcgagaaggactacgaagaggtcggcgcagactcggcagatggagaggacgagggagaagaatattag

SEQ ID NO: 14238 - DNA, 1365 bp, Artificial Sequence
  Description of Artificial Sequence: Synthetic coding sequence
atgagcacatttcgccaggaggatgtagaggatcattatgaaatgggggaagaattagggagtggtcagttcgctattgttagaaagtgccgtcagaaaggaacgggtaaggaatatgctgcaaaattcatcaaaaaacgccgcttatcatccagcagaagaggggtcagtcgcgaggaaatcgagcgcgaggttaatatactgagagagatacggcatccaaatatcattaccctgcatgatatcttcgagaacaagactgatgtcgttctcatcctcgaactcgtcagcggcggtgaactgttcgacttccttgcagaaaaagagtctcttaccgaagacgaagccacacagttcctcaagcagatactggacggcgtacactatttacattcaaagaggattgctcacttcgatttgaaaccagaaaatatcatgcttttagataagaatgtcccgaaccctcgtatcaaattgattgacttcggtatcgcacacaaaattgaagcagggaatgaattcaagaatatattcggcactcccgagtttgtggcacccgaaatcgtcaactacgaacccttgggcttggaggccgatatgtggtcaattggagtgatcacctacatcttgctcagcggagcgagtccattcctcggtgaaactaagcaggagacactaaccaatatctccgccgtgaattatgactttgatgaggagtacttcagcaacacctctgagctggctaaagacttcattcggaggctgcttgtcaaggaccctaaacggcggatgactatcgctcagtccctggaacactcctggattaaggctatcaggcggagaaacgtgagaggcgaggattccggaaggaagccagagaggaggcggctgaagaccacacggctaaaagagtacacaatcaaatcgcatagttcactcccccctaacaattcctacgcagattttgaacggttctccaaagtgctcgaggaagcagctgccgccgaggagggcctgagggaactccaacgtagtagaagactctgtcatgaggatgtagaggctctggccgcaatctacgaagagaaggaggcatggtacagagaagagtccgactctctggggcaggatctgagacggcttaggcaggaactactgaaaaccgaagctctgaagagacaggcccaggaagaggccaaaggggctctgttgggaacttcaggtctcaaacgccgcttttcacgcttggagaatcggtatgaagcgttggcaaagcaggtcgcttctgagatgcgattcgtgcaggacctggtgcgggctttggagcaggaaaagctccagggcgtcgagtgcggcctgcggtag

SEQ ID NO: 14239 - DNA, 1326 bp, Artificial Sequence
  Description of Artificial Sequence: Synthetic coding sequence
atgaaaaagttctttcaggaatttaaagccgacattaaattcaagtccgccggcccaggccaaaagcttaaagagagcgtcggagagaaggctcacaaagagaaacccaaccagccagctccgagaccacccagacagggccccacaaatgaggcccagatggctgccgctgcagcccttgccaggctggagcagaagcaatctagagcatggggtccaacatcgcaggacaccatccgcaatcaagtgagaaaggagctccaggctgaagcaaccgtgagcggcagcccagaggccccggggactaacgtggtgtctgaaccccgtgaggagggcagtgcacacttagccgtaccgggagtctattttacctgccctctgacaggtgccaccctgagaaaggatcagcgagacgcatgcataaaggaggccattctccttcacttttcaacagacccagtcgctgccagcatcatgaaaatttacacatttaataaggaccaagacagagtgaagctgggagtggatacgatcgcgaagtacctcgacaacattcatctgcaccccgaggaagaaaagtatagaaagatcaagctgcagaacaaggttttccaagagcgaatcaactgtcttgaaggaacccatgagtttttcgaggccattgggttccaaaaggttcttctccccgctcaagaccaggaagaccccgaagagttttatgtgctatccgagaccacactggcccaacctcagagcttagaaagacacaaggaacagctgctagccgccgagccggtgcgggccaagctcgatcgccaaagacgggttttccagcctagccctttggcctcgcagttcgagctgcccggggacttcttcaatctcaccgccgaagaaatcaagcgtgagcagcgcctgcgtagcgaggctgtggaacgcctctccgtcctgaggactaaggctatgagggagaaggaggagcagcgggggctgcgcaagtataattatacccttttgagggtgcggctaccagatggttgcttgctgcaagggacgttctatgcgcgggagcggctcggtgcagtatacggtttcgttcgagaggctctgcagagtgattggctaccttttgagctgttggcttccggcggccagaagctgtcagaggacgagaaccttgctctgaacgagtgcggactggtcccctctgcactgttgacgttcagctgggacatggcggttctggaggacatcaaggccgccggagccgaaccggactctattctgaaacctgagctgttatccgctatcgaaaaactactctag

SEQ ID NO: 14240 - DNA, 900 bp, Artificial Sequence
  Description of Artificial Sequence: Synthetic coding sequence
atgcgcgacctgttactccactgggggccaggaccgcccattcgggctccccaggaagaagcagaggccctgttggagctgcagggccgcctgcaggaagcccaggataccaccgaggccttgcgcgcccagctgggggtccaagaagtgcagttgcagggtctacagggcgctctccagcagttacaacaggagactgagcagaactgccgacgtgagttacaacagatgcacgggcagcttgccggattgcgagccaggatggcatctctgagacaaggttgcggggaccttcgaggcctggtaagcacatttacacaaagctgtcagggctccctgtcggaggctcggggccaggtctcttgggccctcggagccttgtccagtggcgggccaggaacgcagttgccggagggtcagcaggggccccccgctgggtgtccgggacgtctgccagagctgaagggaaacattagagtcctgtgtcgactgagacctggtaccagctcatcactggtgagcgtcgagccaggccccggcgggacagtgactacatgctatcggggaaggcaccgtcgctttaggttagactgggtgtttccacctgacgcgagccaggaggaggtgtttcgcgagttggaacctgccgtactgtcatgcctcagagggtactccgtctgtatttttacctacgggcagaccggcaccggcaagacatattctatggaaggaccgcccgaagaccccggcatcgtgccccgcgcgctacaaagccttttccgcgagatgggagccggcagacagcaccgcagataccacggccgatgcctctcgcctgcagaatccccggaacacccacggcctgggctgcctccctgtagggcgcgctcacccctctag

SEQ ID NO: 14241 - DNA, 2517 bp, Artificial Sequence
  Description of Artificial Sequence: Synthetic coding sequence
atgtacgcgttttactctctgttaatttatattttttattcactgttcagaagggatgggggggcagcggccgcggccgagccgggagaccccgcccagagggcgagaaagccccggggccgccggaggccggacttgcccgcaccggagctgtggacggagttgactgggctagccgccagcagcgagcccgaagacggctccgaaggcgcggccgaaggcagggccgcagccgtaagcctggaagaggccctcctccgactggctgagtttctgtcggttcagctcggggccgaggagagctgtgggggcccggcggatctgggtcagtccggcgaggtgccgtcccttcttaccgttaccagccaattgctggcactcctcgcctggctcaggtcccctcggggcaggcaggccttgctacaggggacccagcccgctccccgagttcggcccccaagccccgacgggtcgacttcacaagaggaatcccccagccacttcacagctgtccccggggaaccactgggagacgaaacacaggggcagcagccactgcagctggaggaagaccagagggcgtggcaacgcctcgagcagttgatattgggccagctagaagagttgaaacaacagctagagcaacaggaagaggaactgggcaggctgcgcctaggcgtcggagctaccgactcagagaaacgcgtgcagcatttgacgctggaaaatgaggcattgaaacagtccttaagcctcatgcgagatctgctgcttcattggggtcctggcccccctattcgagcacctcaggaggaggctgaagcccttctggagctgcaaggaagactccaggaggctcaggacaccacggaagcgcttagagctcaattgggggtccaagaagtgcagttgcaggggttgcagggagctctccagcagttgcagcaggaaactgagcaaaattgccgtcgggaactgcagcagatgcacggtcagctggcgggtctccgggcaagaatggcttccctgcggcaggggtgtggagatctccgaggtctcgtgtcaacatttactcagtcctgccagggatctctgagcgaggcccgaggacaggtctcctgggctcttggcgccttgtcctcaggtggtccaggtacacaactccccgagggacagcagggcccaccagcagggtgcccaggccggttgccggaattgaagggaaacatccgcgtcctgtgtcggctccgaccaggaacaagttctagcctcgtttctgtggagcccggccccggggggaccgtgaccacctgttatcggggaaggcaccgccgttttcgactagactgggtatttccccctgacgcttcccaagaggaagtgttccgcgaactggagcctgctgttctgtcttgtttgcgcgggtactcagtgtgtatatttacctatgggcagactggtacaggaaagacatattctatggaggggccacccgaagacccgggaatcgtgcccagagctctccagtcactgtttagagaaatgggcgccggtcgacaacatcgcgtcacactgtctatggtcgagatctataatgaagccgtgcgagacctgctggcaccaggtccccccgaacgactagcagtgcgacagggaccagaagggcaaggtggcattcaggttgctggcctgacacactgggatgtccctaatttggaaaccctacaccagatgctgaagctggggcgctctaatcgggccaccgctgcgactgccatgaatcagcgctcttcaaggtcccatgcactggtgaccttgaccctgagggccgcgagtccccccagagcgcccgggacagctggaaccctccacttggttgatcttgccggatccgaacgcgcgagaaaagctggggccgcaggacctcctcgtggggacccggatggagctagaaggctccgagaagctcaaacaatcaataggtccctgctggccctgggaggcgttatggcagcactccgtgcccatcggccccacgtcccctttcgtgactctcagctcacccggcttctgcagccagcgctcggtcctggcacaacagctgtcctccttctccaggtgggcgccggcgccgggcaagtttgtgcttgccgtagtcctcccactcgggcccggccccccgcccccttggccaggaggagccctagagggagacggatttctgggcggcagtctgctccctcctcatcacccacagagtgggtcaagtggagttggggccaaccaggcgccgccggtagcagagctccccctgggagactcctccccagtgctcctactctgagatcacccgggccacctgcacctcttcgcaggccactcgccgttcttcatgcccctgtgccaaccaccgcccgagcaagacttagcaggccccagcgcgcttgtccaagcagcccgggctcaagaccttgtccatggggtcttaggccaggcctttgctggcagcgcagatag

SEQ ID NO: 14242 - DNA, 597 bp, Artificial Sequence
  Description of Artificial Sequence: Synthetic coding sequence
atggccagcggcaacgcaagaatcggcaagcctgcacccgattttaaagccacagcggtagtcgacggcgctttcaaagaagtcaagctgagtgattacaagggcaagtacgtagtcctatttttttacccgttagacttcacatttgtgtgcccaacagagattatcgccttttctaacagggctgaggatttcaggaagttaggatgtgaggtactcggggtgtctgtcgattctcagttcacccacctcgcatggatcaatactcccaggaaagaaggcggtctggggccgttgaatattccactactggcagacgtgaccaggcgcctgagtgaggactatggtgtcctgaaaaccgatgaaggcattgcatatcgaggcttgttcattattgacggaaagggcgtgttaagacaaattactgtgaacgatctccctgtgggcagaagtgtcgacgaggctctccggttggtgcaggcctttcaatacacagatgagcacggtgaagtgtgtcctgctggctggaagccaggcagcgataccattaaaccaaacgttgacgatagcaaagaatacttttcgaaacacaactag

SEQ ID NO: 14243 - DNA, 1380 bp, Artificial Sequence
  Description of Artificial Sequence: Synthetic coding sequence
atgtctgtgcgtttcagcagtacatccaggcggctgggctcatgcggggggacagggtcagtgcgcctctctagcggaggagcaggtttcggggccggaaacacttgtggcgtgccaggcattggctccggattctcatgtgccttcgggggatccagctccgccggcgggtacggaggggggctaggcggaggaagcgcctcttgcgccgcctttactggcaacgaacacgggctgctaagtggcaacgaaaaagtcaccatgcaaaatttaaatgacagactggctagctacttagaaaatgttagagcactggaagaggctaatgccgatctcgaacagaagataaaaggctggtatgagaaatttggtcccgggagctgtcggggactagaccacgactatagcaggtacttccctattatcgacgagcttaaaaaccagattatcagcgccaccacaagcaatgctcacgtcgtactgcagaacgataacgcccgtcttaccgctgatgatttcaggctcaaattcgagaatgagctggccctgcatcaaagcgttgaagcagacatcaacggactgagaagggtgctcgacgagctaacactgtgtcgaacagacctagagatccagctggagacactctccgaagagttggcatatctgaagaagaatcacgaggaggagatgaaagcgctgcagtgtgctgccggcgggaacgttaacgttgagatgaacgccgcacccggtgttgatctgacagtactgctgaacaacatgagggccgagtatgaggcgctggccgaacagaatagaagagatgctgaggcgtggtttaatgaaaagtccgcatcgctccagcagcagatatctgatgacgcaggagccacaacaagcgctagaaacgagctgatagagatgaagcggaccctgcaaacgctcgagatagaactccaatctctccttgctaccaaacattctctcgaatgctcccttactgagactgagagcaattactgcgcacaactcgcccaaatacaggcccagatcggggccctagaggagcagctgcaccaagtaagaacagagacagaaggccaaaagctagagtacgagcagctgctggatatcaaagttcatttggaaaaggagattgagacttactgcctactgatcgacggcgaggacgggtcctgcagcaaaagcaaagggtatgggggtcccggtaatcaaaccaaggacagcagcaaaactactattgttaagactgtggtggaggagattgatccccggggtaaagtgcttagtagccgggttcatacagttgaagaaaagtccacaaaggtgaacaataaaaatgagcaacgcgtgtctagctag

SEQ ID NO: 14244 - DNA, 834 bp, Artificial Sequence
  Description of Artificial Sequence: Synthetic coding sequence
atgccatctgtgtctaaagccgctgcagctgcactctctggcagcccgccccagacagaaaagccaacacactatcgttacctaaaggagttccgcacggaacagtgcccactgttttcacagcataaatgtgcccagcaccggccatttacttgttttcactggcactttctcaaccagagacgccggaggcccttgcgccggagagacggaactttcaactatagcccggatgtttactgtagcaagtataacgaggccacaggcgtgtgtcctgacggcgacgagtgtccatacctgcataggaccactggcgacacggaacggaagtaccacctgcgatattacaaaactggtacatgtatacacgagactgatgctagagggcactgcgtgaaaaacggactacactgtgcgtttgctcatggacccctggatttacgacctcccgtgtgcgatgtgagggaactgcaggcccaagaggctctgcaaaacggccagctgggcggcggagagggtgtgcctgatttgcagccaggggtgctggcttcgcaggccatgatagagaaaattctcagtgaagacccaaggtggcaagacgccaatttcgtgctggggtcttataaaaccgagcagtgccctaagccaccgcgcctgtgtagacagggctatgcctgcccccactatcataattcccgggaccggcgacgcaatccgagacggttccagtactcctggcaactcggtaggcgggtcttgcggctgagtccacgcgctaataaccctcgggtcgctctgcctagagttcacactggcccttctagcaccgcctag

SEQ ID NO: 14245 - DNA, 918 bp, Artificial Sequence
  Description of Artificial Sequence: Synthetic coding sequence
atggacctgtcaggggtaaaaaagaaatccttattaggagtgaaagagaataacaagaaatctagcactagggcgcctagcccaactaagaggaaggaccggtcggacgaaaagagcaaggaccggtccaaggacaaaggtgccaccaaagagagcagcgagaaagaccgggggcgtgacaaaacgcgtaagaggcgatccgctagtagcgggagttcctctacaagatcaaggtcttcttccactagttcaagtgggagctcgacgtccactggctccagtagcggatccagttcatcctccgcgagttcacgaagtggcagctcttccacgtcccgatcatccagttctagctctagttctggttctccctcccccagcaggaggcgccacgataaccgacgaagaagcagatctaaatctaaacctcccaaaagggacgagaaggaacgcaaaagacgctccccgtctcccaagccgacaaaagttcacattggaaggttgactaggaacgtgactaaagatcacattatggagatattcagcacctacggaaagatcaaaatgatagatatgccagtggagaggatgcatccccatttgtctaagggctacgcctacgtggagttcgaaaacccggacgaagcagaaaaggcactaaagcacatggacggtggacagatcgacggccaggagataacggccactgcggtactcgctccatggccccgccctccgccacgacggtttagcccccccagacggatgctccctcccccccccatgtggagacgcagtccccctcggatgcgacgtcgttctcggtctcctcgcagacgcagccctgtgcgcagacggtccaggtctcctggacggcggaggcaccgctctcgatcttcttctaactcgagcaggtag

SEQ ID NO: 14246 - DNA, 3198 bp, Artificial Sequence
  Description of Artificial Sequence: Synthetic coding sequence
atgcgcaaacaggaggtgcgtacaggacgcgaggcaggacagggtcatgggaccggcagtccagcggagcaggtgaaagccctgatggacctacttgcaggaaagggctctcaaggtagtcaggcgcctcaggccttggaccgtactcccgacgcccctttgggcccttgttctaatgattccaggatccagcggcatagaaaggccctgttatcaaaagtcggaggagggcccgagcttggcggcccatggcatcgacttgcgtctcttctacttgtagaagggctaacggaccttcaacttagggagcacgactttactcaggtagaagccacccggggaggaggccacccagcccggacagtggctctcgatcgactgtttttaccgctctctagagtcagcgttccccccagggtaagcattacgattggcgttgcgggtatggggaagaccactctggtgaggcacttcgtgcgtctgtgggcccacgggcaagtaggcaaagatttttcactggtgttgcccctcaccttcagagatctgaatactcacgagaagctgtgcgctgataggctaatctgttccgtgttcccacacgtaggtgagccttccttggccgttgctgtccctgcccgagccttgttgatcttggacggcctggacgagtgcaggacaccattggacttcagcaacaccgtggcttgcacagacccaaaaaaagaaatcccagtagaccatttgatcaccaatatcattagggggaatctctttcctgaggtgagtatttggattactagtagacctagcgccagcggtcagattcccggaggcttggtggatcgaatgactgaaattagggggttcaatgaggaggagatcaaagtgtgtctcgaacagatgtttcccgaggatcaagccctgctaggctggatgctctcacaggtgcaggcggatcgcgcgttgtatcttatgtgtacagtacccgccttttgccgactgactgggatggcgctgggtcacctgtggcgctcccgtactggaccccaggatgcggaactctggccgccacggactctatgcgaactttattcatggtatttcagaatggctctgagcggagaaggccaagaaaaagggaaggcctctcctcggatcgaacaagtggcccatggcggtcggaagatggtaggaacactaggccggctggcgtttcacggcctcctcaagaagaagtatgttttctatgaacaggatatgaaggcctttggcgtcgacctagccttactccagggcgcgccctgcagctgctttcttcagagggaggaaactttggcctccagcgtagcatattgtttcacccatctgagcctacaggagttcgtggctgccgcctactattatggggcaagcagacgcgccatcttcgatctctttaccgagagcggcgtttcttggcctcggctgggtttcttgacacattttagaagcgccgctcagcgagccatgcaagctgaggatggtcgccttgatgtgttcctgcgcttcctgtcaggcctgctgtccccccgagtgaacgccctgctggccggtagcctgctcgcccagggcgagcaccaagcctacagaacacaggtcgcagagctgctgcagggatgtctccgtccagacgccgccgtttgcgcacgcgccattaatgttttacactgcctgcacgaactccagcatacagagctggcccgctccgtcgaagaggctatggagagcggcgccctggcccgtctcaccggaccagcacaccgcgcggcactggcttacctgctgcaggtcagcgatgcctgtgcacaagaggccaacctaagtcttagcctctctcaaggcgtgctccagtccctgctgccacagctcctgtactgccggaagttgaggctggatacaaatcaatttcaggatcccgtaatggagttgttaggaagtgtgctgtctggaaaggattgcaggatccaaaagatcagcttagcagagaaccagatttcaaataagggggctaaagctctcgcaaggtccctcctggtgaatcggtccttgacttcgctggacctgagaggcaattccatcgggccacagggggctaaggccctggctgatgctctcaaaattaatcggacgctgacaagcctgagccttcagggcaataccgtgcgagatgatggggctcgctccatggccgaagctctcgcgtccaatagaactctctctatgctgcatctccagaaaaattccattggtccaatgggcgcccagagaatggcggacgccctgaaacagaatcgcagtctcaaggagttgatgttcagttccaattctataggcgatggcggcgccaaggctctcgcagaggctctgaaggtgaaccaaggcctcgagtcgctggatctgcaatcaaactctatatcagatgccggggttgccgccttaatgggcgctctgtgcaccaaccagacgctcctgtctttgtccctgcgggagaatagtatttctccagaaggggctcaggcaattgcacatgctctatgcgcaaactctactttaaagaatctggacttaactgcgaatctgctccatgaccagggcgctcgcgcaatcgcagtggccgtccgggagaataggactctgacatcactgcatctccagtggaacttcatccaggccggagcggcgcaggccctgggtcaggctctgcagttaaatcggtctttaacctctctggacctccaggagaacgcgatcggcgatgacggagcatgcgccgtggcgcgggccctgaaggttaatacagcactgaccgcactatatctccaagtcgcctctattggggcttcaggggcgcaggtgctgggagaagctctcgcagttaatcgaacattggaaatcctggacctgcgcggaaacgccatcggcgtggcgggcgcaaaagccctcgccaatgctctgaaggtcaattcttccctgcgtagactgaatttgcaggagaattctctgggaatggatggagctatatgcatcgctaccgcactgagcgggaaccatcgtctacagcacatcaacctgcaggggaaccacattggcgattctggcgcccggatgatctctgaagcaatcaagaccaacgctcccacctgcacggttgagatgtag

SEQ ID NO: 14247 - DNA, 927 bp, Artificial Sequence
  Description of Artificial Sequence: Synthetic coding sequence
atgaatcccattgttgtagtccacgggggtggggctggcccaatcagcaaggacaggaaggagcgggtgcaccaggggatggtccgggctgccacagttggatacggaatactgcgcgagggtggatcagctgtcgatgctgtcgaaggcgcagtggtcgcccttgaagatgatcctgaatttaacgctggctgcgggagcgtgctgaacaccaatggggaggttgagatggatgcttctataatggatggaaaggatctgagcgcaggtgcggtcagtgcagttcagtgtatcgccaacccaattaagctcgctagactcgtgatggaaaaaaccccacactgcttccttacagaccaaggagcagcccagttcgccgcagctatgggggtgcccgagatcccaggtgagaaactagttactgaacgaaataagaaacggttagagaaggaaaagcacgagaagggagcacaaaaaacagattgccagaaaaacctcgggacagtcggggccgtcgccttggattgtaagggcaacgtggcatatgccacctccaccggcggtattgtgaataagatggtgggaagggtgggcgactccccttgtctgggagccgggggctacgccgacaacgatatcggtgctgtttcaactactgggcatggggagagcatcttgaaagttaacctcgccaggctcactctttttcatatcgagcagggcaaaactgtggaggaggccgccgatctgagtttgggctacatgaagagccgcgtgaaaggtttgggaggcctcatcgtagtgtcaaaaactggagactgggtcgctaaatggacatccacctcaatgccctgggctgcggctaaggatgggaaacttcacttcggcattgaccctgatgatacaaccatcaccgacctcccttag

SEQ ID NO: 14248 - DNA, 1212 bp, Artificial Sequence
  Description of Artificial Sequence: Synthetic coding sequence
atggccggacggcgggctcagaccgggtctgctcccccaagacctgccgccccgcacccaccagcttcacgtgcttttccgcagcactgtcgcccacgggatgctgagaggcccccctctccgcgaagtcccttaatgccagggtgcgaactgcccgtggggacttgtcctgatatgtgccctgccgccgaacgggcccaaagagagcgggaacatcggctccaccggcttgaagttgtgccaggctgtaggcaggaccccccacgggccgatcctcagcgggccgttaaggaatactccagacccgcagctggcaagccccgtccacctccgtcgcagcttcgcccaccttctgtactgcttgccaccgttcgataccttgccggtgaagtggccgagtcagctgatatagcgcgggccgaagtggcctccttcgtcgccgaccgtttacgggctgtgctgcttgatcttgcactgcagggtgcaggtgatgccgaagccgccgtggtattggaagccgctttagccactttgctaaccgtggtggcgcgccttggcccagacgcagctcgcggtcccgctgatccagttcttctgcaggcgcaggttcaggaggggtttgggagtctgcgacgctgttacgcccgcggagcaggtcctcatcctagacagcccgccttccaaggcctgttcctactgtacaacctgggctccgtcgaagctctgcacgaggtcttacaattgccggccgccttgcgagcatgccccccccttaggaaggcactcgctgtcgacgcggcattccgggagggaaacgcggctcgactattcagactgctgcagactttaccgtatttacctagttgcgcagtacagtgccacgttggacacgctcgtcgagaggcccttgccagattcgcccgagccttctctactccaaaggggcagacactaccactgggttttatggtcaacctgttagcccttgacgggctgcgcgaggcccgagatctgtgccaggcccacggcctgcctctggacggcgaagaaagggtcgtgttcttgcgaggaagatatgtcgaagagggcctacctcccgctagtacttgtaaggtgctagttgagagcaagctgcgaggacgcacactggaggaggtcgttatggccgaggaggaggatgaaggcacagataggccaggaagtcccgcgtag

SEQ ID NO: 14249 - DNA, 894 bp, Artificial Sequence
  Description of Artificial Sequence: Synthetic coding sequence
atggccgagctaacggccctcgaatcactcattgagatggggtttccccgcgggcgggcggagaaggccctggcgctgacggggaaccagggaatagaggcagctatggattggcttatggagcacgaagatgatcccgacgtcgacgaacccttggagacaccactagggcacatcctgggcagggaacccacttcttcagagcaggggggcctcgaggggtctggaagcgccgctggcgagggcaaaccagccctgagcgaggaggagcgccaggaacagacgaaacggatgctcgaactggtcgctcaaaagcagagggagagggaggagagggaggagagggaggccctagagagggaacggcaacgtcgtcgtcagggacaggaactctccgcagcacggcagagactgcaggaagacgagatgcgccgggcagcggaagagcggcgccgagaaaaagccgaggaactggccgcaaggcaaagggtacgggagaagatcgagcgagataaagctgagagggcaaagaaatatggaggcagtgtcggcagccaaccccctcccgtcgcacctgagcctggcccagttccatcttcacctagccaagaaccaccgacgaaaagagaatatgaccagtgtaggatccaggtccgcttaccagatggcacctctcttacacagaccttcagggctcgggagcagctggcggccgtaagactgtatgtcgaactgcacagaggtgaggagctgggcgggggccaggaccccgtccagctgctgagcggattcccaaggcgggcgttcagcgaagcggatatggagcgcccccttcaggaactgggactcgtcccatccgccgtgttaatcgtggctaaaaagtgccctagttag

SEQ ID NO: 14250 - DNA, 570 bp, Artificial Sequence
  Description of Artificial Sequence: Synthetic coding sequence
atgcgtctttctctgcccctcctcttgttactgctgggcgcgtgggcaatcccgggaggattgggcgaccgggcccctctgaccgcaaccgctcctcagctcgatgacgaagagatgtattcagctcacatgccagctcatttgcgttgtgatgcatgccgcgccgtggcataccagatgtggcagaatctggccaaggccgagacgaaacttcatacctcgaactccgggggcagaagggagctcagcgaactggtgtacacagatgttctcgataggtcctgctcacgcaactggcaagactatggcgtgagggaagtcgatcaggtaaagcgactcactgggcccgggttgtctgagggccctgagcctagcatcagcgttatggtaaccggtggcccatggcccactaggctgtctagaacatgtctccactatctgggggagttcggcgaagaccaaatctatgaggctcaccagcaggggcggggcgcccttgaggcactgctgtgcgggggaccgcagggggcctgcagcgaaaaagtttctgccacccgagaagagctgtag

SEQ ID NO: 14251 - DNA, 3129 bp, Artificial Sequence
  Description of Artificial Sequence: Synthetic coding sequence
atggcaaacgattctcccgctaagtctctcgtggacattgacctgtcaagccttagagaccctgccggtattttcgagctagtcgaagtggtgggcaacgggacatacggccaagtttacaaaggccggcacgtaaaaacgggccagttagcggccattaaggttatggacgtgacagaagacgaagaggaggagatcaagcttgaaattaacatgctgaagaaatactcacaccatagaaacattgccacgtattacggcgcatttatcaaaaaaagcccccccggtcacgatgatcagctttggctggtaatggaattctgcggagcaggctccatcacagacctggtgaaaaacacgaagggtaacacgctcaaagaagactggattgcttatataagcagggagattcttcgggggcttgcccacttgcacattcaccacgtgatccatcgggacattaaaggccagaacgtattactgaccgaaaacgcagaagtgaagcttgatgagacagagtacgagtatagcggaagcgaggaggaagaggaggaggtccctgaacaggaaggagaaccctcctccattgtgaacgtgccgggggaatccactttgagacgggatttcctcaggttgcagcaggagaacaaggaacgcagcgaagccctgaggaggcagcagctcttgcaagagcaacagctccgtgaacaggaggaatataagcgtcagctattggctgaacgccagaagcgaatcgagcaacagaaggagcaacgccggcgattagaggaacagcaacggcgtgaacgcgaggcacgtagacagcaggaaagagagcaaaggcgacgtgaacaggaagagaaacgtcgtctggaggagttggaacggcggcgcaaggaagaagaggagcggcgaagggcagaagaagaaaagaggcgggttgaaagggaacaggaatacattcggagacagctggaagaggaacagcgacacctggaagttctccaacaacaactcctgcaggagcaggctatgctgctagagtgtagatggcgggaaatggaggagcaccgccaagccgaaagattgcagaggcagctgcaacaagagcaggcttacttattgtcgctgcagcacgatcataggagaccacatccccagcattcccagcaaccaccgccccctcagcaagagagatccaagccatctttccacgctcccgaaccaaaagctcactatgaacccgcagatcgagcaagggaggtgccggtgcgcactacatccagatcccctgtgctcagccgccgagattcccctctccaggggagtgggcaacagaactcccaagccggccagcgtaattcaaccagctccattgagccccgattattgtgggaacgggtggaaaagctggttccgaggcccggcagtggatcttctagcggatcctcaaactccggcagtcagcccggcagtcatccagggtcccagtccgggagcggggaaaggttccgcgttaggagttcatctaagtctgagggaagtcccagtcaacgactagagaacgccgtgaaaaagcccgaagacaaaaaggaagtgtttaggcctctgaaaccagcagtgcgaattgatctgacggcacttgccaaagagttgagagcagtggaggacgtccgccccccacacaaggtcaccgattacagtagcagttccgaagagtcaggaacaactgacgaagaggatgacgacgtggaacaggagggcgccgatgaatcaacatcgggacccgaggatacgcgtgcggcgagcagtctgaacctatctaatggagaaactgagtcagtcaagaccatgatagttcacgatgatgtcgaaagtgagcctgctatgaccccttcgaaggagggtaccttgatcgtccggcagacccagtcagcctcctctacattgcagaagcataaatcaagctcaagctttaccccatttattgatccgagactcctgcagatcagtcctagctcaggcacaaccgttactagcgtggtgggcttcagttgcgacgggatgcgtcccgaagcaattagacaggatcctactaggaagggatccgtggtcaacgttaaccctaccaacacacgaccccagagcgatacccctgaaatcagaaaatataagaagcgcttcaatagcgagattctgtgcgccgctttgtggggggtgaacctgctggtgggaacagaaagtggcctgatgttgctcgaccgtagtggtcaaggcaaagtttacccattaatcaacaggcggaggtttcaacagatggacgtccttgaaggacttaatgtgcttgtcacgatatctgggaaaaaagacaagctgcgggtgtattatctgagctggttgaggaacaaaatccttcataacgacccagaagtcgaaaaaaagcaagggtggacaacagtgggtgatttagagggctgtgtccattacaaggtggtaaaatacgaaagaatcaaatttctggtgatcgccttgaagtctagcgtcgaagtgtacgcatgggcccctaaaccgtaccacaagttcatggctttcaaatcctttggggaattggttcacaagcccttgctggtggacctaacggtggaagaaggccagcggctcaaagtgatctatggtagctgtgctggcttccacgctgtggatgtggatagcggctctgtgtacgacatttatcttcccacgcatattcaatgttccattaaaccacacgccatcattatacttcctaacacggatggaatggaactgctggtatgttatgaggacgagggagtctatgtcaacacttatggcagaatcaccaaggacgttgttctacaatggggggagatgcctacttcagtggcctacatacgtagcaatcagaccatgggatggggcgaaaaggcgatcgaaataaggtcagttgaaaccggccaccttgacggtgttttcatgcacaagagagcacagagactgaaatttctgtgcgagcgcaacgacaaggtgttctttgcctccgtcagaagcggtggatcctcacaggtttactttatgacattagggcggacctcactgctgtcatggtag

SEQ ID NO: 14252 - DNA, 1113 bp, Artificial Sequence
  Description of Artificial Sequence: Synthetic coding sequence
atgggtttcaaccgaccatcaaaaatccaggagaacgccctgccaatgatgctggccgagcctccccagaatctgatcgcgcagtcgcagtcaggcacgggcaagacggctgcatttgtgctggcaatgctgtcgcgggttgagccctctgaccgctatccacagtgcctttgcttatctcctacttacgaactcgccctgcagaccggcaaggtgatagaacagatgggaaagttttacccggagctgaagttggcctatgctgtccgagggaataagttagagaggggccagaagatttccgagcaaattgtcattgggacaccaggcactgtactggactggtgttcaaaactgaagttcatcgatccgaaaaagatcaaagtcttcgtgctggacgaagccgacgtgatgattgcgacacaagggcaccaggatcagtcaatcaggattcagaggatgctgcctcggaactgccagatgctattgttctccgctactttcgaggactccgtttggaagttcgcccagaaagttgtgccagatcctaacgttattaagctgaaacgagaggaggagacacttgatacaataaagcaatactacgtgctttgctcctccagggatgagaagtttcaggctctgtgtaacctttatggggccatcactattgcacaggcaatgatcttctgccacacgcgaaaaactgccagctggctggccgcagaactgtccaaagaaggtcatcaagtggccctgctttccggtgagatgatggtcgagcagagagccgccgtgattgagaggtttcgagaaggcaaggagaaggtccttgtcaccacaaatgtttgcgctaggggcatcgacgtggagcaggtgtccgttgtcatcaattttgacctccccgttgacaaggacggcaatccagataatgagacatacctgcatcggattgggaggaccggccggtttggcaaacgagggttggccgtgaatatggtagattccaagcatagcatgaacattcttaaccggatccaggaacacttcaataaaaaaattgaaagattagacactgatgacttggacgaaatcgagaaaattgccaactag

SEQ ID NO: 14253 - DNA, 1437 bp, Artificial Sequence
  Description of Artificial Sequence: Synthetic coding sequence
atggcaaccgactcctgggcattggcggtcgatgagcaggaggctgcagtgaaatccatgaccaacctgcagatcaaagaagaaaaggtcaaagccgatacaaacgggatcatcaaaacctcgaccaccgccgaaaagaccgatgaggaagaaaaggaggacagagccgcccaatcgttgttaaacaaacttatccggagcaacctggtggacaacaccaaccaggttgaagtcctgcagagggaccccaatagccccttgtatagtgttaagagctttgaagagctgcggctgaaaccccagctattacagggagtttatgctatgggcttcaatcgaccttcgaaaattcaagagaacgccttgcccatgatgctggctgagcctccgcagaacttgatagcccagtcacagagcggcaccgggaaaacggctgcttttgttctggcgatgctaagccgcgtagaaccctccgacagatacccacagtgcctatgcttgtccccaacctatgaactcgccctgcagactggaaaagttattgaacagatggggaaattctaccccgagctgaaacttgcctacgcagtcaggggcaacaaactcgaacgcgggcagaaaatatccgaacagatagtcattggcactcccggtactgtgttggactggtgtagtaaactaaaattcatagaccctaagaagatcaaggtattcgtgctcgatgaagctgacgtcatgattgcaacgcagggacaccaggatcagagcattagaattcaaagaatgctgccaagaaactgccaaatgctgctgttctctgctacttttgaagatagtgtctggaaattcgcccagaaggtggtgcccgacccaaacgtgatcaagcttaaacgcgaggaggaaaccctggatacaatcaagcagtattacgttctctgttctagtcgtgacgaaaagttccaggcactgtgcaacctgtatggcgcaatcaccatcgctcaagcgatgatcttttgccataccagaaagaccgcatcatggcttgccgccgagctctccaaggaaggacatcaagttgcgctgctgtctggtgagatgatggtcgaacagcgggcagcagtcattgaacggttccgagagggtaaagagaaggtcctggtcacaacgaacgtttgcgctcgtggcattgatgtcgaacaagtttctgtagttatcaattttgaccttccggtggataaggacggcaatcccgacaacgaaacttacctgcatcggatcgggcggaccgggaggttcggcaagagaggcctcgccgttaatatggtggatagcaaacattccatgaatattttgaaccgcatccaagagcattttaataagaagatagaaaggttagacacagatgacctggacgagatagaaaagatcgcaaactag

SEQ ID NO: 14254 - DNA, 2238 bp, Artificial Sequence
  Description of Artificial Sequence: Synthetic coding sequence
atggtgggaccgggacccactgcagccgccgctgtcgaagagcgccagcggaagcttcaagagtatttggccgccaaaggcaagcttaagtctcagaatactaagccctacctgaagtcaaagaacaattgtcagaatcagccaccaagtaaaagcacaatccggccaaagaatgacgtaactaatcacgtggtgctgcccgttaagccgaaacggagtatctcgatcaaactccagccccggccccctaatacagcgggcagccaaaagccaaagcttgagccgccaaagctcctgggtaaacgactaacatcagagtgtgtgagctcgaacccttacagtaaaccctcgtctaagtccttccaacagtgtgaagctggcagcagcaccaccggcgaactttccagaaagccagtgggtagtctaaatatcgaacagcttaagacaaccaaacagcagctcacagatcagggaaatggcaagtgcatcgactttatgaacaacattcacgtggaaaacgagagcctcgacaacttccttaaagaaactaacaaagagaacctgttggacatcttgactgaacccgagagaaagcctgatcccaaactgtacacgaggagtaaacccaagactgacagttacaatcagacgaaaaattcactggtcccaaaacaggctctcggcaaatcctctgtaaattcagccgtactgaaggatcgcgtgaataagcagtttgtgggtgagacacagagtcggacgtttcccgtgaagagccagcagctctcacggggagccgatctggcgaggcccggcgtgaaaccctcccgcactgtcccttctcatttcattagaactctctccaaagtccagagcagcaagaagcccgtggtcaagaatattaaggatattaaagtgaatcggagccagtatgaaagacctaatgagaccaaaattcggtcatacccagtgacagagcagcgcgtaaagcacactaagcccaggacctacccttctctgctgcagggcgagtacaataacaggcacccgaatattaagcaggaccagaagtcttcccaggtctgtatcccacagactagttgcgtccttcaaaagagtaaggccatctcccagcgccctaatctgaccgtgggacggttcaattctgctataccttccactcctagtattcgaccaaacggaactagcgggaacaagcacaacaataacggttttcaacagaaggcccaaacactagacagcaaactgaaaaaagccgtaccccagaaccacttcctgaataagaccgcccctaagacacaggctgacgttaccaccgtgaacggcactcaaactaatcctaacatcaagaaaaaggccactgcagaggaccggaggaaacagctggaagagtggcaaaagtcgaaaggtaaaacttacaaacgcccccctatggagcttaaaaccaagagaaaggtaattaaggagatgaacatttccttctggaagagtatcgagaaggaagaagaggaaaagaaggcccagctcgagttaagttcaaaaattaataacaccctgacagaatgtctaaacctcatagaaggtggcgtccccagcaacgagatcctgaacattctgtccagcatccctgaggccgagaagtttgcaaagttctggatctgtaaggctaaacttcttgcctcaaaaggaacattcgacgtcatcgggctgtacgaagaggccattaaaaacggtgctaccccaatccaggaattaaggaaggtcgttctgaacattctccaggattccaaccggaccaccgagggtattacctccgatagcctggtagcagagaccagtattacttctgtggaggagctcgccaagaagatggaaagcgttaagtcctgcctcagccccaaggaacgcgaacaggtgacagcaactccgcggattgctaaagccgaacagcataattatcctggcataaaactccagattggtcctattccacgtataaacggcatgcctgaggtccaagacatgaaattcatcacacccgtgaggcgcagcagccggattgagcgcgccgtgtctcggtaccctgaaatgctccaagaacacgacctggtggttgcctctctggacgaacttctcgaggttgaggagaccaaatgttttatattcagaaggaatgaagcgctgccagttactctaggttttcagacccctgaatcttag

SEQ ID NO: 14255 - DNA, 378 bp, Artificial Sequence
  Description of Artificial Sequence: Synthetic coding sequence
atgtcttccactctgggcaaactgtccaatcaggtggaggaaactctcccactgctgaagaaagttccagcaaactattttcacatttgctcagctattctgatgggcttctcactatccaaatccgccacgcaggtaagcgctattcacatggattcgaaagtggatgatcacctgattcgcggtaccgagaagtcccggctggaacccgccacacagctgttccagaacaccaaaaagatcaggttggaggatactaaccaggagaactttacacgcatcgagggaacaggcacgggcagcttgtccggcaaggccctcggatctgtagtgtatgtgaaagagagcgatggactggaaatgacagacgtggagtag

SEQ ID NO: 14256 - DNA, 4284 bp, Artificial Sequence
  Description of Artificial Sequence: Synthetic coding sequence
atgtcaatgctaaaacctagcggactcaaggctcccacaaagatcctgaagccaggttctaccgcccttaagacccccacagctgttgtggcacctgtggaaaaaaccattagtagcgaaaaggccagctccactcctagttctgagacacaagaggagttcgtagacgattttcgtgttggtgaacgggtctgggtcaacggaaataagcctggatttatccagttccttggcgaaactcagtttgcaccagggcagtgggccggaatcgtgttggatgaacccattggaaagaatgacggtagcgttgccggagttcgatattttcagtgcgaacccctgaaagggatttttacaagaccatcaaagctaacaaggaaggttcaagccgaggatgaagccaatggactgcagaccacacccgccagccgagcgacatcccccttgtgcaccagtactgcgtcgatggtttcttcttcccccagcacaccttcaaacatcccgcaaaaaccgtcccagccagctgccaaggagcccagcgctacccccccaatctctaatcttaccaagaccgcttcagagtctatcagcaatttgtccgaagccgggagcattaaaaaaggggaacgagaacttaagatcggcgaccgtgtgcttgttggcggcacgaaggcaggcgttgtcaggttcttaggggagaccgacttcgccaagggagaatggtgtggtgttgagctggatgagccgctgggcaaaaatgatggagctgtcgccggtaccaggtactttcagtgtcaacccaaatacggactttttgcccctgttcacaaagttactaagatcggctttcccagcaccactcctgccaaagcaaaagcgaacgcagtgcgtcgcgtgatggccaccactagtgcatcccttaaacgaagtccctctgccagcagcttgagctctatgagtagcgtcgcgtctagcgtatcgtcgcgtcctagtcgcactggtctactgacggaaacctcatcgaggtacgctaggaagatcagcgggactaccgctcttcaggaggcactcaaagaaaaacagcaacatatcgagcagctgttagccgaaagggatctggaacgagcggaggttgcaaaagccacttcccatgtgggcgaaatcgagcaggagctggcccttgcacgagatggccacgatcaacatgtgctggagctggaggctaagatggaccagctccggacaatggtggaagcggcggaccgggagaaggttgaattactgaaccagctggaagaggagaagaggaaagtggaggacctgcagtttagagtggaggaggaaagcatcactaagggcgacctagaaactcagacaaagcttgaacacgcccgcataaaagagcttgagcagagcttactttttgagaaaaccaaggcagacaaactccagagagagctggaggatacaagagtggcaaccgtttcagagaagtctagaatcatggagctggaaaaagacctggcacttagagtgcaggaggtggcagaattgagacggagattggaaagcaacaagcctgccggcgacgtagatatgtctctcagcttgctgcaggagatcagttctctgcaagaaaagctcgaggtgactcgtaccgaccaccagcgtgagatcaccagcctcaaagagcattttggcgctcgcgaggaaacccaccaaaaggaaattaaagctctatatacggccactgaaaaactttctaaggaaaacgaaagcctaaaatcaaagctcgagcacgcgaacaaagagaacagtgacgtgatcgccctgtggaagtccaagctagaaacagccatcgcctctcaccagcaggcgatggaggagctgaaagtctccttctcgaaaggactggggaccgaaaccgctgagttcgctgagctcaagacccagattgagaagatgcggctagactatcagcacgaaatcgagaacctgcaaaaccaacaggattctgagagggccgcccacgcaaaggaaatggaagcactgcgagcgaagctcatgaaagtaattaaggagaaagagaacagccttgaggccatcaggagcaagctcgataaggccgaagaccaacacttagtggagatggaagataccctcaacaagctccaagaggcagaaattaaagtaaaggagctagaagtgctgcaggccaagtgtaacgaacaaacaaaggttattgataattttaccagccagctgaaagccactgaagaaaaactactcgatcttgatgctctccgcaaggccagctccgagggcaaatcagaaatgaaaaaacttcggcagcagctggaggccgcagaaaaacagataaagcacctggaaatcgaaaagaatgcggagagcagtaaggccagctcaatcacccgcgagcttcaaggaagagagttgaagttgacaaatctgcaagagaacctgagcgaggtgtcccaggtgaaggagacactagaaaaagaactccagatcctgaaggagaaattcgccgaggcaagtgaggaggcagtttcggtgcagaggtccatgcaggaaaccgtaaacaagctccaccagaaagaagaacagttcaacatgttgtcctccgacctggagaagctgcgtgagaatctcgccgatatggaagcaaagttcagagaaaaggacgagagggaggagcaactaattaaggccaaagagaaactcgaaaatgatatcgcagagattatgaagatgagtggcgataattctagccagctgacaaagatgaacgatgagctgcgcctgaaagagagagacgtcgaggaattgcagcttaaactgactaaggcaaatgagaacgcaagcttcttacagaaaagcatcgaggacatgaccgtaaaagctgaacagagtcaacaggaggctgccaagaaacatgaggaagaaaaaaaagaactggagaggaaactctccgacctagagaagaaaatggaaacatcccataaccagtgtcaggagctcaaagcacgctacgaaagagctacttctgaaacaaagactaagcacgaggaaatcttacaaaatttgcaaaaaacactcctggatacagaggataagctgaaaggtgcacgagaagagaattcaggattgctgcaagaattagaggagctccgcaaacaggctgacaaggctaaggccgcccagactgccgaagatgccatgcagatcatggagcagatgaccaaagaaaagacggagactttagccagtcttgaagacacaaagcagaccaacgccaaactgcagaatgagctagacaccctcaaggaaaataatttgaagaatgtagaagagttgaataagagtaaagagcttttaactgtggagaaccagaaaatggaagagttcagaaaggagatcgagactctcaaacaggccgccgctcaaaaatctcagcagctcagtgccctgcaggaagaaaatgtgaagctcgccgaagaactggggcgctcccgggacgaagtgaccagccaccagaaactcgaggaagaacgcagtgtgctgaacaatcagcttctcgaaatgaagaagcgagagtctaagtttatcaaggacgcagacgaggagaaggcctctttacagaaatccattagcatcacatccgccttgcttaccgagaaggacgcagagctggaaaagctgcggaacgaggttaccgtgcttcgtggagagaatgcttctgccaagagcctacactcagtcgtgcagactttggaaagtgataaggttaaactggaattaaaggtcaagaacctggaattgcagttaaaagaaaacaagagacagctgtcctcgagctctggtaacaccgatactcaggcagacgaggatgaacgggcgcaggaatcccagattgatttcttgaactctgtaattgtcgacttgcaacgcaagaatcaggaccttaaaatgaaagtagaaatgatgtccgaagcagctctaaatggaaacggtgatgacctcaacaactacgattctgatgaccaggagaaacaatctaagaaaaagccaaggttgttttgtgacatttgtgactgtttcgaccttcacgataccgaggattgtcccacgcaggctcagatgagcgaggaccccccccattcaacccaccatggttcccgtggcgaagagcggccctactgcgaaatctgcgaaatgttcggccactgggccactaactgcaacgacgatgagaccttctag

SEQ ID NO: 14257 - DNA, 975 bp, Artificial Sequence
  Description of Artificial Sequence: Synthetic coding sequence
atggcatctagcaacaccgtgctgatgcgacttgtcgctagtgcctattccattgcccagaaggccgggatgatcgtgcggagggtgatcgcagaaggggatttgggcatcgtggagaagacatgtgctaccgatctgcagacaaaagcggatcgattggcacagatgtccatctgcagttctctggcaagaaaattccccaagctcactatcattggcgaggaagacctgccctcggaagaggtggatcaggagcttatcgaagattcccagtgggaggaaattctgaagcagccttgccctagtcagtactctgctatcaaggaggaagacctagttgtttgggtagaccccttggacggtaccaaagagtacactgaaggactgctcgataacgtaactgtcctcatcggaattgcttacgagggcaaggccatcgctggggttattaaccaaccctattataactatgaagccgggccggatgccgtgctcggtcgcacaatttggggtgtgctcggccttggagctttcggctttcagctcaaggaagtcccagccggcaaacacattatcacaacaaccaggagtcactccaacaaattagtgacggattgtgtagcggccatgaaccccgatgccgtgcttcgggtgggaggggctggcaacaagatcattcagctgattgaaggaaaagctagcgcttatgtattcgccagccccggatgcaagaaatgggatacatgcgccccggaagtgatcctccacgcggtggggggtaagttaacagatatccacggcaatgtgctgcagtatcacaagggcgtctcccaccgcacatggcccaaacccgacttctttagggcccaattcttcctggagtcgcactcttgtttttccaactttaagaatgtttcaacccctattaagaacatctacgacgttatcatttacgcatatgagacggatttgtag

SEQ ID NO: 14258 - DNA, 270 bp, Artificial Sequence
  Description of Artificial Sequence: Synthetic coding sequence
atgggcacgaaacgggaagcaattctgaaggtgttagaaaatctgacgccggaggagctcaagaagttcaaaatgaaactgggcacagtccctttacgcgagggcttcgagagaattccacggggagctctagggcaactcgatatcgttgaccttactgacaagctggtagccagctattacgaagactacgccgcagaacttgtggtagcagtgctaagagatatgagaatgctggaagaagcagcccgccttcagagggccgcatag

SEQ ID NO: 14259 - DNA, 867 bp, Artificial Sequence
  Description of Artificial Sequence: Synthetic coding sequence
atgactgtagggaagtcatcaaaaatgctgcagcacatcgactatcgaatgcgctgcatactgcaagacggccgcatttttataggtaccttcaaggcctttgacaaacacatgaacctaattctgtgcgattgtgatgagtttaggaaaataaaacctaaaaactcaaaacaggcggaacgagaagagaagagagtgcttggcctggtcttgctacggggcgagaatttagtctccatgacggttgaaggtccaccccctaaggacaccggtattgcccgcgttcctctcgctggcgcggccggtggcccaggtattggccgggcggccgggcgcgggataccagcgggtgtcccaatgccacaggctcctgctgggctggcgggcccagtgagaggcgttggaggaccgagccagcaggttatgaccccacagggtcggggcacagtggccgccgctgccgcggccgccacagcaagtattgccggcgcccctacccaatacccccctggtcggggaggccctcctcctccaatgggtaggggtgccccacccccaggaatgatgggccctccccccgggatgcgtccccccatggggccaccgatgggaatcccccctggaaggggaacccctatggggatgccacctccagggatgcgcccacctcctccaggctgcgaggcattcttcgacccatggccacagtcgatggaggttgccccccagaggcggggcctggatagttctgggccgcgatatcaccgcccagtctgttttctatgctgttgttcttggagtctcatgggactgagtgggttcctgaccgggccacccccccctggcatgcggccaccgagaccctag

SEQ ID NO: 14260 - DNA, 3300 bp, Artificial Sequence
  Description of Artificial Sequence: Synthetic coding sequence
atgcacataaaatccatcatcctagaaggtttcaagtcttatgctcagcgcaccgaagtgaatggattcgaccctctgttcaacgcaatcaccggcctcaatgggtcgggcaagagtaacatcctggattctatttgtttcctgctggggattagtaatctgtctcaggtcagggcttcgaacctccaggacttagtttacaagaacggtcaggctggcatcactaaggccagcgtgtcaatcaccttcgacaactcagataaaaagcagtccccacttggctttgaagtccatgatgagattaccgtcaccagacaggtggttattggcggacgcaacaaataccttattaacggagtgaacgccaataacacgagggtccaggatctcttctgctctgtcggcttgaatgtaaacaacccccacttcctcataatgcagggtaggatcaccaaggttcttaatatgaaaccaccagagattctctccatgatcgaagaggctgctggcacacgtatgtatgagtacaagaaaatcgctgcgcaaaaaacaatagagaagaaagaggccaagctgaaggagatcaaaactattctggaggaggagattacacctaccatccagaaattgaaagaggagaggtctagctacttggaataccaaaaggtgatgagagaaatcgagcatttgtcgagactctacattgcctatcaattcctactagctgaggacacgaaggttcgaagtgctgaagagctgaaggaaatgcaggataaggtcattaagcttcaggaggagctgtctgagaatgacaaaaaaatcaaagccctgaatcacgaaatcgaggaattggaaaagcgaaaggacaaggaaacaggcggcatccttcggtccttggaagatgccttggcagaagcccagagggtaaacacaaaaagccagtccgcttttgacctcaaaaaaaagaaccttgcatgtgaagaatcaaaacggaaagagctcgaaaaaaatatggtagaggacagcaaaacactcgccgctaaggagaaagaggttaaaaaaatcaccgacggtctgcacgcactgcaggaggctagtaacaaagacgccgaagcgttagccgcagcgcagcaacactttaacgccgtgagtgccggtctgtccagcaacgaggatggagctgaggccacactagccggacagatgatggcctgtaaaaatgatatctctaaggcccagactgaagccaagcaagcacagatgaagctgaagcatgcacagcaggaactgaaaaacaagcaagctgaagttaaaaaaatggactctggatacagaaaggaccaggaggccttggaggccgtgaaacgcctgaaggagaagctggaggccgaaatgaaaaagttgaattatgaggaaaataaagaagaaagcttgttagaaaagcgtcgccagctgagccgcgatattgggcggctgaaagaaacttacgaggcgcttctcgctcgcttcccgaaccttagatttgcttacaaagacccagagaaaaattggaatagaaattgtgtcaaaggcctggtggcttctcttattagtgtgaaagatacctcggcgaccaccgccttggaactggtcgctggcgaacgtctgtacaatgtggttgtggatacagaagtcacagggaagaagctgctcgaaagaggtgagctgaaacgccgttacaccatcattccacttaataaaatttccgcccgctgtatagctccggaaactctaagggttgcgcagaacctggtgggacccgacaacgtccacgtcgcgctgtctctcgtagaatataaacctgaattacagaaagccatggaattcgtattcggaacaacgttcgtgtgcgacaatatggacaacgccaagaaggtagcgtttgataagcgcatcatgacaagaaccgtcaccttgggcggggacgtatttgacccgcacggtacattaagcgggggtgcccgctcccaggccgcgtccattctgacaaaattccaggagctcaaagacgtacaggacgagttgaggatcaaggaaaatgaattacgcgccctggaagaggagcttgccgggctgaagaacactgctgagaaataccggcagctaaagcagcagtgggagatgaaaaccgaggaggcagacctcctccaaaccaaactgcagcagtccagttatcacaagcaacaggaagaactggatgcactcaaaaagaccatagaagagagcgaggagaccctaaaaaacacaaaagagattcagagaaaggccgaggagaagtacgaggtgctggaaaataaaatgaaaaacgccgaggcagaaagggagcgggaattgaaggatgcccagaagaaattagactgtgccaaaaccaaggcagacgccagctcaaagaagatgaaagagaagcagcaggaggtcgaggctataacccttgagctggaggagctgaagcgcgaacatacctcctataaacaacagctggaggcagttaacgaggctatcaagtcctatgaaagccagattgaggtgatggccgctgaagtggctaaaaataaggagtccgtaaataaggcccaggaagaagtgactaaacaaaaggaggttattacagctcaagataccgtaattaaagccaaatatgccgaggtggcaaagcataaggagcagaataatgacagccagttgaagattaaggagctagaccacaacattagcaagcataagcgcgaggccgaggatggcgccgccaaggtgagcaagatgctaaaggattacgattggattaacgctgagcgccatctgttcggccagccaaatagcgcctatgattttaagaccaataatcccaaggaagctggacagaggctgcagaaattgcaagagatgaaggaaaaactgggacgcaatgttaatatgcgcgccatgaacgtgctgacagaggccgaagagcgttacaacgatctcatgaaaaagaagcggatcgttgaaaatgataagagcaagattctgacaaccatcgaggatttagatcagaaaaagaaccaggctctgaacatcgcgtggcagaaagtgaataaggattttggcagcattttttcaacactgctccccggggctaatgccatgctggctccgcctgaggggcagacagtgcttgatggcctggaattcaaagtggccttgggaaacacgtggaaggagaatcttacagagctaagcgggggacagcgccagaagcagcagaaccatacgacgggctag

SEQ ID NO: 14261 - DNA, 381 bp, Artificial Sequence
  Description of Artificial Sequence: Synthetic coding sequence
atgttccagaaggatgaatactgcattctgatcctcggccttgacaacgccggcaagacaactttcctggagcagagcaaaacaagattcaataagaattataagggaatgtcactgtctaaaattacaaccactgtgggtttgaacatcggtaccgtcgacgtcggaaaggccaggctgatgttctgggaccttggcggccaggaggagctgcagtcgctgtgggacaaggacaaaactaagtgtggggacctcggcaccctccatagcagcaaggtgtctgcctccttccggctgcgggacttggccgctgatcaccacagaacccaaaagtggcagaggcctgacgtgggtactgctggatggctaccgctgccctag

SEQ ID NO: 14262 - DNA, 1119 bp, Artificial Sequence
  Description of Artificial Sequence: Synthetic coding sequence
atgacctttcaattcaatttcactattgaggaccacctggagaacgagctgaccccaattcgagacggtgcacttactctcgatagttcaaaggagctttcagtcagtgagtcccaaaaaggggaggagcgggatcgtaaatgttccgcggagcagttcgatctgccacaggatcacctatgggagcacaaatccatggagaatgctgctccaagccaggacaccgattcaccactctccgccgcttcttcgagtcgtaatctcgagcctcatggaaagcaaccaagcctcagagcggccaaagagcatgcaatgcctaaggacctcaagaaaatgctggaaaacaaggtcatagaaacccttccgggatttcagcacgtgaagttgtccgttgtcaaaacgattcttctgaaggaaaattttccaggagaaaacatagtgtcaaagagcttttcctctcacagtgatctgatcactggtgtgtatgagggtggacttaagatctgggaatgcacatttgacctgctggcctacttcacaaaggctaaagttaagtttgctggaaagaaagtcctggatttaggctgcggaagcggcctgctgggtattaccgcgttcaagggtggcagtaaagaaattcactttcaggactacaactctatggtcatcgatgaagtcacactacctaacgtcgttgcgaactctacactggaagatgaggaaaatgacgtgaacgaacctgatgtcaagagatgccgcaaaccgaaagttacacagctctataagtgccgattctttagcggcgagtggtcagagttctgcaagctagttctgagcagcgaaaagctgttcgttaaatatgatctgatccttacctctgagacaatctataatcccgattattacagtaacctgcatcaaacgtttctccgacttctgtccaaaaacgggcgtgtgctgctggcctccaaagcccactacttcggggtgggcggaggtgtccatctttttcagaaattcgttgaggagagagacgtctttaaaactaggatacttaaaatcatcgacgagggcttgaaaagatttatcatcgagatcacgttcaagtttccaggatag

SEQ ID NO: 14263 - DNA, 1635 bp, Artificial Sequence
  Description of Artificial Sequence: Synthetic coding sequence
atgaagtgtcactacgaggcccttggtgtgcgacgcgatgcatctgaagaggaactcaagaaagcatataggaagctcgccttaaaatggcaccccgataagaacttggacaacgctgcggaggccgccgaacagtttaagctaattcaggcggcatatgacgtcctcagcgatcctcaggaaagggcctggtacgacaaccacagggaagctttattgaaaggcggtttcgatggagagtaccaggacgactcactcgatctgctccggtacttcaccgtgacatgctacagcgggtatggcgacgacgaaaagggcttttacactgtgtatcggaatgtgttcgaaatgatcgcgaaggaggagctcgaaagtgtgctggaggaagaggtggatgactttcccacattcggggacagccagtctgactatgacacagttgtccaccctttctatgcttattggcaatctttttgtacccagaagaatttcgcatggaaagaggaatatgatacaaggcaggcctccaatagatgggagaagcgcgctatggagaaggaaaacaagaaaatcagggataaggcgagaaaagagaaaaatgagcttgtgaggcagcttgttgccttcattcggaaacgcgacaagagggttcaggctcacaggaaattggtggaagagcagaacgctgagaaggctcgcaaggccgaagagatgagacgacagcagaagctcaaacaggcgaagctggtggaacaatacagggagcagtcgtggatgaccatggccaacttagagaaggagctgcaagagatggaggctcggtacgagaaggagttcggggacgggagcgatgagaatgaaatggaagagcacgagctgaaggatgaagaggatggcaaggattcagacgaggcggaagacgcagagttatatgatgacctttattgtcccgcgtgtgacaagagtttcaagactgagaaagcgatgaagaaccacgagaaaagtaaaaaacatagggaaatggtcgctctactgaagcagcaactagaagaagaagaggagaacttctctaggccacaaattgatgagaaccccctggatgacaattctgaagaggaaatggaggatgctccgaagcagaaggttaagtacctcactttccgtttcatttttgcactgcgactgagcaaaaaacagaaaaagaagaagcaaaagcctgcccaaaactatgatgataattttaatgtgaacggtcctggagaaggcgttaaggtggatcccgaggataccaatctgaaccaggacagcgccaaggagttggaagatagcccgcaggagaacgtgagtgtgactgaaattatcaagccctgtgatgaccctaagtctgaggctaagtccgtgcctaaaccaaaaggaaaaaaaactaaagacatgaaaaagccagtgcgcgtgcctgcagagcctcagaccatgtcggtgctgattagctgcaccacttgtcatagtgagttcccaagcaggaataaacttttcgaccacctaaaagccacaggccacgctagggcgccatccagctcctcgttaaacagtgccacttctagtcaaagcaagaaggagaagcgcaagaatcgctag

SEQ ID NO: 14264 - DNA, 945 bp, Artificial Sequence
  Description of Artificial Sequence: Synthetic coding sequence
atgcctggcttcacctgctgcgtgcctggatgttacaataactcacacagagataaagccctgcacttctacacattcccaaaggatgctgagttgcgccgcctgtggttgaaaaatgtttcccgtgctggagtcagtggatgttttagcacattccaacccactaccggtcaccgcctctgttccgttcatttccagggtgggcgcaagacctacactgtgcgtgtgcccaccattttcccattgcggggcgtgaacgaaagaaaggtcgcgagaaggcccgccggagcagcagcggcgaggcgacgacagcagcaacagcaacagcagcagcaacaacagcagcaacaacagcagcagcaacagcagcagcagcaacagcagcagcagcaacaatcaagcccctctgcctcaaccgcacaaaccgctcagttacagcctaatctcgtgtcagcatccgccgcagttctactgactcttcaggctactgtggatagctcccaggcgccagggagcgttcagccagcccccattaccccgactggtgaagacgtgaagcctatcgatttgacggttcaggtggagttcgctgcagctgaaggtgccgccgccgccgccgccgcttcagaactgcaggccgcaacagctggtctggaggctgcagagtgcccaatggggccacagctcgtggtggtgggggaggaaggcttccccgacactggcagcgatcatagttactccctgagcagcgggactacagaagaagaactgctgagaaagctcaatgaacagcgcgacatcctagcacttatggaagtgaagatgaaggagatgaaaggcagcattaggcacctcaggctgacagaagctaagcttagagaggagttgagggagaaagacaggctgctggctatggcagtgatcaggaagaaacatgggatgtag

SEQ ID NO: 14265 - DNA, 645 bp, Artificial Sequence
  Description of Artificial Sequence: Synthetic coding sequence
atggccggggagaatttcgctacacctttccacggacacgtgggccgtggggcctttagcgatgtgtacgagcctgctgaggataccttcctgctcctgaatgccctggaagctgctgccgccgagttggcaggtgtggagatttgcctcgaggtagggagcggctctggcgtggtatctgccttcctggcaagcatgattgggccccaggccctctatatgtgtacagatatcaacccggaagctgccgcttgcacgctcgagaccgcacggtgcaacaaagtccacatccagcctgtcataaccgatctcgtgaagggattactgcccaggctcactgaaaaggtggatttgctcgtgtttaacccgccctatgtcgtgaccccaccacaagaggtgggtagtcacggtattgaggctgcatgggcgggtgggaaaaatggacgagaggtcatggatcggtttttccccctcgttccggacctgctgagcccgaaaggattgttctatttggttacaattaaggagaacaaccccgaagagattttgaagatcatgaagactaaaggacttcagggcacgacagccctgtcgaggcaggccggtcaggagaccctgagcgtgctgaaatttactaaaagctag

SEQ ID NO: 14266 - DNA, 1536 bp, Artificial Sequence
  Description of Artificial Sequence: Synthetic coding sequence
atgtctgggggcttcgaattacagccaagagatggcggccctcgcgtggccctggcacccggtgaaaccgtgatcgggaggggacccctgctgggcatcactgacaaaagagtatctcgacgacatgccatcctggaagtcgcgggaggccagttgaggataaagcccattcatactaacccttgcttttaccagtcctcagaaaaaagccaattactccccctgaagcccaatctgtggtgctatttgaacccaggggattccttcagccttttagttgacaaatatattttccgtatactcagcatccccagtgaggtagagatgcagtgtacacttagaaatagtcaggtgcttgatgaggataacatactgaatgagacaccaaagagtcctgttatcaacctgccacatgaaacaaccggcgcgtcccagctggagggtagcaccgagatcgcaaaaactcagatgactccaactaattcagtgagcttcctgggcgagaatcgcgattgtaacaagcaacagcctattctggctgaacggaaaagaattctcccaacgtggatgctggctgagcatctgtctgatcagaacctaagtgtccctgccataagcggaggaaatgtcatccagggcagcggcaaggaggaaatttgcaaagacaaatcgcagctgaatactacccagcagggtaggaggcagttaattagctctggcagctccgagaatacgagtgccgagcaggataccggcgaagaatgtaagaataccgatcaggaagaaagcaccatctcttcaaaggagatgccccaaagcttttctgccatcaccttgagcaacactgagatgaataacataaagactaacgcacagaggaacaaactcccaattgaggaacttggtaaggtgagcaagcataaaatcgccactaagcgcacaccacacaaggaagatgaggccatgtcgtgtagcgagaattgtagttcagcacagggagacagtctccaggatgaaagtcagggctcgcacagtgagtcctctagcaatcccagcaatcccgaaaccctgcatgcaaaagcgacagactctgtcctacaaggtagcgaggggaataaggttaaacgcacgtcctgtatgtacggagctaattgctacaggaagaatcccgtgcatttccaacactttagccatccgggggattctgactacgggggcgtgcaaatagtgggccaggacgagaccgatgatcgaccagaatgtccatatggcccgtcctgctatagaaagaacccgcaacacaaaatagaatatagacacaacacactacccgtccggaacgttttggatgaagataatgataatgttgggcagccgaacgaatatgacctcaacgattccttcttggatgacgaagaagaagattacgagccaaccgacgaggactctgactgggaacctggcaaggaagatgaggaaaaagaagatgttgaggagttattaaaggaagcaaaacgattcatgaagcgaaagtag

SEQ ID NO: 14267 - DNA, 984 bp, Artificial Sequence
  Description of Artificial Sequence: Synthetic coding sequence
atggcagccgcagccgccgctgccgcagccacaaatggcacagggggatctagcggcatggaagtagacgcagcagttgtcccctcggttatggcctgtggtgtgaccggctccgtgagcgtggcattgcatccactggtaatcctgaacatcagcgaccactggatccggatgaggagccaggaaggaaggccagtccaggtgataggggcgctcatcggcaaacaagagggtcgtaatatcgaggtgatgaactctttcgagctgctctctcacacggtggaagaaaaaatcatcatcgacaaagagtactattacactaaggaagagcaattcaagcaggtcttcaaggagctagaattccttggatggtatacaaccgggggaccacctgacccgtctgatatccacgtgcataagcaggtgtgtgagatcatcgagtctcctctctttcttaaactgaaccctatgacgaaacacactgatttaccagtctctgtgtttgaatccgttatcgatattatcaatggtgaagccacaatgctctttgcagagcttacatatacgctggctactgaagaggctgagcgaattggggtggatcatgtcgcgagaatgacagcaaccggctctggtgaaaactccactgttgcagaacatttaatcgcacagcacagtgcaataaagatgcttcactcccgggtgaagctgattctggagtatgtaaaggcaagtgaggcaggggaggtgccttttaaccacgagatattacgcgaagcgtatgccctgtgccattgtttacctgtcttgtccacagacaaattcaagacagacttctacgatcagtgtaacgacgtcggcttgatggcttacttgggaaccatcactaaaacatgtaacactatgaaccagttcgtgaataaatttaacgtgctatacgaccgccaagggattgggcgcaggatgcgagggctgttcttctag

SEQ ID NO: 14268 - DNA, 2574 bp, Artificial Sequence
  Description of Artificial Sequence: Synthetic coding sequence
atgaattatcaacagcagctcgcgaactcagccgctatccgggccgaaatacagaggtttgaaagcgtgcaccccaatatctatagcatctatgagcttctggaaagagtggaggagccggttcttcagaaccagataagagagcacgtgatcgccatcgaggacgccttcgttaactcccaggagtggactctgagccggtctgtccccgagttaaaagtgggtattgtcgggaatctcgccagtggcaagagtgctctggtgcaccgttatctaacggggacatatgtgcaggaagaatctccggagggcggcaggttcaaaaaagaaattgtagtcgacggacagtcttatctgttactgatacgggatgagggaggaccccctgaggctcagttcgcgatgtgggtagatgccgtgatctttgtcttcagcctggaggatgaaataagcttccagaccgtctaccactactattctagaatggccaactaccgcaacaccagcgaaattcccctagtgttagtgggcacgcaggacgcaatatcctcagctaaccccagagtgatagacgatgccagagcgcggaagctctctaatgatttgaaacgatgcacatactacgagacttgtgccacctatggcctgaatgtcgagagggtattccaggacgtagctcagaaaatcgtagccacccggaaaaaacagcaattgagtataggaccctgtaagagcctccccaactctccgtcccactcgtctgtttgttcggcccaggtctccgctgtgcatatttctcaaacctcaaacggcggcggtagcctttcagattacagctctagtgtgcccagtaccccatcgaccagccagaaggaactcagaattgatgtgccaccaaccgcaaacacgccgacccctgttcggaagcagtccaagaggaggtctaacttgtttactagtcggaaaggcagtgacccagataaggagaagaagggactagaatcccgcgccgattcaataggctcagggcgggccatcccaatcaaacagggtatgctgctgaaaaggagtggaaaatccctcaacaaggaatggaaaaaaaaatacgttacgctgtgcgacaatggggttctcacctaccacccttccctacatgattacatgcagaatgttcacggcaaagagatcgacctgctgaggaccacagtgaaagtcccagggaagcgaccgcctcgcgccactagcgcctgcgcaccaatctcaagccctaaaactaatggcctgagcaaagacatgtctagtctgcatatatcaccgaatagcggaaacgttaccagcgcctctggaagccagatggcatctggaatctcattggtctcatttaacagcaggcctgacgggatgcatcagcgcagttattccgtcagctctgcagaccagtggtccgaggccaccgtaattgccaactccgccatctctagtgacactggattaggcgattccgtttgcagctcaccgtcaatttcaagcacaacttccccaaagctagatccccctccatccccgcacgctaaccgaaagaagcaccgccggaaaaaaagcaccagtaactttaaagctgacggactgagcggtactgccgaggaacaagaggagaactttgagttcatcattgtcagcctgaccggccagacatggcatttcgaagccactacatatgaagaacgcgatgcatgggttcaagccatagaaagccagatcctggcatccctccagagctgtgaatcttctaaaaataaatccaggctcacatcgcaatctgaggcaatggccttgcaatcgattagaaatatgcgaggcaatagtcattgcgtggattgcgaaacgcaaaaccccaattgggcctcactgaacctgggcgcgctgatgtgcatcgagtgtagtggcatccatcgcaacctgggaactcacttatcacgggttaggagtttggatcttgacgactggcccgtggaactgatcaaagtgatgtctagcatcggtaacgagttggctaacagcgtgtgggaggagtcatcgcaggggcgcactaagccgagcgtagatagtacacgcgaagagaaagagagatggatcagggcaaaatacgaacagaagctttttctggccccccttccctgcaccgagttgagcctgggacaacaccttttgcgggccaccgccgacgaggacctgcgaactgctattctgctcctggcccacgggagccgcgacgaagtgaatgaaacttgtggcgaaggagacggtaggacagctctgcacctggcctgccgcaaagggaatgtggttctggcccagttgctcatatggtacggtgtggacgtgacggccagggacgcgcatggcaacaccgccctcgcatacgctcggcaggcctctagccaagagtgcatcgacgtcctgctgcagtacggctgtcctgacgaaagatttgtgctgatggcaactcccaatctgtcacgcagaaacaacaatcgcaacaactcctcaggcagagttccaacaatcatttag

SEQ ID NO: 14269 - DNA, 1653 bp, Artificial Sequence
  Description of Artificial Sequence: Synthetic coding sequence
atgtcgcaaacttccttgaaacagaagaaaaatgagcccggtatgcgatcaagcaaagagtcattggaggcggaaaagagaaaagagagcgataaaaccggggtacggttgagtaaccaaggaagccaggagtcatcactgcggaaaacagactctaggggctacctggtgcgcagtcagtggtcacgcatatcacgatctcccagcaccaaggccccctccatcgacgaaccaagatcccgtaacacttcggccaagctgccctcatcaagcacgtcttcacggaccccttcaacgagtccatctcttcatgattcaagtcctccgccgctgtctgggcagccttccctgcagcctccagcgagtccccagcttccgagaagtctcgatagccgccccccaacgccccccgaaccagaccctggttctaggcggagcacaaaaatgcaggagaaccctgaggcatgggcccagggcatcgtcagagaaatacgacagactcgtgatagccaacccctggagtatagccggacctctccaaccgaatggaaaagctcaagccaacggaggggaatataccctgcctctacacagcttgaccggaacagcctgagtgagcagcagcaacagcagagagaagatgaagatgactatgaggcggcttactgggctagcatgcggtccttctacgagaaaaacccctcttgtagtcgtccatggcctcctaagccaaagaacgccatcaccatagcactgagttcctgcgcattgtttaacatggtggacggaagaaaaatctatgagcaagaaggcctggagaagtatatggagtaccaactcaccaacgaaaacgtgatcctgactcccggcccggcattcagattcgtgaaggcgttacagtatgtgaacgcaagattgcgcgacctgtatccagacgagcaggatctcttcgatattgtactgatgacaaacaatcatgctcaggtcggtgtcaggcttataaacagcgtcaatcattacggattactcatagatagattttgcctcacgggcggcaaggatccaattggctatcttaaagcatacttgacaaacctgtacattgccgctgacagcgagaaggtccaggaagcaattcaggagggcatcgcaagcgctactatgtttgatggcgccaaggatatggcctattgtgacacacagcttcgcgtggctttcgacggcgacgctgtgttgttcagcgacgagtcagagcacttcaccaaagagcacggactggataaattctttcaatacgacaccctctgtgagagcaaaccactggcccaggggcccctgaaaggcttcctggaggacttgggcagactgcaaaagaaattctacgccaaaaacgaaagactgttatgcccaattaggacctatctggtgaccgcaagatccgccgcatcaagtggcgcgcgggtattaaagaccctgagacgttggggtctcgagattgatgaagcccttttcctggcaggtgccccaaaaagtcctattctggtgaagatcagaccacatatctttttcgatgatcacatgtttcatattgaaggcgcccaaagactgggttctattgctgcctacggatttaacaaaaaatttagctcttag

SEQ ID NO: 14270 - DNA, 888 bp, Artificial Sequence
  Description of Artificial Sequence: Synthetic coding sequence
atgcctgttcacaccctttcgcccggggcccccagtgctcccgcgttgccctgtcgcttaagaaccagggtgccaggttatctgcttagaggccctgctgacgggggggccagaaaaccttcggccgtcgagcgcctcgaagctgataaagcaaaatacgtcaagtccctccacgtcgctaatactagacaggagcctgtccagcccctgctgtctaaacagcccctgttctccccagaaacccgccgcactgtgctgactcccagccgaagggctttgccaggaccctgccggaggccacagctagatttagatattctgtcgagcttaattgacctgtgcgacagccccgttagtccagcagaggcaagccggaccccgggccgcgctgagggagccgggagaccccctcctgccacgccgcctcgcccccccccgtccaccagcgccgtgagacgcgtagatgttaggccccttccggcatccccggcccgtccgtgcccatcccccgggcccgcggcggcatcttctccggccagacctccagggcttcagcggtctaaaagtgatctcagtgagcgcttttcacgggccgccgccgatctcgagagattctttaacttttgcggcctcgatccagaggaggctcgcggtttgggagtagcacacctggctagagccagctcagacatagttagtctggccgggcccagtgccggccccggttctagtgagggtggatgtagtaggcgaagctcagtaactgttgaagaaagggcacgggagcgcgtcccatacggcgttagtgtcgtggagcgaaatgcacgtgtgattaaatggctgtacggactccggcaggcaagggaaagtcccgccgccgagggttag

SEQ ID NO: 14271 - DNA, 549 bp, Artificial Sequence
  Description of Artificial Sequence: Synthetic coding sequence
atgtctggtcgatccgtgccccacgcgcacccggctaccgcagaatatgaattcgcgaaccctagtaggctgggagagcagcgcttcggagagggcctgctgccagaagaaatcctgacgcccacgttgtaccacggatactatgtccgccctcgggcagcccctgctggagagggatctagagccggcgcttcagagttgcgcctctccgaggggaaattccaagcctttttagatgtcagtcactttacccccgacgaggtgaccgttcgcaccgtcgacaacctactggaggtgtccgcaagacatccccagagactagaccgacacggcttcgtgtctagagaattctgtagaacatacgtcctgcctgcggacgtagatccatggagagtgagggctgcattgagccacgacggtatcctcaacctcgaggcgccgcgcgggggcagacacctcgacacggaagtgaacgaggtatatatctctctgctgcccgctccgcctgacccggaggaggaggaagaagctgccatcgtggagccttag

SEQ ID NO: 14272 - DNA, 636 bp, Artificial Sequence
  Description of Artificial Sequence: Synthetic coding sequence
atgtcaaccgccgccgtcccggaattaaagcagatctcacgggtggaagcgatgcgactcggccctggctggtctcatagttgccacgccatgctgtatgccgcaaatccaggacagctgtttggaaggatccccatgcgttttagtgttctcatgcaaatgagattcgacggcctgttgggattcccaggcggcttcgtggatcggaggttttggtcccttgaggacggccttaaccgggtactcgggcttggtctgggatgcctgcggctgaccgaagctgattatctgtcgtcacacctgacggagggaccccatcgtgtcgtcgctcacctttacgccagacaactcacgctggaacagctccatgctgttgagatttccgcagtgcacagtagagatcacggccttgaggtcctggggctggttcgtgtgccactgtacacacagaaggatagagttggcggatttcctaattttctaagcaacgccttcgtttctacagccaagtgccagctgctgtttgcgctgaaggttcttaacatgatgcccgaagagaagctcgtagaggcgctggccgcagccacggaaaagcagaaaaaggccctcgagaagttgcttccggcaagcagctag

SEQ ID NO: 14273 - DNA, 2622 bp, Artificial Sequence
  Description of Artificial Sequence: Synthetic coding sequence
atgcaccccccaccacccgcagccgcaatggacttcagccagaacagcctatttggctatatggaagaccttcaggagcttaccatcattgagcgacctgtacggcgcagtttgaaaacacctgaagagatcgaaaggttgaccgtcgacgaggatctttctgacatcgagcgggccgtatatctcctcagtgcaggccaagacgtccaggggaccagcgtcatcgctaacttaccctttctgatgcggcagaacccaaccgagacgttgaggagagtacttccaaaagtgagggaagcgctccacgtggctggtgtggaaatgcagctgaccgccgctatgagcttcttgaccattctgcaggacgagtcagtgagcatccacgcctatacccacagctttctgcaggtaattctccttcatttggagcacagagacactggagtttcaaatgcctggctggagacattgctgtccgtgatcgaagtcctccctaaggagacattgcgccatgagatcctcaatcctctggtgtcaaaggcgcaactctcccagactgttcagagtagactggtctcctgcaagattcttggtaagctcactaataagtttgacgcccacacaatcaaaagggagatactccctcttgtcaagagcctctgccaagacgtcgagtatgaggtgaggtcatgcatgtgtcgtcagctggagaatattgctcagggaattggtacagagctgaccaaaagtgtggtactaccagaactgattgagctctctagagacgaggggagctcagtgcgactggcagcttttgaaacactggtaaatcttctggatatttttgacacagatgacagaagccagactatccttccactggtgaaaagcttttgtgaaaagtcctttaaagctgatgagtctatattgattagtctgtcattccaccttggcaagctgtgccatggtctttatgggatttttacacccgatcaacacctgcggttcctggagttttacaagaagctctgtaccctagggctgcagcaagagaatggacataacgagaatcagatccctccgcagatcttagagcaggagaagaaatatatctccgttcggaaaaactgcgcctacaattttcccgccatgatagtattcgtagatccaaagaacttccacatggaactttattccacattcttttgtctgtgtcacgacccagaggtaccggttcgctacacaatagccatctgcttctacgaggtctccaagctgctcaacagcggagtctatctaattcataaggagctgattactctcctgcaggacgagagcctggaagtgctagacgcccttattgaccatcttcccgaaatccttgagctcatgtccaccggcggcgaatcttcagtgcaggaaaacaaactcagcagcttgccagacctgatccccgcgcttacggccgctgagcagagggcagctgcaagcctcaagtggcgaacccacgagaagctgctgcaaaagtacgcatgcctccctcatgttattagctccgatcagatttactatcggttcctgcaaaggatgttcactattatgatgactaataatgtgctccctgttcagaaggcggccagccggacgctgtgtatcttcctccgctataataggaagcaggaacagcggcatgaagtgattcagaaactgatcgagcagttgggtcaagggaaaagttattggaatcgacttaggtttctggacacatgcgagttcattatcgagatctttagtaagtcattcttttgtaagtatttcttcttgcccgccatagaactgacacacgacccagttgctaacgtacgaatgaagctctgctatctactgcccaaagtgaagagcactctcaagattcccgccgataagcacctcttgcagcagctggagatgtgcgtgcgaaagctgctgtgccaggaaaaagacaaagatgtgttagcgatcgtgaaaagaaccgtactggaattagatcggatggaaatgtctatggatgcattccagaaaaagttttatgaaaaggatctgctagaccaggaaaaagagagggaagaattactgctgttggaaatggaacagctggagaaggagaaacagcagaatgacggcagacccatgtcagacaaaatgttcgaaaagaagaggagagacaccaaaacccctacgcagtccctgcccaaaaacattccaatctcggtccctggaccatcttctgtgactccatccacatcaaaggaaataaaaaaatccaagctgattcgttctcagagttttaacaaccaggcgtttcacgcaaagtacggaaacttagaaaagtgcgcttctaaatcatctaccaccgggtataccacgtccgtttccggcttaggcaagacctccgtgctctcccttgcagatgactcctttcgaactaggaatgcctccagcgtgccatccagttttagccccaatacgcctctgccttcaacaagtcggggaacagggaattctgttgaccctaagtcatccggttccaaggacacccaaccacggaaggcaacgcttaagtcccggaagtctaatccttag

SEQ ID NO: 14274 - DNA, 951 bp, Artificial Sequence
  Description of Artificial Sequence: Synthetic coding sequence
atgagacagccattgagctggggaaggtggagagcaatgctcgcacgtacgtacgggcccggtccatcggctggttaccggtgggcaagcggagctcagggctacgtgagaaatccgccagtcggcgcatgcgatctccagggggagctggaccgtttcgggggtatcagcgtgcgactagcccggctcgatgccttggacagactggatgcggctgcatttcagaaaggcttgcaggcagctgtgcagcaatggcggtccgagggacgaaccgctgtgtggttacacattccgatccttcagagcaggttcattgcacccgccgctagtttaggcttctgctttcatcacgcggaaagtgatagttccacactcaccctgtggttgcgtgagggccctagcagactgcccggctacgcatcacatcaagtgggagtggctggagccgtgttcgatgagtcgaccaggaaaattttagtcgtccaagaccgaaacaagctgaagaacatgtggaagttccccggtggactgtccgagccagaggaagacataggcgatacagcagtcagagaagtgttcgaggagactggaatcaagtcagagtttcgctccgtgctgagtattcgccaacagcatacaaaccctggcgccttcggaaaaagcgacatgtatattatttgtagattgaagccttatagcttcacaattaatttttgtcaagaggaatgcctgcgctgcgagtggatggacctcaatgacttggcgaagaccgaaaataccacccccattactagccgggtggcaaggctgctgctttatggctacagagagggattcgacaagattgacttgaccgttgaagagctgcctgctgtgtatacggggctgttttataagttatatcacaaggaattacctgagaactataagaccatgaagggcatcgactag

SEQ ID NO: 14275 - DNA, 537 bp, Artificial Sequence
  Description of Artificial Sequence: Synthetic coding sequence
atgggagaaacctggaagaatatctgcagcacagttcgccatggatggtggttgcgggatcatcgcatggctgggctccctatccctcccgagattgtgaaagaagcggaggtgccgcaggccgccctcggagtgcccgcccagggcactggggacaacggacacacccccgtggaggaggaagtcgggggcatacccgtgcccgccccaggactgctgcaggtcacggagagacgccagcctctgtcatctgtgtcttcattagaagtgcatttcgatctcctggacctcacggagctgacagatatgtccgaccaggaactggctgaagtgtttgcggatagtgacgatgagaacctgaacactgagagccccgcgggcctgcatccccttccgcgagccgggtatctgagaagccccagttggactcggaccagagcagaacagtcccacgagaagcagccactgggtgaccccgaacggcaggccactgtgctggacaccttcctcaccgtggagcggcctcaagaggattag

SEQ ID NO: 14276 - DNA, 741 bp, Artificial Sequence
  Description of Artificial Sequence: Synthetic coding sequence
atggcagaacaggaacagaggaagatccccctcgtacctgaaaatctgctcaaaaagcgtaaggcctaccaggccctcaaggccacccaagcaaaacaggcgttactggcgaaaaaggagcaaaagaagggcaaaggtctgcgcttcaaaaggctcgaatctttccttcacgattcatggcggcagaaaagggacaaggtgcgtcttaggcgcttggaagtaaagccacacgccttggaacttcccgacaagcattcactggccttcgttgtacggattgaaagaatcgacggggtcagcttgctcgttcagagaaccatagcaagactgcggctcaagaagattttcagcggcgtgttcgttaaggtgacaccacaaaatctgaagatgctccgtattgtagaaccctacgtgacatggggttttcctaatctcaaatctgtaagagaactcattctgaaacgcggacaggcaaaggtcaagaacaaaaccatcccgctgactgataacacggtcatcgaggaacatcttggaaaatttggcgtgatttgcctggaagatctgattcacgaaattgctttccctgggaaacatttccaggagatctcttggtttctctgtcccttccacttatcagtggctcgtcacgctaccaaaaatcgtgtcgggttcctcaaggagatgggcaccccaggctaccgcggcgagcgaattaatcaactgatccgccaactgaattag

SEQ ID NO: 14277 - DNA, 2442 bp, Artificial Sequence
  Description of Artificial Sequence: Synthetic coding sequence
atggcctggccctgcattacacgggcctgctgcattgcccgtttttggaaccagctggacaaggcagatatagctgtccccttagtgtttaccaaatactctgaggcaactgagcatccaggtgcacctccgcagccacctcccccgcagcagcaggcccaacctgccctcgcccctccaagcgctagggcggtggcaattgaaacacagccagctcagggggaactggacgcagtggcaagagccacggggcctgccccagggccaacaggcgaacgggagcccgcagctggcccaggaagatccgggcccggccccgggcttggcagtgggtctacatccgggcccgctgattctgtgatgcgtcaagattatcgcgcctggaaagtgcaaaggccagagccatcctgtaggcccaggtcagaataccaaccatcggacgcccctttcgagcgggaaacccagtaccagaaggactttcgggcgtggccactcccgagaagaggtgaccacccttggatccccaaacccgtgcaaatttctgcggctagccaggcttcagcacccatcttgggtgcccccaaacggagaccacagtcccaggaaagatggcccgttcaggccgccgccgaggcacgggagcaggaggccgcccctgggggcgcgggtggattagcagcgggaaaggcttctggcgctgatgagcgggacacccgccgcaaagccgggccagcttggatcgtccgccgcgctgagggcttggggcatgaacagactcctctgcctgcagcacaggcccaggttcaggccactggccccgaggcgggacggggccgtgcagccgcggatgcgctaaatagacaaataagggaggaggtcgccagtgccgttagtagcagttataggaacgagttccgggcctggacagacattaaaccggtgaaaccaataaaggccaagccccagtacaaaccccccgatgataagatggtccacgagacttcctatagtgcgcagttcaaaggggaggcttccaagcctacaaccgctgacaataaggtgatcgacaggaggcggattcgttctctctattcagagccattcaaggagcccccaaaggtggaaaagccttcagtgcagtcttccaaacctaaaaaaacttcagcttcgcataagcccaccaggaaggctaaggacaaacaggcagtgagcggacaggcagcaaaaaaaaagagcgcagagggcccctctaccacgaagcccgatgacaaggaacagtctaaggagatgaacaataaattagcagaggctaaagaaagtctggcccagccagtcagcgacagcagtaaaacacagggaccggtagcaactgaaccggataaagaccagggctctgtcgttccaggcctcctgaagggccagggtccaatggtgcaggagccactgaagaagcagggatctgtggtcccgggcccgcctaaagacctagggcctatgattccattacctgtgaaggaccaggatcataccgttcccgagccactgaaaaacgagagccctgtgatatctgctcccgtgaaggatcagggaccttcagtgccagttcccccaaaaaaccagtcgccgatggttcccgccaaggtaaaggatcagggctccgtagtgcctgagtcccttaaagatcagggcccccgaatccctgaacctgtgaagaatcaggctcctatggttccagcgccggtaaaagacgaagggcccatggtttctgcatctgttaaggaccagggccctatggtcagtgcaccagtgaaggaccagggacctattgtgcccgccccagtgaaaggcgagggtcccatcgtgcccgctcctgttaaggatgagggcccgatggtgtcagcacctatcaaggatcaggatcccatggtccctgagcaccctaaagacgagtccgccatggcaacagcgccaattaagaatcagggctccatggttagcgaacccgtcaagaatcaagggttagttgtgtccgggccagtgaaggatcaagacgtggtggttcccgaacacgcgaaggtgcatgattctgccgtagtagcaccagtgaagaaccagggtcccgtggtaccagagtcagtgaagaatcaagatccaatcttgccagtcctcgttaaggaccaagggcctaccgtactgcagccaccaaaaaaccaggggaggatcgtaccggagcccctgaagaaccaggtccccatcgtgccggtgcctttgaaggaccaggatccgctggtgcctgttccagccaaggaccaggggccagccgtgccagagccactcaaaacacagggaccgcgcgacccccaacttcctaccgtttcacctctgcccagggttatgatcccaaccgccccacacacagaatatatcgagtcatcaccctag

SEQ ID NO: 14278 - DNA, 261 bp, Artificial Sequence
  Description of Artificial Sequence: Synthetic coding sequence
atgccccagtatcagacatgggaagagttctcacgggctgccgaaaagctgtacctggctgacccaatgaaagcgcgggtggtcctgaagtacaggcactcagacggcaatttgtgtgtgaaggtgaccgacgatctggtatgcctggtctataagactgaccaagcccaggatgttaagaaaattgaaaaattccacagtcaattgatgcgcctgatggttgctaaggaggctcggaacgtgacaatggagaccgagtag

SEQ ID NO: 14279 - DNA, 1206 bp, Artificial Sequence
  Description of Artificial Sequence: Synthetic coding sequence
atggctcacgtgtcctccgaaactcaggatgttagccccaaggatgagctcacggccagtgaagcttccacaaggtctccactgtgcgaacatacgttccctggagattcagaccttcgctccatgatcgaggagcacgccttccaagtcctgtctcagggaagccttctcgaaagcccgtcgtacactgtttgcgttagtgaaccagacaaagacgatgacttcctctcgctgaacttcccaaggaagctgtggaaaatagtcgagtccgaccagttcaaatctatatcatgggacgagaacgggacttgtatcgttatcaacgaagagctctttaaaaaggagatcttggagaccaaagctccctaccgtatcttccagactgatgcaatcaaaagcttcgtcagacagctgaacctgtatgggttctccaagattcagcaaaactttcagcgctctgcttttctggctaccttcttgtccgaggagaaagaaagctcagtgctttccaaactcaagttttattacaatccaaatttcaagcgtggatacccgcagctgctggtgagagtcaagcgacgcattggggtcaaaaatgccagccctatatcaacactgttcaatgaagattttaacaagaagcattttagagctggggcgaatatggaaaatcacaactccgcattggccgctgaggcttctgaagagtccttgttttcagcctccaagaacctaaatatgcctcttactcgtgagagcagcgtcagacagatcattgccaactcctccgtgcctatccgaagcggttttccccccccctctcccagcacgtctgtcggaccgtctgagcagatagccacagatcagcatgccattctcaaccagctaacaacaatccacatgcatagccattctacttacatgcaggctaggggtcacatcgtcaacttcatcaccaccacaacctcacagtatcacattatctcccccctacagaacggatattttgggctgaccgtggagccctctgccgttcccactcggtaccccttggtaagcgtgaatgaggctccctaccgaaacatgctgcctgccggaaatccctggttgcagatgccaactattgccgatcggtctgccgccccccattccaggctggccctgcagcctagtccactcgacaagtatcatcccaactacaattag

SEQ ID NO: 14280 - DNA, 4302 bp, Artificial Sequence
  Description of Artificial Sequence: Synthetic coding sequence
atgtggagtttaaccgcctcagaaggcgagtccaccacagcccattttttcctgggcgcaggcgacgagggactgggcacccgcggcatcggcatgcgtccagaggagagcgatagtgaactgctcgaagatgaggaggacgaggtgcccccagagcctcagattatcgtcggaatctgcgcgatgacaaaaaaaagcaagtctaagcctatgacacagatcctagaacgcttgtgccgtttcgattatctcacagtggttatattaggtgaggatgtgatactcaatgaaccagttgagaactggccaagctgtcactgtttgatttctttccacagcaaaggctttccacttgataaagcagtggcctattctaagctgcggaacccattcctaattaatgatcttgcaatgcagtattatatccaagaccgacgtgaagtctaccgcatccttcaagaggagggaatagacttaccccgctatgcagtccttaatcgggaccccgccagacccgaggagtgtaatttgatcgagggggaagaccaggtagaggttaacggggcagtgtttcctaaaccttttgtggaaaaacctgtgtccgcggaggatcataacgtgtatatttactatccttcctcagctggcggcgggtcccagcgcctcttcagaaaaatcggatccagatcctcagtgtactcccccgaatctagcgtgagaaagacgggctcttacatttatgaagagttcatgcccacagacggcactgacgtgaaggtatacactgtgggcccggattatgcgcacgccgaagcccggaagtctcctgcattggacgggaaagttgagagggactctgaaggcaaggagatccgctatcccgtgatgctaaccgcgatggaaaaactggtggccagaaaagtgtgcgtagccttcaagcagaccgtgtgtggatttgacctcctgcgcgctaatgggcactctttcgtgtgcgatgtgaacggtttttcattcgtgaaaaactctatgaaatattacgacgattgtgccaagattctgggtaacacaatcatgcgcgaactggcaccacagtttcagataccatggagcatacctactgaggccgaggatattccaattgttccaaccactagtggaactatgatggagctccggtgcgtaatcgctatcattcgacacggagaccggaccccgaaacaaaaaatgaaaatggaggtgaaacatcctcggttcttcgccctgttcgagaaacacggcggctataagaccgggaagttgaaactgaagcggcccgaacagctgcaggaagtgctggatattacaaggttactcctggccgaactggaaaaagagcctggaggtgagatcgaggagaagactggcaagttggaacagctaaaatccgtcctggagatgtacgggcatttctctgggattaaccggaaggtacagctcacttattatccccatggagtcaaggctagcaacgagggccaggatccacagagggagaccctagcccccagcctgctcctggtgttgaagtgggggggagaactgaccccggcgggacgtgttcaggccgaagagctcggacgggcttttcgctgcatgtatccaggagggcagggcgattatgccgggttccctggatgtggcctgctcaggctgcatagcactttcaggcacgatcttaaaatctatgccagcgatgagggacgcgtgcagatgactgccgcagctttcgcgaaaggtttgctagctttggaaggagagttgactcccatccttgtgcagatggtgaagagtgcgaacatgaacgggttgttagactccgatggtgactcactaagctcatgccaacacagagtgaaagctcggctccaccacattctgcagcaggacgccccctttgggcctgaggactacgaccagttggcccccacaaggagcaccagtttgttgaactctatgacgatcattcagaacccggtcaaagtttgtgaccaggtttttgcgctcattgagaacctgactcatcagattcgggaacgtatgcaggaccctcgtagcgttgatctgcagttgtatcactccgaaactctggaactgatgctccagcgctggagcaagctggaacgcgacttcaggcagaaaagcggaagatacgatatctcaaagatccccgacatctatgactgtgtgaaatacgacgttcaacacaatggttcactgggactgcagggtaccgccgagctcttaagactttccaaggcactggcagacgtagtcatcccccaagagtatggcatttcacgggaggagaaacttgagatcgcggtcggcttttgcctcccactgttacggaaaattctgctcgatctccaaaggacacacgaagatgagagcgtcaataagctgcaccccttatgctacttaagatattcgaggggcgtactgagccctgggaggcacgtgcggacacgcctgtactttacaagcgaatcacatgtgcactcgctcttatccgtcttcaggtatgggggactcctggacgaaacacaggacgcccaatggcaaagggcactggactacctctcagcgatctctgagctcaattacatgacccagatcgtaatcatgctgtacgaagataacacacaggatccactgtccgaagagcgctttcacgtcgagctccacttttcacccggggtgaagggtgtcgaggaagagggatccgcccccgccggttgcggatttcggcccgcctcttcggagaatgaagaaatgaagactaatcaaggaagtatggaaaatttgtgtcctggaaaggcttcagacgagccagaccgggcactgcagactagccctcagccgcctgaaggccccggcctaccccgccgctctccactgatacggaacagaaaagccgggagtatggaagttttaagtgagacttcatcctccaggccaggaggatatcgactattttcttcctcaaggcccccgactgaaatgaaacagagcggactggggtcccagtgcaccggcctgttcagcacaaccgtcctgggcgggtctagttccgcaccgaatcttcaggattacgcccggtctcatggaaaaaagctcccacctgcatcgctcaaacatcgtgacgagctccttttcgtccccgccgttaagcggttttctgtgtcttttgctaagcaccctactaacgggttcgaggggtgttctatggtcccaacaatctatcccctggagacgcttcataatgcgctgtccctcaggcaagtgtcggaattcctgagcagggtgtgtcagcgccacaccgacgcccaagcccaagctagcgctgcactctttgattctatgcacagctcccaggcatcagacaatcccttttctccaccccgtacacttcacagtcccccgcttcagttgcaacaacggtccgaaaagcccccgtggtacagctcagggccatctagcaccgtatctagtgccggtccgtcatcccctacaactgtggacggaaactcacagtttggtttctctgaccagccttcccttaacagtcacgtggccgaggagcatcagggtttagggttgctacaagagacaccaggctctggcgcacaggagttgagtattgaaggggagcaagaattgttcgagcctaatcagtcaccacaggttccgccaatggaaacatcacagccgtacgaggaggtctcccagccttgtcaggaagtcccagatatctcgcagccctgccaggacatcagcgaggcactctcacagccatgccaaaaggtacccgatatcagccagcagtgccaggaaaaccacgacaacggtaaccatacatgtcaggaggtgccacacatctcccaaccatgtcagaagtctagtcagttatgccaaaaagttagcgaggaggtgtgtcagctgtgtctcgagaattctgaggaagtatcacagccctgccagggagtctctgtcgaggtgggaaagcttgttcacaagttccatgttggagtaggctctcttgtgcaggagacactggtggaggtcgggtcacccgccgaggaaatcccagaagaagtcattcagccctaccaggagttctcagttgaggtcggaagactcgcccaggaaacatctgctattaatctgttgtctcagggaatccccgagatcgacaagccatcgcaggagtttcccgaagaaatcgatttgcaggcgcaagaagtcccagaggaaattaattag

SEQ ID NO: 14281 - DNA, 1137 bp, Artificial Sequence
  Description of Artificial Sequence: Synthetic coding sequence
atggacagtgtgcgtagtggtgcctttgggcacttgttccggccagataattttatcttcggccaaagcggcgcaggcaataattgggctaaggggcactatactgaaggcgccgagctggtggattctgtgctcgatgtagtgcgaaaggaatgtgaaaactgcgattgtttacaggggtttcagctgacccatagcctcgggggcggcactgggtctggaatgggcaccttgctgatcagtaaagtgcgcgaggagtacccagataggatcatgaacactttttcggtcgttccatctccaaaagtgagtgataccgtggtggaaccgtataacgcaaccctgagcatccatcagctggtagaaaataccgatgaaacttattgcattgacaacgaagccctctatgatatttgttttcggacactcaaactcgccactcctacctatggggatctgaaccatctcgtttccgctacaatgtctggcgtgaccacatctcttcgtttccccggacagctgaatgctgatctcaggaagttggcagtaaacatggtcccattcccacgcctccatttctttatgccaggctttgccccactgacagcaaggggatcccagcagtacagggccctcactgttccagagctaactcagcagatgttcgatgccaagaacatgatggccgcatgtgatccgaggcacggtaggtacctgactgtggccacagtctttcgagggcggatgtctatgaaagaagttgatgagcaaatgctagctatacaaagtaagaactcgagttatttcgtggagtggattccaaataatgtaaaggtggcagtctgtgacatccctccacgcgggctgaaaatgtccagtacatttattggaaacagcactgccatccaggaactgtttaagcgaatcagtgaacagtttacggcgatgttccggcggaaggctttcttacactggtacactggagaaggcatggacgagatggagtttaccgaagctgaatcgaacatgaatgatctcgtcagcgaataccagcaatatcaggacgctaccgcagaggaagaaggggagatgtatgaagacgacgaggaggagagcgaggcacaaggacccaagtag

SEQ ID NO: 14282 - DNA, 1161 bp, Artificial Sequence
  Description of Artificial Sequence: Synthetic coding sequence
atgtgcgagagagccgcacgactgtgtcgtgccggagcgcaccgcctgctgcgtgaacccccacagcaaggacgcgccctggggggcctgttacgctgggtgggcgccaggatgggggagccgcgggagtctctcgcgcctgctgctccagctgaccctgggccagcatcccctcgtggaggtaccgccgttatattggatatttttcggagagccgataagaatgacgatggcaagctcagtctggaagaattccagctgttctttgctgatggagtgctcaatgagaaggagttggaggatctgtttcacacaatcgatagtgacaatacgaaccatgtggataccaaagagttgtgcgactacttcgttgaccacatgggcgactatgaagatgttctcgccagccttgagacattaaaccactctgtattaaaggctatggggtatactaagaaggtttatgagggtggaagtaacgtggatcagttcgtcacccgattcctgctcaaagaaactgcgaaccaaattcagagcttgctatcttccgtggagagcgcggtggaagcaattgaagaacagacatctcagcttagacagaatcatattaagccatcacactctgccgcccaaacgtggtgcggatccccaacaccagcatcggcaccaaatcacaagctgatggccatggagcaagggaaaacgcttccctctgcaaccgaggacgcaaaggaagaggggttagaggcgcaaatttcccgtctggccgagttaatcggcaggctcgaaagtaaggccctgtggtttgatctgcaacagcggctgagtgatgaagatggaacaaacatgcatctgcaactggtgagacaggaaatggctgtctgcccggagcagctttctgaattcctcgacagtctgaggcaatacctgcgcgggaccaccggagtgcggaattgttttcacatcacagccgtgaggttgtcagatgggttcaccttcgtaatctacgaattttgggagacagaagaggcctggaaacggcacctgcaatcgccactttgcaaggctttccgtcacgttaaggtagacaccctgtctcagccagaagctctatctagaattcttgtaccggccgcctggtgcactgtgggcagagactag

SEQ ID NO: 14283 - DNA, 1482 bp, Artificial Sequence
  Description of Artificial Sequence: Synthetic coding sequence
atggagaggtctcctgatgtgagccccgggcccagcagatccttcaaagaagagctgctctgcgccgtgtgctatgatccctttagagatgccgtgaccttacggtgtggtcacaatttctgtaggggctgcgtctcccgctgttgggaggtgcaggtgtctcccacctgccccgtgtgcaaggatcgagcctcccccgcagatcttcggacgaaccacacgctcaataatctcgtagagaagctgctcagggaggaggcagaaggagctcgctggacatcttaccggttcagtcgcgtctgcaggttgcaccgcgggcagttgagtctgttctgtctggaggacaaagaactgctgtgctgcagctgccaggcagatccacgtcatcagggccacagagtacagccagtcaaagatactgcacatgatttcagggccaagtgcaggaatatggaacatgcattaagggagaaagccaaagcgttctgggcgatgcggaggagctatgaggccattgctaagcacaatcaagtggaggccgcctggttggaggggcggattcgacaagaattcgataagctcagagagtttctgagggtcgaagaacaggcaatactggacgccatggcagaggaaaccagacagaaacaattgctggcggatgagaagatgaagcagctgacggaggaaactgaggtccttgctcacgaaatcgaacgtctgcagatggagatgaaagaagacgatgtttcctttctcatgaagcataagagtcgaaagcgccggctgttttgcaccatggaacctgaaccagtgcagcccgggatgctgatcgatgtttgtaaatatttgggatcgctgcagtaccgagtttggaagaagatgctcgctagcgttgaatcagttcccttttcatttgaccctaacaccgccgctgggtggctgtcagtgtccgatgatctcaccagtgtgacaaaccacggataccgggtccaggtggaaaatccagagagattctcttccgctccatgcctattaggcagtagagtctttagccagggttcccatgcatgggaggtggcattagggggccttcagagctggagagtgggcgtggtgcgggtgagacaggactctggcgccgaggggcattctcattcctgttatcacgataccaggtcagggttctggtacgtctgtcgcactcagggggtcgagggcgatcactgcgtaacaagcgacccggccacctccccactggttctggccatcccaaggcggcttcgcgtcgaactggaatgtgaggagggggagctcagcttctatgatgctgagagacattgccatctgtatacatttcatgccagatttggcgaagtgcggccctacttctatctggggggcgcgagaggcgctggcccaccggagccccttaggatttgccctttacacatctctgtcaaggaggagctcgatggatag

SEQ ID NO: 14284 - DNA, 2262 bp, Artificial Sequence
  Description of Artificial Sequence: Synthetic coding sequence
atggctcccgatagcgatcccttccctgagggccccctgctgaagctcttacctctggatgccagggatcggggtactcagcgctgtcgcctgggaccagcagccctgcatgccctgggcgctagactgggctccgctgtgaagatctcattgcctgatggaggctcatgtctttgtacagcttggcctcgcagagatggggctgacggcttcgtgcagctggatcctttatgtgctagtccaggggccgcagtgggggctagcaggagccgacgcagtctgtctctgaatagattactgcttgttccctgtccaccactgagaagggtcgccgtgtggcccgtcttgagggagcgagccggggcccctggcgccagaaataccgcagccgttctggaggccgcacaagaactgttgcggaaccggcctatatccttgggtcacgtggtagttgcacccccgggggcgcctgggctcgtagcagccttacacattgtggggggtacgccctcccccgatcctgccggacttgtgaccccccgcacccgcgtgtctttgggcggtgaaccaccttccgaggcacaaccacaacccgaagtgcctctgggcggcctgtctgaggctgcagattcattgagagaactgctgagactgccgttgagatatcctagagcgctcacggcactgggcctggctgtgcctcgcggagtgctcttagccggtcctcccggtgtcggcaagacacagctagtgcgggctgtggcccgagaggctggggcagagcttctcgctgtgtctgctccagccctgcagggaagtcgtcccggggagactgaggaaaacgtgcggcgggtattccagcgcgcacgtgagctcgcttcaagagggcctagcctcctgttcttggacgagatggatgccctgtgtccgcaacggggcagccgcgccccagaatctcgggttgtcgctcaggtgctgacactgctggatggagctagtggtgaccgggaagtggtggttgtaggcgcgacaaaccgaccagacgcactcgacccagcgttgaggcggcctgggcggttcgaccgcgaggtcgttattgggacccccacactgaagcagagaaaagagatcctccaggtgattacatcgaaaatgccaatatctagccacgtcgacttagggcttctcgcagaaatgactgtgggctacgtgggagccgatttgaccgccctgtgtagggaggccgccatgcatgctttgctacactccgagaagaatcaagataatcccgtaattgatgagattgattttctggaggcctttaaaaacatccagccgagttcattcagaagtgttattggactcatggatatcaaaccagtggactgggaggaaattggtggattagaggacgtcaaattaaagcttaaacagagtattgaatggcctctcaaattcccttgggaatttgtccggatgggcctgacacagccaaaaggagtgttactgtatggaccccccggctgcgccaagacgactctggtacgcgctttggccaccagctgtcattgttcctttgtgtccgtgtcaggggccgaccttttcagtccctttgtgggggatagtgagaaagtgttgtcacagatatttcgtcaggcgcgcgcttccacccctgctattctgttcctggacgagatcgacagcatactcggagccaggagcgcttccaaaacgggttgtgatgtccaggagagggtgcttagcgtgcttctcaatgagctggatggagttggcctgaaaacaattgagcggagggggtctaaaagtagtcagcaggagttccaggaggtgttcaacaggagtgtgatgataatcgccgccacaaacagacctgacgtccttgacaccgcgctgttgagacccggacggctcgacaaaattatttacatacctccgcctgatcataagggacgcctgtccattctcaaggtctgcactaagactatgcccattgggcccgatgtgagcctggagaatctcgcggcggagacctgcttctttagtggcgccgatctgagaaacttatgcaccgaggcagctctgctggctctgcaagagaatggactggatgcgactaccgttaaacaagaacactttcttaaatcactcaagacagtgaagccaagtctgtcctgcaaggatttggccctgtacgaaaatctatttaagaaagaggggttttcaaacgtggaaggcatttag

SEQ ID NO: 14285 - DNA, 1026 bp, Artificial Sequence
  Description of Artificial Sequence: Synthetic coding sequence
atgccaaagcggaaggtaacttttcagggggtgggcgacgaggaagacgaggatgaaatcatagtccctaaaaagaagctcgtcgacccagttgcgggctcgggtggtccaggctccaggttcaagggtaagcatagccttgattccgacgaggaggaagatgacgacgacggagggtcaagcaagtatgacattctggcctctgaggacgtggagggacaagaagcggccaccctcccttccgagggtggcgtaaggatcacgccgtttaacttacaggaagaaatggaggaaggccacttcgacgccgacggcaattacttcctaaacagagatgcacaaataagggatagctggctggataatatcgactgggtcaaaattcgagagcgccctcctgggcagcgccaggcaagcgactctgaagaagaagatagtcttggacaaactagtatgtccgcacaggctctgctagaaggactgcttgagttgttactgccccgggagactgttgccggagccctaaggcggctgggggctcgggggggaggcaaaggccgcaaaggcccaggccagcccagctcccctcagcgcctagataggcttagcgggctggccgatcagatggtggccagaggcaacctgggagtgtatcaagagacgcgggagagattggcaatgagattgaaggggctggggtgtcagaccctgggtccccacaatccaacacctcctccgagtttagacatgttcgctgaagagttagccgaagaagagctggagacgcctaccccaacccagagaggcgaagcggaatctagaggagacgggctagttgacgtgatgtgggagtacaaatgggagaatactggcgacgccgagttgtacggtccatttacctctgcccagatgcaaacttgggtatccgagggatacttccctgacggagtttattgccggaaattagacccacctggggggcaattttataattctaaaaggattgattttgatttgtacacgtag

SEQ ID NO: 14286 - DNA, 690 bp, Artificial Sequence
  Description of Artificial Sequence: Synthetic coding sequence
atggccgaagagatggaatcatctttggaggcgagctttagctcgagtggcgctgtttcgggcgcttctgggttccttcctccagcccggtcaaggattttcaagatcattgtgataggggactctaacgttggaaagacatgcctcacctatcggttttgtgcagggcgctttccagacaggaccgaagccacaattggcgtggacttccgggagagagccgttgagattgacggcgagagaattaagatccagctttgggatacggctggtcaggaacggttccgcaagtccatggtccagcactactaccggaatgttcacgccgtcgtcttcgtgtatgatatgactaacatggcctcgttccacagtctaccctcatggatcgaggaatgcaagcagcaccttttggctaatgacatcccccgtatactcgtcggcaacaaatgtgacctgaggtctgctatacaggtgccgaccgatcttgcccagaagtttgcggacacccacagcatgcctttattcgagacatcagctaaaaacccaaacgataatgaccatgttgaggcgatttttatgaccctcgcccacaaattaaaatctcataagcctctaatgctgagccagcctccggataacggtatcatcctaaagccagaacccaagcctgcaatgacctgctggtgttag

SEQ ID NO: 14287 - DNA, 2352 bp, Artificial Sequence
  Description of Artificial Sequence: Synthetic coding sequence
atgcttttagggttccgacggggtagaagaagccacttcaagcacatcatacacggactgcttccggccgctagcgtggctcccaaagctgcagtcccacgcacacccccccctcgcagccccaatcctagtccggagcggccacggtccgctctggcagctgccattctggccactacacttacaggtagaactgtggcaattccgcagccacgacaacggtctcggtccgaatctgacgtttcttccgtagaacaagacagcttcatagagccatacgcaacaacatcacagctgcgtcccaggccaaactggcagagtgagatgggacgaaggagctctctgccttcctttgaaactcttgattacggagacgaagaggatattgaaacccaactgagtagcagcggtaaggagcttggcgacgtgtccgctcgcgaggacagagggggacactcggatgatctgtacgctgtcccacacaggaaccaggttccacttctgcatgaagtcaactctgaggatgatgagaacatctctcatcaggatgggttcccggggtctcctccagccccccagagaacccaacagaaggacggtaaacaccccgtgctgaacctcaaagatgaaaaaccacctctgtgcgagaagcccccccccagccccgatatcacaggaagggctcgacaaagatataccgaaatcaccagagagaaattcgaggctctcaaagaagagaacatggatctgaataatatgaaccagagcctgactttagaattgaacaccatgaagcaggcaatgaaagagcttcagctgaagttgaaggggatggagaaagaaaagcgtaagctaaaggaggccgagaaggcctcatcacaggaggtagcagcccctgaactgctgtacctgagaaaacaggcgcaggaactggtggatgagaatgacggactaaagatgacagttcaccggctgaatgtggagcttagccgctatcagactaagttcaggcacctatccaaggaggaaagcctcaatattgaagggctgccgagcaagggccctattcctccttggttgcttgatataaagtatcttagcccattgctgttagcctatgaagacatgatgaaggaaaaggatgagctcaatgccacattgaaagaggaaatgcgaatgtttaggatgagagtccaagaggtcgtgaaagaaaacgaagaactgcaccaagagctaaacaagagcagcgccgtgaccagtgaggagtggaggcaacttcagacccaagccaagctcgttcttgaggagaataaactcctgctggaacagctcgagattcagcagagaaaggcaaaggacagccaccaagagagactgcaggaagtgtccaagctgacaaaacagttgatgctgttagaagcaaaaacgcacgggcaggagaaagagctggcggagaatcgggaacagctggagatcctcagggccaagtgtcaagaactgaaaacacacagcgacggcaagatcgccgtggaggtgcataaatctattgtgaatgagttaaagagccagctgcaaaaagaagaagagaaagagagggccgaaatggaagagcttatggagaagctgacagtgttgcaagcacagaagaagagtctgctcctggaaaagaatagcctgaccgaacagaacaaagccctcgaggccgagttggaaagggcccagaaaatcaaccggaaaagccagaaaaagattgaggttctcaaaaaacaggtcgaaaaagcaatgggcaacgagatgagtgcacaccagtacttagccaaccttgtcgggcttgcagagaacattacacaggaaagagattctctcatgtgccttgctaagtgtctggagtccgagaaggacggcgtgctgaacaaagtgattaagtccaatatccgattagggaagctcgaggagaaggtgaaggggtataagaagcaggccgcattaaagctgggcgacatctctcacaggctgctggaacaacaggaggatttcgctggcaagacagcacagtaccgccaggagatgcggcatttacaccaggttctcaaggacaagcaagaggtccttgaccaggcccttcagcagaaccgcgagatggagggcgaacttgaggtaatttgggagtctaccttccgcgagaataggagaataagagagctgctgcaggataccctcaccagaacaggggtccaggataatccacgggctctggtggcacccagtctgaatggggtcagccaggcagatttgctggacgggtgcgatgtctgtagttacgacttaaagagccacgcacccacttgttag

SEQ ID NO: 14288 - DNA, 639 bp, Artificial Sequence
  Description of Artificial Sequence: Synthetic coding sequence
atggctgcgagacggggtgcactcatagttctggaaggtgtggacagagcagggaagtcaacacaatcaaggaaacttgtggaggccttgtgtgcggctgggcaccgagcagagttgctcaggtttccagaacgctctactgagatcggaaagctgttgtcgagctacttacagaagaagtccgacgtggaagaccactcagtgcacttgctcttttcggcaaacaggtgggaacaggtccccctgatcaaggaaaaactgtcacagggcgtcactctggttgtggacaggtatgccttctcaggggttgccttcaccggggcaaaggaaaatttctcacttgattggtgcaagcagcccgacgttggactgccgaaaccagacctggtgctctttttgcagctgcagctagctgacgccgcgaagcgtggagccttcgggcacgagcggtatgaaaatggcgccttccaggagcgggctctgcgctgcttccatcagctgatgaaagacaccactctgaactggaaaatggtggacgcctccaagagcatagaagccgtccacgaagatatccgggtccttagcgaagacgcaatccgaacggcaaccgagaagccactcggggagttgtggaaatag

SEQ ID NO: 14289 - DNA, 504 bp, Artificial Sequence
  Description of Artificial Sequence: Synthetic coding sequence
atggaggaaacgtacaccgactctctcgatcccgagaagctcctacaatgcccctatgataagaatcaccagattagggcctgccgattcccataccacctcatcaagtgtaggaagaatcatccagacgtggcttcgaagctggcgacatgtcccttcaacgcacgtcatcaggtcccacgtgcggagatctcccatcacatctcctcctgcgacgatcgtagctgtattgagcaggatgtggtgaaccaaactcggtctctgagacaggaaaccctggccgaatccacctggcaatgccccccttgtgacgaggactgggacaaagatctgtgggagcagaccagtactccctttgtctggggaaccacacattattccgacaataacagtccggcctccaatatcgtgactgaacacaagaataaccttgctagtggtatgcgcgttcccaaatccctaccttatgtactgccctggaaaaacaacggtaatgcacagtag

SEQ ID NO: 14290 - DNA, 381 bp, Artificial Sequence
  Description of Artificial Sequence: Synthetic coding sequence
atggctgcaggtccagagccacctgaatgggagccaaggtggagaaaggcccttcgcggcaaggaaaacaaaggttcagtggaaatcatgcggaaagatctaaatgatgcccgtgatctgcacggacaggcagaatctgctgccgctgtgtggaagggccacgtgatggacaggcggaaaaaagctctgacagattacaaaaaactgagagcattcttcgtagaagaggaagagcactttctccaggaggcagagaaagaggaggggcttccagaggatgagttggccgatcccactgagcggttccggagcctcttgcaagcagtgagtgaactcgagaaaaaacacagaaaccttggtctgtcaatgctgttgcaatag

SEQ ID NO: 14291 - DNA, 1668 bp, Artificial Sequence
  Description of Artificial Sequence: Synthetic coding sequence
atgcagagctgcgagagtagcggcgactccgctgatgacccacttagcagaggcttgcggaggcgcggacagccaagggtggtggtcataggcgctgggctggccggcctcgccgcggccaaggctcttctggagcaggggttcacagacgtgaccgtgctggaggcctcatcacacataggggggcgcgttcagagcgtgaaattagggcacgcaacttttgagctcggcgctacctggatccacggcagccatgggaaccctatttaccacttggccgaagcaaacggactgttggaagaaactactgatggggagaggagtgtggggaggatctccctctactcaaagaacggggttgcttgctatctcaccaaccacggcaggagaattcccaaagacgtggtggaggagttcagtgacctgtataatgaagtgtataatctgacacaggagttttttaggcatgataagccagtgaacgctgagtcgcaaaacagtgtgggggtgtttactagagaagaggtccgaaaccgaatcaggaatgacccggatgatcctgaggccactaagcggctgaaactggctatgattcagcagtacctcaaggtggagtcttgcgagtcaagctcacacagcatggatgaggtgagcctgtccgcgtttggtgagtggactgagatccccggcgcgcaccatattatccctagcggattcatgcgagtggttgagctgctggcagaaggaattccagcacacgttatccaactcggaaagcccgtgcgctgcattcactgggaccaggcatccgctagaccccgagggccagaaatcgagccgagaggggagggggatcataatcacgataccggtgagggtggacaggggggtgaagaacccagaggcgggaggtgggacgaagacgagcagtggagcgtcgtggtagagtgtgaggattgtgagctgattccagctgatcatgtcatcgtcacagtaagcctgggcgtgttgaagagacaatatacgagctttttccgccctgggcttcccactgaaaaggtggccgccatccatcgcctggggatcggtactaccgataagatattcctggaatttgaggagcctttttggggccccgagtgtaattcactgcagttcgtctgggaggacgaagccgagtcacacacactaacctatcctcctgagctgtggtatcgcaaaatctgtggatttgatgtcctttatccccctgaaagatacggtcacgttttgtcggggtggatttgtggggaggaggcactcgtaatggagaagtgtgacgatgaagcggtggccgaaatctgtacagaaatgctaaggcagtttactggtaatccaaacatccctaaaccccggcgcatactccgatccgcatggggcagtaacccatacttccggggctcttactcttacacacaggtgggctctagcggtgctgacgtcgagaaactggcgaagccactgccttatacggagagctccaagactgcacccatgcaagtccttttctccggcgaagctactcatcgcaaatattactccaccacacacggcgctctcttgagtggacagagagaagcggcgagactgatcgaaatgtatcgcgatttatttcagcaggggacatag

SEQ ID NO: 14292 - DNA, 3153 bp, Artificial Sequence
  Description of Artificial Sequence: Synthetic coding sequence
atggccctttatgacgaggacctcctcaagaaccccttttacctcgctctgcagaaatgtaggcccgatctgtgctctaaagtcgcccagatccacggtattgtgctcgtaccatgtaaaggttcattatcctcaagtatacagtcgacttgtcagtttgaatcatacatcttgatccccgtggaagaacattttcaaacgctcaacggaaaggacgtcttcatccagggcaaccggataaagttgggcgcgggtttcgcatgcctcctaagcgtaccaatcctgttcgaagaaacgttttataacgagaaggaggagtctttttccattttgtgtatcgcacacccactcgagaagagggaatccagtgaggagccactggcacccagcgatccgttctctctgaagaccattgaggacgtccgcgagttcctgggaagacactcagagcggtttgaccgaaatatcgcttcatttcatcggacctttagggagtgcgagagaaagtctctgagacaccacatcgacagcgccaatgccctctataccaagtgcctgcagcagctgctacgcgacagtcatctgaaaatgttggcgaaacaggaggcacaaatgaatttaatgaagcaggctgttgaaatctacgttcatcacgagatctataacctaattttcaagtacgtcggcaccatggaggcgtccgaggacgccgcatttaataagattaccaggagcttacaggatctccagcagaaggacatcggtgtcaagcccgaatttagcttcaacataccccgtgcgaaaagggaattggcccagctgaataagtgcacaagcccacagcagaagctcgtgtgtctgcgcaaggtggttcaacttatcacacagtccccaagtcagagagtaaacttggagactatgtgtgctgacgacctcctgagcgtgctgctgtatctgctggttaaaactgaaatacctaattggatggctaatctgtcgtatataaagaatttccgtttctcctcactggccaaagatgagctgggctattgtttgacatcattcgaggccgccattgagtacatccggcagggcagcctctccgcaaagcctcctgagagcgaaggattcggagaccgtctcttcctcaaacagcgaatgagtctactgtcccaaatgacatcatctccgactgactgtttgttcaagcacattgcctcaggcaatcagaaagaggtcgagcgcctgctaagtcaggaggaccacgataaggacaccgtgcagaagatgtgtcaccccctgtgtttctgtgacgattgtgagaaactggtgagtggaagactgaatgaccctagcgtagtgacacccttttcaagggacgaccgaggacataccccactgcatgtggcagctgtgtgcggccaggctagcctcattgacttattggtatcaaagggagctatggttaatgcaaccgactaccacggcgccactcctttgcatcttgcttgtcaaaaagggtaccagagcgtgaccctgctgttactgcactataaggcctcagctgaggtgcaagacaacaatggaaatacccctttgcacctggcttgcacatatgggcacgaagactgtgtgaaggcacttgtgtactacgatgtggagtcatgtcgtcttgatattggcaacgagaaaggggacactccactccatatcgcggcaagatggggttaccagggggtaattgagacacttctgcaaaacggcgccagcacagagatccagaaccgtttaaaagaaaccccactcaagtgcgccctgaatagcaagatcctgtcagtgatggaggcataccacctttccttcgaaagacgtcagaagtcctcagaagcgcccgtgcagtcaccccaacgctcagtagactcgatctcgcaggagagctctactagttccttctcttccatgtcagcttcgtcaagacaggaggaaacaaaaaaagattatagagaggttgaaaagcttctccgcgccgtggctgacggtgacttggagatggttcgctatttgctggagtggaccgaagaggatcttgaggacgccgaagataccgtctctgccgccgatccagagttctgccacccactgtgtcagtgtcccaagtgcgctccagcacaaaagcggctggcaaaagtgcccgcctcaggcctgggtgtgaacgtgacctcccaggatggatcctccccccttcatgtcgcagccctgcatgggcgagcagatctcatacccctgctgctcaaacatggagcgaatgctggggcgcggaatgccgatcaggcagtgccccttcatctggcctgtcagcagggtcacttccaagtggtgaaatgcctattagactctaacgcaaagcccaataagaaggatctgtcaggcaacacgccattgatttacgcctgttcaggaggtcaccacgaactcgtggccctgctgctgcagcacggcgccagtatcaatgccagcaacaacaaaggtaatacagctcttcatgaagccgtgatagagaagcacgtttttgtggttgagttgttactattacatggggcctcagtgcaggtcctcaacaaaaggcagaggactgccgtggactgtgctgaacagaactctaagatcatggagctgttgcaggttgttccatcctgcgtcgcatctctggacgatgtggctgagaccgatagaaaagagtatgtgacagtgaagatccggaaaaaatggaactctaagctctacgacctgcccgacgagccttttactaggcagttttattttgtacacagtgcgggacagttcaaggggaagaccagtagggaaattatggccagagaccgcagcgtgcccaacctgaccgaaggctctttgcacgagcctggccgacaaagcgttacgttacggcagaataacctccctgcccagagtggttcacatgctgctgagaaggggaatagcgattggccggagcgacctggactgacccaaactgggcccggtcaccggcgcatgctacggagacatacagtggaggatgcagtggtttcccaggggcctgaggccgcaggtcccctcagcacaccacaggaagtgagcgcaagcagatcgtag

SEQ ID NO: 14293 - DNA, 1662 bp, Artificial Sequence
  Description of Artificial Sequence: Synthetic coding sequence
atggatgtggataaggaattgggaatggagtctgtgaaagctggtgcttccggcaagcccgagatgcgacttggaacacaggaggagaccagcgagggcgatgccaacgagtcctctttgctggtgcttagctccaatgttccacttctggctctcgaatttctagaaatagcccaggccaaggaaaaagcttttcttcctatggtgtcccatacctttcatatgcgcactgaagagtccgacgcgtcgcaggagggggacgacctcccaaaaagctcagccaacaccagtcatccaaaacaggacgattctccgaaaagtagcgaggagacgattcagcctaaggaaggcgatatccctaaggccccagaagagactatccagtcaaaaaaagaagacttgcctaagagctccgagaaagccatacagccgaaagaatctaacattcctaaatccagcgcaaagcccatccagcccaagctgggtaacataccgaaggcatctgttaagccctcccagcccaaggagggcgatatcccaaaagcgcctgaagagacaattcaatcaaaaaaggaggatcttcctaaatcttcagaagaagctatacagccgaaagagggcgatattcctaaatcaagcgccaaaccaattcaaccgaagcttggcaatatcgcaaagacatctgtcaagccctcacagcccaaggagagcgatattcccaaaagtccagaggagacaattcagcctaaggagggtgatattccgaaatcttccgctaagcccatccaacccaaactaggaaacatcccaaaggccagtgtcaagcccagtcagcccaaagaaggggacatttccaaaagtccagaggaagcgatccagcccaaagagggcgatctgcccaagtcattggaagaggccattcagcccaaggagggcgacattccgaagtctcctgaggaggccatccagcctaaagaaggagacattcctaaatctctggaggaggctatacagccaaaggagggcgatatacctaagagccctgaggagacaattcagccaaaaaagggcgacattcccaagagccccgaagaagccattcaaccaaaggagggagacattccaaaaagcccaaagcaagctatccaacccaaagaaggagacatcccaaaatccctggaggaggcaatccccccgaaggaaatcgatattccaaagagtcccgaggagaccatacaaccaaaggaagacgactcccctaaaagcctggaggaagctaccccgagtaaagagggagacatcctcaaaccggaggaggaaacaatggaattccccgagggcgacaaagtcaaagtgattctatctaaggaggattttgaggcaagcctaaaggaagccggagagcggctggtcgctgtggacttctctgctacctggtgtgggccgtgtaggacaattcggccgttctttcacgccctcagtgtaaaacacgaagatgtcgtgttcctggaggtcgatgcggataactgcgaggaggtggtccgggagtgtgctatcatgtgcgtccccacattccaattctataagaaggaggagaaggtggatgagttgtgtggggccctcaaggagaagctggaagccgttatagcagagctgaaatag

SEQ ID NO: 14294 - DNA, 2268 bp, Artificial Sequence
  Description of Artificial Sequence: Synthetic coding sequence
atggtgagccacggtagttccccaagccttttggaagctctctcctccgatttcttggcctgcaagatctgcctcgagcagctccgggccccgaaaaccctcccttgtctgcatacatattgccaagattgtttagctcagctcgctgatggaggtcgagtcagatgtcctgaatgtagagaaactgtaccagttccccccgaaggcgtagcttcctttaaaacgaacttttttgtgaacgggctactggacctggtgaaagctagggcatgcggcgacttgcgcgctggtaaacccgcttgtgcactgtgccccctggttggaggcacgtcgacaggagggccagcaacagcacggtgtctggactgtgccgacgacttgtgccaggcctgcgctgacggccacaggtgtaccaggcaaacacacacgcatagggtagtggacctagtgggatatcgagccggctggtacgatgaggaggcccgggaaagacaggccgcccagtgtccccagcacccaggcgaggctctccgattcctttgccagccgtgtagtcagctgctttgtagagaatgccgtctggacccacacctcgaccatccgtgtctacctctggccgaggcagtgcgcgctcggaggcctgggttagaaggtctgctggcaggagtggacaacaatctggtggagttggaggccgctagacgggtagaaaaagaagctctcgcacgcctcagggagcaagccgctagagttggtactcaggtcgaggaggctgccgagggcgtccttcgagctctcctagctcagaagcaggaggttctgggccagctcagggctcacgtcgaagccgcagaagaggctgcaagagagaggttggccgaacttgaaggcagggaacaagtagcacgggcagccgcagcctttgcgcgccgagtgttgagcctcgggcgggaggccgagatcctgtccttggagggcgccatcgcgcagagactccgccagcttcaggggtgcccatgggcccccggcccggctccctgtttactgcctcagttggagctgcaccccggcttactggacaaaaactgccatttgctccgtctgtcattcgaagaacaacaaccccagaaggatggggggaaggacggagctgggactcaaggaggtgaggagtcccagagtcgaagggaggacgagcccaagacggaacgtcagggtggcgtccagcctcaggccggcgatggagcacagactccaaaagaagagaaagcgcagactacccgtgaagaaggtgcccagacattggaggaggacagggctcaaacccctcatgaagatgggggaccccagccgcataggggaggcagacccaataaaaagaagaaatttaaaggacgacttaagagtatttccagggaaccatccccagctttgggccctaacctggatggctcaggcctgcttcccagacccatcttttactgcagcttcccaacgcggatgccaggagataagcggtcccctaggattactggattgtgcccctttgggcctcgggaaatcctcgtagcagatgaacagaatagagccttgaagagatttagcctcaacggtgattacaaaggcacagtccccgtccctgaaggctgtagcccctgttccgtcgcggctcttcagagcgctgttgcgttttctgcctccgctaggctttacttgatcaaccctaatggcgaagtgcagtggcggcgcgcgctcagcctctcccaggcttcacacgctgttgctgcacttccctctggggacagagtcgcagtctcagttgctggtcatgtcgaggtgtataacatggaaggcagcctggctactagatttattcccggtgggaaagcatctagaggcctacgcgctctcgtattcttgaccactagtccccagggccatttcgtgggtagcgattggcagcagaattcagtggtgatctgcgatggactgggccaagtggtgggggagtataaaggacctggcctgcacggttgccagcccggatccgtcagcgtagataaaaagggatacatttttttgactttgagagaagttaacaaggtggtgatcttagatcctaaagggtctctcctcggcgacttcttgaccgcttaccatggactggagaagccccgcgttactactatggttgacggtaggtacctggtggtttccttatcaaacggtactattcatatttttagggttcgctcccctgatagttag

SEQ ID NO: 14295 - DNA, 1467 bp, Artificial Sequence
  Description of Artificial Sequence: Synthetic coding sequence
atggctgctggctcagaggccactacacccgtgattgtcgctgcaggggcaggcggagaggaaggtgagcatgtcaagccttttaagcctgagaaggctaaagaaattatcatgtcattacagcagccagccatcttttgtaacatggtctttgattggcccgctcgacactggaacgccaaatatttgagccaagtgctgcacggaaagcagattaggttccgtatgggtatgaagtccatgtccactgttccccaatttgagacaacatgcaactatgtagaggccactctcgaggagttcctgacctggaattgcgatcagtccagtatctctggtccgttccgggattacgaccattccaagttctgggcctatgctgactacaaatacttcgtgagtcttttcgaggataagaccgacctgttccaagatgtaaagtggtcagacttcgggttccctgggcgcaatggacaagagtctactctgtggattggaagcctcggggcccatacaccctgccacctggattcatatgggtgcaacttggtctttcaggtccagggaaggaagagatggcacctcttcccccccgaggatactccctttctgtatccgactagaattccttacgaagaaagctccgtgttctctaaaataaacgttgtaaatcccgacctgaaaagattcccgcagttcagaaaggcccagcggcacgccgtgactctctctccaggccaggtgctgtttgtgccacgacactggtggcactatgtggaatccatcgacccggtgactgtgtctatcaacagttggatagagttggaagaagatcacctcgctcgggtcgaagaggccatcactaggatgctggtctgcgcgctgaaaaccgctgaaaacccacagaacaccagggcttggcttaatcctactgaagtggaggagacctctcatgccgtgaactgttgttacttaaacgctgccgtgagtgcatttttcgatcggtgcagaacaagtgaggtggttgagatccaagccttgaggacagatggggaacatatgaagaaggaagagcttaatgtttgtaatcacatggaggtggggcagaccgggtcgcagaacttaacaaccgggacagacaagccagaggccgcttctccattcgggcctgacctggttcccgtcgcccaacggtctgaggagcctcccagcgaacgtggcgggattttcggaagcgacggaaaggattttgtggataaggacggggaacattttggaaagctgcattgtgctaaaagacagcagattatgtccaatagcgagaatgcaatcgaggaacagatcgcttctaacacaaccacaaccccccaaaccttcattagcactgacgatctgctggactgtctggtaaaccctcaggtgactcgcatcgtcgctcagctactcattcagggccggtccctttag

SEQ ID NO: 14296 - DNA, 579 bp, Artificial Sequence
  Description of Artificial Sequence: Synthetic coding sequence
atggcacctaagccaggcgcagagtggagtaccgccctctcccacctcgtgctgggggtcgtcagtcttcacgccgcggtgtctaccgcggaagcaagccgaggcgcagccgccggatttctgctccaggttttggccgccacaacgacactggcacccggcctctccacccacgaggattgcttggccggagcctgggtagctacggtcatcggactgccactgcttgcatttgacttccattgggtgaatggagacagatcaagtgcaaatctactcctcggaggcggtatggtcctcgccgttgctggcggccacttgggccccgaggggaggtctgtcgcgggacaggctatgctgctggtagtagctgtgacaatactgatagtcgcagtgtttacagcaaatacctacggcatgtggggcggtgccatgctgggggttgccggtctcttgagcagattggaagaagatcgcctactcctgctgcccaaggaggacgtgtgccgctgggcgctggctgtgggttcttgggcttattgtagagcactgcacacgcagcggctgcaatgggaatag

SEQ ID NO: 14297 - DNA, 462 bp, Artificial Sequence
  Description of Artificial Sequence: Synthetic coding sequence
atgacttctgagtctacgtccccccctgtggttccccccttgcactccccaaagtcccccgtctggccgactttccccttccatcgggaggggagtcgagtctgggagaggggtggtgtcccacccagggacctaccttcacccttacctactaaacgcacccgcacttatagtgcaacagccagagccagcgctggaccagttttcaagggtgtctgcaagcagttcagcagaagtcaggggcacggatttataacccccgaaaacggttccgaggatatattcgtgcatgtgagcgacatcgaaggggaatatgtgcctgtcgagggcgacgaagtaacctacaagatgtgccccatacctccaaaaaaccagaagttccaagccgtggaagtcgtgctgacacagctggctccccacactcctcacgaaacgtggagcggacaagttgtggggtcctag

SEQ ID NO: 14298 - DNA, 537 bp, Artificial Sequence
  Description of Artificial Sequence: Synthetic coding sequence
atgtcgagttttagcagagccccccagcaatgggctaccttcgcacgaatttggtatttgcttgacggcaagatgcaacctccagggaagctcgcagccatggcctctatcaggcttcagggcctgcacaagccagtgtatcacgcgcttagcgactgcggtgaccatgtagtgattatgaatactcgtcatatcgctttctcgggaaacaaatgggagcagaaggtttattcgtcccacacaggctacccagggggttttaggcaggtgaccgcagctcagctgcacttgagggatcccgtggcgatcgtgaagctggccatttatggcatgttaccaaagaacctgcatcgacgtacgatgatggaaaggctgcatctctttcccgacgagtacatacctgaggatattctgaaaaatctggtggaggaactgccacagcccaggaagatccccaagcgcttagacgaatatactcaggaagaaattgacgctttcccccggctgtggactcctcccgaggactaccgcttgtag

SEQ ID NO: 14299 - DNA, 8763 bp, Artificial Sequence
  Description of Artificial Sequence: Synthetic coding sequence
atgcgtggcaggcgaggacggcctcctaaacagccagcggcaccggctgccgagcgatgtgctcccgcccctccccccccccctccacccccaactagcggaccaattggaggactgcggagcagacatcgtggaagttcaaggggaagatgggcagccgcacaagccgaggtcgcccctaaaacccgccttagcagtccccgtggagggagcagttcccgtcgcaaacctcctccaccccctcccgccccaccttctaccagtgctccaggtcgcggtggccggggcggtgggggagggcgcacggggggaggaggggggggcggccacctggcacgcacaaccgcagctcgtcgggccgtgaataaagtcgtgtatgatgatcatgaaagcgaggaagaagaagaggaagaggacatggtgtctgaggaggaggaagaagaggatggggacgcagaggagacacaggattccgaggatgatgaagaagacgaaatggaggaagacgatgatgattctgattatcctgaggagatggaggacgacgatgacgatgcctcttactgtactgaatcctcctttaggtcccactctacatactcgtccaccccaggacgcagaaagcctcgtgtccatcgtccaagaagccctattctagaggagaaggatatccctccactcgagttcccgaagtctagcgaagatctgatggttcctaacgagcacattatgaacgtgatcgccatttacgaagtgctcaggaattttgggactgtcctgaggctttcccccttccggtttgaggacttctgcgcagccctcgtatcacaagagcagtgtacactgatggctgagatgcatgtggtcttactgaaagccgtattgagagaggaagacactagcaacaccacatttggcccagccgatttaaaggacagcgtgaattcaacgctgtacttcatcgatggaatgacttggcctgaagtgctgcgcgtgtattgtgaaagtgataaggagtaccaccacgttctgccatatcaggaggctgaggactacccatacggtcccgtggagaataagatcaaagtcctgcagtttctcgtagatcagttcctgacaacaaacattgctcgggaggagcttatgagcgaaggggtgatccagtacgacgatcactgccgggtctgtcacaagctgggcgatctactatgctgcgagacctgttccgccgtataccatctggaatgcgtaaagcctcctctggaagaggttcccgaagatgaatggcagtgcgaggtgtgcgtggctcataaagtgccaggtgtcactgactgtgtagctgagatccagaaaaacaagccatacatacgccacgaacctattggctatgatcgctctagacggaaatattggtttctcaatagaaggctgatcatagaagaggatactgagaacgagaacgagaagaaaatctggtactatagtactaaggttcagcttgcggagctcattgactgcctggataaggactattgggaggccgaactgtgcaaaattcttgaggaaatgagagaggagattcataggcacatggatatcaccgaagaccttacgaacaaagcccgggggtcaaataagtcttttcttgccgccgctaacgaggaaatcctggagagcatcagggccaaaaagggggacattgacaacgttaaatctcccgaagagaccgagaaggataagaatgaaacagagaatgattcgaaagatgcagaaaagaatcgcgaagaattcgaagaccagagtctcgaaaaggactccgatgataagactccggacgacgatcccgaacagggcaaaagtgaggtcggcgactttaaatcagaaaagagcaatggggagttgtctgaaagccccggagctgggaaaggagctagtggcagcacccggattataacaagactccgcaaccccgattctaagctcagtcagttgaaatctcagcaagtggctgcggcagctcacgaagcgaataaactgtttaaggaaggaaaagaggttctggtggtaaatagtcagggcgaaattagtcgtctatccaccaagaaagaagtgataatgaaaggtaacattaacaactactttaaactagggcaggagggaaaatacagagtataccataaccaatatagcactaattcttttgcactgaataagcatcagcacagagaggatcacgacaaacgacgtcacctggctcataagttctgccttacgcccgctggcgaattcaagtggaatggctccgtgcacggttccaaagtactgactataagtacgctaaggctgacaatcacccagctcgaaaacaacatcccttcctccttcctccatcctaattgggctagtcatcgggcaaactggataaaggccgtgcagatgtgtagcaagcctcgggagtttgcactggcacttgccatactcgagtgcgcagtaaagcctgtagttatgttgcctatttggagggagagcctaggccacaccagactgcataggatgacttcaattgagcgggaggagaaggagaaagtgaagaaaaaagaaaagaagcaagaagaggaagaaaccatgcagcaggctacctgggtgaaatacacatttcccgtgaaacaccaggtgtggaagcagaagggtgaggaatatcgcgtcacggggtacggtgggtggagttggatctcaaagacgcatgtttatcgcttcgtgcctaaattgcccggtaataccaacgtgaattaccgtaagtcactggaaggtacaaaaaataacatggacgaaaacatggacgagagtgataagaggaaatgttcgcgatcccccaagaaaatcaagatcgagccagattccgagaaagatgaggtgaaggggtccgatgcggcaaagggcgctgatcagaatgagatggacatctcaaagataaccgagaaaaaggaccaggatgtgaaggagctgctggacagcgattctgacaagccttgtaaggaggagccaatggaagtagacgacgacatgaagactgaatcacacgtcaattgtcaggagagcagtcaggtggatgtggtgaatgtgagcgaaggttttcatctgaggacctcatataaaaagaagactaaatccagcaaattagatgggctgctcgagagacgcatcaagcaattcacacttgaagagaagcaacggctggagaaaattaagctggagggaggtattaaaggaataggaaagactagcactaattcatcaaaaaacctgtccgagtcccccgtgattactaaagcaaaagagggctgtcagagtgactcaatgcgccaggaacagtcccccaacgccaacaacgaccagccagaggatctcatccaaggatgttctgaaagcgactcgtccgtcctccgcatgagcgacccttcccacaccactaataaattatatccaaaggacagagtgctcgatgacgtgtccattaggagccccgaaaccaagtgtcccaagcagaattccatcgagaacgatatcgaggagaaagtgtccgacctggcctcaagagggcaggagccaagcaagtccaaaaccaagggcaatgacttctttatagatgacagtaagttagcgtcagctgatgatatcggcacattgatctgcaagaataaaaagcccttgattcaagaggaatcggacacaattgtgagttcatcaaagtcggccctgcactcctccgtgcccaaatctaccaacgatcgcgacgccacaccgctcagtcgcgctatggatttcgaaggaaaattgggctgcgatagcgagtccaatagcacacttgaaaatagtagtgatactgtgtccatacaagatagcagtgaggaagatatgatcgtgcagaacagcaatgagtcaatcagtgagcagtttcggaccagagagcaagatgttgaggttttggagccccttaagtgcgagctagtgagcggcgagtcaacaggaaattgtgaagaccgacttcccgtgaaaggcaccgaggccaatggcaagaagccctcgcagcaaaagaaactggaggagaggcccgtgaataaatgttctgatcagattaaactcaagaacaccacagacaagaagaacaacgagaacagggaaagcgaaaagaaggggcaacgcacgagcactttccagattaacggaaaggacaacaaaccaaaaatctacctgaagggtgagtgcctgaaggaaatttctgagtcacgggtcgtatcagggaacgttgagcctaaggtcaataacataaacaaaattatccccgaaaatgacataaaatcgctgactgtgaaggaatcggctatccgccccttcattaacggagatgtgatcatggaagacttcaacgagagaaatagttcagagaccaaaagccaccttctgagcagctccgacgcggagggaaactaccgcgattccttggagactctgccgtcgacaaaggagagcgactcaacacagactactaccccttcggccagctgcccagaatctaactccgtcaatcaggtagaagatatggagattgagacaagcgaggtgaaaaaagtgacatcctctcctattaccagcgaagaggagagcaacttaagcaatgacttcatagatgagaacggactgccaataaacaagaacgagaatgttaacggcgaaagtaagcgtaaaacagtcattaccgaagtgacgactatgacctctaccgtggccacagagtcaaagacagtgatcaaggtggaaaagggggacaagcagaccgtcgtgtcctcaactgagaactgcgccaaatctaccgtgaccaccaccaccaccaccgttaccaaactgagtactccaagcactggaggctctgtggatattatatccgttaaggagcagagcaaaactgtggtgaccactactgttaccgacagcttgactactaccggtggcaccctggtgacaagcatgaccgttagtaaagagtacagcacaagggataaggttaaattaatgaaattcagccggccaaaaaagaccagaagtggcacagccctgccttcctaccggaagttcgtaactaagagtagtaagaagagcatcttcgtgctgcccaacgatgatctcaagaagctcgccagaaagggtggtattcgggaagttccctactttaactataatgcgaagccagctttggacatctggccctatccaagccccaggcctacgttcggcataacctggagatacagactgcaaactgtgaaaagcctggctggcgtttctcttatgcttcgcttgctttgggcctccctgaggtgggatgacatggccgctaaggctccacctgggggaggtactactagaacagagaccagcgagaccgagatcaccactaccgaaatcatcaagaggcgagacgtcggtccttacggcatcaggtcagaatattgcatacgcaaaatcatttgtcccatcggggttccagaaaccccgaaggagacacctaccccacagcgcaagggattgaggagttcggctctgagaccaaagagacccgagacccctaagcagaccgggcctgtgattatcgaaacatgggtggcggaggaggagcttgaattatgggaaatcagagcattcgctgagagagtggaaaaagaaaaagcccaggctgtggagcagcaggctaagaaacggctggagcaacagaaacccacagtaatcgctaccagtacgacctctcccacatcaagcaccacctcgacaatttccccggcccagaaggtcatggtcgcccctattagtggcagtgtcaccacaggaaccaagatggtattaaccaccaaggtgggtagcccagccacagtgacattccaacagaacaagaatttccatcagacctttgccacctgggtaaagcaggggcagtccaacagcggtgtggtgcaggtgcagcagaaagtgctcggtatcatacccagctctaccggcacttctcagcagacatttacctcctttcagcccagaactgcaaccgtgaccatacgtccaaacacatcaggttccggcgggaccactagtaactcacaggtgatcaccggaccccagatccgcccgggtatgacagtgatccgcactccacttcagcagtcaactctaggaaaagcaataatcaggacccctgtcatggtgcagcccggagcaccacagcaagttatgacccagattatcagagggcagcctgtgtccactgcggtgagcgcccccaacacagtctcctcaacgcctggccaaaaaagcctgacctctgctaccagcacatctaatatccagtcttccgcctcccaaccacctcggcctcagcaaggccaggtgaagctgaccatggcccagctgacccagttgactcaaggacacggaggaaatcaaggcttgacggtagtcatccaggggcagggccaaacgactggtcagcttcagctgattccccaaggagtgaccgttctgccaggccccggacagcagctcatgcaggctgctatgccaaacggcacggtgcagaggtttctgtttacacctctggccacgaccgctactacagcctccacaacaaccactactgtgagtactacggccgcagggaccggcgagcaacggcaaagtaagctaagcccacaaatgcaggtccaccaagacaagacgctgcctcctgctcaaagtagttcggtgggaccagctgaggcacagcctcagaccgctcagccatctgcccagccacagccccagacccagccgcagtcccctgcccagcctgaggtccagacacagccagaggttcagacccaaacgaccgtgagctctcacgtgcctagtgaggcacagcctacccatgctcaaagcagcaagccgcaggtcgctgcacagagtcaacctcagagcaacgttcagggccaaagccctgtgagagtccagtctccatcacagacccgaatacgccccagcactccctcgcaattatctccaggccagcagtctcaggtccaaactacaacatcccagcccattccaatccaaccacacacttcactgcagatcccttcccagggacagccccaaagtcagccccaggtgcagtcttcaacacagacactttcttccgggcaaacgctaaatcaggtgaccgtgagcagcccgtcgcggccacagctgcagatccagcagccccagcctcaggtaatcgctgtgccccagcttcagcaacaggttcaggtgctgagccagattcaatctcaggtggtcgctcagatccaggcacagcagtcaggcgtgcctcagcagattaagctgcagctgcctattcaaatccagcagtcttccgctgtgcagactcatcagatacagaacgtggtcacagttcaggctgcctccgttcaggagcagctgcagcgggtgcagcaactgagggatcagcagcaaaagaagaagcaacagcagatcgaaattaagcgtgagcatacactccaagcgtcaaatcaatctgaaatcatccagaaacaggtagtgatgaaacacaatgcggtgatcgaacacctgaagcagaaaaagtcaatgactccagccgagcgcgaggagaatcaaagaatgatcgtgtgtaatcaagtgatgaagtatattttggataaaatcgataaggaagagaagcaggccgcgaaaaagagaaagcgcgaggaaagcgttgagcaaaagagaagcaaacaaaatgccaccaagctgtccgccctgttatttaagcataaggaacagcttcgagctgagattcttaagaaacgcgcactactggacaaagatctccaaatcgaggtccaggaggagctgaaaagggacctaaaaataaagaaagagaaggatcttatgcagctcgcccaggctaccgctgtggcggcaccatgtcctccagtcacacccgcgcctcctgctccccccgcccctccgcctagcccaccaccccctcccgctgtgcaacacacagggttgctgtcaacccctaccttgcccgcagcatcccaaaagcggaagagggaagaggaaaaggactcttcctcaaagtccaagaagaagaagatgattagcaccacctccaaagagacaaagaaagacacaaaactctactgcatctgtaaaaccccctatgatgagtcaaagttttacatcgggtgcgatcgctgccagaactggtatcacggacgctgcgtcggaattctgcagtccgaggccgagctgatcgatgaatatgtgtgcccacagtgtcaaagcacagaggatgcaatgactgtactgactccactgactgaaaaggattacgagggactgaagcgggtcctgcgtagtttacaggcacacaaaatggcctggccctttctcgagccagttgatcctaacgacgcacctgattactacggcgttatcaaagagccgatggacctggccacaatggaggagcgggtgcagcgacggtattacgagaagttgacagagttcgtcgcagacatgaccaaaatattcgacaattgcaggtactacaacccaagcgatagccctttctatcagtgtgccgaagtcctagaaagtttcttcgtgcagaagttgaaggggttcaaggcttctcggagtcataacaataaactccagtctaccgcctcttag

SEQ ID NO: 14300 - DNA, 390 bp, Artificial Sequence
  Description of Artificial Sequence: Synthetic coding sequence
atggccgatccaagggtgaggcagatcaagatcaaaacaggagtcgtgaagcgtttggtaaaggaaaaagtgatgtacgagaaggaagctaaacagcaagaagaaaaaatcgagaagatgagggcagaggacggagagaactacgatattaaaaaacaggccgagatccttcaggagtctaggatgatgatccccgattgtcagagacgactcgaagcggcctatctggatctccagcgcatcctcgtctcaaaggacttctgcgtgatgtttaagttcttcttttctatccagtatatggagtcgcagaaattcaaatacctgactcttaggacttcatggcagtactttctgtttacatgccctttatacagatacattctgaaatag

SEQ ID NO: 14301 - DNA, 582 bp, Artificial Sequence
  Description of Artificial Sequence: Synthetic coding sequence
atgagcgacgacgattctagagcgagcacatcctcatccagctcatcttcctcaaaccaacagactgaaaaagaaactaacacccccaagaagaaagagtcaaaagtgtctatgtccaagaactccaaactcctttccacctcggcaaagcggatccaaaaggagctggctgatattaccctagatcctcctccgaattgtagcgctggccccaaaggagacaacatttacgagtggaggtcgaccatccttgggcccccgggatcagtgtatgagggcggtgtattttttctcgacattacgtttacacctgagtacccatttaagccccctaaggtgacttttcgcacccggatctaccattgcaatatcaattcacagggagtcatttgcctggacatcttgaaagacaactggagccccgctctcacaatatccaaagttctcctgtccatttgcagcctattaacagactgtaatcctgccgaccccctagtgggctctattgcgacgcagtatatgaccaaccgcgcagagcacgacaggatggcccgacagtggactaaacgatatgctacttag

SEQ ID NO: 14302 - DNA, 1395 bp, Artificial Sequence
  Description of Artificial Sequence: Synthetic coding sequence
atgagtctacaattctctaacggatcccggcacgtgtgtctgcgtagcggagcaggcagcgtgaggcctctgaacgggggcgccggtttcgccggttcctctgcttgcggcggctccgtagcaggttcagagttctcttgcgcgctgggtggtggcctgggttccgtgcccggcggatcccatgccggaggcgcactgggaaacgccgcatgcattggttttgctggtagcgagggcggcctgctgagcggcaacgaaaaagtgactatgcagaacctgaatgatagactagcaagttatctggacaacgtgagagccctggaggaggcgaacgcggagctggagaggaagataaaaggctggtacgagaagtatggaccaggttcttgtcgcgggctagatcacgactatagcagataccatctgacaatcgaagaccttaagaacaagattatctcgtccacaactactaacgcaaacgtgattctgcaaatcgacaatgccaggctcgcagcggatgatttcagacttaagtacgaaaacgagttgaccctccatcaaaacgtcgaggccgacataaacggattacgccgcgtactggacgaacttactttgtgtcgtaccgaccaggagctgcagtatgagagcctcagcgaggaaatgacttacctgaagaagaaccatgaggaggagatgaaggcgttgcagtgtgcggccggcgggaatgtcaacgttgagatgaacgctgcgcccggtgtcgacctggccgtgctgctcaacaatatgcgagcagaatacgaggccctggccgagcagaaccgcaaagacgctgaagcttggttcaatgagaagtctgccagtcttcagcagcaaatatcacatgactcaggtgccgccacttttgcccgatcccagctgaccgaaatgagaaggaccctgcaaactctggagattcagctgcaatccctgatggccactaagcatagtttagaatgttccctgactgaaactgaaagcaactactgcacacaactggctcagattcaagctcagattggggctttagaagagcaacttcatcaagtgcggacggagactgaaggacagaagttggagtacgagcatcttcttgatgtaaaagtccacctcgagaaagaaattgaaacctactgccgactgatcgacggagatggcaattcatgtagcaagagtaagggtttcggctccggttcacccggtaattcgagcaaggacctctccaaaacaacacttgtgaagacagtcgtggaagagctggaccagcgcggaaaggtgttatctagccggatacacagcattgaggaaaaaacatcaaaaatgaccaacgggaaaactgaacagagagtccccttttag

SEQ ID NO: 14303 - DNA, 2013 bp, Artificial Sequence
  Description of Artificial Sequence: Synthetic coding sequence
atggaagagttccggcgcagctatagtaggctgtgcagagaaagcggggctgagccacaggaagccgtgttgcagcagctccatcagctcccccgtggaaggctcgacctagccacgcagagcctgaccgttgagacctgccgcgctctggggaaactgctgcctcgcgaaaccctgtgtaccgagctcgtgctgtcggactgtatgctctctgaggagggagccactctactgctgcgcggactgtgcgccaacactgttctcaggttcctggacctcaagggtaacaatctacgcgctgccggggccgaagctctcggaaaactgctgcagcagaataagagcatacagagcctgacgctggaatggaactctctcggcacgtgggatgatgcgttcgcgaccttttgcggtggcttggctgccaacggcgccctgcaaagattagacctgcgtaataaccagatcagccacaagggggcagaggagctggcgttggccctgaaaggcaatacaactctgcaacagctggatctgcgttggaataatgtgggactgctgggcgggagggccttgatgaattgcctgccttctaacaggaccctctggagacttgacctggctggcaacaacataccaggagacgttctgagggcagttgagcaggcaatgggccatagccaggatagacttaccacattccaagaaaatcaggctagaactcacgtgctgtcaaaagaagtgcagcacctcagggaggaaaaatctaagcagttccttgatctcatggagaccattgacaaacagagagaggaaatggcaaagagctcgcgagcttctgctgcacgcgtgggtcagctccaggaggctctgaatgaaaggcactccatcataaatgcccttaaggccaagctgcaaatgaccgaggccgcactggctctgagtgagcagaaggctcaggacctgggggaactgcttgccacagccgagcaggaacagctctcgctgtcccagcgtcaggctaaggagctaaagctggaacagcaggaagcggctgaacgcgagagcaagttgctgcgagacctttcagccgccaacgagaagaaccttttgctgcaaaatcaagtggatgagttagaacgcaaattccgatgtcagcaggagcagctgttccagacgcgacaggagatgacttccatgtcggcagagctcaagatgcgagccatccaggctgaggaacgactggatatggagaagcgcaggtgtaggcagtctttggaagatagcgaatctttgcgcataaaggaggttgagcacatgacgcgacatctggaagaaagcgagaaagccatgcaggagcgtgtgcagaggctggaggccgctcggctgtcccttgaagaggagttaagtcgggtaaaagcagccgctctctcagaaaggggacaggccgaggaggagctgataaaagccaaatctcaggcacggctggaggaacagcaacggttggctcatttggaggacaagctgcggctcttagcccaagccagggacgaggcccagggcgcttgcctgcagcagaaacaggtagttgccgaagctcaaactagagtgtctcaactgggacttcaggtggagggactgagaagacgcctggaggaactgcagcaggaactaagcctcaaagatcaagaacgtgtagcggaggtgtctagggttcgggtggagttacaagaacagaatgggagactgcaagccgagctggcagcacaggaagctctgcgggagaaagccgctgcacttgagcggcaacttaaagtgatggcgagtgatcatagagaagccctcctggacagggaaagtgagaatgcctccttgcgtgagaagttacgactgagggaagctgagatcgccaggattcgggatgaggaagcccagagggcatcgtttctgcagaatgctgtgttggcctacgtgcaagccagccctgtgagaacgctctcccctccaaagtag

SEQ ID NO: 14304 - DNA, 1782 bp, Artificial Sequence
  Description of Artificial Sequence: Synthetic coding sequence
atggaacctgcgactgccccacgtccagacatggcacctgagctcacccctgaggaagagcaggctactaagcagttcttggaggaaattaacaagtggaccgtacaatataacgtgtcaccactctcttggaacgtcgccgtcaagtttctgatggcccgtaaattcgacgtgctgcgggcgattgagctcttccattcctacagggaaacccgacggaaagaggggatcgtcaaacttaaacctcatgaagaacccctcaggagcgagatcctgtctggaaaattcaccattttgaacgtgagagacccaactggagctagcatagctctgtttacagccaggctacaccatcctcataagagcgtgcaacacgtggtgctgcaggcgctgttctacctgctggatagggccgttgactctttcgagacccagcgcaatggccttgtgttcatttacgatatgtgcgggtcaaactatgccaattttgaactggacttgggaaaaaaagtcctcaatcttctcaaaggcgcttttccggcccgtctcaagaaagttctaatagtcggcgctcccatttggtttagggtgccgtactcgatcattagcctgctcctcaaagataaggtccgtgaacgtatacagatcctgaagacctccgaggtcacccagcacctgccccgagaatgcctccctgaaaacctgggaggatacgtgaaaatcgaccttgccacatggaatttccaatttctccctcaagtcaatgggcatcctgatccgtttgacgagatcatactcttttccttaccgcctgccctggactgggattcagttcatgtgcccggtcctcacgcgatgaccatccaggaactggtcgattacgtgaatgctcgccagaagcagggtatctatgaggagtacgaggatattaggagggagaatcccgtcggtacttttcactgctcgatgtcccccggcaatctcgagaaaaatcggtacggggacgtgccatgcttggaccagactcgggtgaaacttaccaaacgcagcggccacacccaaactgattatataaacgcttctttcatggatgggtataagcagaagaatgcgtatattggtactcaaggccctctcgagaacacatatagagacttctggctgatggtgtgggagcagaaggttctggttatagtcatgactactcgctttgaggaggggggcagacggaagtgcggccagtattggcctctcgaaaaggatagccgcattagatttggatttctgactgtcacgaacctgggcgtcgagaatatgaatcattacaaaaaaaccaccctagagatacacaataccgaagaaagacagaagcgtcaggtgacccacttccagttcctgtcgtggccagattatggcgttccgtcaagcgcggccagtctcatagactttttacgggtggtgaggaaccagcagtctttggccgtatccaacatgggcgctcgctctaaaggacagtgtcccgaaccccctatcgtggtgcattgttcagcgggaattggtcggacagggacattttgctccctggatatttgcctggcccagcttgaggaattggggactctcaatgtgttccagacagtttctagaatgcgaacccagcgggccttctcaattcaaacccccgagcaatattacttttgttacaaggcaattctggagttcgcggagaaggagggcatggtgagctcaggccaaaatctcctggcagtggagtctcaatag

SEQ ID NO: 14305 - DNA, 1884 bp, Artificial Sequence
  Description of Artificial Sequence: Synthetic coding sequence
atggaggggctggccgggtacgtctataaggctgcctctgaaggcaaggtgctgactttggccgcgctgcttctgaatcgctcagaatcagatattcgctatctccttggctacgtctcacagcaagggggtcagcggtcaaccccactgatcatagccgcacggaacggacacgccaaagtcgtgcgactcctgctcgagcactaccgggtccagactcagcagacaggcactgtccgctttgacggttacgtcattgacggggccaccgcactctggtgtgccgcgggcgcggggcatttcgaggtagtcaaactgctggtgtcgcatggggctaacgttaatcacaccacagtcacgaattcaaccccactgcgcgcagcttgctttgacgggagactggatattgtgaaatacttggtggaaaataatgccaatattagtattgctaataaatacgacaacacatgcctgatgatcgccgcctataagggccatactgatgtggtgcggtaccttcttgagcagcgcgccgatcctaacgcgaaagcccattgtggggccaccgccctccatttcgctgccgaggctgggcatattgacatagtcaaagaactgatcaaatggcgcgctgctattgtcgtcaatggtcatggcatgactccccttaaggttgccgctgagagttgcaaggccgatgttgtggaactgctactcagccacgccgattgtgaccgtaggagcagaatagaagctttagagcttctgggggcgtcattcgctaacgatcgagagaactatgatattatcaagacttaccactatttgtatcttgctatgttagagaggttccaggatggggataacatcctcgagaaggaggtattgcctccgattcacgcctacgggaatcgaaccgaatgccgcaacccacaagagctcgaatcaattcgacaggaccgcgacgctctgcacatggagggcctcattgttagagagcggattctgggagctgataatattgacgtgtcccaccctataatctatagaggcgcagtatatgcggacaatatggagttcgaacaatgcataaaactctggctccacgcgctgcacctgcgccagaaaggtaatcggaacacgcacaaggacttgttgcgatttgcccaagttttttctcaaatgatccacctcaatgaaacagtgaaggcacccgacattgaatgtgttctgcggtgcagtgtgctggaaatcgaacagagcatgaatcgggtgaagaatattagtgatgctgacgtgcacaatgccatggacaactacgaatgtaatctctatacctttctgtatctcgtctgcatctccacaaaaacacagtgttccgaggaagatcagtgtaaaatcaacaagcagatctataatctcattcacctggacccccgaacacgggaggggtttactctgctccacctcgccgtaaactccaacacccccgtcgatgactttcacacgaacgatgtgtgctctttccccaacgctctcgtgaccaagctcctgctggactgcggagctgaggtgaatgcggttgataacgagggtaattctgccctccacatcattgtgcaatacaataggcctattagcgactttttgacacttcatagcataatcatctcactggttgaagccggggcgcatacggacatgactaataagcaaaataagacgccactggataaatcgaccactggcgtgtcggagatactgctgaaaacccaaatgaaaatgagtttgaagtgtttggcagcaagggctgtgcgagcaaatgatatcaattaccaggaccagatccctagaaccctcgaagagtttgtgggatttcactag

SEQ ID NO: 14306 - DNA, 378 bp, Artificial Sequence
  Description of Artificial Sequence: Synthetic coding sequence
atgcccagtgaaaagacctttaaacagaggagaactttcgagcaaagagtcgaggatgtccgtcttattagagagcaacacccgaccaaaatccctgtgatcatagagagatataagggggagaagcagttgcccgtactggacaaaactaagttcctggtgcccgaccatgtgaacatgtcagagctgattaaaattatccgccgccgactgcaactgaacgcaaatcaggccttttttctgctggtgaacggacactcaatggtctcagtgagcacaccgatctcagaggtttatgaaagtgagaaggatgaggacgggttcctttatatggtgtgcgccagccaggaaactttcggaatgaaattgtcagtgtag

SEQ ID NO: 14307 - DNA, 3786 bp, Artificial Sequence
  Description of Artificial Sequence: Synthetic coding sequence
atggggacgggagactttatatgcatttctatgacaggcggcgctccctgggggttccgcctgcaaggagggaaggaacagaaacagccactgcaagttgccaaaatcaggaaccagagtaaggcctctggcagtggcctttgtgaaggtgacgaggtcgtcagtatcaacggaaacccctgcgccgacctgacctatccagaggtcattaagctaatggaaagcataacggactcactccaaatgctcataaaacgacctagtagtggaatatctgaggccttgatttcagagaatgaaaataaaaacctggaacatctgacccatgggggatacgttgagagcacgacactacagatacgaccagccacaaagacccagtgtacagaattcttcctggcacctgtgaagacagaggtaccattagcagaaaatcagcgtagcggacctgattgtgctgggagccttaaggaggagaccggcccgagctatcagcgggccccgcagatgccagacagccagcgcggtagggttgccgaggaattgatactgcgcgaaaaggtggaagccgtgcaaccgggtccagtcgttgagctgcaactgagcctgtcacaggaacgacataaaggtgcaagtggccctctggtcgccctccctggcgctgaaaaatcaaagagccctgaccctgaccccaaccttagtcatgacaggatcgtccacataaatagcataccgacaaacgaaaaggcagatcctttcctgcgttcttccaaaatcatccagatctcctctggtcgggagcttcgggtgattcaagaaagtgaggcaggggatgctggtctccctcgggttgaggttatcctggattgttccgatcggcaaaagaccgagggctgcagactccaggccggcaaggagtgcgttgattctcctgtggaaggcgggcagtccgaagcccctccgtcgctggtgagcttcgctgtaagtagtgaaggaactgaacagggtgaagatcctcggagcgagaaggaccacagtaggccgcataagcatagggcccgacacgctaggcttaggagatcggagagtttatccgagaagcaggtgaaggaggctaaaagcaaatgtaagagcatcgcgctattgctgacagatgcacccaatcctaatagcaaaggggtgctcatgttcaaaaagcggagaaggagggcccggaaatacactctggtcagctacggcaccggagaattagaaagggaggccgacgaagaggaagagggcgataaagaagacacctgcgaggtggcattcctgggcgcgtctgaaagtgaagtagatgaagagctcttgtctgacgttgacgataatactcaggtcgtgaactttgattgggacagcggcctggtggacattgagaagaagctgaatagaggagacaagatggagatgctcccagataccacgggaaagggagctctgatgtttgcgaagagacgcgaacgaatggaccagataaccgcgcagaaagaggaggataaggtgggaggaacaccatcaagagagcaggatgctgctcagacagacggcctgagaacaaccacatcctaccaaaggaaggaggaggagtcggttaggacacagtcctccgtgtctaagtcttacatcgaagtgtcacatggccttggacatgtcccccaacaaaacggcttctccggaacctccgaaaccgcgaatatacagagaatggtccccatgaatcggacggctaagccgttcccgggctccgtcaatcagcctgcaaccccattttccccaacccgcaatatgacttctcctatcgccgattttccagccccaccgccctactctgccgttactcctcctccagatgccttcagtcggggtgtgtcttctccaatcgctggccccgcccaaccgcccccctggccccagcccgcaccatggagccagccagccttctatgactccagtgagcggatagcaagtagagacgagagaatctcggtcccggcgaagaggacaggaattctgcaagaggccaaacgacgctcaaccaccaagcccatgttcacctttaaggagcctaaggtctctccgaatcctgagttgttaagtttacttcaaaatagcgaggggaaaaggggcacaggcgctggtggtgattccggacctgaagaagattacctttctttgggcgcagaagcgtgtaacttcatgcaaagttcatccgcgaagcagaagactccgcctccagtggctcctaaacccgcagtcaagtcctcctccagtcagcctgtgacccccgtgtctccagtttggtcgccaggagttgcccccactcaacccccagccttcccaacctctaacccctcaaagggaaccgttgtgtcttccatcaaaatcgcgcaaccaagttatccaccagccaggccagcaagtacgctaaatgttgccggcccttttaaaggccctcaggccgccgtcgccagtcaaaactataccccaaaacccacagtgagcacacctaccgttaatgcagtgcagcccggtgctgtcgggccctctaatgagcttcccgggatgtctggcagaggcgcccaactattcgcaaagcgccagtcacgaatggagaagtacgtcgtggactcggacaccgtgcaggcccatgcagccagagctcagtcaccaaccccctctctcccagcaagttggaagtatagctccaacgtgcgagctccccccccggtggcatacaatcccatacactcaccgtcatatcccctagcagctctcaaatcccagccttctgctgcacagcccagcaaaatgggcaagaagaagggaaaaaaaccattaaatgctctggatgtcatgaaacatcagccttaccaacttaatgcctcccttttcacatttcaaccacccgatgcaaaggacggcctccctcagaagtcctctgttaaagtgaacagcgcactggcgatgaaacaagcgctcccaccgcggccagtgaacgcagcaagccccacaaatgttcaagcctcctccgtctatagcgttccagcgtacacctcccctccctccttctttgcagaggcttcttctcccgtgagtgccagccccgtccccgtaggcatcccgacaagtcctaagcaggagtctgcaagttcaagctacttcgtcgccccacggcccaagttttccgctaaaaaaagtggagtgactatacaggaatcaggacggtctctgtcattacctggtcgcagtgtgccgcctcccattagtacaagcccatgggtgtaccaacccacatatagttactcaagcaaaccgaccgacgggcttgagaaggctaataaaaggccgactccctgggaggcggctgccaaatcccctttgggtctggtggacgatgcattccagcccagaaatatccaggagtcaatagtcgccaacgtggtttccgccgctcgtaggaaagtactgccaggtccccctgaagattggaacgagaggctttcttatatccctcaaacacagaaggcctacatggggtcttgtgggagacaagaatacaacgtaactgcaaataataatatgtccaccacgtcacagtatggcagtcagctcccctacgcgtattaccgacaggccagcagaaacgattccgccattatgagcatggagactcgaagtgactattgcctcccagtggcagactataactacaatccccacccaagaggctggcgaagacagacctag

SEQ ID NO: 14308 - DNA, 1146 bp, Artificial Sequence
  Description of Artificial Sequence: Synthetic coding sequence
atgagttggacagtacctgtggtacgggcgagccaaagggtgtcctctgtgggtgctaacttcctgtgtctcggcatggccttgtgtccacgtcaagcaacacgcattcccctcaacggtacatggctgtttacgcctgtgagcaaaatggctacagtgaaatctgagctgattgagagatttacgtctgaaaagcctgtgcaccacagtaaagtctcaatcatcggaactggctctgtgggcatggcgtgtgctattagtatactattgaagggactgtcggatgaactagccctggttgacctcgatgaggacaagctcaaaggcgagaccatggatctccagcacggctctccattcacaaagatgccaaatatcgtttgcagcaaagactactttgtgactgccaacagcaacctcgtgataatcacggctggagcacgacaggagaagggcgaaacacgcctcaatttagttcagcggaacgtggcgatctttaagctcatgatcagttcgatcgtacagtatagccctcactgcaagctgatcatcgtaagcaaccctgttgatattctgacgtacgtcgcctggaagctttctgccttcccaaagaatcgcatcatcggctcaggctgtaaccttgacacagctcgatttcggttccttattggacagaaactcggaatacattctgagtcttgccatggctggattctaggggaacatggcgactctagcgtgccagtgtggtccggcgtaaacatagcaggggtccctctgaaggatttgaatagcgacatcgggactgataaggatccagagcaatggaagaatgtgcacaaggaggtgaccgcaaccgcctatgaaattatcaaaatgaagggatatacctcatgggccatcgggctctcagtggccgatctaacagagagcattctgaagaacctgcggaggatccatcccgtatcgaccatcatcaaggggctttacggcattgatgaggaagtctttctgtccatcccctgtatcctaggggaaaatggtattaccaatctgatcaagatcaagctcacccctgaagaggaagcacacctgaaaaagtcggccaagacactgtgggaaatccagaataaacttaaactctag

SEQ ID NO: 14309 - DNA, 861 bp, Artificial Sequence
  Description of Artificial Sequence: Synthetic coding sequence
atgatggccacaccaaaccaaacggcctgcaatgccgagagccccgtcgctctggaggaggccaaaacctcaggagccccaggcagtcctcaaacccctcccgagagacatgattctggtggctccctgcctctgacaccgagaatggaatcccactccgaagatgaagacctggctggcgcagtaggcggactgggctggaactcccgctctcccaggactcagagccctggtggttgctctgctgaagctgtgctggcccgcaaaaagcaccgtagacgaccaagcaaacgcaagcggcactggagaccttacctggagctgagttgggccgagaagcaacagcgagacgagcgccagtcacaacgtgcctctcgagtgcgggaagaaatgttcgccaagggacagcccgttgctccctataacacgacacaattcctgatgaacgatcgcgaccctgaggaacctaatcttgacgttcctcacggcattagccacccggggagtagcggcgaaagcgaagcaggcgacagtgacggccgaggcagagcccatggagaattccagagaaaagacttctcagaaacttacgaacgtttccatacggagagcttgcagggccgttcaaagcaagagctggtccgagattatctggagcttgaaaaacgcctgtctcaagccgaggaggaaacacgacgacttcagcagctgcaagcatgcaccggacagcagagctgtcggcaggtggaagagctcgccgcagaggtacagcggctgcgcaccgagaaccaaagactgcgacaagagaatcagatgtggaatcgtgagggctgcagatgcgacgaagagcccgggacatag

SEQ ID NO: 14310 - DNA, 1206 bp, Artificial Sequence
  Description of Artificial Sequence: Synthetic coding sequence
atggcgcatgtgtccagtgagactcaggatgtgtctcctaaggacgaactaacagcttctgaagccagcactcggtcacccctctgtgaacacacattccctggcgacagcgacctgaggagcatgattgaggagcacgcctttcaagtcctctcccaggggagcctcctagagtcaccatcgtacactgtgtgtgtcagcgaacctgacaaggacgatgatttcctttcgctgaactttccccgcaagctgtggaagattgtggaaagcgaccaattcaagtcaataagctgggacgagaatggtacttgtattgtcataaacgaagagctgttcaagaaggagattctcgaaactaaagcgccttatcggattttccagacagacgcaattaagtcttttgtacgccaactgaacttgtacggcttctcaaagattcagcagaattttcagagatcagccttcctggctaccttcttatccgaggagaaggaaagctcagtgttgtccaagttgaaattctactataaccccaactttaagcgtgggtacccccagctgctcgttcgtgtaaagcgtcgtataggtgttaaaaatgcctctcccatatcaactctgttcaacgaggactttaacaagaaacacttccgtgcaggggcaaacatggaaaatcataatagcgcactcgcggcagaagcatccgaagagtcgctcttctctgcttcaaaaaacttaaatatgccactgaccagagaaagctcagtgcgccagatcattgccaacagcagcgtgcctatacgtagcggtttcccaccaccaagtccctctacctcagtggggcccagcgagcagatcgccaccgatcagcatgctatattaaatcagttgactactattcatatgcacagtcacagcacttacatgcaagccaggggtcatattgtcaacttcataaccacaacaaccagccagtaccacatcatttcacctctccaaaacggctactttggcctcaccgtcgaaccgtcggcagtccctacccggtaccccctggtttcggtgaacgaggccccatatagaaatatgctcccagctggtaacccttggctacagatgcctaccatagctgatcgatcagccgctccacactctaggttggctctgcagcctagcccgctcgacaaataccacccaaactacaattag

SEQ ID NO: 14311 - DNA, 1728 bp, Artificial Sequence
  Description of Artificial Sequence: Synthetic coding sequence
atggctatggctccttctccctctctcgtgcaagtgtacacaagcccagctgccgtcgctgtgtgggagtggcaggacggcctgggaacgtggcacccatacagtgcgaccgtttgctctttcattgaacagcagttcgttcagcagaaaggacagagattcggtctcggcagccttgctcactccattccactgggccaggcagatccaagcctagcaccatacatcatcgacctgcctagttggactcagttcagacaggataccggcacgatgagggcagtcagaaggcatctgttccctcagcattcagcacctggccgaggcgtggtgtgggagtggctgtcagatgacggaagttggacagcatatgaagcatcagtttgcgactacctggagcagcaggtggcaagaggaaatcagttggtcgatctggcgccccttggatacaactacactgtaaactatactacccatactcagacaaacaaaacatcatccttttgccgcagtgtaaggcggcaggccgggcccccttatcccgtcaccacaataattgcccctccaggacacacaggcgtcgcctgttcttgccaccaatgtttgtcagggtccagaacaggtcccgtcagcggtagataccggcacagcatgactaacttaccggcctaccctgtgccacagcacccccctcataggacggcgtctgtcttcggcacacaccaagcattcgctccgtacaacaagcctagtctgtccggggcacgttccgcccctcggctcaacaccacgaacgcttggggcgctgctcctccctccttagggtctcagcctctgtacaggtcctctctttcacatctcggcccgcagcatctaccaccggggtcatctaccagcggagctgtaagtgcttctctgccatccggaccatcttcgtcccccggctccgtgccagcaacggttccaatgcagatgcctaaacctagtcgcgtgcaacaggcacttgccggtgccacacctaagcccgagcccgagcccgagcaggttattaaaaattacacagaagaactgaaggtacctccagatgaggactgcataatctgtatggaaaaattgtcgacggcttcgggctattctgacgtcactgactctaaggcgataggcagcctggctgtggggcatctcactaagtgttctcacgcctttcatttgctttgccttctggcgatgtattgtaacgggaacaaagatggctcgctgcagtgcccatcctgtaaaacaatttatggtgagaagacaggaactcagccacagggcaaaatggaagtactcagatttcagatgtcattgccagggcacgaagattgcggcaccatcctcattgtctacagcatccctcatgggatccaagggcccgagcaccccaaccccgggaaaccatttacggcacggggcttcccgcgccagtgctacctgcccgataatgcacagggtagaaaggtgcttgaactcctgaaggtggcttggaaacgcagactgatcttcacagtggggaccagctccaccacgggcgagactgataccgtcgtgtggaatgagatacatcataaaaccgaaatggataggaatattaccgggcacggttaccctgatcccaactacctacagaatgttctggctgagttggctgcgcaaggggtgacagaagattgtttggaacagcagtag

SEQ ID NO: 14312 - DNA, 1095 bp, Artificial Sequence
  Description of Artificial Sequence: Synthetic coding sequence
atggagcacaacggttcagcaagtaacgcagataagatccaccagaataggcttagcagtgtgacagaagatgaagatcaggacgccgccctcacaattgtgactgtcctggataaagtagcctcgatcgtggatagtgtacaggcatcacagaaaaggatcgaggagcgacaccgtgaaatggaaaatgcaatcaagtccgtgcagatcgacctcctgaagttgtcacagtcccactctaacaccggacatattattaataaattattcgaaaaaacacgcaaagtgtcagcccatatcaaggatgtgaaagccagggttgaaaagcaacagatccacgttaagaaggtcgaggtgaagcaggaagaaatcatgaagaagaataaatttcgagtcgtcatctttcaggagaagtttcgctgccccacatcattgtcagtggtgaaggatcgtaatttaacagagaatcaggaagaggacgacgatgatattttcgatccacctgtggatctgtctagcgatgaagagtattatgtggaggagtcgcggtccgccagactgcgcaagagtgggaaggagcacatcgataacattaagaaggccttttcaaaagagaatatgcagaagacaaggcagaacttggataaaaaggtcaatcgtattaggaccaggattgtgaccccagagaggagagaaaggttgaggcaatccggggagcgcctgagacaatcaggggagagactgcgccagtccggcgagcggtttaaaaagagtatatctaacgcggccccttccaaagaggcattcaagatgcggagccttcgaaaaggtaaggatcgtactgtcgcagagggagaagagtgcgctcgggaaatgggtgtggatataatcgcaaggtccgagtctctgggacctatcagcgagctgtacagcgatgagttgtccgagcccgaacatgaagccgcacggcccgtgtacccgcctcatgaaggtagagaaatccccacacctgagcccctgaaggttacatttaagtcccaagtgaaggtcgaagacgatgagtcactgctcctggacctgaagcattctagctag

SEQ ID NO: 14313 - DNA, 1266 bp, Artificial Sequence
  Description of Artificial Sequence: Synthetic coding sequence
atgccaaccctcagcgtgttcatggacgttcccctggctcacaaattggaaggttcgctccttaagacctacaagcaggacgattaccctaacaaaatctttttggcctacagggtctgtatgacaaacgaaggccacccttgggtgagtctggttgtgcagaaaacccgactgcagatctcccaggatccttcactcaattatgaatacctgccgacaatgggccttaagtcttttattcaggcctctctcgccctgttatttggcaagcactctcaagcaatcgtagaaaatagggtgggtggcgtgcacaccgtcggcgactcaggggcatttcaactaggagtccagttcctgcgcgcatggcataaagacgcgagaatcgtctacataatatctagccagaaggagctgcatggtttagtcttccaggacatgggctttacagtgtacgagtatagtgtttgggaccctaaaaagctgtgtatggaccccgatatcctcctgaacgttgtcgaacagatccctcacggatgcgtgttggtgatgggcaatataattgactgtaaactaaccccaagcgggtgggcaaagctcatgagtatgattaagtcgaagcagatatttccctttttcgacattccgtgccaaggtctctacacttctgatttagaagaggacacacgcatcctgcagtacttcgtgtcccagggcttcgaatttttctgttcccaaagccttagtaagaattttggcatttatgatgaaggagtaggcatgcttgtcgtcgtcgccgtaaataatcagcagctcctctgtgttcttagccagctcgagggccttgcccaagcgctgtggcttaacccacccaatacgggcgcaagggtgattacgagtatcttatgtaaccctgccctcctgggagagtggaaacagtctctgaaggaggtggttgagaacattatgttaaccaaagaaaaggtcaaggagaagctccagttactgggcactccagggagctggggccatattacagagcaaagcggaacgcacggctatctagggcttaattcccagcaggtggaatatctggtccgcaaaaaacacatatacattcccaagaatgggcagatcaacttctcttgcattaatgctaacaacatcaactatatcactgaaggtatcaacgaggctgtgctgctgaccgaatcttccgaaatgtgtttacccaaggagaagaagaccctgatcgggattaagttgtag

SEQ ID NO: 14314 - DNA, 576 bp, Artificial Sequence
  Description of Artificial Sequence: Synthetic coding sequence
atgggaaagagctgtaaggtagtggtgtgtgggcaggcatccgtcggcaagacatctatactagaacagttgctttacgggaatcacgtggtgggttcggaaatgattgaaacccaagaagacatttacgtggggtccatagaaactgatcgaggcgttagagaacaggtgaggttttatgacacccgtgggttgcgcgacggcgcagagctgccccgacattgcttctcctgcacggatggctacgtgctggtgtattcaactgatagcagggaatcattccaaagagtcgagctgcttaaaaaggagatcgacaaatcaaaggataaaaaagaggtcacaatcgtggtcctgggtaacaaatgtgaccttcaggaacagcggcgcgtggaccctgatgtcgcccagcactgggctaagagcgagaaggtgaaactctgggaagtgagtgtcgctgataggcggtcattactcgagccattcgtgtacctggcttccaaaatgacccagccacagagcaagagcgcatttcccttatctcggaagaataagggatctggaagtttggatggatag

SEQ ID NO: 14315 - DNA, 3207 bp, Artificial Sequence
  Description of Artificial Sequence: Synthetic coding sequence
atggtctcttctgaccgccccgtctctctcgaggatgaagtgtcgcactccatgaaagagatgatcgggggctgctgtgtctgttcagacgaacgaggatgggccgaaaatcccctggtgtattgcgacggacatggttgtagtgttgcagtgcatcaggcatgctatggcatcgtgcaagtaccgactggaccatggttctgtagaaaatgtgaatctcaggaacgtgcggcgagggtgcggtgtgaactttgtccacacaaggatggggccctgaaaaggaccgacaatgggggctgggctcacgttgtgtgcgcactgtacattccagaggtgcagttcgcaaatgttagtacaatggaacccatcgtcttacagtccgtcccccacgataggtacaataagacctgttatatttgcgatgagcaagggcgcgagagcaaagccgccactggagcctgtatgacctgcaataaacacgggtgccggcaggcattccatgtcacatgtgctcagtttgccgggctcctgtgcgaagaggaagggaacggggctgacaacgtacagtactgcggctactgtaaatatcatttctccaagttaaaaaagtccaaaaggggaagcaaccgtagttacgaccagagcctgtccgatagttcttctcatagccaagacaagcatcacgagaaggaaaaaaagaaatacaaagagaaggacaaacacaaacaaaagcacaaaaagcagccggaaccaagccctgcactggtacccagcctgactgtgactaccgaaaagacatacactagtacaagcaataacagtatctcaggtagcctgaagcgcctggaggacaccaccgcgagattcactaatgcgaactttcaggaggtgagtgcacacacatcttctggaaaggacgtttcggaaacgagaggctccgagggaaaagggaagaagtcctcggcacacagcagtggtcagcggggtaggaaacccggcggcgggcgtaaccctggcaccactgtgtctgccgcttccccttttccccaaggctctttttctgggacacccgggagcgttaaaagctcttctggcagttcagtgcagtctccccaggacttcctgtcctttacggacagtgacttgcggaatgactcctactcgcactctcaacagtcatccgccactaaagacgtccacaaaggagagtccgggagtcaagaaggaggggtcaacagcttctcaacactgataggactgcctagcacaagtgctgtgacgtcccaaccaaagtcatttgaaaactctccaggcgatttggggaatagcagcctgcctactgctggttataaaagagcccagacaagtggaatcgaagaagagacagtcaaggagaaaaagaggaagggtaataaacaatctaagcatggtccagggagacccaaaggcaacaagaaccaggagaatgtgagtcacctctccgtgtcctccgcatcccccacctcctctgttgcatccgctgctgggtcaatcacatcttcaagtctgcagaagtccccgactctgctgcggaacgggtcgctccagtctctgtccgtgggctcctctccagtcgggagtgagatttctatgcagtacaggcacgacggggcttgccctacaaccaccttcagcgagctccttaacgcgattcacaacggtatttataatagtaacgacgtggcagtttcttttccgaatgtcgtttctgggagcggatcgtctacaccagtcagctctagccacctcccacaacagagttctggtcacttacaacaagtgggagcgttatctccgtccgccgtctctagcgccgcacccgccgtcgctaccactcaggccaacactctatcgggctcttccctgtctcaagctccctcccacatgtatgggaaccgctctaattcaagcatggccgccttaatagcgcagtccgagaacaaccagaccgatcaggatctgggggacaattctagaaacctggtgggtcgcggaagcagccctcggggttctttatcgccccggtctccggtttcatcactgcagatccggtacgatcagcccggcaatagctccctggaaaatttgccacccgtggcagcgagcatcgagcagcttttggaaaggcagtggagtgagggacaacaattcttgcttgagcaaggcacgccatcagatattctcggcatgctaaaaagcttgcatcagctgcaagtcgagaaccgccgactagaagagcagatcaaaaacctgactgccaaaaaggagcgccttcagctgctgaatgctcagctctccgtccctttccccacaatcactgccaatccgtccccaagccatcagatccataccttctccgctcagactgcacccacaaccgactccctcaatagctcgaagtccccccatatcggaaacagcttcctgccggacaatagcctcccagtgctgaatcaagatttgacgagcagtggacagagcacttcatcaagtagcgccctgtctacgcccccgcctgcaggccagagccctgctcagcagggctcaggagtctccggggtgcaacaggttaacggagtgactgtgggcgcactggccagcggtatgcaaccagtcaccagcaccatacccgcggtgagtgccgtgggagggatcatcggcgccttgccaggcaatcagcttgcaattaacgggatcgtaggcgccttgaatggcgtgatgcagacgccggtgactatgtctcagaacccaaccccacttacacacacgacagtaccaccaaatgcgacccacccgatgccggccacattgaccaatagcgcctctggactgggcctgcttagtgaccaacagcggcaaattctcatccatcagcagcaattccagcagctcctcaactctcagcagctaaccccggagcagcaccaggcttttctctaccagctgatgcagcaccaccaccaacaacaccaccagccagaactgcagcagcttcagatcccagggccaactcagattcctattaacaacttactggcaggcacccaggcaccccctcttcataccgcaactactaaccccttcctgacaattcacggagataacgcatctcaaaaggtggcccgcttgagcgataaaactgggccggtcgcccaggaaaaatcttag

SEQ ID NO: 14316 - DNA, 1353 bp, Artificial Sequence
  Description of Artificial Sequence: Synthetic coding sequence
atgtcctgtctgatggtggaacgctgtggggaaattctgttcgaaaatcctgatcagaatgctaaatgtgtctgcatgctgggcgacatccggctgaggggacagaccggggttagggccgagcgacgcgggagctatccctttatcgacttcagattgctgaacagtacaacatatagcggggagatcggcacgaagaagaaagtcaagaggttgctaagcttccaacggtactttcatgcgtcacggttgctgcggggtatcatcccacaggctccactccatctgctggacgaagactatttgggccaggccagacacatgctaagcaaggttggcatgtgggacttcgatattttcctgttcgaccggctgaccaacgggaattctttggtcaccttgctctgtcacctgttcaacacccacggactgattcaccactttaagctcgacatggttaccctgcataggttcctggtaatggtccaggaggattaccactctcaaaatccttaccataacgccgttcatgcggcagatgtgacccaagcaatgcactgttatctaaaagagcctaaattggctagtttcttgacccccctcgacattatgctgggattgcttgctgccgctgcccacgatgtggaccatcccggggtgaaccaaccatttctgatcaaaactaaccatcacctcgcaaacctatatcagaatatgtccgtactcgaaaatcatcactggagatccaccatcggcatgcttagagaaagccgccttctggcccacttgcccaaggagatgactcaggatattgagcagcagctgggaagcctgatccttgcaacagatatcaatcgccaaaatgagtttttgactcggctgaaggctcacctgcacaataaagacctgagactagaagacgctcaggatcgtcatttcatgctgcagatcgcacttaagtgcgccgacatttgtaacccgtgccgtatatgggagatgagcaaacaatggagtgaaagagtgtgtgaggaattctatagacagggggaactagagcagaagttcgaactggaaatctctcccctttgtaaccagcagaaagattccataccttcaatccagattggcttcatgtcttacatcgtcgaaccactttttcgggagtgggctcactttaccggcaattctactttgtccgagaatatgcttgggcatttggcacacaacaaggcccaatggaagagtctgcttcccaggcagcaccgatcccgaggaagctccggttccggaccggatcacgaccatgccggccaggggacagagtcagaggaacaggaaggggactcaccctag

SEQ ID NO: 14317 - DNA, 2268 bp, Artificial Sequence
  Description of Artificial Sequence: Synthetic coding sequence
atggcaggctgtatacctgaagaaaagacctatcgccgctttctggagctgttccttggcgaattcaggggcccctgcggcggcggggagcctgaacccgagcccgagccggaaccagagccagagcccgagagcgagccagagcctgagccagagttagtggaggctgaagctgccgaggccagtgtagaggagccaggagaagaggcggccacagtggccgctaccgaagagggggaccaagaacaggatccagaacctgaggaggaggctgccgtggaaggagaagaggaggaggagggcgccgcgactgccgcagctgcacctgggcattccgcggtcccccctcccccccctcagctccctcccctgccccctctgccccggcccctctccgaacggattactcgcgaagaggtggagggcgagtcccttgatctctgcttgcaacagctgtataaatacaattgcccatcattcttggcggcggcattagcccgggcgaccagcgatgaagtcctccagtccgacctgagtgcccactacatacccaaggagaccgacggcaccgaaggcacggttgaaatcgagactgtcaaactggctcgctctgttttctccaagctccacgaaatctgctgctcttgggtgaaagacttcccactgaggcgtcgaccacagctctactacgagacttccatccatgccatcaaaaatatgaggagaaagatggaggacaagcacgtgtgcatcccggactttaatatgctgtttaatctcgaggaccaggaggaacaagcatatttcgctgtctttgatggacatgggggggtcgatgctgcaatctacgcttctatccacctgcacgtgaaccttgttcggcaggagatgtttccacacgatcccgcagaagctttgtgtagagccttcagagtgactgacgagagattcgtgcaaaaagctgctagggagagcctgagatgcggtacaactggcgtggtgactttcattcgtggcaacatgctccacgtcgcgtgggtgggcgacagccaggtcatgttagtgcggaagggtcaggccgttgaactgatgaaacctcacaaaccagatcgcgaagatgaaaagcaacgaatagaggcgcttggcggctgtgttgtttggttcggtgcatggcgagtcaacgggtcgctttcagtgtcacgtgccattggggacgctgagcataagccatacatttgcggggatgccgactctgctagtactgtacttgatgggactgaggattatcttattctcgcctgcgatggtttttatgacactgtcaaccctgatgaagcagtgaaagtggtgagcgaccacctaaaggaaaacaatggcgatagcagtatggtagcccataagctcgtggcatctgctagggacgcgggaagctccgacaatatcacagtcattgtcgtttttctgcgtgatatgaacaaagccgtgaacgttagcgaggagagtgattggacagagaacagtttccagggcggtcaagaggacggtggggacgacaaggaaaatcatggcgagtgtaagcgcccctggccacagcaccagtgttccgccccagctgaccttggatacgacggcagggtagacagtttcaccgatcggacttctttaagccctgggtcccagattaatgtgctggaagacccagggtacctggacctgacacagatcgaggcaagtaagccccactccgcacaattcctcctgccagtggagatgttcggccccggagctcccaaaaaggccaacctgatcaacgaattgatgatggaaaagaagagtgtgcaaagctcccttcccgagtggtccggcgctggggagtttcctactgcctttaatcttggtagcacaggggaacagatctatcggatgcagtctctgagcccagtatgtagcggactggagaacgagcagtttaaatcgccaggaaatagggtgtcacgattgagccacttgcgtcaccattatagcaaaaaatggcatagatttagattcaaccctaaattttattcttttctgagtgcccaagaacctagtcacaagattggtacatcattatcctctctcacaggctccgggaagcggaatcgaattagatcaagcctcccctggaggcagaacagctggaaagggtattccgaaaacatgaggaagctccgaaaaactcatgacatcccatgcccggatttgccatggagttacaaaatcgaatag

SEQ ID NO: 14318 - DNA, 771 bp, Artificial Sequence
  Description of Artificial Sequence: Synthetic coding sequence
atggcttcacgatatgaccgcgccatcactgttttttcacctgatgggcatctgtttcaggttgagtacgcccaagaggccgttaagaagggatctacagccgtcggtatccggggtactaacattgttgttctcggagtggagaagaaatccgttgctaaactccaggatgagaggactgtgcgaaagatatgcgcactcgacgaccacgtctgcatggcctttgcagttttgacgatctttatcggcctgacagccgatgctcgtgtggtgatcaacagagctagagttgaatgtcagtcacacaaattaacagtcgaggaccctgtcaccgtggagtatataacaaggtttattgccacgctaaaacagaaatacacacagtcgaacggacggcgaccttttggcatatctgccctaatcgtgggcttcgatgatgacggtatatcgcgcctttaccagactgatccaagcggtacctatcatgcttggaaggcaaatgcaattggacgctccgcaaagaccgtgagggagttcctcgagaagaactatacagaggacgccatcgcgtcagatagcgaagcaatcaagctcgctattaaagcccttcttgaggtcgttcaatcaggcggaaaaaacattgaattagcgatcattcggcgtaatcagcccttgaagatgttcagcgccaaggaggtcgagttgtacgtgacagaaatcgagaaggaaaaagaggaggccgagaagaagaaaagcaaaaagtccgtgtag

SEQ ID NO: 14319 - DNA, 3108 bp, Artificial Sequence
  Description of Artificial Sequence: Synthetic coding sequence
atggcacctcgtctccagctggagaaggcagcatggaggtgggctgaaactgtaaggcctgaggaggtctcccaagagcacatcgagacagcatacaggatttggctggaaccatgcattcgcggggtgtgtcgcagaaactgcaagggtaatcctaattgtctcgtggggattggcgaacacatctggctgggggagattgatgagaacagtttccataacatcgatgaccccaattgcgagcggagaaagaagaactccttcgtgggactgaccaacttgggcgcgacatgttacgtaaatacatttctgcaagtctggttcctcaacctagagctgcggcaggcactgtacctctgtcccagtacctgcagtgattatatgctgggggatgggatacaggaggagaaagattacgaacctcagacgatatgtgagcatcttcagtatctgttcgcgttattgcagaacagcaacaggcgctatatcgatcctagcggcttcgtcaaagccctgggccttgacactggccaacagcaagacgctcaagaattcagtaaattgtttatgtccctgctagaggataccctgtccaagcagaaaaaccccgatgtgagaaacattgtccaacaacagttctgcggcgagtatgcctacgtaaccgtgtgtaatcaatgtggccgggaaagcaaattgctgtctaaattttatgaactcgaactgaacattcagggccataagcagctcacagattgtatttccgagttcctcaaggaggaaaagctagaaggcgataatagatacttctgcgagaactgtcagtcaaagcagaatgcaaccaggaagatcagactgctgagtctaccatgcaccctcaatttgcagctgatgcgctttgtgtttgacaggcagaccgggcacaaaaaaaagctgaacacttacatcggatttagtgagatcttagatatggagccttacgtggagcacaaaggcggttcttatgtgtacgagctatccgcagttttgattcaccgcggcgtgtcagcctacagcggtcactacattgcacatgttaaagatccacagtctggagagtggtataagttcaatgacgaagatattgaaaagatggaaggcaaaaagcttcagctcggaatagaagaagacctggctgagccaagcaaatcgcagacacgcaaacccaagtgcggtaaggggacacattgctccagaaacgcctacatgctcgtataccgcctgcagacccaggagaagccaaatacgacagtgcaggtacctgcatttctgcaggaattggttgaccgcgacaatagcaaatttgaagagtggtgcatcgaaatggccgagatgcggaagcaatccgtggataaagggaaggcaaaacacgaggaggttaaggagctgtaccaacgcctccccgctggcgcagaaccttatgagtttgtatctctggagtggctgcagaaatggctggacgaatcaacccccaccaagcctatcgataatcacgcctgtctgtgcagtcacgacaaacttcatcccgacaagatttctatcatgaaacgaataagcgagtacgccgccgacatcttctatagtaggtacgggggcggtcccaggctcacagtcaaggcgttgtgtaaagagtgcgtggtggaacggtgtcggatcctacggttgaaaaatcaattgaacgaggattataaaaccgtcaacaacctgcttaaagccgccgttaaaggctcagatggcttttgggttggtaagtcttcattacgatcctggcgccagctggcactagagcagttggacgaacaagatggagatgccgagcagtccaatggcaagatgaatggcagcactttgaacaaagatgagtccaaggaggaacgcaaggaggaagaggaacttaactttaacgaagatatcctgtgtccacatggggagctttgtatcagtgaaaatgagaggcgcctggtgtctaaggaggcatggtccaagttgcagcagtacttccctaaagcccccgaatttccttcttataaggaatgttgcagtcagtgtaaaattctggagcgggaaggcgaagaaaacgaagcccttcacaaaatgatagccaacgagcagaaaacatctctacctaacttgtttcaagacaaaaatagaccgtgcctttctaactggccagaggatactgacgtgttatatattgtgagtcagttcttcgtcgaggaatggcgaaaattcgtgcgtaaaccaacacggtgttcccccgtcagttcagtgggtaattccgcactcctgtgtccccatggtggattgatgttcacttttgcgtctatgacaaaggaggattcgaagctgattgctctgatatggccaagtgaatggcagatgattcagaaattattcgtggtcgaccatgtaatcaagattacccggatcgaggtgggcgacgtcaatccatccgaaacccaatatatctccgagcctaagctatgtcccgagtgccgggagggactgctatgtcagcagcagagggacctgagggagtatacgcaggccacgatatatgttcataaggtggttgacaacaaaaaggtgatgaaagactcagctccagagttaaacgttagcagctccgagaccgaggaagacaaggaagaggctaagcccgacggcgagaaagatcccgatttcaatcagagcaatggaggaactaaaagacagaagatctcccatcagaattatatagcctaccaaaagcaggtaattagacgctccatgcgccatcggaaagttagaggagagaaggcgcttttggtgtcagctaaccagacattgaaggaactgaaaatccaaattatgcacgccttttccgtggctcctttcgatcagaacctgagtatcgacgggaaaatcctcagtgacgattgtgcaactttggggaccctgggagtcatccctgagtctgtgatcctgttaaaggctgatgaaccaatagccgattatgcagccatggacgatgtgatgcaggtctgcatgcctgaagaaggcttcaaagggacgggcctcctaggccactag

SEQ ID NO: 14320 - DNA, 2382 bp, Artificial Sequence
  Description of Artificial Sequence: Synthetic coding sequence
atgcttatccaatcagagaagaagacacagctttcgaagaccgaaagcgtgaaggaatctgaaagcctgatggaatttgcccagcctgagatccagcctcaggaatttctgaatagacgctatatgaccgaagttgactacagtaacaaacagggcgaagagcagccctgggaggcggactacgcacggaaacctaatctacctaaacggtgggacatgctcactgagccggacgggcaggaaaagaagcaggagagttttaagagctgggaagcctctggtaaacatcaggaagtttctaagccagccgtctccttggagcaaaggaagcaggacacttcaaagctgaggtcaactctgcccgaggaacagaaaaagcaggagatttctaagagtaaaccgtcacctagccagtggaagcaagacacaccaaagagcaaggcaggctacgtacaggaggagcagaagaaacaggagacccccaagctctggccagtacaactgcaaaaggaacaggatcctaagaaacagacccccaagtcctggacaccatccatgcagagtgagcagaatacgacaaagagctggacaaccccaatgtgtgaggagcaggacagtaagcagcccgaaacccccaaatcctgggagaataatgtagaatctcagaagcacagcttgacctcacaatcgcagatttctcccaagagttggggggtggccacagcctcactcatcccgaacgatcagctgctgcctagaaagctgaacaccgagccgaaggacgtgcctaaaccggttcaccaacccgtagggagttccagcacactccccaaagaccccgtacttcgcaaggagaaattgcaggatctgatgacacagatccagggaacatgcaattttatgcaggaaagcgtacttgacttcgataagcctagcagcgcaatccccaccagtcagcccccctccgcaactcccggatcccctgtcgcaagcaaagagcaaaatctgagtagccaaagcgactttctgcaggagcccctccaggctacttcatcccccgtgacttgttctagcaatgcttgccttgtaaccaccgaccaagcctccagtggctccgagacagagtttatgacctctgagacccccgaggccgcaattccccctggaaagcagccttctagtttagcaagccctaatccacccatggctaaaggatcagaacaaggcttccagagccctccagctagcagttctagcgttaccattaacaccgcgccgttccaggccatgcagactgtcttcaacgtgaatgcaccactgcctccaagaaaagagcaggaaattaaggaaagcccgtatagtcccgggtacaaccaatcatttaccacggctagtactcaaaccccaccacagtgtcagttgccctcgatacacgtagaacagactgtacattctcaggaaaccgccaactatcacccggacggtaccatccaggtgagcaatggttccttagccttctaccctgcccagacgaatgttttccctagaccgacacagcctttcgtgaatagtaggggttccgttcgagggtgcactcgtggaggccgcttaattactaactcttaccggagcccaggaggctacaaagggttcgacacttacaggggattacccagcatcagcaatggcaactactctcagctgcaattccaggccagggagtacagtggcgcaccgtactcccagagagataatttccagcagtgctataagcgcgggggcacctcgggaggcccgagggccaacagcagagctggctggtcggactcgtctcaggtttcgagccccgaacgggataacgagacatttaacagcggggatagcggacagggcgacagcaggtctatgaccccagtcgatgtacctgtcactaaccccgctgctacaattctgcccgtccatgtatacccactgccacagcagatgcgggtggcctttagtgctgccagaacatccaacctcgcccccggtaccctcgatcagcccattgtgttcgacctgctgttaaacaaccttggggagaccttcgatctgcagctgggtagattcaactgccccgtgaacgggacatacgtttttatttttcatatgttaaagttagctgtgaacgtacctttgtacgtaaatctgatgaaaaatgaggaagtccttgttagcgcatatgctaacgacggagcacctgatcatgagacagcctccaaccacgccatcctccagctcttccagggcgaccagatttggcttcgcctgcaccgtggagccatttacggatctagttggaaatacagtactttcagcggttatttactgtatcaggattag

SEQ ID NO: 14321 - DNA, 1083 bp, Artificial Sequence
  Description of Artificial Sequence: Synthetic coding sequence
atggaagaactttcccaagccctggcttctagcttctctgtgtcacaggatctgaactcaacggctgccccgcacccaagactgagccagtacaaaagcaaatattctagcctagaacagagtgagaggcggagaagattactggaactgcaaaagtcaaagcggctagactacgtaaaccacgcccgcaggctggccgaagacgattggactggcatggagtcagaggaagaaaataagaaagacgatgaggagatggacatcgacacagtaaagaaactgccaaaacactatgctaaccaattgatgctctcagagtggttgattgatgtcccatctgatctgggccaggagtggatcgttgttgtgtgtccagtgggcaagcgcgcactaatcgttgcttctcggggaagcacgagcgcgtacactaaaagtggctattgcgtgaacaggttttcttcgctcctgcccggcggcaaccgcagaaactctactgcgaaggattacactatcctggattgcatttacaatgaggtcaatcagacctattacgtgctcgacgtgatgtgctggcggggacaccccttctacgattgtcagactgacttccgcttttattggatgcactcaaagctgccagaggaggaaggattaggagaaaaaaccaagctcaatccctttaaattcgtggggctgaagaacttcccctgtacaccagagagtctgtgtgacgtactgtcaatggactttcctttcgaagtagatgggctcctcttctaccacaaacagacacattactctcccgggtcaacccccttagtggggtggctcagaccctatatggtgagcgacgtgcttggcgttgcagtgcccgccggtccccttactacaaagccagactatgccggccaccagcttcagcagataatggagcataagaagtcacagaaagaagggatgaaggaaaaattgactcacaaagcgtctgaaaacggtcattacgaactcgagcacctgtctacccctaaactgaaaggaagtagtcacagtcctgaccacccgggctgcctgatggaaaactag

SEQ ID NO: 14322 - DNA, 525 bp, Artificial Sequence
  Description of Artificial Sequence: Synthetic coding sequence
ctcatccataaaccgctgaagcgggctataaccacactcatggccggaattctgaggttagtagtccaatggccgcccgggagactgcagacagtaacaaaaggtgtggagtcccttatctgtactgattggatccggcacaaatttactcgaagccgtatccctgaaaaagtgttccaggcttcccccgaggaccacgagaaatacggcggagatcctcaaaacccccataagttacatatcgtcacgcgcataaaatcgaccaggcgtcggccatattgggaaaaagacatcatcaagatgctcggcctggagaaagcgcatactccccaggtgcataagaacatcccgagcgtgaacgccaagttaaaagtggtaaagcatctcattaggataaagcccctgaaattaccccaggggcttcccgctgaggagaacatgtctaacacatgcctgaagagtaccggggaactggtggtgcaatggcatctgaaacccgtcgaacagaaggcacacgaatcgtag

SEQ ID NO: 14323 - DNA, 1434 bp, Artificial Sequence
  Description of Artificial Sequence: Synthetic coding sequence
atggccacatatacctgcataacatgtagagtagctttccgggacgccgacatgcagcgggcacactacaaaacggattggcatcggtacaacctccgcagaaaggtggcctccatggccccagttactgcggaagggttccaggagcgagtgagagcacagcgcgctgtagcagaggaggaatctaaggggtccgctacatattgtaccgtctgtagcaagaagtttgccagctttaacgcgtatgaaaaccatttgaaaagcaggaggcacgtagaattagagaagaaggctgtccaggccgttaataggaaagtggagatgatgaatgaaaaaaacctcgagaaaggcctgggagtcgacagcgttgataaggatgccatgaatgctgctatacaacaggccattaaggcacagcctagcatgtctcccaagaaggccccccccgctcctgctaaagaggcacgtaacgtcgtcgcagtgggaacaggtggccgcgggacccacgatcgggatccatccgagaaaccacccaggctgcagtggtttgagcagcaggccaagaagctggctaaacagcaggaggaggattccgaggaggaagaggaggacctggacggtgatgactgggaggacatcgacagtgacgaagagctcgaatgcgaggacacggaagccatggacgacgtggtggaacaggacgccgaagaggaggaagccgaagagggccccccactgggagccatcccgatcactgattgtctgttctgtagccaccatagctcctccttgatgaaaaatgttgcccatatgaccaaggatcactcttttttcattccggacatcgagtatctgtccgacatcaagggtttgatcaaatacctcggggagaaggtcggagtgggaaagatatgcctttggtgcaatgaaaaagggaaatccttttacagtactgaggcagtccaagctcatatgaacgataaatcccactgtaagctgtttaccgacggcgacgccgctctggaattcgccgacttttatgattttcgaagctcttaccctgatcataaagaaggcgaggatccaaacaaagccgaggaactgccaagcgagaagaatctggagtacgatgacgaaacaatggagttgattctcccatctggggctagagtggggcaccggtctttgatgcggtattacaagcagcggtttggcctgtctcgggccgttgctgttgccaaaaaccgaaaggcagttgggcgtgtgctgcagcagtaccgcgccttgggatggaccggaagtacaggcgccgctttgatgcgtgagcgggacatgcagtacgtgcagcgaatgaaatcgaagtggatgcttaagacgggaatgaagaataatgccactaagcagatgcatttccgagtgcaagttagattctag

SEQ ID NO: 14324 - DNA, 2862 bp, Artificial Sequence
  Description of Artificial Sequence: Synthetic coding sequence
atgatcacctccgccgccggcattatttctttgctggacgaggatgaacctcagctgaaggagttcgcactgcacaaattgaatgccgtggtgaatgacttttgggccgagatctcagaaagcgtggacaagatcgaagtgctttatgaggatgaaggatttcgatcaaggcagttcgcggctctggtagcatctaaggtgttctatcacctgggggctttcgaggagagcctgaactacgcgttgggagcaggcgacttgttcaacgtgaatgataattcagagtatgtggagacaatcatcgctaagtgcatcgaccattacaccaagcaatgtgtagaaaatgccgatctgcctgagggcgagaaaaagccaatcgatcagaggctggaaggtatagttaataaaatgttccagcggtgcctggatgatcacaaatataaacaagccatcggtatcgcactggaaacaagaagattggacgtcttcgagaagaccattctggagtcaaacgatgttcctgggatgctggcctactctctcaagttatgcatgtctctgatgcaaaataaacaatttagaaataaagttctccgtgtgctcgtcaaaatctatatgaacctcgaaaagcccgacttcattaatgtttgccagtgtcttattttccttgatgatcctcaggccgtgtcagacattcttgaaaagttagtgaaggaagataatctgctcatggcgtatcagatttgctttgatctgtacgagtccgccagtcagcagttccttagtagcgtcatacaaaacctaaggacagtgggcacgcccatcgcttctgtgccaggttcaacgaacacggggactgtgccaggctccgagaaggactctgatagcatggagacagaggagaagacctcctcagctttcgtgggcaaaacccctgaagcatccccggagcctaaagatcagactctgaagatgataaaaatcctgagcggtgaaatggccattgagttgcacctacagtttttgattcgcaataataacacggatctgatgatattaaagaacacaaaagatgctgtgcgcaacagtgtttgtcacaccgctactgtaattgctaatagtttcatgcactgtggaaccacgagcgaccagtttctacgcgataacctggagtggctagcccgcgccaccaactgggctaagtttacggccaccgcctccctgggcgttattcataaaggccacgaaaaggaagcgctccagctgatggcgacttacctccctaaggataccagccccgggtctgcatatcaggagggaggcggcctgtacgccctaggcttgatccacgcgaatcatggcggggatattattgattatcttctgaaccagctcaagaacgcaagtaacgacattgttcggcacggaggcagtctgggactgggactggccgccatgggcaccgcacgacaagatgtgtatgatctgctgaagactaatctctatcaggatgatgccgtcacaggtgaagccgccggtctggcactgggacttgtgatgctaggatcaaagaacgcacaggccatcgaagacatggtggggtatgctcaggagacacagcacgagaaaatattgcggggattagccgtggggatagcgttggtgatgtacggaagaatggaggaagccgacgctcttatagagtcactgtgcagggacaaagatccaatcttgaggcgctctggaatgtatacagtggccatggcatactgtggtagcggcaacaataaggctattcgacggctcctccacgtagccgtcagtgacgtaaacgacgatgtaaggcgggctgccgtggagtcactcggctttattctgttcaggactccagagcagtgcccaagcgtggtgagcctgctgtccgaaagttacaacccccacgtccgctatggggccgccatggcactcggcatctgttgtgcgggcaccggcaacaaggaggctataaatctgcttgaacccatgacaaacgatccagtaaattacgttcgccaaggtgcacttatagcctccgcactcataatgattcagcaaacagaaatcacatgcccaaaggtgaaccaattcaggcagctgtattctaaggtgattaatgataaacatgatgacgtgatggctaaatttggggccatccttgcacaagggattctagacgcgggaggccataatgttactatcagtctgcaatcacgcacggggcacacccacatgccctccgtggtgggcgttctcgtctttacccaattctggttttggtttcccctgtcccacttcctctcgctggcatacacaccaacatgtgtgatcggcctgaataaagatctcaagatgccgaaagttcagtataaatctaactgcaaaccttccaccttcgcatatccggctccgctcgaggtccctaaagagaaggagaaggaaaaggtttcgacagctgtactcagcatcactgccaaagccaaaaaaaaggagaaagagaaggagaagaaagaagaggagaaaatggaagtggatgaagccgaaaagaaagaagagaaggagaaaaagaaggagcccgagccgaactttcagctgctcgacaaccccgcccgagtcatgccagcacaactgaaggtgctgacgatgcccgagacatgccgttaccagccattcaagcccctgagcataggtgggatcatcatcctgaaagatacatctgaggacatcgaagagcttgtggagcccgtggcggcccatggaccaaaaatcgaggaggaggaacaggaacccgagcctccagagccattcgagtacatagacgattag

SEQ ID NO: 14325 - DNA, 984 bp, Artificial Sequence
  Description of Artificial Sequence: Synthetic coding sequence
atgtgcagcacttcaggctgcgatctggaggagatcccactggatgacgacgatctaaacaccatcgagttcaaaatattagcctactacaccagacaccatgtgttcaagtcaacgcctgccctgttttcccccaagctgttgaggactcgatcactcagtcagagaggactcggcaactgctctgcaaacgagagttggacggaagtaagttggccttgtcggaattcacaaagctctgagaaggcaatcaatctcggcaaaaagaagtcctcgtggaaggcattttttggagtggtcgaaaaggaggactcacagagtacgccggcgaaggtcagtgcacagggccaacggacactcgaataccaggacagtcactctcagcagtggtcgcgttgcttgtccaatgttgaacaatgcctggagcacgaggcggtggatccaaaggttatcagcattgcgaaccgcgtcgcggagatcgtgtactcctggcccccgcctcaggccacacaggccggaggctttaaaagcaaggagatttttgttacagaagggttaagttttcagctgcagggacacgtcccagtcgcctcctcctcaaagaaagatgaggaggagcagatattagcaaagatcgttgagctcctgaagtacagcggagaccaactggagcgcaaactgaagaaagacaaggctctcatgggccatttccaggatgggctctcatattctgtgttcaaaacaatcacggaccaggtgctcatgggcgtggatccccgaggagagagcgaggtgaaagcacagggctttaaggcagccctagttatcgacgtaacagccaaactgaccgccatcgacaatcaccccatgaatcgcgtgctcggcttcggaaccaaatacctgaaagagaacttcagcccttggatccaacagcacggcggttgggagaaaattctgggtatttcacatgaggaggtcgattag

SEQ ID NO: 14326 - DNA, 1086 bp, Artificial Sequence
  Description of Artificial Sequence: Synthetic coding sequence
atgggtggggccgtctccgctggagaagataacgacgagttgatcgataacctcaaggaagcccagtatatcagaactgagttagtcgaacaggcattccgggccatcgatagggcagattactacctggaagagttcaaagaaaacgcatacaaggacctggcgtggaagcacggcaacatccacctgtccgccccttgtatatacagcgaggtgatggaggccttagacctgcaacctggactgagtttccttaaccttggctccggaacaggctatctttccagcatggtcggcctgattttagggccttttggtgtgaatcatggcgttgaactacattcggacgtgatcgagtatgcgaaacagaaactggatttttttattagaacttctgactctttcgacaagtttgatttttgtgagccttcttttgtcacaggcaactgcctggagatctcacctgactgttctcaatacgatagggtctattgtggcgcgggcgtgcagaaggaacatgaggaatacatgaagaacctgctcaaggtgggagggattctagtcatgccactggaggagaaactcaccaaaatcactcggaccggcccgtccgcttgggaaacaaagaagatcctcgccgtgtccttcgcgcctcttatacagccttgccacagcgagtctgggaagtcgcggctggtgcagcttccccccgtggccgtgaggtctctgcaggatttggctcgaatcgccatccgcggcacgatcaagaagatcatccaccaggagacagtctctaagaatggcaatggcctgaagaacacacctcgctttaaaagacgaagagtccggcgcaggcgcatggaaacaatcgtctttcttgataaggaagtatttgcaagccgcatctcgaatcccagtgacgacaactcttgcgaggacctagaggaggagaggcgcgaggaagaagaaaagacacccccagagaccaagcccgatccccctgtgaatttccttagacagaaggtcctgagcctgcctctgccggaccccttaaaatattacctgctctactaccgcgagaaatag

SEQ ID NO: 14327 - DNA, 780 bp, Artificial Sequence
  Description of Artificial Sequence: Synthetic coding sequence
atgaaagatgttgataacctgaagtctatcaaggaagaatgggtttgcgaaacgggctcagataaccagcctttgggaaataatcagcagagcaattgtgaatatttcgttgactcattgttcgaagaagcacagaaggtgtcatctaaatgcgtctccccagcggaacagaagaagcaggtcgacgtgaatattaaattgtggaaaaatggtttcactgttaatgacgacttccggagctactcagacggcgcttctcagcagttcctcaatagcattaagaaaggcgagttaccatccgaactgcagggcatctttgacaaagaagaggtggacgtaaaggtggaggataagaagaacgaaatatgcctgagtacaaagccggtattccaacccttctcagggcaaggccacaggttggggtccgcaacccctaagattgtgtccaaggcaaagaatatagaggtggagaataaaaataacctctctgctgtgccattgaacaacctcgaacctatcactaatatccagatttggctggccaatggaaagcggatagtgcagaagtttaatataacccatagagtttcgcatattaaggactttatcgagaaataccagggcagtcagaggagccccccattcagcctggcaactgctctacccgtactccgcctcctggatgagactctgactctagaagaggcagacctgcagaacgccgtcattattcagcggcttcaaaagacagcctcatttcgagaactaagcgaacattag

SEQ ID NO: 14328 - DNA, 990 bp, Artificial Sequence
  Description of Artificial Sequence: Synthetic coding sequence
atggtgagaactaagacctggaccttaaaaaaacattttgttggctatcctaccaactctgacttcgagctgaaaaccgctgaacttccgcccttgaaaaacggagaggtgctgcttgaggctcttttcctcaccgtagatccatatatgagagtggccgccaagagactgaaggagggagacactatgatgggacaacaagttgccaaagtggtagagagcaagaatgtggctctccctaaaggaacgattgtgctcgccagcccaggatggactacacattccatctccgacggcaaggatcttgaaaagttattaaccgagtggcccgacacgatcccgctgagcctggctctcggcacggttgggatgccaggactgactgcctactttggtctgctggagatctgtggcgtgaagggcggtgagacggtcatggtcaacgccgccgctggggccgtaggttcagtggtgggacagatcgctaaactgaagggctgcaaagtcgtgggcgccgtgggaagcgacgagaaggttgcctatctccaaaaactgggatttgatgtcgtgtttaattataagaccgtggagtccctcgaggaaaccctcaagaaggctagtccggacggatacgattgctatttcgacaacgtaggtggggaatttagtaataccgtcattggtcagatgaaaaagtttggaagaattgccatctgtggcgccatctcgacgtataacagaactggccccctgccgccaggcccacccccagaaattgttatctatcaggagctgcgcatggaagcttttgtagtctatcggtggcagggcgatgccaggcagaaggccctgaaagatctgctaaagtgggtgctggaagggaagatccagtataaagaatatattattgagggctttgagaatatgcccgcggcctttatggggatgttgaagggagacaatttaggcaaaacaatagttaaagcttag

SEQ ID NO: 14329 - DNA, 3006 bp, Artificial Sequence
  Description of Artificial Sequence: Synthetic coding sequence
atgcagagcacagacttgggcaataaggaatcgggcaagatttggcacagaaagccttcccctgccactcgcgacgggataatcgtaaatattatccataacacgtcggactatcatccaaaggtgctgcgattcttgaacgtggcttttgatggaactggggattgcctgatcgccggagatcaccagggaaatatctacgtgtttgatctccatggcaaccgctttaacctcgtgcagaggaccgctcaggcctgtacagctttggcatttaatctgcgcaggaaaagtgaatttttggtggctctcgctgactacagcatcaaatgcttcgatacggtcacaaaggagctggtgagctggatgaggggtcatgaaagctctgtgttttcaatttcagtgcacgcctcgggaaaatatgccatcacaacaagcagtgatacggcccaactctgggatctggacacttttcagcgaaagcggaaactaaatatccggcagagcgtgggaatccagaaagtctttttcctgcctctttcaaatacaatcctaagctgctttaaagacaactcgatttttgcctgggaatgcgataccctgttttgcaaataccagttgcctgctcccccggagagcagcagcattctatataaagtattcgccgtgacccgcgacggccggatcttagcggccggaggcaaatctaatcacttacacctgtggtgcttggaggctcgccaattgtttcgaatcattcagatgcccaccaaggtccgcgccataagacacctcgaattcttacctgattcctttgacgctggttctaaccaggtgctgggtgtactctcccaggacggcatcatgcgttttattaacatgcaaacttgtaagctcctttttgagatcgggtccctggatgaaggcatctctagtagcgccatcagcccccacggccgttacatcgcctctatcatggagaacggcagcctgaacatttactcggtgcaggccctgacacaggagataaataagcctcctcccccccttgtcaaggtgatcgaagacctgcctaagaataagctgtcttcctccgatctgaaaatgaaagtgacaagcgggcgcgttcagcagccagctaagtcccgggagtccaaaatgcagacccgcatcttgaagcaggatcttactggagacttcgaatctaaaaagaatgaactgcctgacggcctgaacaaaaaacggctccagatcctgttgaaaggctacggggaataccccacgaagtatcggatgtttatctggaggagcctgctgcagcttcctgaaaatcacaccgccttcagtacactcatcgataaagggacccacgtcgcatttctcaaccttcagaagaagtaccccatcaaatctcgcaaactgctaagagtgctgcagagaacgttgtccgcgttggcacactggtccgtcatattcagtgatacaccctacctgcctctcctggccttcccatttgtgaagctgtttcaaaataaccagctgatctgctttgaagttatcgctacattaataatcaactggtgtcaacattggtttgagtacttccctaacccgccgatcaacatattatctatgatcgaaaacgtactggctttccacgataaagagctccttcagcactttattgaccatgacatcacaagtcaactctacgcatggcctttactggaaacagtgttctctgaagtgctcacccgcgaagagtggcttaaactatttgacaatatcttctccaatcacccctcattcctcctgatgacagtagtggcttataatatttgtagccggaccccattgctaagttgtaacttaaaagacgattttgaatttttctttcatcaccgcaacaaccttgatattaacgtggtaatcagacaggtgtatcacctgatggaaaccacccctaccgatatccaccccgatagtatgttaaacgtgttcgtagctctgacaaaaggacagtacccggtcttcaatcaatacccaaagtttattgtggactatcagactcaggaacgggagcggatccggaacgatgagctggactatttacgagaaaggcagaccgtggaagatatgcaggccaaagtggaccaacagagagtggaagatgaagcatggtatcagaaacaggagcttttgaggaaagccgaggaaacccggcgggagatgctgcttcaagaggaggagaagatgatccaacaacgccaaaggttggctgccgtcaaacgagagcttaaagtgaaggaaatgcatttgcaagacgctgctcggagaaggttcctcaaactgcaacaggatcaacaggaaatggagctgagaagactcgatgatgaaatcggccgcaaggtctatatgagggacagggaaatagcagcgactgcgcgcgacctggagatgcgccagctcgagctggagagccaaaaacgcctgtacgagaagaatttaaccgaaaatcaggaggccctcgcaaaagagatgcgagccgacgccgatgcttacagacgcaaggtagatctggaagagcacatgtttcacaagctgattgaggccggagagacacaatcacagaaaactcagaagtggaaagaggccgagggtaaagagtttaggctgcgttcagcaaagaaagccagtgccctgagcgacgcatcccggaaatggttcctgaagcaggagattaatgcagctgtggaacacgctgagaatccttgtcacaaagaggaacctcgcttccagaacgaacaggactcaagctgtctgcccaggacatcccagcttaacgacagcagtgagatggaccccagcacccagataagtcttaaccggagagccgttgagtgggatactaccggtcagaatcttatcaagaaagtgcgaaatcttagacagcgtctgaccgcacgagcacgccataggtgccagacacctcacttgttggccgcatag

SEQ ID NO: 14330 - DNA, 651 bp, Artificial Sequence
  Description of Artificial Sequence: Synthetic coding sequence
atgtcattcttattcggcagtcggtcttcaaagacatttaagccaaagaaaaacatccccgagggaagccaccaatacgagcttctgaaacacgcagaagcaacactgggctcggggaatctcagaatggccgtcatgctcccggaaggagaagacctcaatgagtgggtggctgtgaataccgtagactttttcaaccagatcaacatgttatatgggaccatcaccgatttctgcactgaggagagctgccccgtcatgagcgccgggccaaaatacgagtaccattgggcagatggaaccaatattaagaagcctataaagtgcagcgctcctaaatatatcgactaccttatgacctgggtgcaggaccaattagacgatgagacactgtttccttctaagatcggagttccttttccaaaaaatttcatgtccgtggccaaaactatcctgaagcgcttgttccgcgtgtatgctcacatttatcaccaacattttgaccctgttattcagctacaggaagaggcccatctcaacaccagcttcaagcactttatatttttcgtgcaagaattcaatctaatcgaccgacgggaactagctccgctgcaggagctgatcgaaaaactaacgtctaaggaccgctag

SEQ ID NO: 14331 - DNA, 477 bp, Artificial Sequence
  Description of Artificial Sequence: Synthetic coding sequence
atggccgcccagggagtggggcccggacccggcagcgctgctccccctgggctcgaggctgcacgccagaagctggcactaagacgcaagaaggttcttagcactgaagagatggaactgtatgaactcgcacaggcagccgggggcggcatcgaccctgacgtgtttaaaatcttggttgatctgttgaagttgaacgtcgcccctttggccgtgtttcagatgctgaagagtatgtgcgcagggcaaaggctagcttccgaaccacaggatccagccgccgtgtcattacccacatcaagcgttccggagaccaggggccgggacaaaggtagtgccgctctgggcggggtgctggcgctagctgaacgctctaaccatgaaggctccagccagcgtatgcctcggcagccctctgccacccgcttgcccaaaggaggcggcccggggaaatctcccacccagggctctacgtag

SEQ ID NO: 14332 - DNA, 1425 bp, Artificial Sequence
  Description of Artificial Sequence: Synthetic coding sequence
atgaattccgtgagccccgcagcggctcagtatcgctcctcaagccctgaagatgcacgaaggcgaccggaagcaagaaggccacgaggtcctcgcgggcccgatcccaacggcttgggcccttctggggccagcgggccggctctcggatcacccggtgccggcccgtctgagcctgatgaggtcgacaagttcaaagctaaattcttaaccgcatggaacaatgttaagtacgggtgggtcgtgaaaagccgcacatcctttagtaagatctcttccatccacctgtgcggccggcgctatcgctttgaaggagagggtgacatccagaggttccagagagacttcgtaagccgactgtggctgacgtaccggcgggactttccccctttgcccggtggctgcctgacaagcgattgtgggtggggatgtatgctgagatcgggacagatgatgctcgctcagggcctgttattgcacttcttaccccgcgattggacatgggccgaggggatgggcctgggtccccctgaactgtccggttcggctagccctagccgctatcatggtcccgctagatggatgcctcctcgctgggcccagggagcaccagagttggaacaggagagacgccacaggcagatcgtctcttggttcgcagaccaccctagggctcccttcggcctgcatagacttgtcgagttaggccagagctccggcaaaaaggctggagactggtacggaccttcactggttgcccatatcctgcggaaggccgtggagtcttgctccgatgttacgagactggttgtctacgtgtctcaggactgtaccgtctataaggctgacgtggcacgcctcgtggcccggcctgatcccacagcagagtggaagtccgtggttatactggtacctgtccggctgggcggggagactctcaaccctgtttacgtcccctgtgtgaaggaactgttacgctgcgagctatgtctgggaattatgggcggaaagcctcggcacagtttatattttatcgggtatcaagacgattttctcctgtatctagacccacattactgccagccaaccgtcgatgttagccaggctgacttccctcttgagtcctttcattgtacttctccccggaaaatggccttcgccaagatggatccctcttgcacagtgggattctacgccggcgatagaaaggagtttgagactctgtgctccgagctgacccgtgtattgagcagctcaagcgcgaccgagaggtatcccatgttcacactggcggaaggacacgcccaggaccatagcctcgacgacctatgctctcagcttgctcagccaacactgaggctgcccaggacaggaaggcttctccgggccaagagaccttcctcagaagacttcgtctttctttag

SEQ ID NO: 14333 - DNA, 945 bp, Artificial Sequence
  Description of Artificial Sequence: Synthetic coding sequence
atggccttcgtgacaaggcaattcatgcggagcgtatcttctagttccaccgcctctgcaagcgccaaaaagataatagtgaagcatgtgactgtcataggaggggggctgatgggtgctgggattgcccaggtggcagccgccaccgggcacaccgtagtgttagtcgatcagacagaagacattctcgccaaatcaaaaaagggaatcgaagagtccctgcggaaggttgcaaagaaaaaattcgcggaaaatctcaaggcaggggacgagttcgtcgagaagaccttgtcaacaattgctacaagtacggatgcagcaagcgtagtccattcgaccgatctcgtcgtggaggctatcgtagaaaacttgaaggtgaagaatgaactgttcaaacgccttgataagtttgccgctgagcatactatctttgcatccaataccagttctttgcagatcacgtcaatcgcgaatgccacgacacgtcaagatcgtttcgcagggctgcacttcttcaatcccgtgcctgtcatgaaactcgtggaggttataaagactccaatgactagccaaaagacatttgagtccctagtggatttcagcaaagcattaggaaagcatccagtctcctgcaaagacacacccggctttatagtgaatcgcttattggttccatacttaatggaggccatccgactttacgaaaggggagacgccagcaaggaagacattgataccgccatgaagcttggggccggttaccctatgggtccctttgaattactggattacgtggggctggataccaccaaattcatcgtggacgggtggcatgaaatggacgctgagaacccactgcaccaaccgtccccttctctgaataaactggtagccgagaacaagtttgggaagaaaacaggcgaaggattctataagtataaatag

SEQ ID NO: 14334 - DNA, 810 bp, Artificial Sequence
  Description of Artificial Sequence: Synthetic coding sequence
atggggaattgctgctggacacaatgcttcgggcttctgcgtaaagaagctgggcgactgcagcgagtgggtggcggaggcgggagcaaatatttcaggacctgctcacgcggagagcacctaacgattgagtttgagaatttagtggaaagcgatgagggggagagccccgggagcagccatcggcctctcactgaagaggagattgtagatttacgtgagcggcactatgattctatagcggagaagcagaaggaccttgacaagaagatacagaaagagcaagagcgccagcgtattgtccagcagtaccacccctctaataacggagagtatcagtccagcggacctgaggatgatttcgaatcatgccttaggaacatgaagtcgcagtatgaagtgttccgatcttcaagattatcctccgatgccactgtcctgactccaaatacggagtcaagctgtgaccttatgaccaagacaaaatccacctctgggaacgacgactccaccagcctcgatttagagtgggaggatgaggaaggtatgaatcgcatgctccccatgagagaaaggagcaaaacagaggaagacatcctgcgagccgctttaaagtatagtaataaaaagaccgggagtaatcccacctctgcctctgacgatagcaacggcctcgagtgggagaatgattttgtttcagccgaaatggacgacaatggaaatagcgaatacagcggtttcgtaaaccccgtactagaactgtccgactcagggattcgccacagtgataccgatcaacagacacgctag

SEQ ID NO: 14335 - DNA, 1371 bp, Artificial Sequence
  Description of Artificial Sequence: Synthetic coding sequence
atgaaatgtgagcattgcacacgcaaggagtgcagcaaaaagacaaaaacggatgaccaggagaatgtttcggctgacgccccatcccccgcacaggagaatggggaaaagggtgagttccataagctggctgacgccaaaatctttctatccgactgcttagcttgcgatagctgcatgaccgcggaggagggggtccaactatcccagcagaacgccaaggacttcttcagggtcctcaatctgaataaaaagtgtgacacctcaaagcacaaagtactagtagtctccgtgtgccctcagtcccttccctactttgctgctaaattcaatctatcagtgactgacgccagtaggcgcctatgcggctttcttaaatccttgggcgttcattatgtctttgacactactatcgcagccgacttcagtatcctggaaagccagaaggaattcgttaggcgatatcggcagcatagcgaagaagagcgcaccctgcccatgctgaccagcgcttgccccggttgggtcagatatgctgaaagggtgcttggaagacccatcactgcccacttgtgcaccgctaagagcccccaacaagtgatgggctcgctcgttaaggactactttgcccgacagcaaaatctgtctccagaaaaaattttccacgttatcgttgctccgtgttatgataaaaagctagaggctctccaggagtctttgccccccgccctgcacggatcccgcggcgccgactgcgtcctgaccagtggcgaaattgctcaaattatggagcaaggagacctctccgtgcgagacgctgcggtagatacactttttggggacctgaaggaggacaaagtgacacggcacgatggcgcttcaagtgatggccatctcgcccacattttccggcacgccgccaaagagctgttcaacgaggatgtggaggaggttacctatagagccctgagaaacaaggactttcaggaagttaccctcgagaagaatggggaggtggtacttcggtttgcagcggcgtatgggtttaggaatattcagaatatgattctgaagctcaagaagggaaagttccctttccacttcgtggaagttctggcctgtgccggcggatgcttaaacggcaggggacaggctcagacacccgacggtcatgctgataaggccctactgcggcagatggagggaatctatgctgatattcccgtaagacggccggaaagctctgcccatgtgcaggaactctaccaagaatggctggaaggcataaattcacctaaggcccgagaagtgctgcacacaacttaccaatcccaggaacggggtactcattccctggacatcaaatggtag

SEQ ID NO: 14336 - DNA, 612 bp, Artificial Sequence
  Description of Artificial Sequence: Synthetic coding sequence
atggctcacgtgtcatcagaaacccaggacgtatctcccaaagacgaacttactgcaagcgaggccagcactagaagcccgctgtgcgagcacaccttccccggtgacagcgatctgaggtctatgatcgaagagcacgctttccaggtgctgtcccaaggatctctgctggaaagtccctcatacacagtgtgtgtttccgaaccagacaaagacgatgactttctgagtctgaattttcctcgtaagctgtggaaaatcgtggagtcagaccagtttaagtcaattagttgggacgagaacggaacctgtattgtgattaatgaagaactgtttaaaaaagaaatactggaaactaaggccccttaccgaatcttccagaccgacgccatcaaatcattcgttcgccagctgaatctgtatggcttttctaaaatacagcagaattttcaacggagcgcattcttggctaccttcctgagcgaggagaaggagtccagcgtattgtcaaagatcagatttactaaaatgaagttgtcacgctccagcacctacgagaacaggtacctctgctgtaatctgcacctcaaggatgagagtaactattcttag

SEQ ID NO: 14337 - DNA, 2052 bp, Artificial Sequence
  Description of Artificial Sequence: Synthetic coding sequence
atgaacactagtatcccctatcagcaaaatccttacaacccaaggggctcctcgaacgtgatacagtgctatcgatgtggagatacgtgcaaaggagaggtcgtgcgcgtccacaataaccacttccacatccgctgctttacatgtcaggtctgtggctgtggattagcccaatccggctttttcttcaaaaatcaggagtacatatgcacacaggattatcagcagctgtatggcacacgctgcgattcttgtagggacttcatcacgggggaagtaattagcgctctaggtaggacttatcacccaaagtgctttgtgtgttccctctgtagaaaaccatttcccatcggcgataaggtgaccttcagtggcaaggaatgcgtgtgccaaacatgttcccagagcatggcctcttctaagcccatcaagatccggggccccagccactgcgccggttgtaaggaggaaataaaacacggccagagccttctcgcgctcgataaacaatggcacgtgtcatgttttaagtgtcaaacatgttcagtgattttgacaggagaatacatctcgaaggacggcgttccgtattgtgagagtgactaccacgctcagtttggaattaagtgcgagacctgtgataggtatatttccggccgggtgttggaggcaggcggaaaacactaccatccaacttgcgctagatgtgtacgctgtcatcagatgttcaccgaaggagaagagatgtatctgacgggcagcgaagtgtggcaccccatttgtaaacaagcggcgagggctgagaaaaagctgaaacaccgaaggacctctgaaacgagcatatcaccaccagggagctctattgggagtcccaatcgtgttatttgtgccaaggtagataacgaaatcctgaattataaggacctcgctgccctacccaaagttaaaagtatctacgaagtccagaggcccgatctgatatcatatgagccgcatagccggtacatgtctgacgagatgcttgaacgctgcgggtacggggagagtttggggaccctgagtccctactcccaggatatctacgaaaatctggacctcagacaaagaagggcatcttccccaggctatattgactcgcctacatacagcaggcagggcatgtctcccacattttccaggtctccgcaccattattacagatccggccccgaatcaggccggtcctctccataccattctcagctggatgtgcgctcgtctacacctacctcctaccaagcacctaagcattttcacatcccagccggagattccaatatctaccgtaaaccacctatttacaagaggcatggggatctctctactgcaacaaagagcaagacttccgaggacatttctcaaactagtaaatatagcccaatctatagcccggatccctactatgcgtcggagagcgagtactggacttatcacggctctccgaaggtgcccagggcgaggcgatttagcagcgggggggaagaggatgactttgacagatcaatgcataaactgcagtccggcatcggccgacttatcctgaaggaagaaatgaaggcccgttcaagttcctacgccgatccctggacccccccacgctccagtacctctagccgagaggccctgcacaccgcaggctacgagatgagcctgaatggaagtccaagatcccactacttagcggactcagaccccctgatatctaaatccgcatccctgccagcttatcgacggaatggcctgcaccgcacccccagcgccgatctgttccattatgattccatgaacgccgtgaattggggcatgcgcgaatacaagatctatccatatgagctgctcctggtgaccacccgcggcaggaatagactccccaaggacgtggatcggacccgtcttgagcgccatttgtctcaggaagagttctatcaagtcttcggcatgactatcagtgagtttgatcgactcgccctgtggaaacgtaatgaactcaagaaacaagctaggctgttctag

SEQ ID NO: 14338 - DNA, 2541 bp, Artificial Sequence
  Description of Artificial Sequence: Synthetic coding sequence
atgctgttcacagtcagttgttctaaaatgtccagtatagtggacagggatgacagttcaatctttgacggcctggttgaggaggatgataaagacaaggcgaaaagagtctcccgcaataagtccgaaaaaaagaggcgtgaccagttcaatgtgctgatcaaagaattaggctctatgctgcctggcaacgcccgcaaaatggacaaatcaactgtgctacaaaaaagcattgacttccttagaaagcacaaagaaataactgcccagagtgacgccagcgaaatacgacaagactggaagcccacatttctcagcaacgaggaatttacgcagctgatgttggaggctctagatgggttttttctagccatcatgactgacgggagcattatctacgtgtccgagagcgttacgagccttcttgagcacttgccctccgatttggttgatcagagcatcttcaactttattcctgaaggcgagcatagcgaggtctataagattctttccacccacttgctggagtccgactccttgacgcccgagtatctcaagtcaaagaatcagctggagttttgctgtcatatgctgcggggcactattgaccccaaagaaccgtccacttatgaatacgtcaagtttatcgggaacttcaaatcactgaacagtgtcagcagtagcgctcataacggctttgaagggacaatccagcggacacaccggccctcctacgaggatagggtctgcttcgtggccaccgtgagactggcaacacctcaattcatcaaggaaatgtgcactgtcgaagagcccaacgaggagtttacctctcggcatagcctcgagtggaaattcttgtttttagatcatagggctccccccatcattggctacctcccattcgaggtcttgggcactagcggatatgactactaccacgtcgacgacttagagaacctcgccaagtgtcatgaacatctgatgcaatacgggaaggggaagagctgctattaccggtttctgactaagggccagcagtggatctggctgcagacccactactacatcacttatcatcagtggaactccaggccggaattcatcgtgtgcacacacactgttgtgagctatgcagaagtgcgagcagaaaggcggagggagctcggcatcgaagaatccctgcccgagactgccgcagataaatcccaggatagcggtagcgataaccgaatcaacacggtctctctcaaagaagcattggaacgatttgatcatagtcctaccccatccgcctcttctcgatcctccagaaaaagttcacacacagccgtgagtgatccctccagcacccctaccaaaatccctactgatacttccacaccccctagacagcatctcccagctcacgagaaaatggtccagagacgaagctccttcagcagtcagtctatcaatagccaatctgtgggttcgtccctgacccagcctgttatgagccaggcgacgaatctgcccattccccagggtatgtctcagtttcagttctcagctcaactgggcgctatgcaacaccttaaggaccagctggaacagagaacccgcatgatcgaagccaatattcatcggcagcaagaagaactgaggaaaattcaggagcagctgcagatggtccacgggcaaggcctgcagatgttcctgcagcagtccaacccaggcctcaattttggaagtgtgcagctgagcagtgggaacagctctaacattcagcagctcgccccgatcaacatgcaaggacaggtcgtgccaacaaatcagatacagtccggaatgaacacgggtcatatcgggaccacacagcacatgatccaacaacaaacattgcagagtacttctacacagagtcagcaaaacgttctaagcggtcacagtcaacagacttcattgcccagccagacccagagtaccctgacagcgccgctatataacactatggtgatcagccaacctgcagcaggctcaatggtccagataccctcatctatgccccagaactcaactcagagcgccgccgttaccactttcacacaagatcgacagattcggtttagccagggtcagcagctagtcactaagctggtaacggcccctgtagcgtgcggcgcagtgatggttccatctaccatgctcatgggccaggtcgtaacagcatatcctacattcgctacacagcagcagcaaagtcagacactgagcgtgactcagcagcagcagcaacagtcttcacaggaacagcagcttacgagtgtacagcagccatcccaggcccagctgacccagcccccacagcagtttctgcagacatctaggttgttgcacggtaatccgtcaacacaactaattctgtcggcagcatttcctttacagcagtccaccttccctcagtcccatcatcagcaacatcagagtcaacagcagcagcagttgtccagacatagaacagactccctgcccgatcccagcaaggtccagccccagtag

SEQ ID NO: 14339 - DNA, 1656 bp, Artificial Sequence
  Description of Artificial Sequence: Synthetic coding sequence
atggggaggaaggccattgtcctcgccatcgcgaacaccagcctggccttccccctttgccagcatcttgttacgttctgtctgggcgaggatgacggtgtccatacagtggaagacgctagtaggaaactcgcggtgatggactcccaagggagggtgtgggcccaggagatgttactgcgggtaagtcccgaccacgttaccctgctggaccctgcctctaaggaggaactcgaaagttatccattaggcgctattgtgagatgtgacgctgtgatgccacccggccgttctcggtctcttctgctcttggtctgccaggaacccgagagggcacagcctgatgtccatttcttccagggcttgcgcctcggtgccgagctgatcagggaagacattcagggagctctgcataactatcgctcaggccgcggagagcggcgggccgcagctttgagggctactcaagaagaactccagagggacaggagtccagccgccgaaaccccccctctgcagcggcgcccctccgtacgcgctgtgatttcaaccgttgagcgcggggcgggccggggacgcccccaagcgaagcccattcctgaggccgaggaagcccagcgcccagaacccgtgggtacctccagcaatgcggattccgcctccccagacttgggccccaggggaccagatctcgccgtcctgcaggcagaaagggaggtggatattttaaatcacgtgtttgatgatgtggagagctttgtcagcaggctccagaaaagcgcagaggcagcccgtgtgctggagcatagagagaggggaaggcgaagccgcaggagagccgccggcgaagggttactgaccctcagagctaagccaccttccgaggccgagtacacagacgtcctccagaagataaagtatgcattcagcttactcgctaggctgagaggtaacattgcggacccctcctcacctgagctgctgcacttcttgttcgggccactgcagatgatcgtgaacacttcgggtgggccagaattcgccagttccgtcaggagaccacacctgacttcggacgccgtggcactgcttcgcgacaacgtgacaccccgggaaaacgaactttggacaagcttaggtgatagctggactaggcccggcctcgagctgtcaccagaggaggggccaccctatcgtccggaattcttctcaggctgggaaccacccgtaaccgacccccagagccgggcttgggaggaccctgttgaaaagcagctgcagcacgaacggcggcggaggcaggttactcaagctacccaacagggcagaggctgggaagtgcgcggaagaggccgatctgcctggccgcgactgactcggttgtcatattttcttcagcagtccgcccctcaggttgctgtcaacggacaccgggacctcgaaccagagtcagagcctcagctcgaatccgaaactgcgggaaagtgggttctatgtaactatgattttcaggctagaaatagcagtgagctgtctgtgaagcagcgggacgtgttagaagcactgcaggataaagagaaagtcagtgaactggaggccgtcatggaaaaacagaagaaaaaagtggaaggggaggtagagatggaggtgatttag

SEQ ID NO: 14340 - DNA, 1689 bp, Artificial Sequence
  Description of Artificial Sequence: Synthetic coding sequence
atggctgcctcagctaagagaaagcaggaggaaaagcacctgaagatgctgcgggacatgaccggactgccccataatcgtaagtgctttgactgcgaccaacggggtcctacatacgtcaacatgacggtgggaagctttgtgtgtacttcttgttccgggtccctgagaggactgaatcccccacatcgtgtgaagagcatctctatgactactttcacacagcaagagatagagttcttacagaaacacgggaatgaagtgtgtaagcagatctggttgggcttattcgatgacagaagtagcgccattccagactttcgggatccccagaaggtcaaagagttcttgcaagagaagtatgagaaaaagaggtggtatgtgccccctgaacaggctaaggtcgttgcctcagtgcacgcatcgatcagcgggagtagcgcaagctcaacgtcatccacacccgaggttaagcctctgaaatccctactcggggacagtgcacccacactgcacctcaacaaaggaacaccttctcagtctccagttgtggggaggtcacaaggccaacagcaggaaaaaaagcaattcgaccttctctccgaccttggaagcgacatcttcgccgcccccgctccacagtccacagcgaccgcaaatttcgcgaatttcgcacatttcaatagtcacgccgcacagaactcagccaatgccgactttgcaaactttgatgccttcgggcagagcagtggttccagtaatttcggaggtttccccacagcctcccattccccttttcagccacaaactacaggaggaagcgccgcttccgtcaatgcaaattttgctcacttcgacaattttcctaagtctagctccgctgacttcgggacattcaacactagtcagtcccatcagactgctagtgctgtctctaaagtttctacgaataaagcgggtctccagacagccgataagtatgctgctctggcaaacctcgataatatcttctctgccggacaaggcggggaccagggcagtggatttgggactaccggtaaggcacctgtcggatctgtggtgagtgtgccaagtcagagcagcgcctcgtcggataaatacgcggcgctcgcagagcttgactccgtattctcctcagctgcaaccagcagcaatgcctatacaagcacttcaaacgcctcctcaaatgtgtttggaaccgtgcctgtcgttgcgtctgcacaaacccagcccgcaagcagctctgtccccgccccattcggtgctaccccctccaccaatccattcgttgccgccgccggccctagcgtcgcgagttctactaatcccttccagacaaatgcacgcggggcaacggctgccactttcgggacggcctctatgtccatgccaaccggcttcgggacccctgcgccatactctctcccaacatctttcagcggttccttccagcagcctgccttccccgctcaagcagctttcccgcagcagacagctttctcacagcagcccaatggagccggtttcgcggcctttggtcagacaaaaccagtggtcacgccctttgggcaggttgctgctgccggcgtcagctctaacccctttatgactggggcgccaacgggtcaatttccgacaggaagctcctctactaatccctttctgtag

SEQ ID NO: 14341 - DNA, 2052 bp, Artificial Sequence
  Description of Artificial Sequence: Synthetic coding sequence
atggccgctgccgttgccgctcctctggctgctggcggggaggaagctgccgccaccacttcggtccccgggtcccctggcctaccgggcagacggagtgctgaaagggccctggaagaagccgtggcgaccggtactttaaacctttcgaataggcgcctaaaacactttccacgcggcgccgcccggtcatacgacctttcagacatcacccaggcggatctctccaggaatcgcttcccggaggtgcccgaggctgcctgccagctcgtatccctggagggactatccctgtaccacaattgccttcgttgcctcaaccctgcactgggaaatcttacagctctgacttacttgaacttgtctcgcaaccagctgtccctgttgcccccctatatctgtcagctgccactgcgggtgctgatcgtcagcaataacaaattgggagcactgccccccgacatagggaccctcggaagcctgaggcagttagacgtctcatcaaacgagcttcagtccctgccctctgaactgtgtggcctgtcaagccttcgcgacctcaacgtaagaagaaaccagctttcaaccctgccagaggaactgggggatcttcctctggtgcggctcgatttctcttgcaaccgcgtctcccgtattcctgtatctttctgcagacttaggcatctgcaagtcatactgctcgactcgaaccctcttcaaagtccgccagcccaggtgtgtctgaagggaaaactgcacatttttaagtacctcagtacagaagctggccagcggggctctgctctcggagaccttgctccatctcggcctccatctttcagtccttgccctgccgaagacctgttccccgggcaccgctacgacggaggattggatagcgggttccactctgtggacagcggcagcaagcgctggagcggcaacgagagtaccgacgaattctcagaacttagtttcaggatatcggaactggctagggagcctagaggcccaagggagcggaaagaagacggctctgccgatggggaccctgtgcaaatcgatttcatcgactcccatgtcccgggggaagacgaggaaaggggcacagtcgaggagcagagaccaccagagctgagtccgggggcaggcgaccgggaaagagctccttcgtctcgccgggaagagcctgccggggaagaaagacggcggcccgatactctgcagctgtggcaggagagggagaggcgacagcaacagcagagcggtgcatggggggcacctagaaaagactctttactgaaacctgggcttagagccgtggtgggcggggcagctgccgtaagtacacaagccatgcataatgggtctcctaagagttctgcatcacaggctggggccgccgctggccagggggctcccgctccagccccagcttcccaagagcctctgcctattgctggccccgccacagcacccgcaccacggcccctcggaagcatccagcgacccaattcctttctgtttaggtcatcttcccaaagcgggtctggaccatccagccccgactcagtgctgaggcctcgtaggtacccccaggtacccgacgagaaggacctgatgacccagctgagacaagtccttgagagccgcctgcagcggccactgccagaggatttagctgaggcgctggcatcgggagtgattttatgtcagttagccaaccagcttcggcctaggagtgttccctttatccacgtgccttcccctgcggttcccaagctctctgcgctgaaagctcgcaaaaacgtggagagtttccttgaagcatgtcgcaagatgggcgtgccagaagccgatctgtgctctcccagcgacctactacagggcaccgctcgcggtctgcgaaccgccctggaagcagtgaagcgcgtgggcggaaaggccttgcctcctttatggccaccgagcggactcggaggattcgtggtattttatgttgtgctcatgctcctcctctatgtcacttacactcgcctactcggcagctag

SEQ ID NO: 14342 - DNA, 303 bp, Artificial Sequence
  Description of Artificial Sequence: Synthetic coding sequence
atgtccacatcgaccagctgtccaatcccaggagggagggaccagttgcctgattgctacagtacaaccccaggcggaacgctgtatgccacgaccccaggtggcactcggattatttatgacagaaagtttctcctggaatgcaagaatagtccgattgcaagaacccccccctgctgcctgcctcagattcccggcgtgacgactccccccactgctcccctgtcaaagctcgaggaactgaaagagcaagaaacagaggaggaaatccccgatgacgctcagtttgaaatggacatttag

SEQ ID NO: 14343 - DNA, 2382 bp, Artificial Sequence
  Description of Artificial Sequence: Synthetic coding sequence
atgcccatggaatctgccagctctgacaacaagaaacaaattccaaacgaggccagcgctaggtccgagagggacaccagcgatctcgaacaaaactggtccctccaggaccactaccgaatgtactcacctattatttatcaggcgctgtgtgagcacgttcaaacacagatgtctctgatgaacgacctcacgtccaagaacatcccgaatggtatccccgcagtgccctgccacgccccttctcatagcgaatctcaggctacccctcactcttcctatggcctttgcacttctacccctgtgtggagcctgcagaggcccccctgcccgcctaaagtgcatagcgaggttcagaccgatggaaattcccagtttgccagccaaggaaagacggtgtccgcgacgtgtacagatgtactgcggaattcctttaatacctcccccggggtgccctgtagtctgcctaagacagacatctctgcaattccaacacttcagcagctcgggcttgtcaacggaatccttcctcagcagggcattcataaggaaacagatcttcttaaatgtattcagacctacctctccttattcagatcgcacgggaaagaaacccaccttgacagtcagactcacagaagccctacccagagtcagcccgcatttttagctaccaacgaggagaagtgcgcacgggaacagatacgggaagcaacatccgagaggaaggacctcaacattcacgtcagggatacaaagacagttaaagacgttcagaaggctaagaatgtgaacaagactgccgagaaggtgcgcattataaagtacctgttgggggagctaaaagccctagtcgccgagcaggaagacagtgaaatacagcggttgataaccgagatggaggcttgtatttcagtgcttcctacggtgtccggcaatacggatattcaggttgaaattgctttggccatgcagcccctgagaagtgaaaacgcgcagctcagacgtcagcttaggattctaaatcagcagttgcgtgaacagcaaaagacacagaagccatctggggccgtggattgtaatttagagttgtttagtctgcagagcctcaacatgagtctgcaaaaccaactcgaagagtcactgaagtcacaggagctgctgcaatccaagaatgaggaactgctcaaagtgatagagaatcagaaggacgagaataagaagttctcatctatctttaaggataaagatcaaaccatcctggagaataaacagcagtatgatattgagattaccagaatcaagattgagctggaagaagctttggttaacgtaaagtcaagtcagtttaaattggaaacagcagagaaggaaaatcagattctcgggattactctcaggcaacgcgacgccgaggtaacccgattgcgagaattgacacgtacacttcagaccagtatggcaaaattactgtccgatttgtcggtcgactcagctcgatgtaagccaggcaataacttgacaaagtccctgctgaacatacacgacaaacagctccagcacgaccccgctcctgcacacacctcaatcatgtcctatttgaacaagttggagaccaattatagcttcactcactcagagcccctgagcaccatcaagaatgaggaaaccatagagccagataaaacttacgagaacgttctgagtagccggggccctcaaaactcaaacacacggggcatggaagaggcctctgcacctggaattatatccgcattatccaaacaggactctgacgaggggtctgagaccatggccctcatagaagacgagcataatctggacaacaccatatacatcccctttgcccgatctaccccagaaaagaagtcccccctctcaaagagattgtcaccacagccgcagatacgggccgctacaactcagttagtgtcaaattcagggcttgccgtcagtggcaaagagaacaaactgtgcacacctgtcatctgcagttcatctacgaaagaggctgaggacgcacccgaaaaactgtcacgggcctccgatatgaaggacacacagctattgaaaaagatcaaggaagccattggtaaaattcccgctgctaccaaggagccggaggaacagactgcatgccatggtccttccggctgcctgagtaactccctgcaggtgaagggcaataccgtttgcgatggatctgtgttcacaagcgatctgatgtcagattggtcaatatctagcttttcaacatttacatcacgagatgaacaggattttagaaacgggctggcggccttggacgccaacatcgctcgcttacagaaatccctccgcaccgggcttctggaaaaatag

SEQ ID NO: 14344 - DNA, 1119 bp, Artificial Sequence
  Description of Artificial Sequence: Synthetic coding sequence
atgactttccagttcaactttaccattgaggatcacctggaaaatgagttaacacccatacgcgacggtgcactcacactggattctagtaaagagcttagtgtctccgaatctcagaaaggcgaagagcgggaccgcaaatgctcggcggagcagttcgatctgccgcaagatcacctttgggaacataaatccatggagaatgccgctcccagccaggacacagactcccctttgtcagcagcttcgagcagtcgaaatttagaacctcacggcaagcagccttccctaagggccgccaaagagcatgcgatgcctaaggaccttaagaagatgcttgagaataaagtgatagagaccctgcccggctttcaacacgtgaaactgagcgtcgtgaagaccatcctgttgaaagaaaacttccctggggaaaatattgtgtcgaaatcgtttagctcccattccgatttgatcacaggcgtttatgagggggggctgaagatctgggagtgcacctttgaccttctcgcttactttacgaaggctaaggttaaatttgcaggcaaaaaagtactggacctggggtgcgggtcagggttactgggaattacggcttttaaaggtgggagcaaagagattcatttccaggattataattccatggtgatagatgaggtgactctgcccaatgtggtggccaacagcacactggaggatgaagaaaatgacgtgaatgaacccgatgtgaagcgctgtagaaaacctaaagtcacccagctgtacaagtgccggtttttcagcggcgaatggtccgagttttgtaagttggtgctctctagtgagaagctcttcgtgaaatacgatctcatccttacatccgaaactatctacaaccctgactactacagtaatttacaccagacgtttctccgattgctcagcaaaaacgggcgtgtactgctggcctctaaagcccactactttggcgtcggaggcggcgtgcatctctttcagaaatttgtcgaggaacgggacgtgttcaagactaggattcttaaaatcattgatgagggcttgaaacggttcatcatcgagatcacattcaaattccccggatag

SEQ ID NO: 14345 - DNA, 336 bp, Artificial Sequence
  Description of Artificial Sequence: Synthetic coding sequence
atgactacgctgagggcatttacatgcgatgacttgttcaggtttaataacatcaacctggacccactcactgaaacctatggcatcccgttctacctccagtatctcgcccactggcccgagtatttcattgtcgccgaagctccaggtggggagctgatgggctacataatggggaaagccgagggaagcgtcgcacgggaggaatggcatggccatgttaccgcccttagtgtggctccagaatttagacgactgggcttggctgccaaactaatggagctgctcgaggagatatcggagaggtacgaagaatctactttccaggggtattag

SEQ ID NO: 14346 - DNA, 1449 bp, Artificial Sequence
  Description of Artificial Sequence: Synthetic coding sequence
atgaatggtacactcgaccatcccgaccagccggacctcgatgcgattaaaatgttcgtcggccaagtgccccggacatggtccgagaaggatcttcgcgagctgtttgaacagtatggcgcagtgtacgagatcaacgtgctcagagaccgctcacagaaccctcctcagagtaaagggtgttgcttcgtgactttctacaccagaaaggctgctcttgaggcccagaatgccctccacaacatgaaggtccttcccggtatgcaccatcccatacagatgaaaccagccgattccgagaaaaataacgccgtggaggacaggaaacttttcattgggatgatctcgaaaaaatgtaccgaaaatgacatccgggtgatgtttagcagctttgggcagattgaagagtgtcgcatcctgaggggtcctgacgggctgagtagaggctgcgcatttgtgacattcaccacgcgtgctatggcacagacagccattaaggctatgcaccaggcccaaactatggaaggatgttcatcgcccatggtggtgaaattcgccgacacgcagaaggataaggaacaaaaaagaatggcgcaacagctccagcaacagatgcagcagatttcggccgcgagtgtttggggaaatctggctggactgaatacgcttggcccacaatatctcgcattgcttcaacagactgccagctccggtaacttaaacacattatcctccttgcatcccatgggaggcttgaacgcgatgcagctccagaatctcgcagctttggccgccgctgctagcgcagctcaaaacactccctctggcaccaatgccctaacgacaagttcatcgcctcttagcgttctgacctcctcaggctcatccccttcctcatcttcatccaatagtgttaacccaatcgcatcactcggcgccttacaaacactggccggggcgaccgctgggttgaacgttggtagcctagccgggatggctgctttgaatgggggcctgggctcttctggcttgtccaatgggacaggtagtaccatggaggctctgacacaagcttattcaggaatccagcagtatgccgctgcggctctcccgactctgtacaaccaaaacctgctcactcagcagagcatcggcgccgccggctcccagaaagaaggcccagagggagcaaatctgttcatttaccaccttccccaggaattcggagatcaggacttattacagatgttcatgccctttggcaacgttgtgtcagccaaagtgttcatagacaaacagaccaacctatcaaagtgcttcggatttgtcagctatgataatcctgtctctgcccaggcggccattcagagcatgaacggctttcagatagggatgaaaaggctcaaggtgcaactaaagcggagcaaaaatgactccaagccctactag

SEQ ID NO: 14347 - DNA, 1347 bp, Artificial Sequence
  Description of Artificial Sequence: Synthetic coding sequence
atgtctcctctagagtgtagtgaatgcttcggcgaccagctgctgcaccggacttacacctggcagttaactcttcactcacgccccaactacacccgcaagcgggacactaggagcgagtcactcgagatccccatctctgtcgtactgcctcaaagaggtacagccgagccattccccaggctgcacaacctgtattccacacctagatgcgcacagcaggcggctcttcccagactgtcaagacggatggcatcacaacacagctatcccctgaatcggttcagctctgtgcccctcgaccctatggagcgaccgatgagccaggctgatttggagttagactataacccgccaagagtccagctgagcgatgagatgttcgtctttcaggacgggcgttgggtgaacgagaactgcaggttacagagcccgtatttcagccccagcgcctcgtttcaccataagctgcaccacaagcgcctggccaaagagtgcatgctgcaggaagagaacaagagtctccgagaagagaataaagccctgcgtgaggaaaaccgcatgctgagcaaagagaacaagatcttacaggtcttttgggaggaacacaaggcttctcttgggagagaagaatcgagggccccatctccactcttgcataaggattccgcctcattggaggtggtgaagaaggaccacgtcgcacttcaggttccccgaggcaaagaggactccactctgcagttactccgggaagaaaatcgagcattgcaacaattactggaacaaaagcaggcatattgggctcaggcagaggacaccgcagcaccagccgaggagagtaaacctgctccttcgcctcatgaggaaccgtgcagtccagggctgctgcaggaccaaggaagcggcctaagttctaggtttgaagagccgaagggtccccctgctcggcaggaggactcaaaagaactaagggcccttagaaagatggttagcaacatgagtggaccttccggcgaagaagaagcaaaggtcgggcctgggctcccggacggctgtcagccactgcagcttttaagggagatgcgccaggcattacaagccttgctcaaagaaaataggctcctccaagaggagaacaggaccctgcaggttctcagagcagaacacagaggtttccaagaagagaataaagccctgtgggagaacaataagctgaagctgcaacagaaacttgtaattgacaccgtcactgaagtcacagctcgcatggaaatgcttatcgaagaactgtatgcattcatgccagcccgaagccaggaccccaagaaaccctctagggtttag

SEQ ID NO: 14348 - DNA, 1002 bp, Artificial Sequence
  Description of Artificial Sequence: Synthetic coding sequence
atggcagctgccgccgctgggacggcgacatcccaacgcttttttcaaagctttagtgacgccctgatcgatgaagaccctcaggcggctctggaggaactgacaaaagcgctagaacagaagcccgatgacgcacagtactactgtcagagagcctactgccacatcttactgggcaattattgcgtcgccgtggctgatgcgaagaagtccctcgagctgaacccaaataattcgaccgccatgctgagaaagggtatctgtgagtatcacgaaaaaaattacgctgccgctctcgaaacattcactgagggccagaaattggattccgccgacgcaaatttttcagtgtggatcaaaagatgccaggaggctcagaatggctccgagagcgaagtgtggacccaccagtccaagatcaaatacgactggtatcagaccgagtcacaggttgtaatcactctgatgataaagaacgtccagaagaacgacgtgaacgtggagttttccgaaaaggagttgtccgctctggtcaaattaccatccggcgaggattataatctgaagctggagctgctgcatcccattattcccgagcaatccacttttaaggtgctttccaccaagatcgaaatcaaattgaagaaacccgaggcggtaaggtgggagaagttggaaggacagggtgatgttcccacacccaaacagttcgtggccgatgtcaaaaacctctaccccagctccagtccctatacacgcaactgggacaaactggttggcgagattaaggaagaagaaaaaaatgaaaagcttgagggggatgcagcactcaaccgtctttttcagcagatttactccgatggctccgacgaagtaaaacgcgcaatgaataaatcgttcatggagtctggcggtaccgttctgtccacaaattggtcagacgtcggcaagagaaaagtcgagataaacccacccgatgatatggaatggaagaaatattag

SEQ ID NO: 14349 - DNA, 1029 bp, Artificial Sequence
  Description of Artificial Sequence: Synthetic coding sequence
atgtccctgcatgggaagagaaaagagatctataagtatgaagcaccctggacagtttacgctatgaactggagcgtgcggcccgataaaagatttagactggcactcgggtcttttgtcgaggaatataataacaaagtgcaactggtcggactggatgaagagagctccgaatttatctgcaggaataccttcgaccacccatatccgacaaccaagttgatgtggatccccgatactaaaggtgtgtaccccgacctcctggccacatccggagactacctgagggtgtggagggtgggggaaaccgaaacaaggctggaatgtctgctgaataacaataagaacagtgacttttgcgccccccttacctcattcgattggaacgaggtagacccatatctattggggaccagcagtatagacacaacatgcactatctggggcctggagaccggtcaggtgctgggtcgcgtgaacttagtatctggacatgtgaagacccagttaatagcacatgataaggaagtttacgacatagcctttagtagagccgggggaggccgcgacatgtttgcctcggtgggtgctgacgggagcgtcaggatgttcgatctaagacacctcgagcattccacaattatttacgaggatccgcagcaccatccgctgctgcggctgtgctggaacaaacaagaccctaactacctcgccacaatggcaatggacgggatggaagttgtgatcttggatgtcagggtcccgtgcacgcctgtagcccggctcaacaatcacagggcttgtgtgaatggcatcgcctgggccccacatagttcgtgccacatctgcactgccgctgacgaccatcaagccctgatctgggatattcaacaaatgcccagggctatcgaagatccaattttggcctatacagccgaaggcgagattaataacgttcagtgggcaagcacacaacccgactggatagcaatctgctacaacaactgcctcgagattctccgcgtttag

SEQ ID NO: 14350 - DNA, 507 bp, Artificial Sequence
  Description of Artificial Sequence: Synthetic coding sequence
atggctgagggcagcagaattccacaggcacgcgccctgctgcaacagtgcttgcacgccaggctgcaaattcgccccgcagacggcgacgtcgccgcacagtgggtggaggtgcagagggggctggtgatctacgtgtgtttctttaaaggcgccgacaaggagttgttacctaaaatggttaacaccctgcttaacgtgaagctttctgagactgagaacggaaagcacgtgtcgattctcgatcttcctggtaacattctgatcatcccacaggctacactgggaggtcgactaaagggacgcaacatgcaataccacagcaatagtggcaaagaagaaggcttcgaactgtattcccaattcgtgacactttgcgaaaaagaggtcgctgctaactctaagtgtgcagaggcccgcgtggtggtggagcacgggacctacgggaataggcaagtgttgaagcttgatactaacggtccttttacccaccttattgagttttag

SEQ ID NO: 14351 - DNA, 3069 bp, Artificial Sequence
  Description of Artificial Sequence: Synthetic coding sequence
atggaaggcgccctaacggcacgggacaaggtaggggtacaagatttcgtattattagacgcatacaccagcgagtccgcatttgtagataacctgcggaaacgtttttccgagaatctgatctatacctatattgggaccctccttgtcagcgttaacccctatcaggaacttggaatctatacagtgagccagatggaactttatcagggggtcaactttttcgagctaccacctcacgtgtatgcaatcgcagataacgcctataggatgatgtgcgctgaattgaataatcattttattctgatatcgggtgagagcggggcgggtaagaccgaggcatccaagaagattctcgaatactttgccgtcacttgcccgatgactcagagcctacaaatcgctagggacaggttattgttttcaaaccccgtgctcgaggcgtttggtaacgctcgcactctgcgaaatgataatagctctcggtttggtaagtatatggatatccagtttgacttccagggcattcccgttggtggccatatcatctcctatcttattgaaaaaagccgcgttgtataccagaatgaaggcgaacggaacttccacatcttctatcagctactggctgggggggaggaagaacggctctcatacctggggctggagcgcgatccccagctatataagtatttatcacaaggtcactgcgccaaggagagttcaatctcagacaaaaacgactggaagaccgtcagtaacgccttctctgtgattgacttcacagaggcagacctggagaatctgttcggcatcatcgctagtgtgcttcatctaggcaatattgggttcgaagaagacgatcaaggttgcgcaactatacctgacacgcacgaaattaagtggattgccaaactcttgggtgttcatcccagcgttctcctggaggctctgacccacaggaaaattgaggcaaagaccgaggaggtcatctgtccattaactcttgagctcagtgtgtacgccagagatgctatggcgaaggcagtatacggccgcacctttacatggctagtcaacaaaattaatagctcacttgtcaacaaggatttcacacggaaaacggtgatcggattgctggacatttatggttttgaagtgtttgataagaatggttttgagcagttttgcataaattattgtaacgaaaaactgcagcagttgctcatcgaaagaacacttaaggctgagcaggccgagtatgagatggaaggcattgagtgggagccaataaagtatttcaacaacaaaattatttgtgacctggtggaggagcggcataagggtatcatctcaatcctcgacgaagagtgtattcggcctgggccggcgacagatctgagcttcctcgaaaagctggaagagaaagttgggaagcatgcccacttcgagacacggaagcttgcaggtccgaagggtagaaagaggattggctggatggagttcagactactacactatgcgggagaggttacatattgtactaagggttttctggagaaaaacaacgatctactctaccgccacctgaaggaggtgctgtgcaagtccaaaaacataatcttacgagagtgttttcttctggcagaacttgaaaatcgccgccgcccgcccaccgtgggaacgcaatttaaaaatagcctgtccagtctgctagagaccttgatatctaaagaacccagctatatacgatgtattaagccgaatgataggaaagaaccttctaagttcgacgacttcctcatccgccatcagatcaaatacttaggcttgatggagcatctccgagtgaggagagccggatttgcttatagaaggaagtatgagcacttcctccaaaggtataagagtttgtgtccggacacatggcctcattggcatggaccacctgctgagggcgtcgaacggcttattaagtatattggctacaagcctgaagaatataaactggggaagaccaagatctttatccgatttccccgtacattgtttgccaccgaggatgcctttgaattctccaagcatcaactggtcgctcgcatccaggccacctataaacggtgcctcggccgccgcgagtacgttaagaagaggcaagctgccattaagctggaagctcattggcgcggggctctggctcgtaaagcaatccagagacgcaagtgggccgttcgaataattcggaaatttattaaaggttttatttcccgtaataagccgctgtgcccagacaatgaggaattcatcgtctttgtgcggaaaaattacatactgaatctgcgctatcacttgcccaaaactgtgctggataaatcatggctgaggcctccaggcatcctggagaatgcaagtgacctgctgcgtaagatgtgcgtcaggaacctggtgcagaagtattgtcgcgggatcaccgcggaaaggaaggccatgatgcagcagaaagtggtcacgtccgaaatctttagaggcaggaaggacgggtacactgaatcactaaaccagcccttcgttaactcacggatagatgagggagacatcaatccaaaggtcctccagttgattagccacgaaaaaatccagtatggcgtccctgtgataaagtatgaccgcaagggcttcaaggctagacaacgacagttaatcttaacacagaaggctgcgtacgtcgtggagctcgccaaaataaagcagaagatagaatactctgctcttaagggggtgtctacttctaatctgtctgacggtatccttgtcatacacgtcagtccggaggacagtaagcaaaagggggatgccgtactccagtgcggccatgtgtttgaggcggtgacaaagctggttatgttagtgaagaaggagaatatcgttaacgtggtacagggcagcctgcagtttttcatctctccagggaaagaaggtaccatcgtgttcgataccgggcttgaagagcaggtttataagaataaaaacggccagctgacagtggtcagcgtccgcaggaagtcttag

SEQ ID NO: 14352 - DNA, 1044 bp, Artificial Sequence
  Description of Artificial Sequence: Synthetic coding sequence
atgaacacattaatggacgtgctgcgtcaccggcctggctgggtggaagtgaaggacgaaggagaatgggatttctactggtgtgatgtgagctggctccgcgagaacttcgatcacacctatatggatgagcacgtcagaatctcccactttaggaaccactacgagcttaccaggaagaactacatggtcaaaaatctgaaaagattccgaaaacaattagagagggaggctgggaagcttgaggcggctaaatgcgactttttccctaagacattcgaaatgccttgcgagtatcatctctttgtcgaggagtttcgcaaaaatccaggaataacatggatcatgaaacccgtagcccgcagtcaagggaaggggatattcttatttaggcgactgaaagatatagtggattggcggaaagacaccagatcaagcgacgaccaaaaggacgatattccggtggagaattacgtggctcaacgctacattgaaaacccttatctgattggagggcgcaaattcgacctgcgcgtatatgtgttggtgatgtcatacattccccttagagcctggttgtacagagacggattcgccaggttcagcaacacgaggtttacactcaactccatcgatgaccaatacgtccatctgactaatgttgccgtgcagaaaacatcaccagactaccacccgaaaaaagggtgtaagtggactttgcagcggttccggcagtaccttgcatcaaagcacggaccagaggcagtggagacactttttcgggacatagataatatattcgtgaaatcactgcagtctgtgcagaaagtgattatttcagacaagcactgttttgagttgtatggatacgacatcttgatcgaccaagacctgaaaccctggttgcttgaggtaaacgcttctccatccctgactgccagtagtcaggaggactacgagctcaagacctgtctgttagaggatacattgcatgtcgtcgatatggaggctcggtctctgcgggccgatagtccctgttggtag

SEQ ID NO: 14353 - DNA, 444 bp, Artificial Sequence
  Description of Artificial Sequence: Synthetic coding sequence
atgagctctgagccgccgcctcctccacagcctcccacacaccaggcttccgttggcctcctggacacacctcggtcaagagagcgttcgccatctccgctacggggcaatgtcgtcccgtcccctctgcctacacgccgcacccgcactttcagcgctaccgtccgcgcatcacagggcccagtttacaagggcgtgtgcaaatgcttctgccgcagtaagggccatggcttcatcactccagctgacggcggacctgacatctttctgcacatctcagacgtagagggagagtacgttcctgtggaaggagacgaagtcacttataagatgtgcagcattccgcccaaaaacgagaaacttcaggctgtggaagtggtcataactcacctcgcaccagggactaagcacgagacgtggagcggacacgttatttcatcttag

SEQ ID NO: 14354 - DNA, 558 bp, Artificial Sequence
  Description of Artificial Sequence: Synthetic coding sequence
atggctgacggcggtggcgggggaggtaccggcgcagtgggcgggggcggcacatcacaggcctctgcaggggccgccaccggggctacaggcgccagcgggggaggcggaccaatcaacccagcctccctcccacccggcgatccacaattgatcgctctgatcgtggaacagttaaagagtagaggtctgtttgattctttccgcagggactgcttggccgatgtagatacgaagcccgcgtaccagaacttgcgccagaaagtggataatttcgtctcaacacacttggataaacaggaatggaaccccaccatgaacaaaaaccagcttcggaatggcttgcgtcaaagtgtcgtacagtcaggcatgttggaagccggagttgaccggatcatttcccaggtggtagatccaaagctaaaccatattttccggcctcagatcgaacgagccatccatgaatttttggctgcacagaagaaggctgccgtgcctgcaccacccccagagccagagggtcaggatccacccgccccatcgcaagatacctcttag

SEQ ID NO: 14355 - DNA, 6351 bp, Artificial Sequence
  Description of Artificial Sequence: Synthetic coding sequence
atggacgaggtggagcaggaccaacacgaagctaggttgaaggagttgttcgattcctttgataccacagggactggctccctcgggcaggaggaattaactgacctgtgtcacatgctcagcctggaggaagtcgcacctgtactccaacagaccctgttgcaggacaacctgcttggccgagtccacttcgatcagtttaaggaggcgctcatcctgatactgagtcgaaccctgtcaaacgaggagcacttccaggaacctgattgctccctagaagcccagccaaagtacgtccgtggaggcaaaagatacggcagaagatcgctccctgagttccaagagagcgtcgaagaatttcccgaagtgaccgttatcgaacctctggatgaagaggctagaccatcgcacattccagctggcgactgctccgaacattggaagacccagagatccgaagagtacgaagccgagggacagctcaggttctggaatcccgatgatctgaacgcatcccaatccggctcttccccaccacaggattggatagaggaaaaattgcaagaggtgtgcgaagatctgggtattacacgtgacggccacctcaacaggaagaagcttgtcagcatctgcgaacaatacgggctgcagaatgtggatggagaaatgttggaagaagtgtttcataacctggaccccgatgggaccatgagcgtcgaagattttttctacggcctgtttaagaacgggaaaagtctcaccccatcagcatccactccctaccgtcaactgaagcgacacctttccatgcagtcatttgacgagtcggggaggcggaccactaccagctcagccatgacatcaaccataggtttccgcgtattctcctgtcttgacgacggcatggggcacgcctctgttgaacgcatcctggatacctggcaagaagagggcatcgaaaatagccaggaaatccttaaggcgctagatttctctctggatggtaatattaatcttactgaactcacactggctctggagaacgagctgctcgtgaccaagaacagtatacaccaagctgctcttgcttctttcaaagccgaaattagacatctcctagagcgtgtcgaccaggtcgtgagagagaaggaaaagctccgctccgaccttgacaaagctgaaaagttgaaatccttgatggcctctgaggtggatgaccaccatgctgccattgaacgtcgcaatgaatataacctccggaagctggatgaagaatataaagaacggatagccgccctgaaaaacgaactcagaaaggaacgcgagcagattctccaacaggccggaaagcagcgcttagagcttgaacaggagattgagaaggccaaaaccgaggaaaattatattagagatcgcctagccttgtccctcaaggaaaatagtaggctcgagaacgagcttttggagaacgccgagaacgttctggcagagaaatttggggatctggacccatccagtgccgagttctttctgcaggaggagaggctgacacagatgcgcaatgagtatgaacgccagtgcagggtcttacaggaccaggtggatgagctgcagtccgagctcgaggagtaccgcgcccagggacgggtgctccgcctcccccttaagaactcgccctcagaggaggtggaagctaacagcgggggcatcgagcctgaacatgggctcggcagcgaggagtgcaaccccctcaatatgtctatagaagccgagctcgtgatcgagcagatgaaggagcagcatcatcgcgacatttgttgcctgcggctggagctggaagataaagtgaggcactatgagaagcagcttgatgagacagtggtgtcctgcaagaaggcgcaggagaatatgaagcagcggcatgagaacgagacccacacactcgagaaacagatcagtgatctcaagaacgagatagcagaactgcaagggcaggccgctgtgctaaaggaagcacatcacgaggcaacatgcagacacgaagaagagaaaaaacagctgcaagtgaagttggaggaggagaagacccacctccaggagaaactccgcctccagcacgagatggagttgaaggctaggttgacacaggcccaagcctccttcgagagggagagagaggggttgcagtcatcggcatggaccgaggagaaggtcagggggctgacacaagagctcgaacaattccaccaggagcagctgacctccctggtggaaaagcatacactagagaaagaggaattacgaaaagaactcctcgagaaacaccagagggaacttcaggaagggcgagagaaaatggagacagaatgtaaccgtcggacttcccagatcgaagcccagttccagtccgattgccagaaggtgaccgaacggtgcgagagcgccctgcagtcactggagggtcggtaccgtcaagagctcaaagatctacaagagcagcaaagggaagaaaaaagccaatgggagttcgagaaagacgagcttactcaggagtgcgccgaggcccaggaattgctcaaggagaccctgaagcgtgaaaagaccacatctctggtcctaacccaggaacgggagatgctcgagaaaacttacaaagagcatttgaatagtatggtcgtagagcggcagcaactcctgcaggacctcgaggatctccgaaacgtctccgaaacacagcagtccctattgtcagatcagattcttgagctgaagtcctctcacaagagagagctgcgagagcgtgaggaagtgctctgccaggccggagccagcgaacagctggctagccaaagactggaacggcttgaaatggagcatgaccaggaaaggcaggagatgatgtctaaacttctcgctatggaaaatatccacaaagccacttgcgagacagcggacagggagcgcgccgaaatgtcaactgaaatctccaggcttcagagtaagatcaaggagatgcagcaggcaacttccccactaagcatgctgcaatccggctgccaagtcatcggagaggaggaggtggaaggggatggagcgctgtcattactccagcagggcgaacagttactcgaggagaacggggacgtcctgctgtctttgcagcgcgctcacgaacaggctgttaaagaaaatgttaaaatggccactgaaatcagccgcctgcagcagcgtctccagaagctggagccgggcctggtgatgagctcatgcctggatgaaccagctacagagttcttcggcaacactgccgagcagacagaacaatttctgcaacagaatagaaccaagcaggtagagggggtgacacggcgccacgttctaagcgacctggaagacgacgaagtccgggatcttgggagtaccggaacctcatcagtccaacgtcaggaagtcaagatcgaggaatcagaggcctcagttgaagggttttcagagctggaaaatagtgaagagacgcgaactgagtcatgggaattaaagaaccagatctcacagctgcaggaacagctcatgatgctatgcgcagactgcgacagagcttctgaaaagaaacaggacctgctcttcgatgtgtcagtgctgaagaagaagttaaagatgttagagcgcatccctgaagcaagcccaaaatacaagttactttatgaagacgtatcacgagagaacgattgcctgcaggaggaactcagaatgatggagactagatacgatgaagctctcgagaacaacaaagaacttacggcggaagtcttccgcctgcaggacgagctgaagaagatggaagaagtgacagaaacattcctctcattagaaaagagctacgacgaggtgaagatcgaaaacgagggcctgaacgtgttggtgcttaggttacagggcaagatcgagaaactccaggaatcagtggtccagagatgtgattgttgtctttgggaggcttctcttgaaaacttggaaatcgaaccggatggaaacatcctccagttgaaccagacccttgaggaatgcgttccacgtgtgcgtagtgtgcaccacgtgatagaggagtgcaagcaggagaaccagtaccttgagggtaacactcagctgctggagaaagtgaaggcccatgagatagcgtggcttcacgggacaatccagactcaccaagagcggcctcgggtccaaaaccaagtcatcctcgaggagaatacaactctgctggggttccaggataagcatttccagcaccaggccacaattgcagaactggaactggagaagacaaaactgcaggaactgactcgcaagctaaaagaaagagtgactatcctagtcaagcagaaggacgtgctatctcatggagaaaaggaggaggagctgaaagcaatgatgcacgatctgcagatcacttgcagcgagatgcagcagaaggtcgagctcctcagatacgagagcgaaaaactacagcaggaaaactccattctgaggaatgagataacaaccttaaacgaggaggattctatttctaacttgaagctcgggacgcttaatgggagtcaggaagaaatgtggcagaaaactgaaactgtgaagcaggaaaatgctgccgtccagaagatggtcgaaaacttgaagaagcagattagcgaattgaagattaagaaccaacagctagatctggaaaacaccgagctgtcccagaagaatagtcaaaaccaggagaaactgcaggaactgaatcagagactaactgaaatgctgtgtcagaaggaaaaggagccaggcaattcagcgctagaggagagagaacaggagaaatttaatcttaaggaggaactcgaacgatgtaaagttcagagttcaactctggtgagctccttggaggccgaactctcggaggtgaaaatccagacacatatcgtccagcaggagaatcacctcctgaaggacgaattggagaaaatgaaacagctgcaccggtgcccagacctgtcggacttccagcagaagatctcctcagtgctctcctataacgagaagctgcttaaagaaaaagaggcattgtccgaagagcttaatagctgcgtggataaactggcaaaatcatccctactggagcaccggatcgcaactatgaaacaggagcagaagtcctgggagcatcagagcgcttcactcaaatcccagctcgtcgcctcccaagaaaaggtccagaatctggaggatactgtccaaaacgtgaacctccaaatgagtcgcatgaaaagtgacttaagggtgacacaacaagagaaagaagctctgaaacaggaggtcatgagcctgcataagcagctgcaaaatgccggcgggaaatcatgggctccggaaattgcaacgcacccctcaggattgcacaaccaacagaaacgattgtcatgggataaacttgatcacctgatgaacgaagaacagcagctgctctggcaggagaatgagagactgcagacaatggttcagaacaccaaagcagagctgacacacagccgagagaaggtgcgacaattggagagcaatctactcccaaaacatcaaaaacacctcaacccctcaggcacaatgaaccctaccgaacaagagaaactgtccctgaaacgcgaatgcgatcaattccagaaggaacagtcaccggccaataggaaggttagtcagatgaattctttagaacaagaactggagactatccaccttgagaatgagggcctgaagaaaaaacaggtcaagctcgatgaacaactcatggagatgcagcacctacgctcgactgctacgccatctccatccccccacgcctgggacctgcagctgctgcagcagcaggcgtgtcccatggtgccaagggagcagttcctccagttgcagcggcagctcctgcaggccgagagaatcaaccaacaccttcaagaggagctggagaaccgtacatccgaaactaacacccctcagggcaatcaggagcaactggtgacggtaatggaagagcgcatgatcgaagtggaacagaagctgaaactggtaaaaaggctacttcaagagaaggtcaatcaactaaaagaacagctgtgtaaaaacacaaaagctgacgctatggttaaggacctgtacgttgaaaatgcgcagctgctgaaggctctggaggtgacagaacagagacaaaaaacagccgaaaaaaaaaattatctcttagaggaaaagatcgccagcctttcaaacattgtgagaaatctgacccccgctcctctgacctcaactccgcctctgcgcagttag

SEQ ID NO: 14356 - DNA, 2664 bp, Artificial Sequence
  Description of Artificial Sequence: Synthetic coding sequence
atgcccatacttttgttcctgatcgacacctcggcctccatgaatcagcgttctcatctcggcaccacgtatttggataccgccaaaggggcagttgagaccttcatgaaactacgtgctagggatcctgcttctaggggggaccgttacatgctcgttacatttgaggagccaccttatgccatcaaagccgggtggaaggagaaccacgccacgttcatgaatgagcttaagaatctgcaagcagaagggctcacaacactcggacaaagcctgcgcacagcttttgatctccttaatctcaatcgactcgtgactgggattgacaactacggacaggggcggaatcctttttttctggagccggctatcatcatcaccatcactgatgggagtaagttgactactacctcgggcgtgcaagatgagctccatctgcccctcaactcacccctgcctggctcggagttgaccaaagagccctttcgatgggatcagagactcttcgccttggtcttgcgtctccccgggacgatgagtgttgagagcgaacaattgacaggcgtgccattggacgactctgctattaccccgatgtgtgaggttaccgggggacgctcttactccgtctgctctcccaggatgctgaatcagtgcctcgaatccctggtgcagaaggtgcaaagtggcgtcgtgatcaattttgaaaaggcgggtccagacccttccccggtggaagatggtcagccagatatatccaggccattcgggtcccagccatggcatagctgccataaactgatctacgtgaggcccaatcctaagacaggtgtgccaatcgggcactggcccgtaccggaaagtttttggcccgaccaaaactcccctactctgccccctcggacttcgcatcctgttgtcaaattttcctgcactgattgcgagccaatggtgatcgacaaattgccattcgacaagtacgaacttgagccatcaccactcacacagttcattctggagaggaaatcgccacagacctgctggcaggtgtacgttagcaatagcgccaagtactccgagctgggacacccttttgggtacctcaaggctagcaccgctctgaattgcgtgaacttgttcgtgatgccttacaattacccagtgctgctgcctctccttgacgacttatttaaagtgcataaggcaaaaccaacactgaaatggaggcaaagctttgaaagttatcttaagacaatgcctccatattaccttggtccactgaagaaagccgttagaatgatgggtgctccaaatctgattgctgatagcatggagtacggcttatcttacagcgtcatcagttacttaaagaaattaagccaacaggctaaaatagagagcgaccgcgtgatcgggtctgtggggaagaaagtggtgcaggagacagggataaaagtacggtcaagatcccacgggttgagcatggcttatcgaaaagattttcagcagctgctgcagggaataagtgaagacgtccctcatcgcctgttagatctcaatatgaaggaatacacgggtttccaggtggcactcctaaacaaagacctgaaaccacagacattcagaaacgcatacgatatcccccgcaggaatctgctggatcatctgactcgcatgaggtcgaaccttctgaaaagcaccaggcggtttctaaaagggcaggacgaggatcaggtacactccgtgcctatcgcacagatgggtaattatcaggagtacttgaaacaggtgccttcaccactgcgcgagctggatcctgatcaacccaggcggttacacacttttggtaaccctttcaagttagacaagaaaggaatgatgattgacgaagctgatgagtttgttgccgggccccagaacaaacataaaagacccggcgaacctaatatgcaggggatccccaagcgccgacgctgtatgagcccactcctcaggggccgtcagcagaaccccgtggtcaacaatcatattggagggaaagggccccccgcccccacaacacaggctcaaccagatctgattaagcccctgccgctgcacaaaatctctgagactacaaatgactccatcattcatgatgtggtcgagaatcacgtcgcagaccaactgtctagcgacattacccctaatgctatggacaccgagttctcagcctctagcccggcctcacttttagaacggcctaccaatcacatggaagccctaggacacgatcatctggggacaaatgacttgacagtgggaggcttcttggagaatcacgaggaaccccgtgacaaagaacaatgcgcagaagaaaacatcccagcatcttcactcaacaagggcaaaaagcttatgcactgtcggtcacacgaggaagttaacactgaattaaaagcgcagatcatgaaggaaatccgcaagccgggtcggaaatacgagcgcatcttcacgcttctaaaacatgtgcagggcagtctgcagacccgactgatttttttacaaaatgtgattaaggaggcttcacgattcaagaagcgaatgctgattgaacagctggagaacttccttgatgaaattcacaggcgggccaaccaaattaaccatattaattccaactag

SEQ ID NO: 14357 - DNA, 1944 bp, Artificial Sequence
  Description of Artificial Sequence: Synthetic coding sequence
atgtctgacgaggtcttcagcactacactggcttacactaagtcacccaaagtgacaaaacgaacaacatttcaagatgagcttatcagggccattactgcccgcagcgccagacagagatcgtccgagtattcagacgattttgactccgacgaaattgtgtccctcggtgacttttctgacacaagtgcagatgaaaatagtgtgaataaaaaaatgaatgattttcacatatcggacgacgaggagaagaatccgtccaaactgctgttcttaaagaccaacaaatcaaacggcaatattacaaaggacgaaccagtgtgcgcaattaagaacgaagaagaaatggcgccagacggctgtgaagacattgtcgtgaagtcgttttcagaatcccagaacaaagatgaagagtttgagaaagacaaaataaagatgaaaccaaaacccaggattctttccatcaagagcacatcttccgccgagaataatagcctagacactgacgatcactttaagccttctccaaggcccagatctatgctgaaaaagaagtctcacatggaagagaaggacggcttggaggacaaagaaacggcattatccgaagagctcgaactgcactccgcgccctcctccctacccacaccaaatggcatccagctggaagccgagaagaaggcgttcagcgagaatctcgaccccgaggacagttgtctcacctctctcgcgtctagttcactgaagcagattttgggtgacagcttttcccctgggtctgaaggtaacgcctcgggcaaggaccctaatgaggagatcacggaaaaccataatagcttgaagtccgacgaaaacaaggagaattcattcagtgccgaccatgttacgaccgccgtcgagaagagcaaggagtcccaggttacagcagacgacctggaggaggaaaaagcaaaagcagagttgatcatggatgatgaccgtaccgtggaccctctattatcgaaatcccagtcaatcttgatcagcacatctgcaacagcttcctcgaaaaagactattgaagacaggaacatcaaaaataagaagagcactaataaccgagccagttccgcttctgcccggctaatgacatccgagttcctaaagaagtcctcctctaaacgccggactcctagtacgaccacctccagccactatttaggtacacttaaggtgcttgatcagaaacccagtcagaagcagagtattgagccagacagggccgacaatattcgcgctgcggtgtatcaggagtggctggagaaaaagaacgtgtacctgcatgaaatgcaccggatcaaacggatagaaagtgaaaatctgaggattcagaacgaacagaagaaagcagcaaaacgcgaggaggcccttgctagcttcgaggcttggaaggctatgaaggagaaagaggccaagaaaatcgctgcaaaaaagcgcctggaggagaagaacaagaagaagacggaagaggagaatgctgcacggaaaggtgaggctttgcaagccttcgaaaagtggaaggaaaaaaagatggagtatctgaaagagaagaacaggaaagaacgggagtatgagagggctaagaagcaaaaagaggaggaaaccgttgccgaaaaaaaaaaggataaccttaccgctgtggaaaaatggaacgagaaaaaagaggctttcttcaagcaaaaagaaaaggagaagatcaacgagaaacgcaaggaagaactgaagcgtgcggagaagaaggacaaagataaacaagcaatcaacgagtacgagaaatggctggagaataaagaaaagcaggaacggattgaacgaaaacaaaaaaagcgccactcctttcttgaaagcgaagcccttccaccttggtcacctccttccaggacggttttcgccaaggtattttag

SEQ ID NO: 14358 - DNA, 1074 bp, Artificial Sequence
  Description of Artificial Sequence: Synthetic coding sequence
atgcaaacatttcttaaggggaagagggtgggctactggctgagtgagaagaagattaaaaagttgaactttcaggccttcgccgagctttgtaggaaaaggggcatggaggtggttcaactcaacctgtcccggcctattgaggaacaggggcctctcgacgtgataattcacaaactgaccgatgttatcctggaagctgatcagaatgattctcagtccctggaactggtgcacaggtttcaggaatatatcgatgcccaccccgaaacaattgtgctggacccactgccagcaattcgcaccctgctcgatcgatccaagagctacgagcttattcggaagatagaagcttatatggaagatgatcgtatctgcagcccccctttcatggaactcactagcttatgcggggacgatacaatgagacttcttgaaaagaatggtttgaccttcccttttatatgcaaaacacgtgttgctcacgggacaaactcacacgagatggctattgtctttaatcaagagggtctgaacgctattcagcccccttgtgtggtgcagaatttcatcaatcataacgcagtgttatacaaggtatttgtggtgggcgagtcctatactgtcgtccagagaccaagtctcaaaaatttcagcgctggtacttccgaccgggagtctatttttttcaacagccacaatgtctccaagcccgaatcttcctccgtgttgacagaactggataaaatcgaaggagtctttgaacgccctagcgacgaagtgatcagagagctgagcagggcgctgaggcaggcactcggagtatcactgttcggaatcgatatcatcattaacaatcaaacagggcagcatgccgtcatagacataaatgcattccccgggtatgaaggcgtctcagaattttttacggatctactgaaccatatagcaaccgtcctgcaggggcagtccaccgcaatggctgccccatctggagagtttcgggctggtgacctctgctgtgatttagggaagtcgtttcaggtgttcggaccgccacccccttgtctttag

SEQ ID NO: 14359 - DNA, 852 bp, Artificial Sequence
  Description of Artificial Sequence: Synthetic coding sequence
atgctcagatgcggccagatgatcttcgcacaggccctcgtgtgtcgtcacctggggagggattggcggtggacccagcggaagcgtcagccagactcatatttttctgttctgaacgcctttatagatagaaaagattcttactatagcatacaccaaatcgcacagatgggcgttggggagggaaaatccatcggacagtggtacggcccaaatactgtggctcaagtgctgaaaaagctcgccgtgttcgacacttggtcctcattagcagttcatatagctatggataatacagtggttatggaggagatcagaagactttgcaggacaagtgtgccatgcgccggcgctacagcctttccagccgactctgaccggcattgcaacggctttccggctggggctgaggttacgaaccgacccagcccctggagacccctggttctcctgataccactgaggctgggattgacagatattaatgaggcttacgtcgaaacccttaagcattgcttcatgatgccccagtccttaggggtgataggcggaaagccaaactccgcgcactatttcattggttacgtcggcgaggagctaatctatctggatccacatacgacccagccagcggtggaacctactgacggctgcttcataccggacgagtcattccactgtcaacacccaccgtgtcgtatgtcaatcgccgaactggacccgtctattgctgttgtgctcggggtcgggaagcagggccgcttagtgcggtccatcccatgggccccgcgaccatctagctggtgcgccgccgtgttaggggctgcagtcgtgatgtgcggcactccttag

SEQ ID NO: 14360 - DNA, 2160 bp, Artificial Sequence
  Description of Artificial Sequence: Synthetic coding sequence
atgggcttttctaatatggaagacgacggccccgaggaagaggaaagagtcgccgagccacaggcgaacttcaatacaccccaggccctccgcttcgaggagctgctggctaacttactgaacgaacaacaccaaatcgccaaggagctgttcgaacagttgaaaatgaaaaagcccagtgcgaaacagcagaaggaggtagagaaggttaagccccagtgcaaggaagttcaccagactctcatcctggaccccgcccagcggaaacggttacagcagcagatgcagcaacacgtgcagctgctcactcaaatccacttgctggccacctgcaatcccaacttaaatcctgaggcttcatccacccggatatgtttaaaagagctaggtaccttcgctcagagcagtatcgccctgcaccatcaatataacccaaaattccaaacgctcttccagccctgtaacttaatgggggcgatgcagctaattgaggatttctccacacacgtgagcatcgactgtagtccccacaaaaccgtaaaaaaaaccgccaacgagtttccctgtcttcccaagcaagttgcctggatactggctacctctaaagtgtttatgtatcccgagctgctgcctgtgtgctctctgaaggcgaagaaccctcaagataagattctattcacaaaggctgaggacaataaatacctgttgacttgtaaaactgcccgccagcttacggtgcgtattaagaacctgaatatgaacagagccccagataatattatcaaattttataagaagaccaagcagcttccagtattgggtaagtgctgtgaagagattcaaccccatcagtggaagcctcctatagagcgcgaagaacacaggctgccattttggctgaaggcaagtctgccatctatacaggaagagctgaggcatatggcggacggggctagggaggtaggtaatatgacaggtacaacagagatcaactctgatcaggggttggagaaggacaacagcgagctggggtctgaaacccgatacccacttctcttgccaaagggcgtcgtgttaaagctgaagccagtggctgatcggttcccaaagaaggcatggcgtcaaaaaaggtcctccgtcctgaaaccactgttaatccaaccgtcaccaagcctgcaaccttccttcaacccaggaaagacaccggctcagagcactcatagtgaggcccccccatccaagatggtccttcggattccacatccaattcaaccggcaacagttcttcagacagtgcccggcgtgccccctttgggggtctccgggggggaatccttcgaaagccccgccgccctgcctgccatgccccctgaagcccgaacatcatttccgctcagcgagagtcagactctgctgtcctccgctcctgtgccgaaagtgatgatgccctcacctgcttcgtccatgttccgcaagccgtacgtccgccgtagacctagcaagaggcggggcgctcgagctttcagatgcatcaagcccgcgcccgtcattcatccagccagcgtgatcttcactgtgccagcgaccaccgtgaaaatcgtgtcattgggaggtgggtgtaacatgattcaacctgtcaatgccgccgttgcccagtcaccccagacgatcccgatcgcgaccttgctggtcaaccccacttcctttccgtgcccactcaatcagccgttggtggcctcgagtgtgagcccattaattgtgtctgggaattcagtcaatctgcctatcccaagtacgccggaggacaaggcacacatgaacgttgacatcgcctgtgccgttgcagatggagaaaacgccttccaggggctcgaaccaaaattagagccccaagaactctcccccctgtcagcaactgtatttccaaaagttgagcattccccagggcccccacctgtagacaagcagtgtcaagaaggactatctgagaattctgcctatcgttggacggtcgttaagactgaggagggacgccaggccctggagcctctgccgcagggaatccaggagtccctgaataactctagcccaggcgatctcgaggaggtggtaaagatggaacctgaggatgccactgaggaaatttctgggttcctgtag

SEQ ID NO: 14361 - DNA, 1134 bp, Artificial Sequence
  Description of Artificial Sequence: Synthetic coding sequence
atggaagctgccgccgtcacggtgactcggagcgccactagaagaagacgaagacagttgcagggactggccgctcctgaagcggggacacaggaggaacaggaggatcaggagcccaggcctcgcaggcgacgcccaggacgatcaatcaaagacgaagaggaagaaacagtgtttcgtgaagttgttagttttagccccgacccactcccggtgcgctactatgacaaagacacaacaaaaccaattagcttttacctgagcagcttagaggaactgttggcctggaaacctcggctggaggatggctttaatgtggcactagagcctctggcctgtaggcagcctcccctgagctcacagcgccctcgcacgttactgtgtcacgatatgatgggtggctatttagatgatcgctttattcaggggtccgtcgttcaaaccccctacgccttctatcattggcagtgtatcgatgtgtttgtatacttttcacaccataccgtcaccattccccctgtcggttggaccaatacagcacataggcacggagtgtgcgtactcggcacttttatcactgagtggaacgagggagggaggctctgcgaagcgttcttggccggagatgaaagatcttaccaggccgtcgcagatcggcttgtgcaaataacgcaattcttccgctttgacgggtggttgatcaatatcgagaacagcctgtcgcttgccgccgtaggtaacatgcccccgtttttaagatatctgacaactcagcttcacaggcaggtgccaggtgggcttgtattgtggtatgacagtgtggtccagtctggacagctcaagtggcaggacgaattgaaccagcacaatcgggtgttctttgattcttgtgatggtttctttaccaactacaactggcgggaagagcatctggaacgcatgcttggtcaggccggcgagagacgtgctgatgtgtacgtaggcgtcgatgtgttcgccaggggtaacgtggttgggggccggtttgacactgataagtccttagaactgatcaggaagcacggtttcagcgtggccctctttgctccggggtgcagcgttttcccaggtgtgggaaatctactctgctgttag

SEQ ID NO: 14362 - DNA, 927 bp, Artificial Sequence
  Description of Artificial Sequence: Synthetic coding sequence
atgcggggaaaacggcggcctcagaccagggccgccaggcgattggctgcacaggagtcatccgaagcagaagatatgagcgtgccgcgagggcctatcgcccaatgggcagatggtgctatcagtcccaacgggcaccggccacagttgagggcggcctcaggcgaagacagtaccgaagaggccctagcggctgcggccgctccatgggagggggggccggtgccaggagtcgatacctccccattcgccaagtctcttgggcattcccgcggtgaagcagatctgttcgacagcggggacattttcagcaccgggactggttctcagagtgtagaaagaacgaagccaaaggcgaaaattgctgagaatcctgcaaatccccctgtgggtggaaaagctaaaagtcccatgttccctgctctcggcgaagcgagcagcgatgacgacctcttccagtccgctaagccaaaaccagctaaaaaaacgaacccgttccccctactggaagatgaagacgatttattcaccgatcagaaagtgaagaagaacgaaacaaagagttcttcccagcaggatgttatcctcactactcaggatatctttgaagacgacatctttgctacagaggcaatcaagcctagccagaagacaagagaaaaagaaaaaaccttagaatctaatctgttcgatgataatattgacatcttcgccgatctcacggtcaaaccgaaggagaaatcgaaaaaaaaggtggaggcaaagtccattttcgacgacgatatggacgatattttctctactggcattcaagccaaaaccaccaagccaaaatcgcggagcgcgcaggccgcacccgagcctaggtttgaacataaggtttccaatatctttgacgacccgctgaatgcctttggtggccagtag

SEQ ID NO: 14363 - DNA, 933 bp, Artificial Sequence
  Description of Artificial Sequence: Synthetic coding sequence
atgctgaaaaacaaaggccactccagcaagaaagataacctcgcggttaacgcggtggccttgcaagatcatatcctgcatgatctgcaactacggaacctaagcgttgccgaccactcaaagacccaggtgcagaaaaaagaaaataagtccctcaaaagggatacaaaggcaattattgacacggggcttaaaaaaaccactcagtgccccaaacttgaagacagcgagaaggagtacgtcctggatcccaaacccccaccacttactctggcacaaaagttgggcttgatcggccctcctcccccgcccctttcatcggacgaatgggaaaaggtaaagcagcgcagcctgctgcaaggggactctgtccagccttgtccaatttgtaaggaggaattcgagttacgcccacaagtgctcttgtcctgttctcatgtgtttcacaaggcttgcctgcaagcattcgagaaatttactaacaagaagacctgccccctctgccggaagaatcaatatcagaccagggtcatccacgacggagctcggctttttcgtatcaaatgcgtcaccagaattcaggcctattggaggggctgtgtcgtgaggaagtggtatcggaatctccggaagactgtgccccctacagatgccaagcttaggaaaaagtttttcgagaaaaaattcacggagatcagtcaccggatcctgtgtagttataacacgaatattgaagagttgttcgccgagatcgaccagtgtctggcgatcaatcgtagcgtgctgcaacaactcgaagagaaatgcggtcacgaaatcacagaagaagagtgggagaagattcaggtgcagaacgagacatctgcatgctttgaggacccctgtctcggggcacacggctcacacttcagccttagcaattttctgctgtag

SEQ ID NO: 14364 - DNA, 1119 bp, Artificial Sequence
  Description of Artificial Sequence: Synthetic coding sequence
atgcgggtgggccccgtgcgctctgctatgtccggcgcctcgcagcccagggggccggctcttttattccctgcaacaaggggcgttccagccaagagattgctcgatgctgacgatgctgctgctgtggcggctaaatgcccgagactgagcgagtgcagcagtcctcctgattatctgtcacctcccggatccccttgcagcccacaaccaccaccagctgcccctggcgccggggggggatccggttctgcaccgggacctagcagaattgctgactacctgctgctccctctggctgagagagaacatgtcagcagagccttatgtatacacacaggtagggagttgcgatgtaaggtttttcccatcaagcactatcaggataagatccgaccttacattcaactcccctctcacagcaatatcacaggcattgtggaggttatcctgggggaaaccaaggcttacgtttttttcgaaaaggacttcggcgacatgcatagttatgtccggtctcgtaaaagactgagggaggaagaagcggctaggctcttcaaacagatcgtcagcgccgttgcacactgccaccagagtgccattgtgctgggtgacctaaaactgcgaaaattcgtatttagcacggaggagcggactcaattgcggctcgagtctctggaagatacccatataatgaaaggtgaagatgatgccttgtcggacaagcacgggtgtcctgcgtacgtcagtcccgagatactcaatactacaggtacatatagtggcaaagcagccgacgtgtggagtcttggtgtgatgctctataccttgctcgtaggtagatatccgtttcacgactcagatcctagcgcgttgttttcaaaaattagacgaggtcagttttgcattccagagcacatatcaccaaaagctagatgtctcatccgctccctcctgcgtagagaacctagcgagcggttaacagcccctgagattctcctgcacccctggtttgaatctgtacttgagcccggctacatcgattctgaaattggcacaagtgaccagatagtcccagagtatcaggaagacagtgacatcagctcgtttttctgttag

SEQ ID NO: 14365 - DNA, 1554 bp, Artificial Sequence
  Description of Artificial Sequence: Synthetic coding sequence
atggaaactgaccttaattctcaagaccgtaaggacttagataagtttatcaaatttttcgctctgaagacagtgcaggtgatcgttcaggctcggcttggcgaaaaaatatgtaccaggtcctccagcagcccgaccggaagtgactggtttaacttggccataaaagacatcccagaagttacccatgaggccaaaaaggctctggcggggcagctgccagctgttggccgcagcatgtgcgtggaaatcagtttgaagacaagcgaaggagactcaatggaacttgagatctggtgccttgaaatgaacgaaaaatgcgataaggaaatcaaggtgtcctataccgtatataatagactgagcctgctcctgaaaagcctgcttgccattacgagggtcacaccggcctaccgtctgtcgcgcaagcagggtcacgaatacgtgattctttaccggatttatttcggcgaggtccaactgtccggcttgggcgagggcttccagaccgtgcgcgtgggtactgtcggtaccccagtcggcaccattacattatcctgcgcctatcggattaaccttgccttcatgagtacacgacaattcgaaaggaccccgcctataatgggcataattattgaccactttgtggatcgcccgtacccgagcagcagcccaatgcacccatgcaattatagaacggctggggaagacacgggggtgatatatccgtcagtagaagattcacaagaggtctgcactactagcttttcgactagtccccctagtcagttgagttcctcaaggttgtcataccagccagcagcccttggcgtgggatctgccgatctggcctaccccgtggtgtttgccgctggtctaaatgcaacccacccccaccaattgatggttcctgggaaagaggggggagtgcctcttgcccctaaccagccagtgcacggcactcaggcggaccaggagagactggccacctgtacgccgtcggacaggacccactgtgccgccaccccttcatcttccgaggataccgagaccgtttctaactcctcagaaggaagggcatctccacacgacgtgctggagaccatttttgtgaggaaggtaggcgcttttgtgaataagccgattaatcaggtcactctaacaagtctggacataccatttgctatgtttgccccgaaaaacttggaactggaagataccgatcctatggtgaatcctcccgactctcccgagaccgaatcacccctccagggcagccttcactcagacgggtctagcggaggcagtagtggcaatacccatgacgactttgtgatgatcgacttcaaaccggccttcagcaaagacgatattctgcctatggatttaggaaccttttatagagagtttcaaaacccaccgcaactgagctctctgtccattgacatcggggcgcagagcatggctgaggatctggattccttacctgagaagttggccgtccacgaaaagaacgttagggaatttgacgcattcgttgaaacactgcagtag

SEQ ID NO: 14366 - DNA, 1488 bp, Artificial Sequence
  Description of Artificial Sequence: Synthetic coding sequence
atgtggaggggctgtgcccgctcgcgtaagcgcaaaaaggtcgacaacgactacaatgcactgcgcgaaagactcagtaccctcccagacaagttatcatataacattatggtgcctttcggcccattcgcctttatgcctgggaaactggtgcataccaacgaggtgacagtcttacttggcgacaattggtttgccaagtgcagtgccaagcaggcagtggggctggtagaacatcgcaaggaacacgtgaggaaaacgatcgatgacctgaagaaggtaatgaaaaatttcgagagtcgggtggagtttactgaagatctacagaagatgtcagacgccgcaggtgatatagtggatatacgcgaggaaattaagtgtgattttgaatttaaagccaaacatcggattgcccataagcctcattctaagcccaagactagcgacatcttcgaggcagacatcgctaatgatgttaagagcaaagacctcttagctgacaaagaactttgggccagactggaggaacttgaacgtcaggaagaactgttgggggagctggattctaaacctgatacagtgatcgccaatggggaggataccacctctagtgaagaggagaaggaggatcggaacacaaacgttaacgctatgcaccaggtgaccgattcacacaccccctgccataaagacgtggcttcctccgagccttttagcggccaggttaattcccagctgaactgctctgtaaatggatcaagctcataccactccgatgacgacgacgatgacgacgacgatgacgacgatgataatatcgatgatgacgacggtgataacgaccatgaggctctgggagtgggtgacaatagtatccctacaatctatttctctcacaccgtcgagcccaaacgggtgcggataaacaccgggaagaatacaacgctgaaattttccgagaagaaagaagaggcaaaaaggaagcggaagaattcgaccgggagcggacacagcgcccaggaattgcctaccatacgcacccctgcagacatttaccgcgcattcgtggacgtggtcaatggcgagtatgtcccgagaaagagcatcctcaagtcaaggtcacgcgagaactctgtgtgctctgataccagtgagtcctctgcggctgaattcgacgacaggcgaggcgtgctgcgctccatctcgtgtgaagaggccacatgctccgatacttcagaatctattttagaagaggaacctcaggagaaccaaaaaaagctcctacctctttccgtcactcccgaagcattctcaggcaccgttattgaaaaagagttcgtttctccatccctcaccccgccaccggctatcgctcatcccgcgctacccaccatcccggagagaaaagaagtgctcctcgaggcctccgaagagacaggcaaacgggttagcaaattcaaggccgctcgcctgcaacagaaggactag

SEQ ID NO: 14367 - DNA, 1458 bp, Artificial Sequence
  Description of Artificial Sequence: Synthetic coding sequence
atgtgtcaagtaggggaggattatggagagcccgctcccgaagagccccctccggctccccggccatcgcgggagcagaagtgcgtgaagtgtaaagaggcgcagccagttgtcgtgatccgagccggtgatgctttctgtcgtgactgctttaaggcgttttacgtgcacaagtttcgggctatgctaggaaaaaaccgccttatattccctggggagaaggtcctgctggcgtggtcaggtggccctagctcatcgagtatggtttggcaggttttggagggtctcagccaggacagtgcaaaaaggctgagattcgtggctggtgtcattttcgtggacgagggggccgcatgcggtcagtctttagaggagcgcagcaagacccttgccgaggtcaagccgattctgcaggccacgggtttcccttggcacgttgtggctttagaagaggtgttcagtctcccacctagtgtactctggtgttcagcccaagaattggtgggctccgagggcgcatacaaagctgctgtggatagcttcctccagcagcaacatgtcctgggggcgggcggcgggcctggccccacacagggagaggaacagcccccacagccccctctggaccctcagaatctggcccgcccccccgccccggcccaaacagaggccctttcccagctcttttgttccgtcagaacactgactgcaaaggaggagcttctgcagactctgcgaacccacctcatcctgcacatggcgcgcgcacacggttactcaaaggtgatgacaggagattcctgtactcggctcgcgataaaattgatgactaatctggcgctggggcgtggagcctttttggcatgggatactggtttttctgacgagcggcatggagacgtagtggtggtgaggccaatgcgggaccacactctgaaggaggtggctttctataaccgcttgttttcagtccctagcgtgttcacacccgccgtggataccaaagcacctgaaaaggcttccattcaccgactgatggaagcatttattctgaggctgcagactcagtttcccagtaccgtcagcaccgtgtacagaactagcgagaaactcgtgaaaggcccacgtgacggtcctgcagccggcgattccggccctcgttgcctcctttgcatgtgtgcgctggacgtcgacgcagccgattcagccacggcctttggcgcccagacttctagcaggctctctcagatgcaatctcccataccactgaccgaaacccggacacctcctggcccttgctgctctcctggcgtggggtgggcccaacgctgtggtcagggtgcctgtcgtagagaggatccccaagcctgtatcgaagagcaattatgctactcctgccgggtgaatatgaaggacctgggcctaggtctggccggagaccccggccttagtgattag

SEQ ID NO: 14368 - DNA, 1353 bp, Artificial Sequence
  Description of Artificial Sequence: Synthetic coding sequence
atgtcactgaggctgtcctctgccagtaggcggagttgtccaagaccgacgactggtagtctgcgactgtacggcgggggaacgtctttcggcacgggcaattcttgcggaatatccgggataggctccgggttctcatcagccttcggaggaagcagctcaggcggcaatactgggggcgggaatccatgcgctgggttcacggtaaacgaacgtggccttctaagcgggaatgagaaggtgacaatgcaaaatctgaacgacagactggccagttacctggactcagtacatgctttagaggaggccaacgccgaccttgagcaaaaaataaaagggtggtatgaaaaatttggacccggctcctgccgcggactcgatcacgattacagtaggtactttccaattatagatgacctgaagaaccagatcattgccagcaccacatcaaatgccaacgccgttttgcagatcgacaatgccagacttaccgccgacgacttccgtttaaagtacgaaaacgaactggccttgcaccagtccgtggaggccgacgtgaacggccttaggagagtcttggatgagataactctctgccggaccgacctagagatccagtacgagacactgtctgaggaaatgacttatctgaagaaaaatcataaggaggagatgcaggttctccagtgcgcagcagggggtaacgtgaatgtggagatgaacgctgctcccggtgtcgatcttaccgtattgttaaataacatgcgagcggaatacgaagcactggctgagcaaaataggcgcgatgccgaagcctggttcaatgaaaagtcagcctcgttgcaacagcagataagcgaggatgtgggcgcaactaccagtgcccgcaacgaactgacagaaatgaaaaggaccctacagactctggagattgagctgcagagcctcctggccactaagcactccctggagtgctctctgacagagacagaatccaactactgcgctcaactcgcacagattcaagcccaaataggtgctcttgaggaacagctacatcaggttcgcacagagacggagggccagaaactcgagtacgagcagctgctcgacataaagctgcatctcgaaaaagagatcgaaacttattgcctcctgattggtggcgatgatggcgcctgtaaatcaggaggttataaatctaaagattatggatctggcaatgtcggatcacaggtcaaggaccctgccaaggcaattgttgtgaaaaaagtgcttgaagaggtggatcagaggtcgaagatactcactactaggttacactcccttgaagaaaagtctcagagtaattag

SEQ ID NO: 14369 - DNA, 2679 bp, Artificial Sequence
  Description of Artificial Sequence: Synthetic coding sequence
atggaccagcctgaggccccgtgctcttccaccggcccacggctggcagttgctagggagctgctactcgcagccctggaggaactgtcacaggagcagctgaaacggttcaggcacaaacttcgagatgtgggacctgatggacggagcataccatggggcagactggagagggccgacgctgtcgatctggctgaacagttggcccagttctacggcccagagcccgcgcttgaagtcgctcgaaagaccctgaagcgcgctgacgctagagacgttgccgcacagctgcaggagcggagattgcagcggctcgggctggggtccggaacactcctgagcgtgagtgagtacaaaaaaaagtacagggaacatgttctccagctccacgcgagggtgaaggaaagaaacgccagaagcgtgaagattaccaaaagattcaccaaactgttgatcgcccccgaatcagctgcccctgaagaggccatggggcctgctgaggagcccgagcctggaagggcaagacgaagtgatacccacacttttaacaggctcttccggcgcgacgaggaaggaaggagaccgctcactgtggttctgcaggggcccgcagggataggaaagacaatggcagccaagaagatattgtacgattgggccgctgggaaactctaccaaggacaggtggactttgcattttttatgccttgcggcgagttgcttgaaaggcccggaaccagatcactggccgatctgatcttagaccagtgcccagatagaggagcaccagtaccacagatgcttgcacagcctcagagactactgttcatcttagacggagcagacgagctcccggctctggggggaccagaagctgcgccctgtactgatccgtttgaagccgcatccggcgcccgagtcttggggggactgctttccaaagccctgctgcctacagccctgttgctcgttaccactcgcgccgccgcccctggccggctgcaggggcgcctttgtagcccgcagtgcgctgaagtgagaggtttttcggacaaagacaagaaaaagtacttctacaagtattttcgggatgaacgacgggccgagagagcttacaggtttgtgaaggagaatgagaccctgtttgccctgtgcttcgtaccatttgtctgctggatagtctgtacagtgttacgacagcaattggagttaggcagagacctgagtcgtacttcaaaaacgaccacatccgtgtatctcctgttcatcacctctgtgctgtcttcagcccccgtggctgacggtccaaggctgcagggcgacctccgcaatctttgtcgactcgccagagagggcgtcctgggacgcagggctcaattcgccgagaaggagctcgagcagctggagttacgcggcagtaaggtccaaactctttttctgagcaaaaaggaactcccgggcgtgctggagacagaagtaacctaccagttcattgatcaaagtttccaagaattcctggcggccctcagctacctccttgaagatggaggcgtgcccagaactgccgctggcggcgtcggcacgctgttacggggcgatgcccagccccattctcatcttgtgttaacaaccaggtttctattcgggcttctgagcgctgagcgaatgagagatatagagcgacacttcggttgcatggtgagcgagcgcgtgaagcaggaggccctgaggtgggtgcagggccagggacagggttgtcctggagtggcaccagaagttaccgagggagcgaagggcttagaagacacagaggaacctgaggaagaggaagaaggtgaagagccgaactacccgcttgagctcttgtactgcttatacgagactcaagaggatgcctttgtacgccaggccctgtgccgattccctgaactggctcttcagagggtcagattttgtagaatggacgtcgctgttctgtcatattgcgttagatgctgtcccgccggtcaagcactgaggctgatttcatgcaggctcgtggcagctcaggagaagaaaaagaagtccctgggaaagagactccaagcatcattgggcggaggcagctcgagccagggcaccaccaaacagctgcccgcatcgctgctacatccgctgttccaggcgatgacagaccctctgtgtcatctgtcgtctctcacgttatcccattgcaaactaccagacgctgtgtgcagggatttgagtgaggccctgagagctgcccccgctcttaccgagcttgggctgttacacaatagacttagtgaagccggcctgcgaatgctgtccgaagggctcgcttggccccagtgccgcgtccaaacagttcgtgtgcagctccccgacccccagcgggggctacagtacctggtgggcatgttacgtcagtcaccagctctcacaaccctcgatctgtcaggatgccagcttcctgccccaatggtgacttatctgtgcgccgtactccagcaccagggctgcggactgcagactttgtcacttgcatccgttgagctgtcagagcagagtcttcaggagcttcaggctgtgaaacgagccaagccagacctcgtaataacacatccagctctggatggccatccacagccacccaaggagttgatcagtactttctag

SEQ ID NO: 14370 - DNA, 1047 bp, Artificial Sequence
  Description of Artificial Sequence: Synthetic coding sequence
atgggcaaagactattacaaaatacttggtatccccagcggcgcgaatgaagacgaaattaaaaaagcttacaggaaaatggcgctgaagtatcaccccgacaagaacaaggaacccaatgccgaagagaaatttaaggagattgctgaggcttacgatgttctctccgaccccaagaaaaggggcctgtatgaccaatatggtgaggaagggctgaaaaccggtggaggtacatccggcggatcttctggaagcttccattacactttccatggggatccgcacgctacgtttgcctccttttttggtggctctaacccgttcgatatcttttttgcttcttcacgctctaccaggcccttttctggtttcgacccagatgatatggacgtcgacgaggatgaagatccttttggcgcttttggtcgctttggatttaatggactgagccgcggccctcgacgcgctccggaacccctgtacccccgcagaaaagttcaggatcctcctgtcgtacacgaactgagagtgtcgctggaagagatctaccatggatccactaagcggatgaaaatcactcggcgccggttgaatccagacggaagaactgtgcgcaccgaagacaaaatcctacacatcgttatcaagagaggttggaaggaagggaccaagataacttttcccaaggaaggagacgctaccccagataacattcccgccgatattgtcttcgtcctcaaagataaaccacacgcacatttccgcagagacgggaccaacgtgctgtactctgccctgatctcactcaaagaggccctctgtggatgcactgtgaacatcccaactattgatggtcgagtgataccactcccttgcaacgatgtcatcaagcctggcactgtaaaaagacttagaggcgagggcctgccttttccaaaagtccctacacaacgcggggacctcatagtagagtttaaagtgcgctttccagatcggctcaccccacagaccaggcagatactgaagcagcatttaccttgtagctag

SEQ ID NO: 14371 - DNA, 1899 bp, Artificial Sequence
  Description of Artificial Sequence: Synthetic coding sequence
atggatacgatgatgctgaatgtaaggaatttgtttgaacaactggtccgaagagttgaaattttgtccgagggtaatgaagtacagtttatccagctagccaaggatttcgaggacttccggaaaaaatggcaacgcactgatcacgaattgggcaagtacaaagacctcctaatgaaagccgaaacagagcggagtgccctggatgtgaagctcaagcatgctcggaaccaggtggacgtcgagataaaaaggagacagcgggctgaagctgactgcgaaaaactggaacgtcagattcaactgattcgggagatgcttatgtgcgacacaagcgggagtatccagctcagcgaggaacaaaagtctgcgctggcattcctgaatcgagggcaaccaagctccagcaacgctggcaacaagagactgtccactatagatgagtctggatctattctgtccgatataagctttgacaagactgacgagagcctggattgggactcgtcgctggtgaagacttttaagctgaagaagagagagaagagaagaagcacctcaagacagttcgtggatggcccacctgggcctgttaagaaaacccgcagtattggaagcgccgtcgaccaagggaatgagtccattgtggcaaagactaccgttaccgtccccaacgatggggggcccatcgaggcagtttctactattgaaacggtgccatactggactaggagcagaagaaagacaggaaccctccaaccatggaattccgactctactctcaacagtcgccagcttgagcccaggactgaaaccgattctgtggggaccccacagtctaacgggggtatgcggttacacgactttgtgtccaagactgttatcaagcctgaaagttgcgtgccctgtgggaaaaggatcaaattcgggaagctatccttgaaatgcagagactgcagagtggtctcccatcccgaatgtcgggacaggtgccccttgccgtgtatccccaccctgattggcacacccgtcaaaatcggggagggcatgcttgccgacttcgtctctcaaacgtctccaatgatcccgtcaatcgtcgttcattgtgttaatgaaatagaacaaagaggcttgaccgagaccggcctctatcggattagtggctgtgatcggacagtgaaggaactgaaggagaaattcttgagagtcaagactgtgcccttactgagtaaggtcgacgacatacacgcgatttgcagtttgttaaaggactttctccgcaatctgaaggaacctctcctgacattccggcttaatagagcattcatggaggcagcggaaatcacggacgaagacaattccatcgccgcaatgtatcaggcagtcggtgaactaccacaggcgaaccgcgataccctggccttcctgatgatccatcttcagcgtgtggcccagtctccacacacaaaaatggacgtggctaatttagccaaggtgttcggccctacaattgtcgcacacgcggtcccaaatccagatcctgtcaccatgttgcaggacattaagaggcagcccaaggtggtagaacgattgctgagcctccccctggaatattggagtcaattcatgatggtggagcaggagaatattgaccccctccacgtgatagaaaacagtaatgctttctccacaccccagacacccgatataaaagtgtccctgctgggccccgtgacaacccccgaacaccagctactgaagaccccttcttcgagctctctgagccagagggtgcggtctacattaactaagaatacccctagatttggtagtaagtctaagagcgccactaacctcggtcgccagggcaatttcttcgcctcccccatgctaaaatag

SEQ ID NO: 14372 - DNA, 12075 bp, Artificial Sequence
  Description of Artificial Sequence: Synthetic coding sequence
atgtcaagcgagcaagataagtcggcatctaaggaaaaatccaagaagccagtgcgtttccttccacaactatccatggaaaaacttgcaagcaaggagaagttcaaggctcccgccagagcgcttccacaactctcgatggtctcgactaagccgcattggcaacaggctgccccaagcttccacctgagtgttaagcaggacgatgagtctcccgagcccttctctgtaaagaacgagcagagccacgctgagtacatggaaagatttgggaaaaagggtaagctgccccaccaggttgacgattcttatgtgggtccctccacctctaagtctaaggggaaaagcccacataaagaacgagaaaacttccgttccactctcgtgaatgtaatcatgcaacaggatgcagatctcgatagcgcggtgccagacggaagtaccataccaaaacccacagctagcgctatcgagaaggatattctacgctactactattatatccaccatgggatcgacactgaccacgtcgctcctatggaagacagctggttggaacacgttctcgacttagtcccccagcaccttaaggtctttaccgactccatagtcaccttgtccgacgagatgagggaagactaccttctgagcgtcagaaagagtattgtggatttcgtgctaaaggacccgcgcgagaaaggggatgataagaaaacagatgagctgcccgcacatcgggcggaaatggagattctgcccaagccttggcgcaaatcgttcctcgccgccagctcatacataagagatcatctaaacgcaatgaatccaacaatgcttgccgttctggacttatggcatactaacttcaagaaactccgactggtggatataaaggaatttcataactgtcaggacgctctggaactgtcttccttccaaaacatcatcatgagacacatggacagcgccaaagaaaccttactgaaaatgtggttccccgaggtgcagaacatctactaccaggggaacaagaaaaaacagttacctacaggggatagctcagctaagttagaatctttcttcaattgcgccgcagccctgatgactttgcagttgcaggatcttacccttgtctctatgcaggacttcacagacctgatcgctcaaccccccgattcagtgcgcgcctttgagcatcccggatttatcatgaggctgattcttgacaacgatactatcaagtttgagcccgagctgagcgactacattgatatattcctaaacgtgtacgatgtgatgataaaagctgtaagtttcgtaccccgcgtcgagacaaagctgtatagcaagtgggaatctaagtctaagcccacgacgctgaagcccattatcctgaacgagatcgtcgatgctcataaggagaagataaaggaagtgattatgaaagagagcgtcgctcctacagaacatctccggctgtacgacaaatatgattttctcattacacgaaaagccgagcgcgacgtcgacaatttcctcgctgagaaccatagttatgagaagatcattgatgagatctgcaagtaccagaagctgatcgaggagatccagtatacttcaattaagaccatacgcttgggtatgttcgaaatgcactgcgaggagcttatccgcgccctggtaaaacgtgccgacattatttgtgggaaattgcttgcaaagatgtttcgtgatcatcaagaagtgaacacacgcctctgcgatgagttcgaacggattgctgagaaagcattgtcaacaccccccaacacagcagaactgatggagatgaaggcctacatccagaaggtggaggtgacagatatgatcgagctcgaacaacggctggtggactctaagaactgtcttgcttttctgatcgaatatgttaacttctctccagcagatatgcggctcaataacagtgtattccagtggtacggaagaatgggcgagatcttcgaagaacatagaaaaataattaaggagaaaattgagcaatatcaggaaggtctcaagttaagatgtgagcgcttcgttgaagagttagagagctatgctaagcagtcagaggagttttactcgttcggagatctacaagacgtgcagcgttacttaaagaaggcacagatccttaatggcaagttagacctggctgctgacaagatagagcaattcaacgctgaagaggaagctttcggctggctgccctccgtgtacccccaaagaaaaaagatccaggacggcctaaacccttacttacgcctctacgagactgctgtggaattctccagtaactacagagcatggacagaggggccttatcacaaagttaatcccgaccaggtagaagcagacattggaaactactggcggggactgtacaaacttgagaagacctttcatgattccccgtacgctctggctatgaccaaaaaggtgcgtagcaaggtcgaagattttaaacagcacatacccctgatccaggtcatctgtaatccgggactgaggccgcggcattgggaagctatgagtgcaattgtcggataccctctgcagccgtccgacgacagtaccgtgtctagttttctcgacatgaacttggagccatacatagacagattcgagggcatctccgaagcagctagcaaggagtattcccttgaaaaagcgatggaaaaaatgatcaccgaatgggatgctgtggagttcgtcattcactcttaccgggagacagggacttttattcttgcatctgtcgatgagattcagatgctgcttgacgatcatatcataaaaacccagactatgagaggctcacctttcatcaagccctatgagaagcagatgagagaatgggagggcaagcttctccttctgcaagagattctggacgagtggttgaaggttcaggctacctggctgtacctagagcctatcttcagctctccagacatcatgtcgcagatgcctgaggaaggaagacggtttaccgctgttgacaagacttggcgggatattatgcggtctgtgatgcaggacaagcacgtgctcaccgtggttaccattgaccgcatgctcgaaagactcaaaaagagcaacgaactgctggagctgattctgaaaggacttaacgagtatctggagaaaaagagactgttttttcctagattctttttcctgtccaacgatgaacttcttgagattctaagcgagaccaaagatcctacccgggtccagccccacctcaaaaagtgcttcgagggcatcgccaaagtggagttcactgagacgctggatataacacacatgaaatcaagcgaaggagaagtcgtggaactgattgagataatatctaccgccaaggcaagaggccaggtcgagaagtggctagtggagctcgagcgtgtcatgataaactctatccacaaagttacaggcgacgccaccttcgcttacactaaatacgaacggatcaactgggttcgggactggcctggccagacagtgctgtgcgttagccaaatattttggaccaaggaggtccagacggccatccccatggggatcaaggcattagagcagtatctgaagacctgtaaccgacagatcgacgatatcgtgactctcgtccgaggcaagctgtccatgcagaaccgcgtcacgctgggagccctggtggtcctcgatgtccacgctcgggacgtgctgagcagcctggttaagaagaatatttcagatgactctgatttcgagtggctgtcccagctgaggtattactggcaggaaaaccatctggagactaagatgatcaacgcaggactcaggtacggctacgaataccttggcaatagccccagacttgtcattacaccccttaccgaccggtgctatagaaccctgttcggggctctccacctgcatcttgggggtgcaccagagggtcccgccggaaccggtaaaacagagaccacgaaagatctggctaaagccgtggctaagcagtgcgtggtgttcaattgcagcgacggcctcgactatctggccctgggtaagttttttaagggccttctgagctgtggggcatgggcctgctttgacgagtttaataggattgacctcgaagtgttgagtgtagtagcgcaacagattttaactatccagaggggcatcaacgctggcgcggacatcttaatgtttgagggaacagagctcaagctagatccaacctgtgccgtgttcatcacgatgaatccagggtatgccggaagaagcgaactccccgacaacttgaaggctctcttcagaacagtagctatgatggtccctgactatgctatgatcgctgaaatagtgctctattcatgcggatttgttaccgctagaccactgagtgtgaagatcgtcgccacttacaggctgtgtagcgagcagctgagttcccaacatcactacgattatgggatgagggctgttaaatcagttctcactgctgcagggaatttgaaattgaagtacccaaatgagaacgaagaaatcctcctgctgagaagtatcatcgacgtgaatttaccaaaatttctgtcgcacgacctgccgttgtttgaaggcatcacaagcgatctgtttcccggcgttaaactacccaaaccagactacaacgatcttctagccgccatcaaggataattgtgctagcatgaacctgcagatgaccgctttcttctccgaaaagattcttcaggtatacgagatgatgatagtgaggcacggcttcatgatcgtgggagagccattcggtggaaaaacaagtgcctatagggttctcgctggagctctgaatgatatctgcgaaaaaggcttgatggaagaaaataaagtccagatcactgtgttaaatcccaaatcagtcaccatgggccagctctacggccagtttgacagcgttagtcatgaatggagcgatggagtactggccgtgagcttccgtgctttcgcttcaagcgttacccctgacagaaagtggctgatcttcgacggaccagtcgacgctgtctggatagaaaacatgaatacagtcctagacgacaacaagaaattgtgtctgatgtccggtgaaatcatccagatgagtccacaaatgaatttaatcttcgagccgatggacctggaggtcgcttcaccggccacagtttccaggtgcggaatgatttacatggaaccacacatgctcggttggaggccacttatgctcagctgggtcaaccttcttcccgccagtgtcagcgtcatccagaaagagttcataatgggcctcttcgatcgtatggtgccggtgagtgtcgaattcattaggaaacacacaaaagaactgtcccctacatcagacaccaacctcgtgcgctctcttatgaacctgatagattgctttatggacgatttcgccgacgaagtaaagctaaaggaacggaacgatcgagaaacgtatagtttgctggaaggaattttcctgttcagtctgatttggtctgtgggtgcaagttgtacggatgacgacaggttaaaattcaacaagattctgagggagctgatggagtccccaattagtgaccggacccggaacacctttaaacttcagtctggcactgagcagacttctagcaaagctcttaccgttccttttcccgagaagggaaccatttatgactatcaattcgtgactgaaggcattgggaaatgggagccatggattaagaaactgaaggaagcaccccctatcccgaaagacgtaatgttcaacgaaatcatcgtgccaacacttgacactatacggtattcagcgttgatggagctgctcacaacacaccagaaaccttccatattcgtgggcccgacagggacaggcaagtccgtgtacatcactaacttcctgctcaaccagctgaacaaggaaatttacaaacctttactcataaattttagtgcgcagacgaccgctgcgcagacacaaaacattgtaatgtctaagttggacaagcgcaggaaaggtgtattcggaccccctttgggcaagaggatggttgtattcgttgacgacgtgaatatgccggcgcgagaagtctacggggcgcagccccccatcgagttgctcagacagtggctagaccactggaattggtatgacctgaaagattgctcaatgataaagctggtggacattcaaatcatgtgtgcaatggggccaccgggtggcgggaggaaccccgtcaccccacgctacatgaggcacttcaacataatcaccatcaatgaattctcagacaagagcatgtacactatcttttcccgcattctgacatggcatttagagatatgctataagtttcccgatgaattcttagacctgacgacacagatcgtgaacggtacaatgactctgtataaggaggctatgaagaacctgctccctacacctgcaaagagccactatctgtttaaccttagggacttctctcgtgttatacaaggcgtgtgcctgagtcgccctgaaaccacggagaccacagaagtcatcaagagactgtgggtgcacgaggtgctgagggtgtattacgaccgcttgctcgacaacacggatcggtcttggctaattaattacatccaggagatcctcaggaattacatgtacgaggattttcatgaactcttccaacgactcgatttcgacaatgacggcatggtcgaagctgacgatctgcgatcattaatgttttgtgactttcacgatcccaagcgggaagatacaaactatcgcgagattgcagacgtggataatctgcggatgattgtcgagatccacctcgaggaatacaacaatatttcaaagaagccaatgaacctcgtgctgtttagatttgcaatcgagcacatctcccgcatctctcgtatcttaaagcagccccgctcccacgccctgctcgtcggcgttggcggatccggaaggcagtcagtgactcgcttagcagcccatatggccgattattctgtgtttcaggtggaaatctctaagggatatgacacaacggagtggcacgaggacctgaaggtcatcctgcggaaatgcgctgaaggtgagatgcagggcgtatttttgttcactgatactcagatcaaggaggagagctttctggaggatgtatccaacctgctcaacgccggagagatcccaaacctgtttgcactagatgagaaacaggaaatctgtgacaagatgcggcagctggacagacagagggataaaaccaagcaaaccgacgggtccccaatagcactctttaacatgtttattgatcattgccgttctcagctgcatgtagtcctggccatgtctccgatcggtgacgcattccgcaatcggttacggaaattcccagctttggtcaactgctgcaccatcgactggtttcaaagttggcccgaggatgcgctccaggcagtggccagcaggttccttgaggaaatagagatgagtgaagagatcagggacggctgcatagatatgtgcaaatccttccacacctccacaattgatttgagtaagtctttcttcgtcgagctccagaggtacaattatgtcaccccaacgagctatttagaactcataagtacttttaagctccttctggagaagaagcggagcgaagtcatgaaaatgaagaagcgatacgaggtgggtcttgaaaagctagactccgcctcgtcccaagtcgcaaccatgcagatggagcttgaggcactgcaccctcagctgaaagtggcatccaaggaggtggacgagatgatgattatgattgaaaaggaaagcgtggaggtagcgaagacggaaaaaattgttaaagcggacgaaaccatcgccaatgagcaggctatggccagcaaagctattaaggatgagtgcgatgcggacttggcgggtgcattgcctatactcgaatcagcccttgccgccctggatactttgacagcccaggatattacagtggtgaaatcaatgaagtctccacctgcaggcgtaaagctagtgatggaggccatttgcattttaaagggcatcaaagcagataaaattcctgaccctactgggtccggaaagaaaattgaagatttctggggccccgctaagcgtctcctgggagacatgcgatttcttcagtctttgcatgagtacgataaggacaacatccctcccgcctacatgaacatcattcgcaagaactatatacccaatcctgacttcgtcccggaaaaaatcaggaatgcatctaccgccgcggagggtctctgtaaatgggtcattgccatggactcctacgataaagtggccaaaatcgtggctcccaagaaaatcaaacttgctgccgcagagggggagttaaagatcgcgatggatggattgaggaaaaaacaggcggcccttaaagaggtccaagacaagcttgctcggctgcaggatactctggagctgaataaacagaagaaggctgaccttgagaaccaggtcgatttatgctctaagaagctggaacgtgcagagcagttaatcggaggactggggggcgagaaaaccagatggtctcatacggcccttgagctggggcagctgtatatcaatctcacaggcgacattctgatcagtagcggtgtcgtggcatatcttggcgcatttacttccacgtacaggcagaaccaaacaaaagagtggaccactttatgcaagggacgcgacattccctgctccgatgactgctcgctgatgggaacgttgggcgaagctgtgaccatccgcacctggaatatcgctggcttgccctcggactctttctccatcgacaatggcatcattatcatgaatgccaggcggtggcccctgatgatagatccacagagccaggcaaataaatggattaaaaatatggaaaaggccaactcattatacgttataaagttgtcagaaccagattacgttcggactctcgaaaattgcatccagtttgggactcctgttctgttggagaatgtaggagaggagctggacccaatcctcgaacctctgctgctgaaacagacctttaaacaagggggaagcacttgcatacgcctgggtgatagcactattgagtatgcaccggactttcggttttatatcacaacgaaactgcggaatccgcactacctgcccgaaaccagcgtgaaggttaccctgcttaactttatgatcacccctgagggcatgcaggaccagctgctgggcatcgtggtagcgcaggaaagacctgatttagaggaagaaaagcaggccttgatccttcaaggggccgaaaataaaaggcaactcaaagagatcgaggataagatcctggaggtgctgagttcatccgaggggaatatactggaggacgaaacggcaattaagatactaagttcttctaaggctcttgccaatgagatcagccagaaacaggaagtggcagaagagacagaaaaaaaaattgataccacacggatgggctatcggcccatcgcaatacattcctccatcctcttcttcagcctggcagacctcgcgaatatcgaacctatgtatcagtattctcttacatggtttataaacctgttcatactatccatcgaaaacagcgaaaaaagtgagatcttggctaagcggctgcaaattttaaaggaccatttcacctactccctgtacgtgaacgtttgcagaagcctgtttgagaaggacaagctcctgttcagtttctgtctaactattaatcttcttctgcatgaacgcgcaatcaataaggccgaatggcgctttttgctgacggggggaattgggctcgacaacccttatgcgaatctctgtacctggctgccacagaagtcctgggatgaaatatgcagactcgacgaccttcccgcctttaagaccatccgccgggaattcatgcgactgaaagatgggtggaagaaggtctatgattctttagagcctcaccatgaagtgttcccggaggaatgggaggacaaagccaacgagtttcaacgcatgctgattattagatgcctcagaccagataaggtgatcccgatgcttcaggaattcattatcaaccgcctggggcgcgcattcatcgagcccccaccttttgatcttgcgaaggcatttggggacagcaactgctgtgccccactcatctttgtcttgtcccctggggccgatccgatggcagcactgctgaagttcgctgatgaccagggttatggcggcagcaaactgtcctccctctcgcttgggcagggtcagggacccatcgcgatgaagatgctcgagaaggccgtaaaggaaggcacctgggtagtgctccagaactgtcacctggctactagctggatgcctaccctcgagaaggtctgcgaggaactttctcctgaaagtacacacccagattttaggatgtggctgacaagctaccctagtcctaactttccagtttcagtgctgcaaaacggggtgaaaatgactaacgaggcccctaaaggactgcgggctaacattatccggtcataccttatggatccgatttccgaccccgagttttttggctcgtgtaaaaagccggaggagtttaagaagttactctacggactgtgttttttccatgctctggttcaggagagacggaagttcgggccacttggctggaacattccttacgaattcaatgagactgacctccgcatttcggttcagcagctgcacatgttcttgaatcagtatgaggaacttccatatgaagcgctacgctacatgacaggcgagtgcaattatggtgggcgggtcaccgatgactgggataggcgcactctgcgcagcatcctcaataagttttttaatccagagctcgttgagaactccgactacaaattcgatagctctggaatttactttgtgccacctagcggcgaccataagtcttacatcgagtatacaaagacactgccgcttactcctgcccctgagattttcggtatgaacgccaatgccgacattactaaggaccaaagtgaaactcagttgctcttcgataacattctgctgactcagtcaaggagcgccggggccggtgcaaaatcttccgatgaagtggtgaacgaggttgctagcgacatcctcggtaaattgccaaacaacttcgatatcgaagcggccatgaggcggtaccctaccacctacacgcagtctatgaacacagttctcgtacaggagatgggacgcttcaataaactgcttaagaccattcgtgattcctgcgtaaatatacagaaggccatcaaaggtctggccgtgatgtccacggacctagaggaagttgtgtctagtattctgaacgttaagattcctgagatgtggatggggaagtcctatccaagcctgaagccattggggtcatacgttaatgactttcttgccaggctgaagttcttacagcaatggtatgaggtgggtcccccaccagttttttggctgtccggatttttcttcacacaggccttcctgaccggggcacagcagaattacgcccgtaagtacaccatacctattgacctgctgggattcgattacgaagtgatggaggacaaagagtacaaacatccccctgaagatggtgtattcatccacgggctgttcctcgatggggcgtcctggaaccgaaagataaagaaattagccgaatcacatcccaaaatcttatatgacacagtgcctgtgatgtggcttaagccttgcaagcgggcggatattcccaaacggcccagctatgttgccccactctataagacttcagagaggcggggggtcctctctaccactggccacagcaccaatttcgtcatcgctatgaccctgccctccgatcagcccaaggaacattggattggccggggcgtagcactgctgtgccaactgaactcgtag

SEQ ID NO: 14373 - DNA, 1506 bp, Artificial Sequence
  Description of Artificial Sequence: Synthetic coding sequence
atgtcctcccggcaggacaagagtgcctccaaagaaaagtccaagaaaccagtgcggttcctgccccagctcagtatggagaagctggctagtaaagagaaatttaaagcgccagcaagggcccttcctcagctgtctatggtgtcaactaagccccactggcaacaggccgccccatccttccatctgtccgtaaaacaggacgacgaatctccagagccattctccgtgaagaacgaacagtcccacgctgagtatatggaaagatttggtaaaaaggggaaactcccccatcaggtggatgacagctatgtgggcccttctaccagtaagagtaagggcaagtcacctcataaagaacgcgagaactttcgtagcaccctagtcaacgtgatcatgcaacaggacgcggatctagactcggctgtgcccgacggctcaacaattccaaaaccaaccgcctccgcaatcgaaaaagatattctcagatactattactacatccatcacggtattgacacagaccatgtggcaccgatggaagatagttggctcgagcacgtgttagatcttgtgcctcagcatttaaaggtgtttacagatagtattgttaccctgtcagatgagatgagagaagattacctgctcagcgtgaggaagtcaatcgtggactttgtgttaaaggacccgagagaaaagggagacgataagaagacagatgagctgcccgcccatagagcagagatggagatcctgcctaaaccatggcgcaagtccttcctggccgcctccagctacataagagaccatttgaatgctatgaatcctaccatgctcgcggtgctcgacttgtggcatacaaacttcaagaagctcaggcttgtcgacatcaaagaatttcataactgtcaggacgctctggaactcagctccttccaaaacatcataatgagacacatggacagtgctaaagaaactctgctgaaaatgtggtttcctgaagtccagaacatctattaccaggggaataaaaagaaacaactcccgaccggcgattcaagcgcgaagctggagagtttctttaattgtgccgctgcgcttatgaccctccagttgcaggacctgacattagtttccatgcaggacttcaccgatctcatagctcagcctccggacagtgtcagagccttcgagcacccggggttcattatgcgcttaatactcgataatgatactataaagtttgagcctgaactctccgactacatagatatctttttaaacgtgtacgatgtgatgatcaaggcggtttctttcgttcctcgagtcgagacgaagctgtacagcaagtggagaaacaaggcaaagcccgggcatttctactttagccacatacagaggtctgtcacatttcagcacagcgaggtgagttctcctcagaactcccatttcaaaatagtgtcgcccttttccgtgctaggtttcacttggagatgtcagctttag

SEQ ID NO: 14374 - DNA, 840 bp, Artificial Sequence
  Description of Artificial Sequence: Synthetic coding sequence
atggccgcacctgtgaggcgaacgctgctgggtgtggccggcggctggcgcaggttcgagcggctgtgggccgggagcctatcctcacgaagccttgcactggctgccgcacctagttctaatgggagcccgtggaggttgcttggtgcactctgcctgcagcgcccgcccgtggtgtctaagcccctgacaccactacaggaggaaatggcaagtctcctacaacagatcgagattgagcgaagtctgtacagcgaccatgagcttcgagcactggacgaaaaccaaaggctcgctaagaagaaggctgacctgcacgatgaggaggacgaacaggatatactgcttgctcaggatctggaagatatgtgggaacagaagttcttgcagtttaagctcggggccagaataactgaggcagatgagaagaacgataggacctctctgaataggaagctggatcgaaatttggtgctgttggtccgggaaaaattcggagaccaggacgtgtggatcctgcctcaagctgagtggcagcccggtgaaactcttcgaggtacagctgaacgcaccctagctacgctcagcgagaataatatggaggccaagtttctggggaacgcaccatgcggccattacacatttaagttcccccaagcaatgaggacagaatccaacctgggtgccaaggtgttttttttcaaggcgcttctgctgaccggtgacttcagccaagcaggaaataaagggcatcacgtgtgggtcactaaggatgagcttggggactacctgaagcccaagtatctcgcccaggtccggagattcgtgtcagatctgtag

SEQ ID NO: 14375 - DNA, 609 bp, Artificial Sequence
  Description of Artificial Sequence: Synthetic coding sequence
atggaagccgaagcaggtggattggaggagctcacagacgaagaaatggcagcactgggcaaggaagaacttgtgagacggctgagaagggaggaggcagctcgactcgcggccctggtgcagcgcggcaggctgatgcaagaggtgaacagacagcttcagggtcacctgggcgagatcagggaattgaagcagctgaaccgtcgactccaggccgagaaccgagagttgagagacttgtgctgctttttggacagcgagcgacagcgtgggaggagagcagctcgccaatggcagctcttcgggactcaggcgtctcgagccgtccgcgaggacctcggcggttgctggcagaaactggctgagctcgagggccgtcaggaggagctcctacgagagaacctggctcttaaggagctgtgcttggccctgggagaagagtggggcccaagaggcggcccttccggtgccggagggagcggcgcaggccccgcgccggaactggctctgccgccatgtgggcctagagatctgggggacggtagttcgtccaccgggtccgtgggctcgccagaccagctgcctttagcctgctcaccagacgattag

SEQ ID NO: 14376 - DNA, 1353 bp, Artificial Sequence
  Description of Artificial Sequence: Synthetic coding sequence
atgagggagtgcatttctattcatgtaggccaggctggagtgcaaattggaaatgcctgttgggaactgtattgcctggagcacggcatccaacctgacgggcaaatgccctccgacaagactattggtggaggcgacgactccttcaataccttctttagcgagactggcgctggcaaacatgtgcccagagccgtgttcgtggatcttgagcccactgtggtggacgaggtccggacaggcacatacagacagctgtttcaccccgagcagctgatcaccggaaaggaagatgccgcaagcaactatgcacgcggccattacacaattggcaaggaaattgtggatttggtgctggatagaattcggaagcttgccgacctgtgtactggattgcagggttttctcatcttccattctttcggtggagggactggctccggattcgccagcctcctgatggaacgtctcagcgtggattactcaaagaagtcaaaactggagttcgctatctatcctgcaccccaggtgagcacagccgtcgtggagccatacaattccatcctcaccacccacactacactagagcatagtgattgtgcattcatggtcgacaatgaggccatctacgacatttgtaggaggaatttagatattgagcggcctacctacacaaaccttaataggctgatcggacaaatagtctctagtatcacagcctcactgagattcgatggggccctaaacgtcgacctgaccgaattccaaactaacttggtgccttatccacggattcacttcccgttggcaacctatgcgcccgtgataagcgctgagaaggcttaccacgaacagctatctgttgcggagattaccaacgcatgtttcgagcccgccaatcagatggtgaagtgtgaccctcgccacgggaagtacatggcatgttgtatgctttatcgtggtgacgttgtacctaaagacgtaaatgcagccattgccacaatcaagactaagcggacaatccagttcgtagattggtgcccgactgggtttaaggtcgggatcaattatcagcctcccacggtggtcccaggtggagaccttgctaaggtccagcgggcagtgtgcatgttgtctaatacaactgccattgcagaagcttgggcgcggttggtgcacaaatttgacctgatgtatgcaaaatgggcttttgtacactggtacgtgggtgaggggatggaggagggtgaattctcggaagctagagaggatctggccgctctcgagaaagactgtgaagaagtcggcgtagacagtgtcgaggctgaggcggaggaaggcgaggcctattag

SEQ ID NO: 14377 - DNA, 3078 bp, Artificial Sequence
  Description of Artificial Sequence: Synthetic coding sequence
atggtggctatggccgaggctgaagctggagtggctgtagaagtacgaggactgccacccgccgttccagatgagttgttgactctctactttgaaaaccggcggcgctctggcggaggacccgttctgtcctggcaaaggctgggttgcggcggcgttttaacatttagagagccggcagatgccgagcgggtacttgcacaggctgaccatgagctccatggtgctcagctctctttgaggcccgccccacccagagctccggcccgtctcctcctgcaaggactccctcccggtacaaccccacagaggctggaacaacatgtccaggctctgctcagggcctcaggtctgccagtgcaaccttgttgcgcccttgcctcaccacgacccgacagggccctcgtgcaactgcctaaacccctgagtgaagcagacgttagggtactggaggagcaggcgcagaatctgggactggaaggcactctcgtatcactggctcgcgtgccacaggctagagccgtgcgagtggtgggcgacggggcatccgtggacttgttactgctggaattgtacttagaaaatgaacggcgctcaggaggaggaccattggaggacttgcagcgcctgcctgggcctctgggaaccgtagcgtctttccagcagtggcaggttgccgagagggtgctgcagcaagagcataggctgcaaggttccgagttgtcactggttccccattatgatatcctcgagcctgaagagttggccgagaatacctcgggcggtgatcacccctctactcaaggcccgcgggcaacaaagcacgccctgttgcgcacgggaggcctcgtgacagccctgcaaggagccggcacagtgaccatggggagcggcgaggaaccgggacagagcggggcgagcctgcggactggtcccatggtgcagggccgggggattatgacaacaggtagcgggcaagagcccggacagagcggaacgtccttgcgtacaggtccaatggggagtctggggcaggccgagcaggtctcaagtatgcctatgggcagcttggaacacgaagggctggttagcctgcgccctgttggcctgcaggagcaggagggcccaatgagccttggtccagtgggcagcgccggtcccgtcgagacgtcaaagggcttgctgggccaggaaggcctcgtggagattgcgatggacagtcccgagcaggagggacttgtgggtcccatggagatcactatgggctcgctggaaaaagctgggccagtgtcccctgggtgtgtgaagttagccggtcaggaaggattggtggaaatggtgcttctaatggagccgggcgccatgcgctttttgcaactgtatcacgaggacctcctggcaggactcggcgacgttgccctacttccgcttgagggtcccgatatgaccgggttcagactgtgcggagctcaagcgagttgccaggcagcggaggagttcctgcggtcattgcttggaagcatttcctgccacgtcctgtgccttgaacacccaggatccgcgcggttcctcctggggcccgagggtcagcatctgctacagggtctggaagcccagtttcagtgcgtgttcgggactgagcgattggccactgccaccttggacaccggactggaagaggtggaccctactgaggcactgccagtgctgccgggtaacgcccataccctgtggacgccagactctaccggaggggaccaggaggatgtgagcctcgaggaagtccgagagctgctggccactttggaaggactggacctggacggtgaagattggttgcctagagaattggaggaggagggccctcaagaacagccagaggaggaggtgaccccaggccacgaagaggaagaacctgttgcgcccagcacagtggccccccgctggctggaggaagaggcagcccttcagctggccctgcaccgatcactcgaaccacagggccaggtggccgagcaggaggaagccgcagctctgagacaagcactaaccctctcattgctagaacagcccccactagaggccgaggagccacctgacggaggaacagacgggaaggctcagttagtggtacacagcgccttcgagcaagatgtcgaggaattggatagggcccttagggccgccctggaagttcatgtacaggaggaaacagtgggcccctggaggagaacgctgcctgcagagctgcgagccagactggaaagatgccatggcgtaagtgttgctcttcggggtgactgtaccatcttgagaggttttggagcacatcccgcgcgggctgcacgtcatctggtcgccctgcttgcggggccatgggaccagtccctggcgtttcccctggccgccagtggccctacactcgcgggacaaactctgaaggggccctggaataatctcgagaggctggctgaaaatactggagagtttcaagaggtggtgcgagcattctacgacacgcttgatgctgcaaggagttcgattagagtggtgcgagtagaacgcgtgtctcaccctcttctgcaacagcaatatgagctgtaccgggaaagactgctccagaggtgcgaacgacggccggtagaacaggttctgtaccatggcacaaccgcccccgccgtgcctgatatatgcgcacatggattcaacaggtctttttgcgggagaaatgcaacagtttacggcaagggagtttattttgctcggagggcgagtctgtctgtgcaggataggtattcgcccccgaatgctgatggccataaagctgtatttgtcgctagagtgcttacaggcgattacgggcaaggtcgacggggcctcagagctcctcctttacgaggtcctggccacgtcctgctcagatatgatagtgccgtggattgtatttgtcagcctagcatcttcgtgatatttcatgatacccaggctctgccaactcatcttatcacttgcgaacatgtgccccgggcaagccctgatgatccgagcggactgcctggccgctcccccgatacttag

SEQ ID NO: 14378 - DNA, 390 bp, Artificial Sequence
  Description of Artificial Sequence: Synthetic coding sequence
atgtcacatctgcagtcactattgctggacacactcttgggtaccaaacacgtggacagcgccgccctgattaagatccaagagcggtcactgtgcgtggcctcacccggattcaatgtaaccccatctgacgtgcggaccctggtgaacggattcgctaagaatccactgcaggcccgcagagaaggactgtactttaagggcaaggactacaggtgcgtgcgcgccgatgaatattctctatatgctaagaacgagaacacaggcgtagttgtcgtcaaaacccacttgtaccttcttgtggccacctacacggagggtatgtatccttccatttgtgtcgaggccactgaaagcttgggtgattaccttcgcaagaaaggatcctag

SEQ ID NO: 14379 - DNA, 945 bp, Artificial Sequence
  Description of Artificial Sequence: Synthetic coding sequence
atgctaggcaagggcggaaaacggaagttcgatgagcacgaggatggactggaaggcaagatcgtcagcccatgcgatggaccatccaaagtgtcttatacactacagcggcagacgatcttcaatatttctctcatgaagctgtataaccatcggcccctaaccgagccgtccctccagaagacagttttaattaataacatgttgcggagaatccaggaagaactgaaacaagaggggagcttgcgcccaatgttcactccttccagtcagccaaccactgagccaagtgactcgtacagagaagccccacctgccttttcccatctcgcttcaccctcttcacacccctgcgatctgggctcaactacaccactggaagcttgtcttacaccagcctccctccttgaagacgacgatgataccttctgtacgtcacaggcaatgcagcccacggctccaacgaagctgtctcctcccgccctgctgcccgaaaaggactctttttcgtccgctttggatgagattgaagagttgtgcccgacaagcacctctaccgaagccgctacggccgccacggacagcgttaaaggcacctcgagtgaagctggcacacaaaaattggacggccctcaggaaagccgagcggatgactcgaagctcatggactcactgcctggtaatttcgagatcactacttcgacaggctttctgacggatttaactctcgatgatatactgttcgccgatattgatacgagcatgtatgatttcgacccatgtacttccagctctgggacggcaagcaaaatggctcctgtctctgccgatgacctgctgaagacccttgccccatacagcagccagcccgtgaccccgagccagcctttcaagatggacctcacagaactcgatcacatcatggaggttctagtaggcagctag

SEQ ID NO: 14380 - DNA, 246 bp, Artificial Sequence
  Description of Artificial Sequence: Synthetic coding sequence
atgaagggcagcaggatcgaattgggtgacgtcacaccacataacataaagcaactcaaaagactgaaccaagtgatttttccagtaagctataacgacaaattttataaaaagttcggattcgagatcattgaaaccaagaaaaattactacaaacgcattgaacccgccgacgctcacgtgctgcagaagaatctgaaagttccatccgggcagaatgctgatgtccagaagactgacaattag

SEQ ID NO: 14381 - DNA, 1437 bp, Artificial Sequence
  Description of Artificial Sequence: Synthetic coding sequence
atggcgagcgctaccgaggacccagtgctggagcgctacttcaagggccataaggcagcaataacatcccttgatctgagtcctaacggcaagcaactggccactgcttcctgggacacttttctgatgctctggaactttaagccacacgcgagggcttaccgctacgtgggtcataaagacgtggtgacctccgtgcagtttagcccacacgggaacttactggccagcgcaagccgagaccgtaccgtgcggttgtggatcccagataaaaggggtaaattcagcgagttcaaagctcacaccgctcccgtcagatcagtggatttttctgcagatggccagtttcttgcaacggccagcgaagacaagagtattaaagtgtggagcatgtataggcagcggtttttgtactctctctacagacacacacattgggtgaggtgtgccaagttctctcctgacggacgcctgattgtctcatgctcggaggataaaaccataaaaatctgggacactaccaataagcagtgtgtgaataacttttcagattcagtggggtttgccaactttgttgatttcaatccgagcgggacctgtatcgcatctgccggcagcgatcagacagtcaaggtctgggacgtacgagtcaataagctgctgcagcattatcaggtccattccgggggcgtgaattgcatttcttttcaccccagcggaaattacttaataactgctagcagtgatggaaccctcaaaattctcgatctgctcgaaggtagactaatctacactttgcagggccacactgggcctgtctttaccgtgtcatttagcaagggcggggaactgttcgctagcgggggagctgacactcaggtgcttctgtggcgcactaattttgacgaactgcattgcaagggtctaactaagagaaatctcaaaagacttcacttcgattctcctccccacctgttggatatataccccagaacccctcatccacacgaagagaaagttgagactgtcgagattaaccccaagctggaggtcatcgatttgcaaatttctacccctcctgtgatggacatactgagttttgattcaactaccactactgaaacatcaggtaggacactaccggacaagggcgaagaggcgtgtggatacttcctaaatccatccctaatgtccccagaatgtctcccaaccaccactaaaaaaaagactgaagatatgtccgacctcccttgtgaatctcagaggtcaattcccctagccgtgacagacgccctggaacatattatggaacaattgaatgtgctgactcagacggtaagcatcctggagcagcggctcaccctgacagaggataagctgaaggattgcctggagaatcagcagaaactgttttctgctgtgcaacagaagagttag

SEQ ID NO: 14382 - DNA, 1263 bp, Artificial Sequence
  Description of Artificial Sequence: Synthetic coding sequence
atgctgaaggccgtcattcttattggtggaccccagaagggaacccgcttcagacctctgagcttcgaggttcctaagcctttgtttccggtcgctggggtaccaatgatacaacaccacatcgaggcatgtgcccaagtccctggtatgcaggagatacttctcatcggcttttatcaaccggacgaacctctcacacagtttctcgaggcagcccagcaagagttcaacctgccagtgcgatatctgcaggaattcgcacctctcggcaccggaggaggactctatcatttcagggatcaaatccttgcaggctcccccgaagcgttcttcgtgctgaacgcagacgtatgctctgatttcccactgtcagccatgctagaggcacaccgccggcagcgtcacccctttctgctcctggggaccaccgccaaccggacccagagcctgaattacggatgtattgtggagaatccacagactcatgaagtgctccactatgtcgaaaagccctctaccttcataagcgatatcatcaactgtggcatctacctcttttcacctgaggccctcaagcccttgagagacgtgttccagcggaaccagcaggacggtcagttggaagattcacccgggctgtggcccggggctgggactattcgactcgagcaggatgtgtttagtgccctggcaggtcagggccaaatttacgtgcacctcactgatggaatctggtcacagattaagtccgccggatcggctctatatgcttcaaggctttatctgagccgatatcaggacactcacccagagaggctggccaaacatacccctgggggaccctggattaggggcaatgtttatatccatccaacggcaaaggttgcaccaagcgcggttctcggtcccaatgtctccatcgggaagggcgtgacagtgggagagggcgttcgcctcagagagagtatcgtgctccacggagcaacactgcaggaacacacctgtgtgctccattccatcgtggggtggggctccaccgtcgggcggtgggcacgggtggagggcaccccttctgaccccaacccgaatgacccgagagcccgcatggattccgagagcttgttcaaagacggcaaattgctgcctgccataacaatactaggatgtagagtcagaattccagccgaagtgctcatcttgaacagcatcgtgctgcctcacaaggagttgtccaggtcttttaccaatcagatcattctgtag

SEQ ID NO: 14383 - DNA, 1215 bp, Artificial Sequence
  Description of Artificial Sequence: Synthetic coding sequence
atggatcaggattacgaaagaaggctcctccgccagattgttatccagaatgaaaataccatgccacgcgtgacagagatgagaagaaccttaactcccgcaagttcacctgtctcctcgccatctaaacacggagaccgatttatcccatcaagagccggagcaaattggtctgtgaacttccatcgcataaatgagaacgaaaagagtcctagccagaatagaaaggctaaggacgctacttccgacaacggaaaggacggcctggcctatagtgccttgctgaagaatgagctcctcggggcgggcattgagaaggtgcaggatcctcagacagaagaccggcgacttcagccatcgacccctgagaaaaaaggactctttacagtaaccaggctgtgcgacctgtctgtggagggggattccgtgacgtccgtggggtggtccgaacggggaaacctcgtggctgtcggaacacataaggggttcgttcagatctgggacgccgcggcagggaaaaagctgtcaatgctggaagggcatacagcccgggtcggggcactcgcgtggaacgcggagcagctctctagcggaagtcgagaccggatgatactccagagagacatcagaactccacccctccaatcggaaaggagacttcagggacatcggcaagaagtgtgcggcttgaaatggagcaccgatcatcagctccttgcgagcggaggcaacgacaacaaactcctagtgtggaaccattcatccctgtctcccgtgcaacagtacacagagcatctggcagcagtcaaagccattgcctggagcccccaccaacatggactgttggcaagtggcggcggcactgccgatcgatgtattaggttctggaacactctaaccggtcaaccgttgcaatgcatagataccggaagccaggtgtgcaacctagcttggtccaagcacgccaatgagctggtgagcacacacggctatagtcagaaccagatattggtctggaagtacccatcgctcactcaagtcgccaaactcaccggacacagctaccgagtcctgtatctagccatgtctccagacggcgaagcgattgttaccggagccggcgacgagactctcaggttctggaatgtcttttcaaagacgcgttccactaaggagagcgtgtccgttctgaatctgttcactaggatcagatag

SEQ ID NO: 14384 - DNA, 5892 bp, Artificial Sequence
  Description of Artificial Sequence: Synthetic coding sequence
atgaagcagagaaagggccaggggagtgggggttcccggggccgcaaaaaacgtggcctaagcgacatttcaccgagtacttccctccctcctcttgtggagggacaactgaggtgcttcctaaagctgacggtgaacagggtgatctggaaaatagctaagccccccacctgtgtcctggtccgggttaggtggtggggtgagacaagcgatgggacactattctgtccaagggatgcccttcagaccgaaccaaaggcagtaaggaccacgacccggtacgcaattcggtgcggaccaaagcaatttaccagctatctcacagacatggctgtgttggttctggaggtaataactaagcttgacggtctgccgattggccgagtccagataaatggcctggctcagctctctccaacgcatcagataaacggattcttcactatcgtgagctcaacaagcaagaaactgggggagttgcaagttagcctggccttagaacctttatctgagacgtatgacagctaccacccactgcctaccactgacatgactgaaaatgtgctactgtctaagcagggattcagagaaaataccgaaccttcctcaacacaattccaggtgccatcccgccccagggatatccacaccataaaaattgacggtaaggagctggcggcaaattcttcccgctctacgactcccagaggcaaggatcatgtgtgtttcgcagagaaccccgataccatcaaggactcttctttcggcttgcaacatagtctgaattctggacagtcactagagagcgtcacactgaagggtcgcgcgccccgtaagcagatgagtctcctcaatagttccgaattccagccccagattcggaccgtagctaagagccatagcgactcctgcatcctgtcctcgaataaccttcctacaaaggacctgctttccgctctcttagaacagggcaataagctcagaaatgcaatggtgatctcagccatgaaatcaagcccagaaacttctatgctgctggatcaggtccacccacccataaacgaagactctctgagggcttccacccagataagagcgttttcacgaaatcggttcaaagatcatattgaggaccacttgctgccttccaccgagaacactttttggcgccatgacacaaaagctgacaccagggccatccagctgctgctgggtagtgccgagctcagtcagggcaatttctgggatggcctcggcagtccacccgattcaccttcacctgggagtgatgtgtattgcatttcagaactcaacgatccacaatacgaccagagtctgttagagaatctcttctacactgcacccaaatcagacacatccatttcggactttctatctgaggaggatgatatcgtcccaagtaagaaaattagccagagcactgcccttgcacgatcctcaaaggtcctggagagttccgaccacaaactgaaaaaaaggtctgcagggaagcgaaatagaaaccttgtcgagcagcagatgctgagcgaaactcccgaggatgctcagactatgacactgtctgtagatcggctggctctgttggggcggacacactccgttcgcataattatcgagacaatgggagtccctcctgattctccgcagatgacacctggaaagaaatcgtatgccggccctcccccaaaagtaactacagccaagaagcggacgttttttgtagaataccactttcctgtcggcttctcagaatccggactcggcaagaccgctctgatcactgaagtggtgagactcgctagcagcaagattacagatggtaaggtgaagtttcagcagagatttgtattcccagtccaattcggtggcccgatgatagagcactggtggaatagcaatcttacctttcagatatacgtgaaaaagaccccacaaaaaaagccggaggttataggatccgtatcattgagcttacgtgcggtgatccagagcgaactgttgagcttctccgatcaactccccgtgcagcaagaaaatgggcagtcaccatttggaccactgaaggtgacaatggaactgatcacagataacaaagatttcacaggcattaataccaaacttagtggaaatacacactatacccccctgtgcgccccgacttcacctaacaaggccttgcccgagctgaatcaagatatgacttgcacaaagaaccctcaaaatctgaatcagatccacgaagagacagccaagaaagcgcaaaacctagtcctccccaaccgaaagagcccgtccccagtggccccacacccaagtacctttgttgctactcccgcctcccacaacctagtgaatcagaccaacggaaccacaaaggagtcagccctgttgctccatgtcctgctcatggtgcccgacggaaaggattttataagcggcgagagtgagaagcagagcccctgtaacgtgtaccttaactgtaagttgttctcaactgaggaggtcactcgttccgtgatcgcctgggggactacacaacctgtgttcaatttcagccaggtgattcctgtctcccttagctctaagtacctggaacgcctaaaaaacaacgtgatggtcatcgagacatggaataaagtccgctcacccggccaagataagctcctgggactggtcaagttaccactgcatcagttctacatgtcgtttaaggacgccaaaatctccaggctgctgttagatgctcagtaccctgtcgtcgccgtcgattcttacatgccagtgattgacgtctttagcggacaccagaatggcagtctgcgggtcttcttggccatgggcagttccaaccagatcatggctttacagcgtctgaaaaacgaggagggcaccctccctccttttagccctagacctgctcacttcttagatcagcctacggcagcgtccgtggcaatggccgaggatcgcggaaacggtctgatggagcactgctttgagatccacatcgaaatggttaaggggcttgcaccacttcaggcgaccgtatggggtgaagctgactgttacgtccaatattactttccagtgcaacatagtcagagcagcgtgctgaagggacccgagtttctggagaacggtataaccctgaagcccttccgaaccgccaccaccctgtgtgtcccggatcccatattcaattccgaacaccaccacagcctactgctccccgcagaggtcccagtccagagactgctgctgtcagcgttcagcgcacaaggcctggtacctggggggggagttcagtttgagatctggtgcaggtattactaccccaacgtaagggaccaaaaagttgctaaaggaactctgcccttaagtaggatttgtgctatggtcaccacccagcatcgggaggatgtaggcattcagactttcaatctgccactgaccccacgtatcgagaataggaaggaactgagaaatcagtcatccggactgctggacgtcgggctgaggtataggcggtctcctagaactgctgagggcgtgctagccgcccggacagtgtctataagtgtgcaaatcatccgggcttgtggcttacaggcggctgcaaaagctctggctgagcgcgaacctgctctccagtttagtgcaaccgtcggcgttaacgcgtccgtcacgacccacctgtccttcctgccacagggtgagcagcgccgtacccaccccgtggcatgctcgttctgtcctgagttttcccaccatgtcgaattcacctgtaacctggtgacccaacactgctccggcgaggcctgtttcctcgccgagctgctcgagtttgcagaagtgatattcgctgtctaccacgaaaatacaaagagcgcgtctgatatcatttcaatcgagtcttgtaaagaatatttactaggggtcgtgaaagtgccgactaaggaactcctgatcaaacgtagtggcataactggatggtacccgattattctgccagaagacgggggcctgcctcacggcctggaactgatgcagaaaattgtggggggcctggaactctctataagctttactcatcgaggcgacagagaaagggtcctggaggcggctgaacacttgggatggtccttcgagaatagcttgaaagacttcgtcagaatggacgagggcgaaccagctaccgtcactatctccactcccagactttggcttcccatccactgcgtcctcctggccggccataaccatattcacaagaatacgtactgttatctgagatataaattttatgatcacgaggccttttggacgccccttaaaaagcctaaggagtccgtcaataagaaacaaattatggtcacattcaaggcgtctaagcgagcagaagtgaccaggggcccttccctcttgtggtacttccgtgaagagagactcgagatccaggtttggcgggcttacggaaatgattccgtcgagaggccccaccaaacagatagctggatcggttccgcctatgtcgacctggcgcgcctgggagagaggtctgcccgaactttaacggtatctggggtataccccctattcggccgaaatgctagcaatctcagcggagccgccttaagggtccatgtagtcctgtcctccttgtccagccacctggaaccaacacacgagctcgattcaatggactgctctagtcattctgaaagcgaacaactgcccagacggaatgatgaggtgcagctttcgcctcccgaagtcatttcttgccaccaaaagagtcccgctagcacacaggtgccctgtagtagcactaccgccgaggtgcgtctgactcaagagggccctgcggatttggacggcacttttgctgtgtcaatcctcgtagagagggctatgcacctgtcattaaaagggtcacccctcacagaaagaaaagtgtcaatcccatcttgttgcgtaagtttcgccacagccgacgagtcatcccctgtctatacccaggtggttgagaacactgactcccccatttggaacttccaacaacagtctcgcctgagcaaggagttgctcctagatcctcagcagactctggtcttcaaagtctggcataagggtgatgaagagcgggtgatcggattcgcaagtgttgacttgtcccctttgctaagcggatttcagttcgtctgcggctggtataacatcacagacttcagtggtgaatgccagggacagatcaaggtcgcagtgtcacccttggagtcacttatccatttcaaagaagaacgtcaggcccgccgcggggtggaaacctctaaatctctcatccccatatacagccccttttcgttcccagcgtctgacacttatgcggccttttcctcgcacatggctagacagacactggaccagttggcccatgcaagctccaaagagttggacttcagcagtcccggtaggagcgatactaccaggagtcaggcctcccgtcacgaggaacacgtgcagaatattaggaggtttcacgagagcctccatctgcaaggcgaagctccattgccatgcgacgacaagttgaccacgtcacctctgtcctcccagacctctatcttgaccagtctgagaaaaaacttaagcgagctcgaccagatccagcggtatttcagacagaagctcactaagcccttcctccctctgtctccacaaacccagactgccatttcccagcatcaagagtcatgccgcgatcatctcggacctggtgccagctctctggaccccggaagtcaatgcatcctggagaaaagctctaatttggtgctgcaggtgtcctcgttgattacaggctcatactag

SEQ ID NO: 14385 - DNA, 5586 bp, Artificial Sequence
  Description of Artificial Sequence: Synthetic coding sequence
atgaagcaacggaaggggcagggctcaggcggcagcaggggacgcaagaagcgcgggctttcggacattagtcctagtacgtcactgcctcccctcgtggagggccagcttcggtgctttctgaaactgactgttaaccgagtgatttggaagatcgccaaaccacccacatgcgttcttgttcgtgtcaggtggtggggcgagacctcagacggcacacttttttgtccacgcgacgctctccaaactgaacctaaggccgtacgcaccactaccaggtacgccatacgttgcggtcccaagcagttcacatcttacctcaccgacatggcggttctggtgctggaagtcatcacaaaactcgacggcctgcctatcggaagagtccagattaatgggctggcccagctgtcacctacacaccagatcaacggtttctttactatagtatcctctacctctaaaaagctcggggaattacaggtgagcttggcgttggaacccctcagcgagacgtacgactcctatcacccattacctactacagacatgaccgaaaacgtgctgctttcgaaacagggctttcgggaaaatactgagccaagtagcacgcagttccaggtgcctagtagaccccgggacatacacacgattaaaatcgacgggaaggagctggcagcaaacagttcccggagcaccacacctcgcggcaaggaccatgtctgcttcgctgaaaaccccgacactattaaggacagttcgtttggtctgcagcactccctgaactctggacagtctctcgagtctgtgacactcaagggacgggcacctaggaaacagatgtcgctgcttaatagctcagagttccaaccgcagatacgcaccgttgccaagtcacactcagactcatgtatcctgtcatctaataacctgcctacaaaggatctgctgtctgcacttttggagcagggtaataagctaagaaacgcgatggtgatatccgctatgaagtcatcacccgaaacatccatgctactggaccaggtacacccgccaatcaatgaagattctctccgcgcttccacccagatacgggctttttccaggaaccgtttcaaggaccatatagaagatcacctgctgccctctacagaaaacacattctggcgacacgacacaaaggctgacacccgggcgatacagctcctccttggatccgccgagctctcacagggaaacttttgggatggcctcggctccccgcctgacagccctagcccagggtcagacgtgtactgcatctcggagctcaacgatcctcagtatgatcagagtctgctcgagaacctcttttatactgcgcccaagagtgacacatccataagcgatttcctatccgaagaggatgacattgtgccctctaagaaaattagtcagtccactgcccttgcccgtagtagtaaggtgcttgaatccagcgaccacaaactaaaaaagaggagcgcaggtaagcggaacagaaacctagtcgagcaacagatgctgtcggagactccagaggacgcgcagacgatgacactgtctgtagataggctggccctactgggccggacacacagcgtgcggattatcatcgaaaccatgggtgtgcctcctgattctccgcagatgacccccggtaaaaaaagctacgccggtccgccacccaaggtgactaccgccaaaaagcggaccttctttgttgaatatcacttccctgtcggtttttccgaatccgggcttggaaaaaccgctttgattaccgaagtggttcgtttggcatctagcaaaataaccgatggcaaggtgaagttccagcaacgcttcgttttcccagttcaattcggtggccctatgattgagcactggtggaactcaaacctgacattccaaatctacgttaagaaaaccccgcagaagaagcctgaggtgatcgggtcagtcagcctctccctgcgagccgtcatccagtctgagctgctgtccttttcagatcagctgccagtccagcaggagaatggacagtctcccttcggccccttgaaggtgaccatggaattaattacagacaacaaggattttactggaattaatacgaagctaagtggaaatacccactatacacctttatgtgcccctacctctccaaacaaggctctccctgagctgaatcaagatatgacgtgcacaaagaatccacagaatctcaaccagatccacgaagagactgccaagaaagcccagaacttagtattgccaaatcgaaagtctcccagtccagtcgctcctcacccctcaactttcgtggcaacaccagctagccacaaccttgtgaaccagacaaacgggactactaaagagagtgcattactactgcatgtattacttatggtccctgatggaaaggattttatttccggagaatctgaaaaacagtcgccatgtaatgtgtatcttaattgtaagctgtttagtaccgaggaggtgactcggtctgtcattgcctgggggacaacccagcctgtgttcaatttttcccaagtgattcccgtgagcctgagctctaagtatctggagcgtctgaagaacaacgtcatggttattgaaacctggaataaagtcaggagcccagggcaggataaactactgggcctcgtgaaactccccctgcaccaattctacatgtcgttcaaagacgctaagatttcgcgcctgctcctcgatgcccagtatccagttgtggccgtggatagctacatgcctgtgatcgacgttttctccggtcatcaaaatggtagccttcgggtttttttggccatggggtcgtcaaaccagatcatggctctgcagcggctcaaaaacgaggagggcacactgcctcccttttccccccggcccgcacattttctcgaccaacccacagccgcatccgtggctatggccgaggacaggggtaacggactgatggagcactgctttgagatccacatagagatggttaagggactggcccccctgcaagcaaccgtgtggggagaagccgactgctacgttcaatactattttcccgtccagcacagccagagttctgtgctgaagggtcccgagttcctggagaatggaatcacactcaagccttttagaaccgccactacactctgcgtgcctgatcctatcttcaactcggaacatcaccacagcctgcttcttccagctgaagtgccggttcaaaggctcctcttgtccgcgtttagcgcccagggccttgtacccggcgggggagtgcagttcgagatatggtgccgttactactatccgaatgtcagagatcaaaaggtcgccaagggcactctgccactctcgcggatctgtgccatggtcactacccagcaccgcgaagacgtaggcattcaaacatttaatctgccactgactccccgtatcgagaatagaaaggagctacgaaatcagagtagtgggttgctggatgttggcctccgctatagacgaagtccacggaccgctgaaggtgtgctggcagcacgtactgtctccatttctgtgcagataatcagggcctgtggacttcaagcagccgccaaggccctcgctgagcgcgaacctgcattgcagttttctgctacagttggggtgaacgcatcagttacaacccatttatcgtttctgccacagggggagcagaggcggacccatcctgtagcttgtagtttttgccccgaattcagtcatcatgttgaattcacatgcaatttggttacacaacactgtagcggcgaggcttgcttcctggctgagttgcttgaattcgccgaagtaatcttcgccgtatatcacgagaacaccaagagcgcgtccgatattatatcaatcgagtcttgtaaggaatacctgctgggcgtggtcaaggtgccgaccaaagagcttctgattaaacgctccggaattactggatggtaccccataatactacctgaggacggtgggctaccgcacggactggaactgatgcagaagattgttggaggccttgagcatctcgggtggtcattcgagaatagcctaaaagacttcgtgcgcatggatgagggggagccagcaacagtcacgatctccactccacgtctgtggctcccaattcactgcgtcttgctggccgggcacaaccacattcacaaaaacacgtattgctacctgcggtataaattctatgatcatgaggccttttggacccctctcaaaaagcctaaagaatcagtgaacaagaaacagattatggtaacttttaaagcatcaaaacgtgctgaggtcacccgtggtccctctctcctctggtatttccgggaggagagactggagattcaggtctggcgcgcttacggaaacgattccgtggaacgtccgcaccaaacagattcttggatcgggtcagcctacgtcgatttggctcgcctgggagagagatcggcacggacactcacggtgtctggggtatatcctctgttcggcagaaatgcctccaatctgtctggcgctgcccttcgcgtgcatgtggtgttgtcaagcctctccagtcatctggagccaactcacgaactcgactctatggactgctctagccactccgagtctgaacaattaccacggcgaaacgatgaggtgcagctatctccccctgaggttatctcatgccatcaaaagagtccagcatccacccaggtaccttgctcctccaccaccgcagaggttcgtttaactcaggaggggcctgcggacttggatgggacgtttgccgttagcattctggttgaacgagccatgcacctgagtctcaaaggctcaccactgactgaaagaaaagtgtctatccccagctgttgcgtgtcctttgccaccgcagatgaatcctcacccgtctacacccaggtcgttgaaaacacagactcaccaatctggaattttcagcagcaatcgcgtctaagcaaggaactgctgctagacccccagcagactctggtctttaaagtttggcacaaaggggatgaggagagagtgatcggatttgccagcgtcgacctgagtcctctcctatcaggctttcaatttgtgtgcgggtggtacaatattacagatttcagtggggaatgccaggggcaaatcaaagtagctgtttcccctctggagtccctcattcactttaaggaggaacggcaggcgcggcgaggagtcgaaacatccaaaagcctgatccccatctacagtcccttctccttcccggcaagtgacacatacgccgccttcagctcccatatggcccggcagaccctcgaccagctggcgcacgcaagcagtaaagagctcgacttttcctccccaggcaggtcagataccaccagatctcaagcctcccgccacgaagagcacgtgcagaacatacgccgctttcacgaaagcttacatctacagggtgaagcccctttgccctgtgacgataaactgactaccagcccgctgagcagccagacatag

SEQ ID NO: 14386 - DNA, 1131 bp, Artificial Sequence
  Description of Artificial Sequence: Synthetic coding sequence
atgctcactttcctgcagcagcttagggtagactggcctgccgccagtgagcgggcttccagtcacaccctgaggtcgcacgccctggaggagctgacgtccgctaatgacgggcggacgctgagtcctggcatcttgggcagactctgcctaaaggagcttgtggaggaacaaggccggactgctggttatgacccaaacctcgataattgtctggtgacagaggatctcctcagtgtccttgctgaactgcaggaggcactgtggcattggccagaggattcacatcccggtctggctggggctagcgacactggaaccgggggatgtctcgtcgtccacgtagtgagttgcgaggaggaatttcagcagcagaaactggaccttctctggcagaaattggttgataaggctcccctgaggcaaaaacacttgatctgtggacccgtaaaggttgccggagcaccaggaacgctcatgactgccccggagtactacgagtttaggcacacccaggtgtgtaaagcatccgccctgaagcacggcggcgacttggcccaagatccggcctggacagaaattttcggggtcctgagcgtagcgacgatcaagtttgagatgttgtctacagccccccaatctcaactgtttctggctctggcggattccagtatatcgacaaaggggacgaaatctgggacattcgtgatgtataattgtgcgcggctggcaactctcttcgagtcctataaatgttctatggagcagggcctctaccccacctttccacccgtgtcaagtcttgacttttccttactgcatgatgagggggaatggctcctccttttcaactctattctgcccttcccggatctgctgtcgaggactgccgttctggactgcaccgctccaggcttgcatattgcggtgcgcactgagatgatttgtaagttcctggtgcagttaagtatggacttctctagctactataaccgggtgcatatactgggggagcctcgtcctcacctgtttgggcagatgttcgtccgcttgcagctgttgcgtgcagtccgggaggttctgcatacaggcctcgccatgctcggactaccccctctgagccatatctag

SEQ ID NO: 14387 - DNA, 1572 bp, Artificial Sequence
  Description of Artificial Sequence: Synthetic coding sequence
atgaaccaaccttgtaactcaatggaaccaagggtgatggacgacgacatgctgaaattggccgttggtgatcaggggccccaagaggaggcgggccagctggccaagcaggaagggatcctcttcaaagacgttttatcactgcagctagattttcgcaatattctgcgcatagataacctgtggcagttcgagaacctgaggaagctacagctggacaacaatattatcgagaaaatcgagggtttggagaaccttgcacatctcgtgtggttagatcttagcttcaacaacatcgagaccattgagggactggacactctggtcaacttggaagacctttccctatttaacaacagaatcagtaaaatcgacagtctggacgccctggtgaaactgcaggttttgagcctcggaaacaacagaatcgacaacatgatgaatattatctacctgcgacgtttcaagtgtttacggacgctgagccttagccgcaatccaatctctgaggctgaagattacaaaatgtttatatgtgcctacctccctgatttgatgtatttggattaccgacgaatagatgaccacaccaagaagctggccgaggcaaaacaccagtacagcatcgacgagctgaagcatcaggagaacctgatgcaggcgcagctggaggatgagcaggcccagagggaagaactggaaaaacacaaaaccgcatttgtggaacacctgaacggcagcttcctcttcgacagcatgtacgcagaggattcggaggggaacaacctcagttacctgccgggtgtcggcgaacttctcgagacctacaaagataaattcgtaattatctgcgtgaatattttcgagtatggactcaagcagcaagagaagaggaaaacagagcttgatactttctctgagtgtgtgcgggaggctatccaagaaaatcaggagcaggggaaacgaaaaatcgccaagtttgaggagaagcacttgtcaagccttagcgccatccgagaagagctagaattgccaaatattgagaagatgatcctagagtgctccgctgatatatcggaattgtttgacgcccttatgactctagaaatgcagcttgtggagcagcttgaggagacaatcaatatgttcgaaagaaacattgttgatatggtggggctgtttattgagaacgtgcaatctctcatggcccagtgccgggatctcgaaaaccatcatcatgagaagctcctggaaatttccatctctacactggaaaagatcgtggagggagaccttgacgaagaccttcccaatgacctcagagcattatttgtggataaagatacgatagtgaatgccgtgggagctagtcacgatatccaccttttaaaaatcgataatagagaggatgaactggtgacacgcataaattcttggtgcacgagactcattgatagaattcacaaagacgagatcatgagaaatagaaagcgcgtgaaagaaattaatcagtatattgatcatatgcagagcgagctggataatctggaatgcggagatattcttgactag

SEQ ID NO: 14388 - DNA, 1680 bp, Artificial Sequence
  Description of Artificial Sequence: Synthetic coding sequence
atgaaagtgattacatgcgaaattgcctggcacaacaaggagccagtgtattccttggatttccagcacggcacagcagggagaatccaccggctggcttcagccggagtcgacaccaatgtgagaatctggaaggttgaaaaggggcccgacggcaaggccatcgtggaatttctgtctaacctcgccaggcacacaaaggccgttaacgttgtccggtttagcccgacaggagagatccttgcttccggaggggacgatgcagtaatattgctgtggaaagtgaacgataataaggagccagagcaaatagcgttccaggacgaggatgaagcacagctaaacaaggagaattggaccgttgtgaaaacactccggggacatctagaggatgtgtatgacatttgctgggccacggacggcaatctcatggcttctgcatctgtagacaatactgccatcatctgggatgtgtcaaagggacaaaagatctcaatatttaacgaacacaagtcttacgttcaaggcgtaacctgggaccctctcggccagtatgttgccaccctgagctgcgacagagtgctacgagtatactctatccagaagaagcgtgtcgctttcaacgttagcaagatgttatccgggattggagccgagggggaggcgcgtagctatcgcatgtttcatgacgactctatgaaatccttctttcgccggttatcatttacgcccgatggaagtctgctcttgactcccgccggctgtgtggaaagtggtgagaacgtgatgaatactacatacgtcttttcacgcaaaaatctgaaaaggcctatcgcacacctgccttgcccaggaaaggctacactggccgtgcgttgctgtcctgtctatttcgagctgagacctgtagttgaaaccggagtcgagcttatgtcgctgccgtacaggctggtcttcgctgttgcttcagaagactcagtgctgctgtacgacacacagcaatccttccccttcggatacgtgtcaaatatccactatcacacactgtctgatatatcctggagcagtgacggcgcgttcttagcgattagttccaccgacggctactgtagctttgttaccttcgaaaaagatgagcttggtatcccgctgaaagaaaaaccagtgttgaacatgcgtaccccggataccgcgaaaaagactaagtctcagacgcatagaggttcctcaccgggtccaagacccgtagaggggacccccgcctcaagaacgcaggacccgagctctcctggtactacaccaccacaggctagacaggcaccagcccctacggttataagggaccccccttcaattaccccagctgtgaagagcccccttccaggcccctccgaggaaaaaacactgcagccaagctcccagaatacgaaagcccacccttccaggcgcgtaacgttaaacaccttgcaggcctggtcaaagaccacaccccgacgcattaacttgacaccccttaaaaccgatacgccccccagctcagtgccaacatccgtcatctccactccatcaacagaagagattcagagtgagacgccaggcgacgcccaaggaagccctcccgaactaaaaagaccgagactggacgaaaacaaaggtggcacagaatctcttgatccatag

SEQ ID NO: 14389 - DNA, 1527 bp, Artificial Sequence
  Description of Artificial Sequence: Synthetic coding sequence
atggcagacgggcaggtcgcggagctcctattgagacgactggaagccagtgacggcggcttggatagtgccgaacttgcggctgaactgggcatggagcaccaagcagtagtcggcgctgtgaaaagtttgcaagctcttggggaggttattgaagcagaacttcggtccacaaaacattgggagttaaccgccgaaggggaggagatcgcacgtgagggcagtcatgaggcccgcgtgttcagatcgatccccccggaaggcctagctcaaagtgagctgatgagactgcccagcgggaaagtgggattctccaaggcaatgtcaaacaaatggatccgtgttgataagtccgctgccgatgggccccgggtgtttagggttgttgactccatggaagacgaggtgcaaaggcggcttcagctcgtgagaggtggacaagcagagaaacttggagaaaaagaacggtctgaactccgtaagagaaaattacttgccgaagttactcttaagacctactgggtcagcaagggaagcgccttcagtaccagcattagcaagcaagaaaccgagctgagtcctgaaatgattagctctggctcatggagagatagaccctttaaaccctataatttcttggcacacggagtcctgcctgacagtggacacctccaccccctcctgaaagtgaggagtcagttcaggcagatatttttggagatggggtttactgagatgccaacagacaactttatcgaatcctcgttttggaattttgacgccctcttccaaccacagcagcatcctgccagagatcagcacgatactttttttctgcgagaccctgccgaagccttgcagctgccaatggactatgtgcaacgcgtgaagaggacccatagccagggggggtacggcagtcaaggttacaagtacaactggaagctggatgaagcccgcaagaatttgctccggacccacactactagtgctagcgcccgcgccttatacagattggctcaaaagaagcctttcacaccggtaaagtacttctcgattgatagggtgttcagaaatgaaaccctagacgccacacacctagctgagttccatcagatcgagggagttgtggctgaccacggcctgacactggggcacctgatgggcgtactgagagaattcttcaccaagctgggtatcacacagctcaggtttaagccagcatataacccctacacggagccttccatggaggtcttttcctatcatcagggtttaaagaaatgggttgaagtcggaaactccggagtgttccgacctgagatgctgttacccatgggcctgcccgagaacgtaagcgtcatcgcttggggcttatcactggagagacctaccatgattaagtatggaatcaacaacatccgtgagctggtcggtcataaggttaacttgcagatggtctacgattctcctctgtgtaggctggatgccgagccccggcccccccccactcaagaagcagcatag

SEQ ID NO: 14390 - DNA, 1203 bp, Artificial Sequence
  Description of Artificial Sequence: Synthetic coding sequence
atgtcatcccctctggcttcgctgagtaaaactagaaaggtgcctctcccatctgagcccatgaaccccggccggagaggaatccggatctatggtgacgaggacgaagtggatatgctctccgacggctgtggcagtgaagagaagatcagcgtcccatcttgctacggtgggatcggagcccctgtcagcaggcaaggcgatagtctggcacctccagaggttgactttgataggctgctggcaagcctccaagacttatcggagctcgtagtggaaggggacacccaggtgacgcccgttccagggggggcccgcttacggacacttgaacccatacccttaaaattatatcgcaatggcatcatgatgttcgacggaccatttcagccgttctacgatccctccactcagaggtgccttagggatattctcgacggattttttccctctgagctccaaaggctatacccgaatggtgtaccattcaaggtctctgacctgcggaatcaggtctatctagaagacggcctcgaccctttccccggtgaaggcagggttgtaggccggcagttaatgcacaaagctctggatcgcgttgaagagcacccagggtcccggatgaccgccgaaaagttcctaaatagactgccgaaattcgtcatcaggcagggggaggtgattgacataagggggcccatccgcgatactctccagaattgctgtcccctccccgctaggattcaagagatcgtggtcgaaactccgacattggccgctgaacgggagcggtcacaggagagtcctaacactccagccccgccactctccatgttgcggatcaagtccgaaaatggtgaacaagctttcctgctgatgatgcagccagataacactatcggagatgtgagagcgctcttggcccaggcaagagttatggatgcctctgcctttgaaatcttctcaacctttcctcccaccctttaccaggacgacacactgacattgcaagcagcaggcctggtcccaaaagccgccttacttttgcgggcacgacgagctcccaagtctagtctgaaattctccccgggaccctgccccgggcccggcccaggcccatcccctggtcccggaccaggcccttctcctggccccggtcccggcccaagcccttgtcccgggccatccccctccccacagtag

SEQ ID NO: 14391 - DNA, 1350 bp, Artificial Sequence
  Description of Artificial Sequence: Synthetic coding sequence
atggcttccgccctgcggccacctcgggtgcccaaacctaaaggcgtactgccatcccactactatgaatccttcctggaaaagaaagggccctgtgaccgagattacaaaaagttttgggctggccttcagggtctcactatctacttctacaattcgaacagggatttccagcacgtcgagaagctgaacctgggcgcttttgagaaactaactgatgagattccttggggaagttcacgcgatcctgggactcatttttcactgatacttcgtgaccaagagataaagttcaaagttgagaccctggaatgccgtgagatgtggaaggggttcatcctcaccgttgttgagctgcgcgtgcccaccgatcttacgctgctcccaggccatttgtacatgatgagcgaggtcctggctaaggaggaagcacgccgcgcactcgagaccccatcatgcttcctgaaggtttcacgcctcgaggcacagctgttgctagagaggtaccctgagtgtggaaatttgcttcttcgaccgagtggcgacggcgcggatggggtgtcggtaacaacgaggcaaatgcacaacggtacacatgtggtaaggcactataaggttaagagagagggccccaaatatgtgatcgacgtggagcaacccttcagctgcacctcgctcgacgccgtggttaactacttcgtaagccacactaaaaaggccttggtacctttcctgctcgatgaggactacgagaaagtcctgggttatgtcgaagctgacaaagagaatggagagaatgtatgggttgcccctagcgctcccgggccaggaccagctccttgcaccggtggtccaaagcccctaagtccagcctccagccaggacaagctccctcctctgcccccgctgccgaatcaggaggagaactatgtcacacccataggcgacggaccagccgtggactatgaaaatcaggacgtggcatctagctcttggcctgttatcttaaaacctaaaaaacttcctaaaccacccgcaaagctacctaaaccaccggtaggccccaaacccgttgagaaaggattccaccatgtggctcaagctggccttgaactgctgacatcgtctgatccccctacgagcgcttcgcagtccgccggaatcaccggcgtgagccatcatacttggccgcacctgagctccctgcctgaaccgaaggtgtttaatggaggcctagggcgtaagttgcccgtgtcttctgcgcagcctctctttccaaccgccggccttgctgacatgaccgctgaactgcagaaaaaactggagaagaggcgggcattggaacattag

SEQ ID NO: 14392 - DNA, 1239 bp, Artificial Sequence
  Description of Artificial Sequence: Synthetic coding sequence
atggaccccatccgtagcttctgtggaaagctgcggtcccttgcttctacccttgattgtgaaacggctcggctgcagcgtgcactggatggagaagaatcagattttgaagactatcctatgaggatcctctatgacctccacagtgaggtacagacattgaaagacgacgtgaacatcttactggacaaggcccgcctcgagaaccaggagggcatagatttcatcaaggccactaaggttctgatggaaaaaaattctatggacattatgaagataagggaatactttcagaaatatggctattcaccccgtgtgaagaaaaattccgtgcatgagcaggaggctattaatagtgatcccgagctgtccaactgtgagaatttccagaagaccgacgtgaaggacgacctatcagatccacccgtggccagctcatgcatctcggaaaagagcccccggtctcctcagttaagtgactttgggctggagagatacatcgtgtcacaggtgttgcctaatcccccacaggctgtcaataactataaagaagagccagtaatagtgactccacccacaaagcagtcccttgtgaaagtattgaagacccccaagtgtgctcttaaaatggacgacttcgaatgcgtgacacccaagctggaacacttcgggatttcggagtatactatgtgcctcaatgaggactataccatgggcctgaagaatgcaaggaataacaagagtgaagaagcaatcgacaccgagtcccgcctcaatgacaacgtgtttgccactcctagtccgattatacaacagctggaaaaatcggacgctgaatacacgaactctccccttgtcccaacattttgtacccccggcctaaagataccgtccacaaaaaattcaatcgcccttgtttccacaaactaccctctcagcaagaccaatagctccagtaacgaccttgaggttgaggaccggacctcgctagttttaaactccgacacatgtttcgaaaacctgacagacccctccagcccaactatttcctcctacgaaaatctgctgcgaactccaactccgcctgaagttacaaagatcccagaagacatccttcaactgctatctaagtacaactccaacctggccacgcccatcgcaattaaagccgtcccgccatctaagcggtttttgaaacacgggcagaacatccgtgacgtgagcaataaagaaaactag

SEQ ID NO: 14393 - DNA, 2583 bp, Artificial Sequence
  Description of Artificial Sequence: Synthetic coding sequence
atgaccgagggcacaaagaaaacctccaagaagttcaaattcttcaaattcaaaggcttcggtagcctgagcaatctaccccggtcatttactctgaggagaagttccgcttctatcagccgccagtcccacctcgagcccgacactttcgaggcaactcaggatgacatggttacggtaccaaagtcaccaccggcatatgcaaggtcctcagatatgtactcccatatgggtaccatgccccgcccatccatcaaaaaggcccagaactcgcaagcagcacgccaggcccaagaagctggcccaaagcctaacctggttcccggtggagtccccgatcctcccggcctggaagccgctaaggaagtcatggtgaaagcgactggtcctctggaagacacaccagccatggagcctaatccatccgcagtggaggtggaccctatcagaaagcccgaagtgcccaccggcgatgtggaagaggaacgccccccacgcgacgtgcactccgagagggccgccggagagccggaggctgggtcagattatgtgaagttcagcaaggaaaagtatatcctggactctagcccagaaaagctccacaaagagctggaggaagaattaaaactctccagcaccgacctgagatctcacgcctggtatcacggtagaattccacgagaagtgagcgagactctggtccagcgaaacggcgactttctgataagggactcccttacctctctgggagactatgtgctgacatgtagatggcggaaccaggcactgcacttcaagataaataaagtcgttgtgaaggccggggagagttacacacacatacagtatttattcgaacaggaatcgttcgatcacgtgcctgccctggtccggtatcatgtggggtctcgcaaggcggttagcgaacagagcggcgcgattatctactgtccagttaacagaacctttcccttgaggtacctggaggcctcatatggactcggacagggttccagcaagcccgcatccccagttagcccatccggcccaaaggggagccacatgaaacgtcggtctgtgactatgacagacggtcttacagccgacaaagtgacacgcagcgatggttgtcctacctctacttcccttcctcgaccacgtgatagtattaggagctgcgctctgtccatggatcagatccctgacctccatagccctatgagccccatttccgaatctccctcatccccagcatacagcacagtgactagggtacatgcagccccagctgcaccctcagcaactgctcttccagcatccccggttgcccggaggagctccgagccccaactctgtcctgggtccgcccctaagacgcatggggagagcgataaaggaccacacacttccccctcgcatactctggggaaggccagcccgtctccctccctgtcttcatattctgaccccgacagcggtcactactgtcagctgcaacccccagtccgaggatcccgggaatgggcagctaccgagaccagttctcaacaggctagaagttacggcgaacggttaaaggaattgtctgagaacggagcccctgaaggcgattggggtaagacttttaccgtccctattgtggaggtcaccagcagttttaatccagctacctttcagagcctgctcattccccgggacaaccggccacttgaagtgggactcctgcgaaaagtcaaagagttgctggcggaggtggacgccagaacgctcgccaggcatgttacaaaggtggattgcttggtggcccggatcttaggagtcacaaaggaaatgcaaacacttatgggcgttcgctggggaatggagctcctgacactgccccatggcaggcagctgcgcctggacctgcttgagcggttccacaccatgtctattatgttagcggtggatatcctgggatgtacagggtccgcggaggagcgagcagctttactgcacaagacgatccaacttgcagccgagctgcggggcaccatgggcaacatgttttcattcgctgcagtcatgggagcgctcgacatggcccagatatccaggttagaacaaacctgggtgacattgcgacagcggcataccgagggcgcaatattgtatgagaagaagctcaagcccttcctgaagtcgctcaacgaagggaaagaaggaccacccttgtctaatactacatttccccacgtgctcccgctgattactctgctcgaatgtgactctgccccccccgaaggccctgagccatggggttcgacggaacacggggtggaagtagtacttgcccacctcgaagctgctcggaccgtcgcccatcacgggggcctgtatcatacaaacgcggaggtgaagctgcaaggtttccaggccaggcccgaattgctggaggtgttctcgactgaattccagatgaggcttctctggggctcacagggcgcaagttcaagccaagcgcgcaggtatgaaaaatttgataaggttctgaccgcgctgtcccataagttggagcctgccgtgcgttcctctgagctctag

SEQ ID NO: 14394 - DNA, 573 bp, Artificial Sequence
  Description of Artificial Sequence: Synthetic coding sequence
atgactgtgccttggaggcctgggaaacgaagaataacatacaaggaggaagaggacttgaccctacagccaagaccagctagtagtgcccctgagtccctggtaggccttcaggagggaaagtcaacggagcaagggaaccacgatcagctgaaagagctttattcagccggaaatcttacagtgctggctacagacccactgttgcatcaggatcctgtccagctcgacttccattttagactgacctcacaaacctctgcccactggcacggacttctatgcgataggcggctgttcctggatatcccttatcaggccttggatcagggcaatagagagtcccttactgcaaccttggaatatgtggaagaaaagacgaatgttgattcagtgtttgtgaacttccagaatgacagaaatgatcggggtgcactgctgcgcgcattttcttatatgggcttcgaggtcgtacggccggaccaccctgctcttccacccctagacaatgttatcttcatggtgtatcccttagagcgtgacgtcggacatctgcctagtgaacccccttag

SEQ ID NO: 14395 - DNA, 1527 bp, Artificial Sequence
  Description of Artificial Sequence: Synthetic coding sequence
atggctacagattggctcggtagtatcgtgagtatcaattgtggggatagtctgggcgtttaccaggggagagtgtccgcggtcgaccaggtgagccagactattagtctcacccgcccttttcataatggcgttaagtgtctcgtgcccgaggtgacattccgcgcgggagacattactgaattgaagatcctagagatccctggcccaggcgataatcagcacttcggcgacctgcaccagacagaactgggcccttcaggcgccggatgccaggtcggcatcaaccagaacggtactggcaagttcgtcaagaagcccgcttcaagcagctccgccccccagaacattccgaaacgcacagacgtgaagtctcaggacgtcgccgttagtccgcagcagcaacagtgctcaaagagctacgtggacagacacatggagagcttgagccagtccaaatcctttcgaagacggcacaattcatggagctctagctcccgccacccaaatcaagccacccccaagaaatccggactgaagaatggacagatgaagaacaaggatgacgagtgtttcggagatgatatagaagagattcctgacactgactttgactttgaaggaaatctggccctgttcgataaggccgccgtgtttgaggagattgatacatacgagcggaggagtggaaccaggtcccgcgggatccctaatgagcgccccactcgataccgtcatgacgaaaacatccttgagagcgaaccaatcgtgtatcgtcgtatcatcgtaccccataacgttagtaaggaattctgcacggattcagggctggtagtgccctccatcagctacgagttacataaaaaactactgtcagtcgccgagaaacacggcctgacccttgagcggcggctcgaaatgaccggcgtttgtgcatctcagatggccctcacgctgctcggcggacccaacagactgaaccccaaaaatgtccaccaacggcccactgtagctctgttgtgtgggccccacgtcaagggcgcccagggaattagctgtggacggcatctcgcaaatcatgacgtccaagtaattctctttctccccaacttcgtaaagatgttagagtccattactaatgagctaagcttgttcagcaagacacaaggacaacaggtgtcatccctgaaggacctccccacaagcccagtggacctggtcatcaactgtctggattgtcctgaaaacgtgttccttcgtgaccagccctggtataaggcagccgtggcatgggccaaccaaaaccgcgcacccgtgctttcaatcgatccccctgtgcacgaggtcgaacaggggatcgacgctaaatggtccttggccctgggtctgcctctcccattaggggagcacgcagggaggatttatttatgtgacattgggataccgcagcaagttttccaggaggtcggcatcaactatcacagccccttcggatgtaagttcgtgatcccgctgcatagcgcatag

SEQ ID NO: 14396 - DNA, 1158 bp, Artificial Sequence
  Description of Artificial Sequence: Synthetic coding sequence
atggggcggtggtgccagaccgtcgcccggggtcagcggcccaggacttcagcaccgtcccgagctggagccttgctattgctgttgctgctgctacgaagcgcaggttgttggggggctggtgaggcacccggagcgctcagtaccgccgatcctgctgaccagagtgtccaatgcgtgccaaaggccacttgcccgtcctcacgtccgcgcctgctgtggcagacacccactactcaaactctcccctcaacaacaatggaaactcagttccctgtgagcgaaggcaaggtggacccgtataggtcctgcggcttctcttacgagcaggacccaacgctgcgggatcccgaagctgttgcaagaaggtggccctggatggtcagtgtacgcgcaaacggtacccacatttgcgcaggaacaattattgccagccagtgggtgctcactgttgcacactgtctaatctggcgggacgtgatttactccgtcagagtggggagtccgtggattgatcagatgacccaaactgcttcagacgtgcctgtgttgcaggttatcatgcatagccggtatcgagcccaaagattttggagctgggtcggtcaggccaacgacattgggctgctgaaactaaaacaggagctcaaatattccaattatgtgagacctatttgtttgcccggcaccgattacgtgctcaaggatcattctcgatgtactgtaactggctgggggctgtccaaagctgacggcatgtggccacaatttcggacgatacaggagaaggaggttatcattctcaataacaaggagtgtgataatttttaccacaatttcactaaaatcccaacactggtccaaatcatcaagtctcagatgatgtgcgcagaggacacccaccgggaaaaattttgttatgagttgacaggggaaccattagtatgtagcatggagggcacctggtatctagtgggtttagtgagctggggggccggatgccagaaatcggaagccccccctatctatcttcaggtgtccagctatcagcactggatctgggattgtctgaatggccaggccttggctctgccagcccccagcagaaccctgctgctggccttaccactgcctctgagccttttagccgcgctgtag

SEQ ID NO: 14397 - DNA, 750 bp, Artificial Sequence
  Description of Artificial Sequence: Synthetic coding sequence
atggttgaccgcctggctaattcagaagctaataccaggcgcatttcaatcgtggaaaattgctttggagccgctggtcagcctctgacaatccccggaagggtgttgatcggagagggcgtgctgactaaattgtgtcgcaagaagcctaaggcaagacaattttttctgtttaatgatatcctagtgtatggcaatatcgttattcagaagaaaaagtacaacaagcaacatattattcctttagagaatgttaccattgattccatcaaagatgaaggggacctgcgaaacggctggctaattaagaccccaacgaagtccttcgccgtgtatgccgccacagccactgagaaatcggaatggatgaaccacatcaacaagtgtgtcactgacctgctgtccaaatcgggaaagaccccatcaaatgaacatgcggctgtctgggtgcccgactctgaggccactgtgtgcatgcgctgtcagaaagccaaatttactccggtgaacaggagacaccactgtcgcaaatgtggtttcgtggtgtgtggcccttgctctgaaaagcggttcctgcttcctagccagtccagcaaacctgtcagaatctgtgatttctgctatgacctcctttccgcaggcgatatggccacttgccagccagcgcgctctgactcatactcccagtccctgaaaagcccattaaacgacatgagcgacgatgacgacgacgatgattcatcagattag

SEQ ID NO: 14398 - DNA, 2745 bp, Artificial Sequence
  Description of Artificial Sequence: Synthetic coding sequence
atgggtgattccagggatctgtgtccacacctcgattccattggcgaggttacgaaagaagacctccttctgaaatccaaaggaacttgtcagtcatgtggcgtcacaggtcccaacctttgggcttgcctgcaagtagcttgcccttatgttggatgtggcgagtcctttgccgaccatagcacgatccatgctcaagccaaaaagcacaatctgaccgtcaatttgactacattccggctttggtgttacgcctgcgagaaggaagtgtttcttgagcagcgtttagcggcgccattattggggtcctcaagcaagttctcagaacaagattcccctcctccctcccaccctctgaaggctgtcccgattgctgtggccgatgagggagagagcgaaagcgaagacgacgacctcaaaccacgaggactcacgggcatgaagaacctgggcaactcctgctacatgaacgccgccctgcaggccctgtctaactgtcccccactcacccagttcttcctcgagtgcggaggcctggtacggactgacaagaagcccgcactatgtaaaagctatcagaagctggtctcggaagtttggcataagaagaggccatcatatgtcgttcccacttctcttagccacggtatcaaattggtcaatcccatgttccgcgggtacgcccaacaggacacccaagagttcctcaggtgcctcatggaccagttacacgaagaactgaaggagccagtcgttgcaacagtcgcactgaccgaagctagggactcagattccagcgacaccgatgagaaaagagagggggacaggtccccatccgaggacgaatttctgagctgtgacagcagctcagatcggggagagggagatggccagggcagaggcggtggctctagtcaggcagagacagagctgcttatcccagacgaagcagggcgggccattagtgagaaggaacgcatgaaggataggaaattctcgtggggccagcagcgcacaaactccgagcaggttgacgaagacgcagatgtggacaccgctatggcagcattggatgaccagcctgccgaagcccagcccccgagccctcgaagttcttctccttgtagaacgcctgaaccagataacgatgcacacctccggtccagttctcgcccgtgttctcctgtgcaccatcacgagggtcacgctaagctttctagtagcccaccaagggcctcgcccgtgagaatggccccatcttatgtcctgaaaaaggcacaagtgctgtctgccggaagccggcgtcggaaagagcaacgctatagatcagttatttccgacatttttgacggctctatcttgtctctggttcagtgcctcacctgtgaccgcgtatcaacaacggtagaaactttccaggacctgtccctacctattccaggaaaggaagacctggcaaaactccactcagctatttaccaaaacgtccccgcaaaacccggcgcatgtggggattcctacgcggctcaaggatggctcgccttcatcgtggagtatattcggaggtttgtggtgagctgcacgcccagctggttctgggggcctgtggtcactcttgaagattgtttggctgccttcttcgccgcagatgagttgaaaggcgataatatgtacagctgtgagaggtgtaagaaattgcgcaacggggtcaaatactgtaaggtgttgagattacctgagatcctgtgcattcacttgaagaggtttcgccacgaggtaatgtattctttcaagatcaacagccacgtctctttcccactcgaaggattagacctcagaccctttctggcgaaggaatgtacaagccaaatcacgacctacgatcttctgtcagtcatctgccaccatggaaccgctgggtctggccactatattgcttactgccagaacgttatcaacggacagtggtatgaatttgatgaccaatatgtcacagaggtgcacgaaaccgtcgtgcagaacgccgagggttacgtcttgttctatagaaagagcagcgaggaagcaatgagggaacggcagcaagttgtgtccctggccgctatgagggagccctccttgctgaggttttacgtctctagggaatggttgaacaaattcaacacatttgcggaaccagggcctatcaccaaccagacatttctgtgctctcacggtggtattccacctcacaaatatcattacatcgatgaccttgtggtgatactacctcagaacgtttgggagcacctgtataacagatttggcggcggccctgccgtgaatcatctgtatgtgtgctccatctgccaggttgaaattgaggctctggcgaagcggagaaggatcgagatcgacacattcatcaaactgaataaggccttccaagccgaagagtcgccaggagtcatctactgtatcagcatgcagtggttcagagagtgggaggccttcgtgaagggcaaggataacgaaccccccgggccaatcgataacagtcggatcgcccaggtgaaggggtctggacatgtgcagctgaagcagggcgcagactacggacagatcagtgaggaaacatggacctatctgaacagcctgtacggtggcggccccgaaattgccatccggcagagtgtggctcagccacttggccccgagaacttgcatggggagcagaagatagaggctgaaactagggcggtttag

SEQ ID NO: 14399 - DNA, 1341 bp, Artificial Sequence
  Description of Artificial Sequence: Synthetic coding sequence
atgagggcggcacgtcggggattgcattgcgctggtgccgagagacctcggagacgaggacggctttgggatagctcaggggttccccaacggcagaagcgaccaggtccatggaggacacagacacaggagcagatgagcagggacgtgtgtatacatacatggccatgcacttactaccttgagcccaagagaaggtgggtcacaggacagttgtccctgacctctctttccctgcggtttatgaccgacagcacaggcgaaattttagtgtcatttcccctctcatccattgtcgaaatcaagaaagaggctagtcattttattttcagctccatcaccatcctcgaaaaaggccatgccaagcattggttctcttctctcaggcctagcaggaacgttgtgttctcaatcattgagcatttctggcgggaactgctgctgtctcaacccggggcagtggccgatgcgagtgtgccccggaccagaggagaagaactgacaggtctgatggcaggctcacagaagaggctcgaggatacggcacgggtgctgcaccatcaaggacagcaacttgactccgtcatgcggggcctcgataaaatggaatccgatcttgaagtcgctgatcgcctcctgactgagctcgaatcccctgcttggtggcccttctccagtaaactttggaaaaccccaccagaaactaagcctcgtgaggacgtgtctatgaccagttgtgagccattcgggaaggaggggatactcattaaaataccggctgttattagccacagaacggagagccacgtcaagccagggcgccttaccgttctcgtttcagggctggaaattcacgactcaagctctctcctgatgcatcgatttgaacgcgaagacgttgacgacatcaaggtgcactcaccatacgaaatcagtattcgacagaggtttatcggaaaacccgatatggcataccgtcttatatctgccaagatgccagaagttatccccatcctagaagtccaattcagcaaaaagatggagctactagaggatgccttggtgcttagatctgctaggacctcatccccagctgagaaatcctgctccgtgtggcatgctgcctcagggcttatggggcggacattacatagggaacctcccgctggggaccaagaaggcactgcacttcatttacagacatcgctccccgcgctttccgaggcggatactcaggagctgacacaggggttcagaccaatgtcgctgagcacgcagactgtccttgttatgctgtgctccgaatctgccggcgccttatggagacagaggctatcctag

SEQ ID NO: 14400 - DNA, 1896 bp, Artificial Sequence
  Description of Artificial Sequence: Synthetic coding sequence
atggctatcgtccagacgctgcccgtccccctggaacctgccccggaagccgccaccgccccacaggcacccgtaatgggctctgtgtcatctctgatctccgggagaccctgccccgggggacccgctccccccaggcaccacgggccgcccggtcctacttttttccggcaacaagatgggctgctgaggggaggatacgaggcccaggagcccctttgccctgcggtaccacctcgcaaagctgtgcctgtgacgtcttttacctacatcaatgaggactttcgaactgaatctcccccttcccctagctccgatgttgaagatgcacgggagcagcgagctcacaacgcccacctgagaggcccacccccaaagctcatccccgtgagcggaaagctcgaaaaaaacatggaaaagattctgattagaccgacagcatttaagccagtgttacctaagccccggggcgctccaagccttcctagttttatggggcctagagccaccggactgtcagggtcccaaggatcccttacacagcttttcgggggtcctgcttcctcctcatcgagcagctctagctccagcgctgccgataagccactggccttcagtggctgggctagcgggtgtccttcgggaaccttgtctgacagcggtcgaaacagtctgtcctccctgcccacttatagcacaggcggcgccgagcctaccacctcttcaccaggaggccacttaccctctcacggatccggcagaggagcgttgcctggtccagctagaggcgtgccaactggacccagtcactctgactcaggcaggtctagctccagcaaatctacaggatcccttggggggcgcgtggcaggcggcttgctggggagtgggacacgtgcctcacctgactctagcagttgcggagaaaggtctcctccacctcctccacccccaccctctgacgaagcgttgcttcattgcgtgctcgaaggcaaactgagagatcgtgaggcagaactgcagcagctgcgcgactctctggatgaaaatgaagccaccatgtgccaagcgtatgaggagagacaacgccattggcagagggaaagagaggccctgagagaggattgtgcagcacaggctcagcgggctcagagagcacaacaactgctacagcttcaagtgtttcagctgcagcaggagaaacggcagctccaagatgatttcgcccagttattacaggagagagagcaactggaacgcagatgcgctaccctggagcgcgaacagagagagttaggcccaaggttggaagagactaaatgggaggtttgtcagaaatcaggcgaaatctccctgttgaaacagcagctcaaggagagccaggctgaattggtccagaagggatcggagctcgtggcattgagggtggcgttacgtgaggcgcgggctactttgagagtgtctgaggggcgtgcccgcggactgcaggaagcagcacgggctagggagctagaactggaagcatgcagccaagagctacagcgccaccgacaagaagccgagcaactgcgagaaaaggcgggccagctcgacgctgaagccgctggactgcgcgaacctcccgtccctccagcaaccgccgacccttttctgctcgccgagtcggatgaagcttcagccacggctaatccggtgcacagacgctttcagcctacgccagcacgcggtgccgggaaaaaaaaaggcctccctccattgcatattccgcccgatcccaaggctcgtgaaagccagatggctccagccgcccctgatgttcctgcccacatcggggggcagggccgagcatgggctcggtttcctggactgagctctgcagcttcacttctggagtag

SEQ ID NO: 14401 - DNA, 1473 bp, Artificial Sequence
  Description of Artificial Sequence: Synthetic coding sequence
atgaacggcgctctcgaccatagtgatcagccggaccccgatgctattaaaatgttcgtgggtcaaatcccgcggtcatggagcgaaaaagagctcaaggagttatttgagccatacggcgctgtctaccaaataaacgtgctgcgggataggagccagaacccgccccagtcaaagggatgttgctttgtgaccttctataccagaaaagccgcactcgaagctcagaatgctctccataatataaagaccttgcctggcatgcaccacccaattcagatgaagcctgccgacagcgagaagagcaatgccgttgaggatcgaaaactgttcatcggcatggtgagcaagaagtgtaatgaaaacgacatccgggtcatgttctctcctttcggtcagattgaagagtgccgcatcttacgcggccccgacggtctttcacggggctgtgcattcgtgacattcagcacccgagcaatggcgcagaacgcaattaaggctatgcatcagtcccagaccatggaaggttgtagttcccccatcgtcgtgaaatttgccgacacccaaaaggacaaagagcagagaagattgcagcagcagctggctcagcaaatgcagcagcttaacaccgccacctgggggaatctgactggtctgggcggcctgacaccccagtacctggcacttctgcaacaggcaaccagtagttctaatttgggagctttttcaggaattcagcagatggctggtatgaatgctctccagttacagaacctggctacactagccgcagctgctgccgccgcacagacttctgctacttccaccaacgctaatcccctgagcaccaccagcagcgccctgggcgctctcactagcccagtcgccgcatctacaccgaatagtaccgccggggcagcaatgaattcattaaccagcctcggaactctgcagggcctcgcaggagctaccgtcgggctcaataatataaacgccctggccgttgcgcagatgctctccggaatggctgccctgaatggtggtttaggcgcaaccggtctgactaatggcactgctggcactatggatgcactcacacaggcatacagcggcatccagcaatatgcggctgctgccctaccaaccttatactcacagtccctgctgcagcagcagagcgccgcgggaagtcagaaggagggtccggagggcgcaaacctgttcatctatcacttaccccaggagtttggcgaccaggatattctgcagatgttcatgccatttggaaacgtgattagcgctaaagtatttattgataagcagaccaatctgtcaaaatgtttcggtttcgtgagctacgataatcccgtgtctgctcaggccgccatccaggcaatgaacggtttccagatcggcatgaagcggcttaaagtgcaattaaaaagaagtaaaaatgactccaagccatattag

SEQ ID NO: 14402 - DNA, 627 bp, Artificial Sequence
  Description of Artificial Sequence: Synthetic coding sequence
atggccgccagcgtggagcaacgcgagggtacaatccaagtccaaggtcaggccctgtttttccgagaggccttgccaggaagcggacaggccaggttctctgtgttgctgcttcatgggatccgattttcttcagagacttggcagaatcttgggaccctccatagacttgcacaggcggggtacagagccgtcgcaatagaccttccaggcctgaaaggcgagccccctgcacaggaacctctcttgtcacagtcacgggcatctttccttgctgccgtggtggacgcccttgaattaggtccaccagtagtgataagtcctagtctgtctggtatgtattccctgccatttcttacagcaccgggcagccagctgccaggcttcgtcccggttgctccgatttgtactgataagataaacgcagccaactatgccagcgttaagactcccgcactcattgtgtacggcgatcaagaccctatgggacagacctctttcgagcatctcaagcaattacccaaccatcgggtcctaattatgaagggcgcagggcacccctgttatttagacaaacccgaagagtggcacaccggcctgctggacttcctgcagggactccagtag

SEQ ID NO: 14403 - DNA, 546 bp, Artificial Sequence
  Description of Artificial Sequence: Synthetic coding sequence
atggagagtagatcagtcgcacaggcaggcgtacagtggtgcgatctaggaagtctccaacctccgcccccaggctttaagcagttttcttatttctcgctacagtccagctgggattaccgatatgtcccgccctgcccagcaaattttgtatttctggttgagatggggttcctccacgtcgatcaggccggactgaagttactgacctccggtatagatttcgccacaaggaagattgctaagttactgaaaccgcaaaaggttatcgagcaaaatggcgattcgttcacaattcataccaacagtagtctccgtaactactttgtcaagttcaaagtgggcgaggagtttgacgaggataataggggcctagacaacagaaagtgcaaatccctggtcatatgggacaatgatcgattgacctgcattcaaaagggcgaaaagaaaaaccgggggtggacgcactggatcgagggggacaagcttcacctggaaatgttctgcgagggacaggtgtgtaaacagacctttcagagggcctag

SEQ ID NO: 14404 - DNA, 1647 bp, Artificial Sequence
  Description of Artificial Sequence: Synthetic coding sequence
atgtccgcctctctcaattataaatcgttctccaaggagcagcaaacaatggataacctcgaaaagcagcttatctgccccatctgtctggagatgtttacaaagcctgtggttatacttccatgtcagcacaacctgtgccgcaaatgtgctagcgacatcttccaggcctctaacccatatctccctaccaggggcggcaccacaatggcgagcggaggtcggtttcgctgtccgtcctgtcgccatgaggtggtgctggatcgacacggcgtctacggtcttcagcgtaacttgctggtcgaaaatataatcgacatctacaagcaagaaagcacacgacccgagaagaaatcagatcagccaatgtgtgaagaacacgaggaggaacgaatcaacatttattgcctgaactgtgaggtccccacttgcagcttatgcaaagtgtttggagcccacaaggattgccaggtggcccctcttacccacgttttccaacggcagaaatccgagctctccgacggaatcgctatcttagtgggctccaacgatagagtacagggagtcatctcccagctagaagacacatgtaagacgattgaggagtgctgccgcaagcagaagcaagagctgtgtgagaagttcgattacctctatggcatcctagaagagagaaaaaacgagatgacccaagttattaccaggactcaggaggagaaactcgaacacgtaagggcactgataaagaaatattcagatcacctggagaacgtgagcaagctggtagagtcgggcattcagttcatggacgaaccagagatggccgtttttctgcagaatgctaagaccctcctgaaaaagatctcggaggcctccaaagccttccagatggaaaagattgagcatggttatgagaacatgaaccacttcacagttaatctgaacagagaggagaagataattcgagagatcgatttctatcgcgaagacgaagacgaggaagaggaagaggggggagagggggagaaagagggcgaaggcgaagtgggaggggaagcggtggaagtagaggaagttgaaaacgtgcagactgagtttcccggcgaagacgagaatcctgagaaggcctctgagctatcccaggttgagctgcaggcagcacctggcgctctgccggtgagttcgccggagcctccccccgctctcccaccagccgcagacgcacctgtcacccagggtgaagtcgttccaaccgggtcagagcagaccacagagtctgagactcctgttccagctgccgccgagacagccgatccattgttttaccctagctggtataaaggccagactcgaaaagcaacgacaaatcccccttgcacccccggtagcgaggggctgggacaaatcggccctcctggctcagaagactctaacgttaggaaggccgaagtcgcggccgcagcagcctctgaaagggccgcagtcagcggcaaggaaacgtcagcccctgctgcaacctcgcagatcgggttcgaggcacccccgctgcaggggcaggcagccgcccccgcatcgggatctggtgccgactccgaacctgcccgtcatatttttagctttagttggctaaactctcttaatgaatag

SEQ ID NO: 14405 - DNA, 1374 bp, Artificial Sequence
  Description of Artificial Sequence: Synthetic coding sequence
atgtttcctaagttttctctccggagcatgttccacggggccggcggtgggaacgatatacagtggtgtttcagccaggtcaaaggggctgtcgatgatgatgtggccgaggccgacataattagcacagtggagttcaaccatagtggggagttgctggctacaggtgataagggcggtcgcgtagtgatttttcagcaagagcaggaaaataaaatccaatctcatagcagaggcgaatacaatgtctactccaccttccaatctcacgagcccgagttcgactatctcaagtcattggagatcgaggagaaaattaacaagattcggtggctgccacagaaaaacgccgcccaattcctcctgagtaccaatgataaaaccatcaaactgtggaagataagtgagagggataaacgccccgagggttacaacctgaaggaggaagatggccggtacagggatccaacgactgttactactctgcgcgtacccgtattccgccccatggacctgatggttgaagcatccccccgccgcattttcgctaacgcacacacttatcatatcaacagcatttcaataaatagcgattacgagacttatttaagcgccgacgacctcagaatcaacctatggcacctagaaatcactgaccggagttttaacatagtcgacattaagccggccaatatggaagaactaacggaagtgattactgccgcggagttccatcctaactcttgcaatacatttgtctatagctcctcaaaaggtaccattcggctgtgcgacatgagagcctctgctctgtgcgatcggcatagtaagctttttgaggaacccgaggatcctagcaataggtctttcttctcagaaatcatctcaagtatcagcgacgttaaattcagtcacagcggtagatatatgatgactagagactatctctccgtgaagatatgggacctgaatatggagaatcgacctgtcgaaacctaccaagtccacgaatatctccgttctaagctgtgtagtctttacgagaacgattgcatatttgataagttcgaatgctgctggaatgggtccgactccgtcgtgatgacaggtagttacaataacttcttccgcatgtttgacagaaataccaagcgggatattacattggaggcaagcagagagaacaataagcctcggaccgttctgaaacccagaaaggtctgcgcatccggcaaacgcaaaaaagacgagatcagtgtggattcactcgacttcaacaagaagatcctgcacaccgcttggcatcctaaagaaaacattattgccgtggccactaccaacaatctttatatttttcaggataaggtcaattag

SEQ ID NO: 14406 - DNA, 738 bp, Artificial Sequence
  Description of Artificial Sequence: Synthetic coding sequence
atggcaggcttggagcttctgtccgatcaaggctatagggtcgatggacggagggcaggagaactgagaaaaattcaggcccggatgggagtttttgcgcaggccgacgggagtgcctacatcgaacagggaaacaccaaggctcttgcagtcgtgtacgggcctcatgaaatacgggggagtagagcccgcgctctaccggatcgagccctggtgaattgtcagtacagctcagccacattttcgactggggagagaaagcgccgccctcacggcgatcgcaagagctgcgagatggggctccaacttcgccagacgttcgaggcggcaattctgacgcagctgcaccctcgctcacagattgacatttatgtgcaggtgttacaggctgacgggggtacttacgccgcctgcgttaacgcagccaccctggcagtgctggacgccgggataccaatgagagacttcgtctgtgcatgtagcgccggctttgtcgacggtacagccttggcagacttgagccatgttgaagaagccgcaggagggccgcagctggccctggccttgctgcctgcttccggacagattgccctgttagaaatggatgcccgtctacatgaagatcacttagagcgggttcttgaggcagccgcccaggctgcccgagatgtacacactcttctcgatagggttgtacggcagcacgtcagggaagccagcattctgctcggggactag

SEQ ID NO: 14407 - DNA, 2631 bp, Artificial Sequence
  Description of Artificial Sequence: Synthetic coding sequence
atgatggctgacggtgccgctgctggggccggcgggtcaccttcacttagagaactgcgcgctaggatggtggcagccgcaaacgaaatagccaaggagagaagaaaacaggatgtggttaacagggtcgctacacactccagtaacataaggagtacattcaaacccgtaatagacggaagcatgttaaaaaacgatatcaagcaaaggcttgcacgcgaaagaagggaggagaagcgacgacagcaggacgctaataaagagacacagctgcttgagaaagagcggaagactaagttacagtacgagaagcagatggaagaaagacagcggaagctaaaggagagaaaggaaaaagaggagcaacgtagaatcgccgccgaagagaagcgtcatcagaaggatgaagctcagaaagagaagttcacagccatactgtaccgaacattagaacggaggaggctcgctgatgattaccaacaaaagagatggtcttgggggggaagtgccatggccaactctgaatctaaaacagctaataagagatcagctagcacagaaaagcttgagcagggtacaagcgctctgattagacagatgcctctgtcatcagccggtctgcagaactccgtggcgaaacggaagactgacaaggagcggtcatccagtttgaacaggcgagactcaaacctccacagctctaccgataaggagcaggcagagcgcaaaccgagagttacaggtgtgacaaactacgttatgcagtacgtgactgtccccctacggaaatgcaccagcgacgagttgagagcagtcatgtttcctatgtccaccatgaagataccaccgcagactaaagttgaagagagtcctctggagaaggtggagaccccccctaaggctagtgtggatgctccaccacaagtcaacgtagaggtgttttgcaacaccagtatggaagcttctccaaaagcgggtgtcgggatggcccccgaggtaagtacagatagcttccccgtcgtcagtgtagacgtgtctcccgttgtaagcacctatgattctgagatgtccatggatgcctccccagaactctcaatcgaagccctgccaaaggtggacctcgagacagtacccaaagtgagcattgttgcctctcctgaggcctccctggaggcccccccggaggtgtctctggaagcgctgccagaagtgagcgttgaagccgcacccgaagggagcttagaagcaccaccgaagggttctgccgaggtagctcctaaagagtcggtgaaaggatccccaaaagagtcgatggaagccagccctgaggcaatggttaaggcctctcctaaaacttcgctggaggcatctatggaggccagtcccaaggcaaaagctcgagatgcccctaagaagtcagagatggacaagcaggcgcttatcccaattgccaagaagaggcttagcagctacaccgagtgctacaaatggtctagttcaccggagaatgcttgcggccttccatccccaatcagtaccaaccggcagatccagaaaaactgtcccccttcacccctgcccctgatttctaagcaatccccccagacatcatttccatataaaatcatgccgatccagcacaccctatctgttcagagcgcttctagcaccgtgaaaaaaaagaaagaaacagtctctaaaacaaccaaccggtgtgaagcactgtctcagcgccacatgatttatgaggagtcagggaacaaatcaactgcgggaatcatgaatgcagaagcagcaactaaaatactgacagaacttaggcggctagctcgggagcagcgagagaaagaggaggaggagaggcaacgggaggagatgcagcagcgggtaattaagaagtccaaagacatggcaaaggaggccgtgggcgggcaggcggaagaccacctgaaacttaaagatggacagcagcagaatgaaaccaagaagaaaaaagggtggctagaccaagaagatcaagaagcaccactgcagaaaggcgatgccaaaatcaaggcccaagaggaggcggataagaggaagaaagaacacgaaagaattatgctccagaacctgcaagaacgcctggagcgcaagaagcggatagaggagatcatgaagaggactagaaaaactgacgtgaacgctagcaaggtgaccgagaccagtagtcacgatatctatgaggaagctgaggctgacaacgaagagtcagataaggacagtttgaacgaaatgttcccaagtgccatcctgaacgggaccggatcccccacaaagttcaaaatgcccttcaataacgccaagaagatgactcataagctcgtttttctggaggatggtacttcacaggtgagaaaggaacccaagacctacttcaatggagacctgaagaactttaggcagaaatccatgaaagacaccagcatccaagaggtcgtgagcagaccgtcgtctaagcgcatgaccagtcacaccactaaaacacgaaaggctgatgagacaaatacaactagccggtcaagcgctcaaacaaaatctgagggattccacgatatcctgcccaaaagctcagatacttttaggcagtag

SEQ ID NO: 14408 - DNA, 6291 bp, Artificial Sequence
  Description of Artificial Sequence: Synthetic coding sequence
atgtgcagcacacccggtatgccagctccaggcgcgtcactagctctacgcgttagctttgtagacgtgcaccctgatgtgattcctgtccagctgtggggactggttggcgagcgcaggggcgagtacctgcgcctcagccgggaaatccaagaagccgctgctacacgaggacaatgggccctagggtcagccagcgcatctcctggagaattgtgcttggttcaggtgggattgttgtggcacaggtgcagggtcgtgtcgcgccaggcccaggagtcgcgtgtgtttctcttagatgaaggaagaaccattacggcgggcgcaggtagtctggctccgggtcgaagggaatttttcaacctccctagcgaggttctgggctgtgtcctggccggcctcgtcccagcagggtgtggcgctggctctggggaaccaccacagcactggcctgctgacgctgtggactttctctcgaacctgcaaggcaaggaggtgcacggatgcgtcttagatgtgctcttgcttcaccggttggtactgctcgaagtaccggacgtgtttcaacagatgcgagagctgggtctggcccggcgggtcccggactccctgtttagaagcttgcttgagcgttatctcacagccgccactgctagtgttggctctggcgtaccggtgctctctcgcgtaccactgaagcaaaagcagcctggattagattacttttaccctcaactccagcttggagtaactgaagctgtcgtgatcacacaggtgtgtcatccccaccggattcattgtcaattgagaagtgtcagccaagaaatccacaggctgtccgaatcaatggcgcaagtctaccggggctcaacgggcaccggtgacgagaattccacttcagcaacttgggaggagcgagaagagagcccggataaacctggtagcccctgcgcctcctgtgggttggatggacattggtatagggctcttttgctcgagacctttcgcccccagagatgtgcccaggtgcttcatgtagattacggacgcaaggaactggtgtcgtgtagttctcttaggtacctcctgccagagtacttccgcatgccggtggttacctatccttgcgccctgtacggcctgtgggatggcggcagaggatggtcaaggtctcaggtgggggacctcaagactctcatactcgggaaggctgtaaacgccaagatagaattttactgtagctttgagcatgtgtactacgtctccctctacggcgaggatggcattaatctgaatagagtctttggagtgcagagttgttgtttggccgatcgggttctgcaatctcaggccactgaagaggaggaacccgagacatcccagtctcaatcccctgccgaggaagtggacgaagagatcagcctccctgccctgaggtcaattcggctcaaaatgaatgccttttatgatgcgcaggtcgagttcgtgaagaacccttcagaattctggattcgtctaaggaaacataatgtgaccttttcaaagctaatgcgccgaatgtgcggcttttattccagtgcgtccaagctcgatggtgtcgtgctgaagcccgaaccggatgacctctgctgcgtgaagtggaaggagaacggctactaccgtgccatagttaccaagctcgatgataagagtgtggacgtgtttttggtggatagaggcaactctgaaaacgtagactggtacgacgtgcggatgttgttgcctcagtttaggcagttaccaatcctggcagtgaaatgcacccttgccgatatctggccgctcggaaagacatggagtcaagaagcagtctctttcttcaagaagacagtgctccacaaggaactggtcatccatatcttagacaaacaagatcaccaatatgtcatcgaaatcctcgacgagtcccgcactggtgaagagaatatttctaaagtgattgcgcaggctggctatgctaagtaccaggagtttgagacaaaggagaacatcctggtcaacgctcacagccccgggcatgtctcaaatcatttcaccaccgagtccaacaaaatcccgtttgctaagacaggggagggcgaacagaaggccaaaagagagaataagactactagcgtctccaaagccctatctgacacaaccgttgttacgaatggctccaccgagctcgtcgtacaagaaaaggtcaaacgggcctccgtgtacttccccctcatgcaaaactgtctggaaatcaagccaggctcctcaagcaaaggtgaactggaggtgggctcaactgtggaagttcgcgtttcctatgtcgaaaatccaggttacttctggtgtcaactgactcgtaatatccagggtctgaagaccctgatgtctgacatccagtattattgcaagaatacagcagcgcctcatcagaggaatacactggcttgtctggccaagaggaccgttaaccgccagtggagccgagctctgatcagcggtatccagagcgtcgagcacgtcaatgttacatttgtcgattatggagatagagagatggtgtctgtcaagaatatctacagcatctccgaggaattcttaaaagttaaagcccaggcatttaggtgctcactgtataatctcattcagccagttggacagaacccatttgtgtgggacgtgaaagcgattcaggcctttaatgaattcattgacaatgcgtggcagaagaacctagagttgaagtgcactatctttgctttggcgagcataaatgaggaattgtttaatattgtggacctccttactccattccagtcagcttgtcatttcttagttgagaagcgcctagcgcgccctgtgaagcttcagaagcccctggagagctctgtgcagttacattcttacttctattcaacccacgacatgaagataggttctgaggagcttgtgtacattacccatatcgacgatccttggacattttactgtcagctcgctagaaatgcgaacatccttgaacagctgagctgcagcatcacacaactcagcaaggtcttgctgaacctcaagacgagccctctgaacccgggcaccctgtgtctggccaaatacaccgacggaaattggtaccgggggatcgtgatcgagaaggagccaaagaaagtcttctttgtggatttcggaaacatctacgtcgtcacatctgacgacctgctaccaataccatctgacgcatatgatgtgctgctattgcccatgcaggctgtgcggtgctctctttctgatattccagatcatatcccagaagaggtggtggtttggtttcaggagactatcctggataaaagcctcaaggctttggtggtcgcaaaggatcctgatggtacgctcattattgagctgtacggggataacatccagatttcggccagcatcaacaaaaagctgggtcttctgtcttacaaggatcggataagaaaaaaggaatcagaggtcctgtgtagcacgacggaaaccctggaggaaaaaaatgagaatatgaagctgccttgtaccgagtatttgtccaaaagcgttggatataaacttcccaacaaggaaatacttgaagagagctataagccccaaattaatagttcctacaaagagcttaagctgttgcagagcctgacaaaaacaaatctcgtaacccagtatcaagattctgtcggcaacaaaaactcacaagttttccccctgactaccgagaagaaagaggagatctccgccgaaactccacttaagacggcaagagtcgaagccacattaagcgagagaaaaattggggatagttgcgacaaggacctccccctgaagttctgtgagttcccccagaagaccattatgccggggttcaaaacgacagtttatgtttcccatatcaatgatttgtccgacttttacgtgcagctcattgaggacgaagcggagatcagccatctgtctgagcggcttaattccgtgaagacaaggcctgaatattatgtcggccctccactgcaacggggcgatatgatttgcgccgtattcccggaggacaatttgtggtaccgagcagtgatcaaagaacaacaacctaatgacctgcttagcgtgcagtttatagactatggcaacgtgtcagtcgtgcacacaaacaagatcgggaggctagatctggtgaacgcgatcctgcccggtctttgcatccattgcagcttgcaggggttcgaagtgcctgacaacaagaactccaaaaaaatgatgcattacttcagccagagaacttctgaggccgccatacggtgcgaattcgtgaagtttcaagatcgttgggaagtgattctcgcggacgaacatggaattatagccgacgacatgatttccaggtatgcactcagcgagaagagtcaagtggagctctcaacgcaggtgattaagagcgcctcgtctaagagcgtgaacaaatcagatatcgatacatcagtgtttctgaactggtacaacccggaaaaaaaaatgattcgagcttatgctactgttatagatggccccgaatatttttggtgtcagttcgcagacaccgagaaattacaatgcttggaagtggaggtgcagacagcaggcgaacaggtggccgacagacgcaattgcattccctgcccctatatcggtgatccctgcattgtccgctatcgagaggatggacactactatagagccctcataactaacatttgtgaagactatctggttagcgtgcggctagtcgacttcggaaatattgaagactgtgtggatcctaaagccttgtgggccattccgagcgaattactgagtgttcccatgcaggcatttccctgttgtttaagcggcttcaacatcagcgaaggcctctgcagtcaagaaggcaacgactacttttacgagataatcacagaggatgtcttggagataacaattctcgagattcgccgagatgtttgcgacattccattagcaatagtggacctcaagtcaaaagggaagagcatcaatgagaagatggagaagtattcaaagacaggaataaagtcagcactaccgtacgaaaatatcgacagtgaaattaaacaaacactgggctcttacaacctcgatgttggactaaagaagctgagtaacaaagccgtgcaaaataaaatctacatggagcagcagacagatgaactggctgagataacagagaaggatgtgaatatcattggcactaagccatccaacttccgcgaccctaaaacagacaacatctgcgagggatttgagaacccttgcaaagacaagattgatactgaagagctggaaggcgagctggaatgccatctggtggacaaggccgaatttgacgataaatacttaatcacaggctttaataccctgctgcctcatgctaacgagacaaaggaaatcctcgagttgaattccctggaggtgccattatcccctgacgacgagagtaaagagtttttagagttggagagtatcgagctgcagaattcactggtggttgatgaagagaaaggagaattgtcacccgtgccaccaaatgtgcccctgtcccaggaatgtgtgacaaaaggagctatggagctcttcaccctgcagctcccgctttcgtgcgaagccgagaagcagcctgaactggaactgcctacagcccaactgcccttagacgacaagatggatcctctctccctgggcgtgtctcagaaagctcaagaatctatgtgtaccgaggacatgagaaaatcgtcctgtgtggagagctttgatgatcagcgacgaatgtcactgcatttgcacggagccgactgcgatccaaagactcagaacgaaatgaacatctgtgaagaggaattcgtggagtacaagaatagagacgccataagcgcgctaatgccactgtttagcgaggaggagtcctctgacgggtctaagcacaataacggcctaccagatcatatatccgctcagctgcagaacacctacacactgaaagcctttaccgtcgggtcaaaatgcgtggtgtggagcagcctcaggaatacctggagcaagtgcgaaatactcgagactgcagaggaaggcacacgtgttttgaatctaagcaatggcatggaggagattgtgaaccctgagaatgtctggaacggtatcccaaagctcgacaaatcaccacccgagaaacgaggactggaggtgatggaaatatag

SEQ ID NO: 14409 - DNA, 690 bp, Artificial Sequence
  Description of Artificial Sequence: Synthetic coding sequence
atgggcaaatcctgtaaggtggtggtttgcgggcaggcatccgtggggaaaacctccatacttgaacagttactctacgggaaccacgttgtcggctccgagatgatcgaaacacaggaggacatttacgtcgggagcattgaaacagatagaggtgtgcgggagcaggtgcggttttacgacacaaggggcctgcgagatggcgcagaactccctcgtcactgtttttcttgtacggacgggtatgtgctggtgtattccactgatagcagagagtcatttcagcgtgtggagctgctaaaaaaggaaatcgacaagtcaaaggataagaaagaagggctgactctccccccgcgacttgagtgctctggcatgatcacggcacattgttccctgaacctgccacggttgcgctggagtagctgccttagccctttgctgaggctgcaagtcacaatcgtggtcctcggtaacaaatgcgacctccaggagcagaggcgagtcgacccagacgtggcccaacattgggccaagagcgagaaggttaagctgtgggaggtctctgttgcagaccggaggtcgctgctcgagccttttgtatatttggcaagcaagatgacacaacctcagagtaagtccgcattcccgctcagtcgtaagaacaagggcagcggctcactcgatggctag

SEQ ID NO: 14410 - DNA, 2412 bp, Artificial Sequence
  Description of Artificial Sequence: Synthetic coding sequence
atggagagcggtcctcgggcagagctaggggcaggggctcccccagccgtggtggcccgcaccccacccgagccaagaccctcccccgagggagaccctagccccccccctccaccaatgagcgcattagtgcctgataccccccccgacaccccacctgcgatgaagaacgcaacctcttctaagcagctgcctctggagccagagtcccccagtggccaagtgggccctagaccggcacccccacaggaggagtctccaagcagcgaggctaagagcagaggaccaacacccccagcgatgggacctagggacgcccgcccccctagacgctcgagtcagcccagccccacagctgttcctgcctcagactctcccccaaccaagcaagaagtcaagaaagccggtgagagacataagctggccaaggagaggcgagaggagcgagccaagtaccttgcagccaagaaggctgtttggttggagaaagaggagaaagctaaggccttgagagagaagcagttacaggaaaggcgtaggcgcctagaagaacagaggctaaaagccgagcagcgccgggcggcgctcgaggagagacagcggcagaagctagaaaaaaataaagagcgctacgaagccgcaattcaaagatctgtgaagaaaacttgggctgagatcaggcagcagcgttggagttgggccggggctctccaccactcatcacccggccataaaaccaacaggtccttacagttgtctgcctgggagagttctattgttgaccgcttgatgactcccaccctgagcttccttgccagatcaaggtcggccgtcacactgcctcgcaacggccgggaccagggccggggctgcgatcccggccgcgggcccacgtggggacgggctggggctagcttggcaagggggcctcagccagatcggacccatccctccgccgcagtgcccgtgtgccctcgctccgcctccgcaagccctctgactccatgctctgttacacgaagtgtacaccgttgtgcgcccgcaggggagcgcggagagcgcaggaagcctaacgccggagggtcacccgccccagtgcggaggaggcccgaggccagtcccgtccagaaaaaggagaagaaggacaaggagcgggagaacgagaaagaaaagagcgccttggctcgggagcggtctctcaagaagcggcagtcattacctgctagcccccgtgccagactgagcgctagcaccgcctcagagctatctcctaagtcaaaagcaagaccaagtagcccttcgaccagttggcatcggcccgcttcgccatgcccttcccctgggcccggccatactttacctcctaagcccccctctccaaggggaacaaccgcctcacccaagggacgggtacgcagaaaggaggaggccaaagagtcacccagcgcggctgggccagaagataaaagtcagagcaagcgcagagcctctaacgagaaggaatcagccgccccagccagccccgccccttctcctgcacccagcccgactcccgcgccaccgcaaaaggagcaaccacctgccgagaccccgacagacgctgccgtccttacatctccacctgcacccgcaccccccgtcacgccttcaaagccaatggctggcaccactgaccgcgaggaagccacaaggctccttgctgaaaaaagaagacaggcccgcgagcagcgggagcgcgaggaacaggaacgcaggttacaagccgagagggacaagaggatgcgcgaggagcagctcgcccgagaggccgaggccagagccgaacgcgaagcagaggcccgcagacgcgaggagcaggaagctagggagaaggcccaagccgagcaagaggaacaagagcgcctacagaagcagaaagaggaggccgaagctcgctcgagggaagaggctgagcggcagcgcctcgagagagagaagcattttcaacagcaggagcaagagcgccaggaacgacgcaaaagactcgaagagattatgaagaggacccgtaagagcgaagtctccgagaccaaaaaacaagattcaaaggaagcgaacgccaacggatcatcacctgagccagtgaaagctgttgaagctcgcagccccggactacagaaggaagccgtccaaaaagaggagcctatccctcaggaaccacagtggagcctcccttccaaggagcttccagcatccctcgttaatgggcttcagccgttgcccgctcaccaggagaacggcttcagcacgaacggtccttccggcgacaaaagcttatcccgcacaccagagactctgctgccattcgccgaggccgaggcgtttctgaaaaaggccgtcgtccaatcccctcaggtgacagaagttctttag

SEQ ID NO: 14411 - DNA, 1125 bp, Artificial Sequence
  Description of Artificial Sequence: Synthetic coding sequence
atgcgcgctccaatgctccaaaagcagcaagctcctcggatggataccccaccgcccgaggagaggcttgagaaacagaacgaaaagttgaataatcaggaggaagagacagaatttaaggaactggatggtctacgagaggctctggccaacttacgcggattgtcggaggaggagagatccgaaaaggcaatgctgaggtcccgtattgaggagcaatcccagctcatttgtatcctaaaacgccgatccgacgaggcattagagagatgccagatccttgaattacttaacgctgagctcgaggagaagatgatgcaggaggctgagaagctgaaggcacagggagagtattctcgcaaattggaggagaggttcatgactctcgccgccaaccacgagttgatgctgaggttcaaggatgaatacaagagcgagaatataaaacttcgagaagaaaatgagaagctccgattggagaactcctcgctgttctcacaagccctgaaagatgaagaagccaaggtgttgcagctgactgtcaggtgcgaggctctcaccggagagcttgaaacgctaaaggaacggtgcgctcaagatgcttgccaggcacaggccagggagaaagagctgctcgaactccagtcccagcaggcttgtacacacaccaaggagaccgagcagcttcggtcgcaactgcagacactgaaacagcagcatcaacaggccgtggaacagatcgccaaggctgaagagacccatagtagtctttctcaggagttgcaagctcggctccagacagtgacgcgcgaaaaggaagagctattgcagctgtccatcgagcgcggaaaggtactccagaataagcaggccgaaatctgtcaactcgaggaaaaattagaaatcgccaatgaggatagaaagcacgcattggagcgatttgagcaggaggccgtcgccgtcgatagcaacctgcgtgttcgcgagctgcaacgcaaagtcgacggcatccaaaaagcgtatgacgagttgcggctgcaaagcgaggctttcaagaaacactctctagacttgttgtctaaggagcgggaattgaatggaaagctgaggcacttgtctccctag

SEQ ID NO: 14412 - DNA, 585 bp, Artificial Sequence
  Description of Artificial Sequence: Synthetic coding sequence
atggaagacgggctgctagagatcatgactaaggatggcggggacatgccagccccactggaagtgagcaccgtgcctgctgtgggggatgtgatttcaggcgagtataacggaggcatgaaggagttgatggaacacctcaaggcccagctccaggctcttttcgaagatgtgcgcgccatgcggggtgctctggacgaacaggcctctcatattcaagtgctgtcggacgacgtctgcgccaaccagcgggccatagtcagcatgtgtcagatcatgaccacagcacctcgacagggtggccttggagtcgtcggtggaaagggctccttccagagcgatcctcaagagcccgaaacaccaagccctggaatcggcgactccggactcctcggacgggaccctgaggatgaagaagaggaagaggaagagaaggagatgcccagcccagctaccccttcgagccattgtgagcggcctgagtctccatgtgccggcttgctcggaggtgacggaccactcgtggaaccccttgatatgccagatatcacactgctccagttggagggtgaagcctcattatag

SEQ ID NO: 14413 - DNA, 1281 bp, Artificial Sequence
  Description of Artificial Sequence: Synthetic coding sequence
atggctcacctgaggggctttgccaaccagcactcacgcgttgacccagaagaactgtttacaaagttagaccggattggcaagggcagcttcggagaagtgtataaaggtattgacaatcacactaaggaagtggtcgcgattaaaatcatagacctcgaagaagctgaggacgagatcgaagacattcagcaagagatcaccgtgttgagccaatgtgattcaccgtacattacccgatacttcgggagttacttaaagtctaccaagctgtggattattatggagtacctaggaggaggttccgcgcttgatttgcttaaacctgggcctctggaagagacctacatcgcaaccattctcagggaaatcttgaagggactggactatttacactctgaacgcaagatccatcgggacataaaggccgccaatgttctcctgagtgaacagggggacgtgaaactggctgacttcggcgttgccgggcagctgacagatacacagatcaaacgcaatacctttgttgggactcccttttggatggcacccgaagtcatcaagcagtctgcctatgatttcaaagctgacatttggtctcttggcatcactgccatcgagctggcaaaaggcgagccaccaaattctgatttgcatccaatgcgggtactgtttcttattcctaaaaatagtcccccaacattggaaggccagcacagcaagccctttaaggagttcgtggaggcatgcctgaacaaggatccgcggtttcgccccaccgctaaggagttgttgaaacacaagtttataactcgctataccaaaaaaacgtcttttctgaccgaactgattgataggtataagcgttggaagtcggaaggtcacggggaggaaagctcgagcgaggactcagatatcgacggtgaagccgaagatggggagcagggccctatctggactttccctcccaccattcgacctagcccgcactctaagcttcataaaggaacagccctccattcatcgcagaaacccgcggaaccagtaaagaggcagcctcgctcacagtgcctgtccacgctcgttcgtcccgtgttcggggagttaaaggagaagcataaacagagtggcggctctgtgggggccctggaagagctggagaacgccttctctctggctgaagagtcctgcccggggatctcggacaagctgatggtgcatctggtcgagcgagtgcagaggttctcacacaaccggaaccatctaacctcaactaggtag

SEQ ID NO: 14414 - DNA, 1350 bp, Artificial Sequence
  Description of Artificial Sequence: Synthetic coding sequence
atgatgttgtctaccgagggcagagaaggttttgtagtgaaagtgaggggcctgccatggtcatgcagcgccgatgaagtcatgaggtttttttcggactgcaagatccagaatggcacatccgggattcggtttatttataccagggagggaaggcccagtggggaggccttcgtggagctggaaagtgaggaggaggtgaagctagcactcaagaaagacagggagactatgggccaccgatacgtggaagtcttcaagagcaactcagtggagatggattgggttttgaagcacaccggccctaacagccctgacaccgctaacgacggattcgtgcgactccgcggattgccttttggctgctctaaggaggaaatagtgcagtttttcagcgggctggagatagtgccgaacggcatgaccctaccagtcgacttccaggggagaagcaccggggaagccttcgtacaattcgcatcccaggagatcgcagagaaggcgttaaagaaacataaagagcggatcggccatcgctatatcgaaatctttaagagttcacgcgccgaggtgagaacccactacgacccccctcggaaattgatggctatgcaacggccgggcccatacgatcgtcctggggccggtaggggctacaattctatcgggagaggagctggctttgagagaatgagacgtggagcttacggaggcggatatgggggctacgatgactatggtgggtacaatgatgggtacggcttcggatcagatcgcttcggccgagacttgaactactgtttcagcggtatgtccgatcataggtacggggatgggggttcatcattccaaagtactacaggccactgcgtgcacatgcgaggcctcccttatcgcgcaacggagaacgatatttataacttctttagccccttgaacccaatgcgagttcacatcgagattggtcccgatgggcgcgttactggggaagccgatgtggagttcgcaacacacgaggatgctgtcgctgccatggcaaaggacaaagccaatatgcagcatcgctatgtcgagctcttcctaaacagcactgcgggcaccagcggaggcgcgtacgaccattcatacgtggagctgttcctgaacagtaccgccggtgctagcggcggtgcttatggctcccagatgatgggtggaatgggactatcgaatcagtccagctacgggggtccagcttctcagcagctgtcaggcggttatggcggggggtatgggggccaaagcagcatgtctggctatgatcaggttctgcaagaaaacagctctgattaccagtccaacctagcttag

SEQ ID NO: 14415 - DNA, 1317 bp, Artificial Sequence
  Description of Artificial Sequence: Synthetic coding sequence
atgtgtcctaagaacgccagttactatgggaatcgcgctgctactttgatgatgttggggcgattccgggaggctctgggagacgcccaacagagcgtccgattggatgactccttcgtccggggacatctgagggagggaaagtgccacctgtctctcgggaatgctatggcggcttgcagaagctttcaaagggccctggaattagaccacaagaatgcacaagcccagcaggagtttaaaaatgccaatgcagtcatggaatatgagaaaattgctgaaacagattttgagaaaagagatttccgaaaagtggtgttctgcatggatagggccttggaatttgctcctgcatgccatagattcaaaatcctgaaggccgaatgcctcgccatgctgggccggtatcctgaagcccagtctgtggcatcagacattcttaggatggattcaaccaacgcagatgccctgtatgtgcgcggactctgcctgtattacgaggattgcatcgaaaaggctgtgcaattctttgtgcaggcacttcgtatggcgccggatcatgaaaaggcgtgtattgcgtgtcgcaacgcaaaggctctcaaggctaaaaaagaagatgggaacaaagcttttaaggaaggaaattacaagcttgcctatgaactatataccgaagcactcgggattgatcctaataatatcaagaccaatgccaagctgtactgcaaccgaggtacggtcaacagcaaattgaggaagctggacgatgccattgaggactgcactaacgctgttaaacttgacgatacttacattaaggcctacttgcgtagggctcagtgttacatggataccgagcagtacgaagaggccgtacgggattatgaaaaagtgtaccagactgagaaaaccaaggagcataagcagttattgaaaaatgctcaacttgagttgaagaagagtaaacgcaaggactattataagattctaggggtggacaaaaacgcctctgaggacgaaattaaaaaggcctaccggaaacgagcacttatgcaccaccctgataggcactctggggcgtcagctgaggtacagaaggaagaggagaaaaaattcaaggaggtcggtgaggcgtttaccatcttgtcggaccccaaaaaaaagacaagatatgatagcggccaagacctggatgaagagggcatgaacatgggcgatttcgacccaaataatatttttaaagcttttttcggcgggcctggcggcttctcattcgaggcgtcaggacccgggaatttcttttttcaatttggatag

SEQ ID NO: 14416 - DNA, 165 bp, Artificial Sequence
  Description of Artificial Sequence: Synthetic coding sequence
atgccgggcaaaaaggccaggaaaaatgcccagccctccccggcaagagcgccagccgaacttgaagtcgagtgcgctacccagctgcggagattcggtgacaaattaaattttaggcaaaagctcctgaatttgatttcgaagctcttctgctcaggtacttag

SEQ ID NO: 14417 - DNA, 1404 bp, Artificial Sequence
  Description of Artificial Sequence: Synthetic coding sequence
atggcctccgttgctgctgctagggctgtgcctgtgggatctggactccgcggactgcagcggacgctcccattagttgtgatacttggtgccacaggaacgggtaaaagcaccttagccctacaattggggcaaagattggggggggagatagtctcggcagacagcatgcaggtgtacgagggactcgacattatcaccaataaggtgtcagctcaagagcagagaatctgccggcaccacatgataagcttcgtcgacccactggttacgaactacaccgtggttgacttccgaaatagggctaccgctcttatcgaggacatcttcgctagggataaaattcctatagttgtcggcggcacaaactactacatcgagtcgctgctctggaaggtattggttaataccaagccccaagagatgggcacagagaaagtcatcgacaggaaagtcgaactcgaaaaggaagatggtttggtcctgcacaagaggctgagtcaggtggaccccgagatggcggcaaaactgcatccccacgacaaaagaaaagtggcaagaagtctgcaggtcttcgaagagacaggaatcagccattctgaattcctgcatcggcaacacaccgaggagggcggcggccccctcgggggcccattaaagttttccaacccttgtatcttgtggctgcacgccgatcaggctgtgctggacgagcgccttgataaacgcgtagacgacatgctcgccgcaggcttattggaagagttaagggattttcaccgtagatacaatcaaaagaatgtcagcgagaacagccaagactatcagcacggcatattccagtcaattggcttcaaagaattccacgaatacctaatcaccgaaggcaagtgtactctcgagacatccaaccagctcctcaagaagggaattgaagcactaaaacaggtgaccaaacggtacgctaggaaacagaaccggtgggttaagaatcggtttctttctaggcccggccccattgtgccaccagtttacggcctggaagtgtcggacgtgagtaagtgggaggaatccgttctggaacccgcccttgaaatagtacaatcgttcatacaaggtcacaaacctaccgccaccccgattaaaatgccatacaatgaggcggagaataagcgttcataccatctatgcgatttgtgcgacaggatcattatcggcgatagagagtgggccgcccatattaagtcaaagtcacacttgaaccagctaaaaaaacggaggcggctggattccgacgctgtgaacaccatcgaatcgcaatccgtttctccagatcacaataaggagccgaaggagaaggggtctcctggtcaaaacgaccaggagctgaaatgttcagtatag

SEQ ID NO: 14418 - DNA, 558 bp, Artificial Sequence
  Description of Artificial Sequence: Synthetic coding sequence
atgggagtaaatttaacccgaagcaacaaggagaccgtgaaacacagtgatgtcttatttctcgctgtcaaaccacatatcatcccctttattctggacgagatcggggccgatgtgcaggcacgccacattgtggtatcctgcgcagccggcgtgactatatcatctgttgaaaaaaagctgatggcattccagccggcacctaaagtgattcggtgtatgacaaacaccccagtagttgttcaagaaggggcgaccgtttacgcaacaggcacacacgcactggtggaagacggacaattgctggagcagctgatgtcctctgtggggttttgcacagaggtggaggaggacttgatcgacgctgtaaccggcctcagcggctcaggaccagcttatcagagcatggctgatcaagagaagatttcccccgcagccttgaagaagacactgctcgaccgagtaaaattagaaagcccgaccgtcagcactctgaccccaagttcaccagggaagctgctgacgagaagcctggcgctgggcggcaaaaaagactag

SEQ ID NO: 14419 - DNA, 960 bp, Artificial Sequence
  Description of Artificial Sequence: Synthetic coding sequence
atgagcgtgggatttatcggcgctggacagctcgcgatgctgtggcggggggcctcccggccacagcacccagttggcagtcaggacaatagccaactgccccgaaacgagccagcccacggtgtgcgcgcgcaagaggacggttgtgagcccgatacccaacagcagggcgatggggaagcccaaaggcgaccagtgagcggttgtgaagcccacatcatcccatttatccttgatgagatcggcgctgacgtgcaggctaggcatatcgtggtcagctgcgccgcaggtgtgacaatcagctcagtggagaagaagttgatggcctttcagccagccccgaaagtcatccgatgcatgaccaatacgcctgtggtggttcaagagggcgcgaccgtttatgccaccgggactcatgctttagtggaggatgggcagctcctcgaacagctgatgagcagtgtagggttttgcacagaagtggaagaagatctgattgatgccgtcacagggctcagtggatctggtcccgcctatgcctttatggctttggacgcattggcggacggcggagtcaaaatgggattaccacggaggctagccatccaactgggtgcccaggctctgctaggtgcagccaaaatgctccttgatagcgaacaacacccatgccagctgaaagataacgtttgctcacctggtggagctacaattcacgccctccattttcttgagagtggagggttccgcagtctattgattaacgcagttgaagcatcctgtattcggacgcgagaactccaatcaatggccgaccaggaaaagatctcaccggctgcactcaaaaaaacattgctcgacagggtgaaactcgagtcaccaactgtgtctaccctgacaccatcttctccaggcaaacttctgactcgctcccttgccttgggcgggaagaaggattag

SEQ ID NO: 14420 - DNA, 708 bp, Artificial Sequence
  Description of Artificial Sequence: Synthetic coding sequence
atgttgtcagcgactaggcgagcttgtcagctgctgcttctacactcacttttccctgtgccccggatgggcaatagcgcaagtaatatcgtgagcccccaggaggccttgccaggtagaaaagagcagacacccgtggccgccaaacaccacgtgaatgggaaccgaacagttgaaccattcccggaagggactcagatggcggtcttcggcatggggtgcttttggggcgcggaacggaagttctgggtcctcaagggggtttatagcactcaggtgggatttgctggaggctatacaagcaaccctacttataaggaggtgtgtagcgagaaaacggggcatgccgaagtcgtgcgggtagtgtaccaaccggaacatatgtcttttgaggagctcctgaaagtgttctgggagaaccatgatccaactcaggggatgaggcaaggaaatgaccatggcacacagtatagatccgccatctatcccacctccgccaaacagatggaagctgccttgagttctaaagagaactatcagaaggtactgtccgagcatggattcggccccatcaccacggacattagagaggggcagactttctactatgctgaagactatcatcagcagtacctgagtaaaaatccaaatggttattgtggcttaggtggcaccggagtgtcatgtcccgttgggattaaaaagtag

SEQ ID NO: 14421 - DNA, 3873 bp, Artificial Sequence
  Description of Artificial Sequence: Synthetic coding sequence
atgtccggtcctctggagggggcagacggaggcggggatccacgcccaggagagagcttctgccccgggggggtgccgtcccccggacctccccagcatcgcccctgccccgggcctagcctggcagacgacacggacgctaattccaatgggtcctctggcaacgagtcaaacggacacgaatccaggggggcttctcaacgatctagccactcctctagctcagggaacggtaaggattcagccctgctcgaaactaccgagagttctaagtccacaaattcccaatcgcccagcccaccctcgagctcgattgcctactctctgctgagtgcaagcagcgagcaggacaatcccagcactagtgggtgctctagtgagcagtccgcccgggcgcggacccagaaagagctgatgactgctcttagagagcttaagttacgcttgccacctgaacgcagaggtaaagggagaagcggaactctcgctacactacagtacgccctggcatgcgtgaagcaagtccaggccaaccaggaatattaccagcagtggagtctggaggaaggcgagccctgttccatggacatgtctacctacactctggaagagctggagcacataacatccgagtatacacttcagaaccaggacacttttagtgtggccgtgtcgttcttgaccggcagaatcgtctacattagcgagcaagccgccgtgttgctgaggtgtaagagggatgtcttccggggaactaggttctccgaactcctggcccctcaggacgttggggtgttctatgggagtactgccccgtccaggcttccgacatgggggacaggggcatccgccggatcaggtctgagggacttcactcaggagaagtcagtgttctgtcgaattcgcggtggacccgatagggacccaggtccccggtaccaacctttccgattaacgccctacgttacgaagatccgagtgtcagatggggcacccgcgcagccctgctgcctgctgatcgctgagagaatccatagcggctacgaggcgcctcgcatacctccagacaagagaatcttcacaaccaggcataccccttcctgcctgtttcaggatgtcgacgagcgagccgctcccctgttgggttaccttccccaagacttattaggggccccggttcttttgttcttgcaccccgaggaccggcctctcatgcttgcaattcataagaagatcctgcagttagctggacagccttttgaccattcaccaatccgcttttgcgcaaggaatggcgaatacgtcacaatggatacctcctgggctggcttcgtccacccctggtctagaaaagtcgcctttgtgttgggcagacacaaggttagaacagctcccctcaacgaggatgtgtttacaccaccagccccttcccccgcaccatcgctcgacaccgatattcaggagctgagtgagcagatccacaggctgcttctgcaaccagtgcattcaccatccccaacgggcctttgcggcgtgggagcagttacatcccctggtcccctgcactccccagggagcagcagcgattctaacgggggcgacgctgaggggcctggaccacccgccccagtgacatttcaacaaatttgcaaggacgtacacctcgtaaagcaccaaggtcagcagctctttatcgagtcgcgcgctcgtccacagagtcgcccgcgactgcccgcaacaggcacctttaaggcaaaagccctgccgtgccagagtccagacccagaacttgaagcggggagcgctccagtgcaggcccccctggcacttgttccagaggaggcggaacggaaggaggcctcaagctgcagctaccagcagatcaactgtctggattcaatactacggtacctcgagagttgcaacttgccctctacaacaaaacggaaatgtgctagctccagttcttacaccacatctagcgcctcagatgacgatagacagaggacaggtcctgtgtctgtggggacaaaaaaagaccccccctctgccgccctgtccggagaaggggcaacacctcggaaggaacccgtggtcggagggacattgtcccctctagctctggctaacaaggccgaatcagttgtttctgtaacttcccagtgtagtttctcgtccacaatcgtgcatgttggcgacaagaagccccctgagtcggacatcatcatgatggaagatcttccgggtttggcccctgggccagctccatctcctgccccttcgccaacagtagcaccggaccctgcaccagacgcctatagacccgttggcttgaccaaagccgtgctgtcgctgcacacacagaaggaagagcaggcttttctctctcgctttagggatctagggaggttgcggggcttggactctagctcaacagccccttccgctttgggagaaaggggatgccatcacggtccagcccctccctcccgacgccatcattgtaggtctaaggctaagaggagtcgacaccaccaaaacccccgggccgaagcgccttgctacgtgtctcacccgtcccctgtaccgccctccactccttggccgacgccaccggcaacaaccccttttcccgccgtggtccaaccttatcccctgcccgtgtttagccctcgcggtggacctcagccgctacctcctgccccaacctcggtcccacctgccgcgttccccgcaccgcttgtgacacctatggtggccctggtgctacctaattatctatttcccacaccgtccagctatccatatggcgcattacagacgccagcagaagggcccccgaccccagcctctcattctccaagcccttctctcccagcgctggcgccctcaccccctcataggccagatagccctctattcaattcaaggtgctcctccccgttgcagcttaacctgctgcagcttgaggaactcccaagggcagagggcgccgctgtggccggcggtccaggatccagtgccggcccacctccaccttcagctgaggcagcagagcctgaggccaggctagctgaggtcacagagagttccaatcaggatgccctgtccggttccagtgaccttctcgagctgctgctccaggaagacagccgaagcgggaccggttcagccgcgagtgggtcactcggatcgggcctgggtagcggcagtggcagtggatcacatgagggcggaagcacctctgcctcaatcaccaggagctctcagagcagtcacactagcaaatatttcggaagcatagatagtagcgaagccgaagcaggagcggccagagggggggccgagcccggcgatcaagtgatcaagtatgttctccaggacccaatctggttactcatggcgaacgctgaccaacgcgttatgatgacttatcaagttccgagcagagacatgacaagcgtcctgaaacaggatcgggagcgcctgagagccatgcagaagcagcaacccaggttctcagaagatcagcggcgcgagctcggcgctgtgcattcatgggtccggaaagggcaactcccacgagctctcgacgtgatggcctgcgttgactgcggtagttccacacaagaccccggccacccagatgacccgctgttctccgagctggatggactgggtctagagcctatggaagaaggcggcggcgagcaaggatcatcgggcggtggttccggggagggtgagggctgtgaagaggcacaaggcggggcaaaggccagcagtagtcaggacctggccatggaggaggaagaggagggtaggtcaagttcctcacctgccttacccactgctggcaattgcacatcctag

SEQ ID NO: 14422 - DNA, 2022 bp, Artificial Sequence
  Description of Artificial Sequence: Synthetic coding sequence
atggagaaggcggtcaacgacggaagccactctgaagaactgttttgccatctgaagacaatctctgagaaggaggacctccccagatgcacttccgagagccacctcagttgtctgaaacaggatattctcaatgagaagaccgaattggaggctacccttaaggaagccgagttggttacccatagcgttgagctgctcctgcctctcttcaaagatacaatcgaaaaaattaactttgagaatgccaatttgagtgcgcttaatttaaaaattagtgagcagaaggaaatcctgattaaagaactggatacgtttaaaagcgtgaaactggcacttgagcatctgctgcggaagagagactacaagcagacaggggacaacttatcctctatgttactggagaacctgacggacaacgagagcgagaatactaatctgaagaaaaaggtgttcgaaaaagaggcacatatacaggagctgagttgtttattccagtccgagaaagccaatacactaaaggctaatagattttcacagtccgttaaggtggtgcatgagcgacttcagatccagattcacaagcgtgaggcagaaaatgacaagctgaaggagtacgtgaaatcccttgagacaaagatcgctaagtggaatcttcagtccagaatgaataagaatgaggccattgtcatgaaggaagccagccgacagaaaactgtggccctgaaaaaggccagtaaggtgtacaaacagaggctagaccattttaccggtgccatagagaagctgaccagtcaaatcagagatcaggaagccaaattgtccgaaacaatttctgcctcaaacgcatggaaaagccactacgaaaagattgttatcgaaaaaacagaattggaggtgcagatagaaactatgaaaaagcaaatcattaatctccttgaggacttgaagaaaatggaagatcatggcaagaatagctgtgaggagattctacggaaggtgcattcaatagaatacgagaacgaaacactgaatcttgaaaataccaagcttaagctccgttttccatgtaggataactgagtctaaaaacatgaacattttgatcgtgctggatatgttgtgttatatttcaagcgagaagaccaccctggcagccctgaaagacgaagtcgtttccgtggagaatgaactgtccgagctccaagaggtggaaaagaaacagaagacgttgatcgagatgtacaagactcaggtacagaaactgcaggaggcggccgaaatcgtgaaaagccgctgcgagaacctgttacataagaataaccagattaccaaaactaaaaacaagaacgtggagaagatgagggggcagatggagtcgcacctgaaagaactggaacgagtgtgtgacagcttaaccgcagccgaacgccgcctgcacgagtgtcaggaatcgctccaatgttgtaagggaaagtgtgctgaccaggaacacaccatcagagaactgcaggggcaggttgatggaaaccacaatctgctcacgaagcttagcctggaggaagagaattgcctgatccagttaaaatgcgagaatctgcagcagaagctagaacagatggacgccgagaacaaggagctggaaaaaaaattagctaatcaggaggagtgcttgaagcactcaaacctgaagttcaaggagaagtccgcagagtatacagccctcgcccggcagctggaagcagcactggaggagggccgccagaaagtcgccgaggagatcgagaaaatgtcctcgagggagagcgccctgcagatcaagatccttgatttagaaacagagctgcgcaagaagaacgaggagcagaaccagttagtctgcaagatgaattctaaagcacagcatcaggaagtctgcctaaaagaagtacaaaacagcctcgaaaaatcagagaatcagaacgagagcatcaagaattatctacagttcttgaaaacctcttacgtcacaatgttcgaatag

SEQ ID NO: 14423 - DNA, 798 bp, Artificial Sequence
  Description of Artificial Sequence: Synthetic coding sequence
atggatgataaggctagcgtaggtaagatatctgtatcgtccgacagcgtcagtaccttgaacagcgaggacttcgttctcgtcagcagacaaggggatgaaactccatccaccaacaatggttcagatgacgagaagaccggtcttaagattgtggggaacggttcggaacagcaactgcaaaaagagctggccgacgtattgatggatcctccgatggacgaccagcccggcgagaaagagctagtgaaacggtcccagcttgacggcgaaggcgacggacccctctcgaaccagctctccgcaagctcaacaatcaaccccgttccgctggttgggctccagaagcccgagatgagcctccctgtaaagccgggccagggtgactcagaagcctctagccctttcaccccagtcgccgatgaggacagcgtggtcttctccaaactgacctacctgggatgtgctagtgtgaatgccccaaggtccgaggtggaagctctgagaatgatgtctatcttgcgttcacagtgtcagatctccttagacgtcacactaagcgtgccaaacgtgtctgaggggatagtgagactattagatcctcagaccaacaccgaaattgcaaattatcctatctataagatacttttttgcgttcgcgggcacgatggcacaccggaatccgattgctttgctttcacggagtctcactataatgctgagctctttcggatccacgtattccggtgtgaaattcaggaagcagtgtctcctcaggagaaaactctgtgtaaatag

SEQ ID NO: 14424 - DNA, 636 bp, Artificial Sequence
  Description of Artificial Sequence: Synthetic coding sequence
atgtgggcttctcttagtctcgaccatccaagcgcaaaagaaaatcaggcccttaggttgattgaaatgagagaggaaaacggtaatgtcccaaaaacagagcaggccggatcccttaaacctctgagagacactggaaagagtaatttgaaagagaaaaaggcaaatagcaagctcaagcagatagagaaggagtatactcagaagctcgcaaagagctcacagattatcgccgagcttcagactacaattagcagtcttaaggaagagaattcacaacagcagctggctgcggagaggcgtctgcaggatgtccgacagaagttcgaagacgagaaaaagcagctgataagggacaacgaccaggccataaaggtgctgcaggatgaacttgagaaccgcagcaatcaggtcagatgcgctgagaaaaaactgcagcacaaagagctggaatcacaggaacagatcacatacatccggcaggagtatgagacaaaactgaaaggactgatgccagccagtttgcgccaggaattagaagacactatttcctctctaaaatcacaggtgaattttttgcagaagagagctagcatcctgcaggaagagcttacaacttatcaaggcaggcggtag

SEQ ID NO: 14425 - DNA, 867 bp, Artificial Sequence
  Description of Artificial Sequence: Synthetic coding sequence
atgagctctagtatgtggtatattatgcagtctattcagtcaaaatattccttatctgaacgcctgattcggactatcgccgctatcagatcatttccccacgacaacgtggaagacctcatccgtggtggcgccgatgtgaattgcactcacggaaccttgaagccccttcactgcgcatgcatggtgagcgacgccgactgtgtggagttgctcctggaaaagggcgccgaagtgaatgccttagacggatataaccggacggccctgcactacgccgccgaaaaggatgaagcctgcgttgaggttttactggagtatggagccaacccgaatgccctcgatggcaatagggatactcccttacattgggcggcattcaagaataatgctgagtgcgtacgagctctcctggagtctggcgcgagcgttaacgccctcgactacaacaatgacactccattgtcctgggctgccatgaagggaaaccttgagtccgtgtccatcttgttggattatggcgctgaagtgcgtgtgatcaacttgatcgggcagacacctatcagcagactagtcgcccttcttgtaagaggcttgggcaccgagaaggaagacagttgctttgaactgctgcaccgcgcggtaggccactttgagctgaggaagaatggcaccatgcccagggaggtagctcgcgacccccagctgtgtgagaagctgaccgttctgtgcagcgcacccggtacgctcaagaccctagcaagatatgcggtacgtcggagcttaggcctgcagtaccttcccgacgcggtcaaaggcctgccattgcccgcctcgctcaaagagtatctgctgctgctggagtag

SEQ ID NO: 14426 - DNA, 1341 bp, Artificial Sequence
  Description of Artificial Sequence: Synthetic coding sequence
atgcgagaaatagtccacattcaggctggacagtgcggcaatcagattgggactaagttttgggaggtgatctcagacgagcatggcatcgatccggctggaggctacgtcggtgactctgcactccaactcgagcggataaacgtgtactacaatgaatctagtagccagaaatacgtgccaagggcggccctggtcgacctggagcccggaaccatggattccgttcggtccggcccttttggccagctgtttcgccctgataatttcatcttcggccagaccggcgcaggcaataactgggctaaggggcactatactgaaggcgccgagctggtggatgcggtactcgacgtggtgcgtaaggaatgcgaacattgtgactgtctgcaggggtttcaacttactcactcacttggcggtggaaccggtagcggcatgggcacactgttgatttctaagattagagaggaattccccgaccgcattatgaacacgttttcagtaatgcctagcccgaaagtgtccgatacagtagtggagccctataacgccaccctgtcagtgcaccagctggtggaaaacaccgatgaaacatattgtatcgacaacgaggctctgtacgacatttgctttaggacgctcaagctcaccacccccacctatggcgatctaaaccatctggtaagtgcaactatgtctggtgtgacaactagtctcagatttccgggacagctgaacgcagacctgaggaaattggctgtaaacatggtaccatttcctagactgcacttcttcatgccagggttcgcccccctgacgagtcgcggctcgcagcagtacagggccctgactgtcccagagctgacccagcagatgtttgatgcaagaaatatgatggcggcatgcgacccgaggcacggaagataccttaccgtggcgacagtgtttcgggggcctatgtcaatgaaggaggtcgacgagcaaatgctggccattcagagcaaaaattcaagttattttgtagaatggatcccaaataacgtaaaggttgccgtgtgtgacatccctcctcgaggactcaaaatggccagcacttttataggaaactcaactgccattcaggagcttttcaagcgcatctcggagcagttctcagcgatgttcaggagaaaggccttcctccactggttcaccggggagggaatggatgagatggagttcactgaggcagagtccaatatgaacgatctggtgtcagagtatcagcagtaccaggacgcaacagcaaatgatggcgaggaggcttttgaagatgaggaagaagagatcgacggatag

SEQ ID NO: 14427 - DNA, 792 bp, Artificial Sequence
  Description of Artificial Sequence: Synthetic coding sequence
atgttgtcctccaagggacttaccgtagtagacgtctaccagggatggtgcggcccatgtaaacctgtcgtttccctttttcagaagatgcgaattgaagttggcctcgacttattgcacttcgccttggcagaggctgatcggctggatgtcctggagaagtaccgggggaaatgcgagcctacatttctgttttatgcgatcaaggatgaagcgcttagcgatgaggatgagtgcgtcagccatggtaagaataatggcgaggacgaggacatggtcagtagtgaaagaacatgcacactggcaattataaaaccagacgctgtcgcccatgggaagactgatgagattatcatgaagatccaggaggctggcttcgagatactgaccaacgaagagcgaaccatgaccgaagctgaagtccgcctgttttatcagcataaggccggggaggaagcttttgaaaaactcgttcaccacatgtgctccgggcccagccacctattgattctgacaaggaccgagggctttgaggatgttgtcacgacttggcgaactgtgatgggccctcgggacccgaacgtagcccgacgcgaacagcctgaatccctccgggcacagtatggaactgagatgccattcaacgctgtacacggatctcgagatagagaggatgcagaccgggaactcgccttactgttcccctctctgaaattttccgataaagataccgaggcaccacaaggcgaatcgtcgactcagcctaggctcaagattaccgacttagattag

SEQ ID NO: 14428 - DNA, 1089 bp, Artificial Sequence
  Description of Artificial Sequence: Synthetic coding sequence
atgctcaagaacaagggccattccagtaagaaagataacttggctgtgaacgcagtcgctctgcaggatcatatactgcatgatctgcagctgagaaacctcagcgtcgccgatcactcaaaaacccaggtgcaaaagaaagaaaataaatctttgaaacgggacactaaggccattatcgacacaggcctgaagaagacaactcagtgcccgaaactggaagactccgaaaaagagtatgtcctggacccgaagcccccacctctcactctcgcccagaaactggggcttataggcccacccccaccacctctcagctctgatgagtgggaaaaggtgaaacaaaggagcctgctccagggcgactcagtgcagccatgtccaatctgcaaagaggagttcgagctgcgcccccaggtgctgctaagctgttctcacgtctttcacaaggcctgtctccaggcttttgagaaatttacaaataagaaaacctgcccactctgccggaagaatcagtatcagaccagagtcattcatgacggagcaagattattcagaatcaagtgcgtgacccgtatccaggcctactggcgcggctgcgtcgttaggaagtggtaccgaaacttaaggaagacagtgcccccaactgatgcaaaactgagaaaaaagttcttcgagaagaagttcaccgagatcagccacagaattttgtgcagctataatacaaacatcgaggagctcttcgccgaaatagatcagtgcctcgctatcaatcgctccgtgctgcagcagctcgaggaaaaatgcggtcatgagatcacagaggaagaatgggaaaaaatccaggtccaagctctgagacgggagactcacgagtgttcaatttgtctagccccattatccgccgctggcggccagagagtcggggcgggccgtaggagtcgagaaatggccctgctttcatgttcccacgtgtttcaccatgcatgcctgctcgcacttgaggagttttcagtcggcgatcggcccccatttcatgcttgtccactctgccgctcctgctaccagaaaaaaatattagaatgctag

SEQ ID NO: 14429 - DNA, 291 bp, Artificial Sequence
  Description of Artificial Sequence: Synthetic coding sequence
atgatcgagaagatgcagggatccagaatggacgagcagaggtgtagctttcctccccccttgaaaacagaggaggattatattccatatccttcagtccatgaggtcctaggcagagagggtccgttccccctcatcttgctgccgcagttcggcggatattggattgaaggtactaatcacgaaatcacttcaatccctgagaccgagccactacagagcccaacaaccaaagtgaaattggagtgcaatcccaccgcccggatctacagaaagcattttctgggatag

SEQ ID NO: 14430 - DNA, 459 bp, Artificial Sequence
  Description of Artificial Sequence: Synthetic coding sequence
atggcagggctccccagaaggataataaaagagacccagagacttctggctgaaccagtccctggcataaaggccgaaccggatgaatccaacgctaggtactttcacgtggtgatcgccggtcctcaggacagcccttttgagggcggcactttcaagctggaactttttctcccagaggaatatcctatggctgcgcctaaagttcgcttcatgaccaagatctatcatcctaatgttgataagctggggcgcatttgcctcgatatcttgaaagacaagtggtctcccgctctgcagattcggaccgtactcctctccatccaagctctgttgagtgctcctaatcccgacgacccattggcaaatgacgtggcagagcagtggaaaactaatgaagcccaagccatagaaacggcaagagcttggacccgtctatatgccatgaacaatatttag

SEQ ID NO: 14431 - DNA, 3354 bp, Artificial Sequence
  Description of Artificial Sequence: Synthetic coding sequence
atgtatagatcttccgcccggtctagtgtgagtagtcatcgtcccaaagatgatggcggtggaggcccccgctcggggaggtccagcgggtctagtagcgggccggctcgacgcagctcgcccccaccacctccttctggctccagttcacgaacacccgccaggcggccacggagtcctagtggacatagggggcgacgtgccagccccagcccacctcgtggcaggagggtatccccctctccccccagagctagaaggggatcaccttccccaccacggggtagacgactttttccacccggtccagctggcttccgcggatcctctaggggggagtctcgcgcagactatgctcgagatggtaggggcgaccaccccggggacagcggcagccgcaggagatctcccgggctgtgtagtgattcactcgagaaatccctgcggatcacggtgggcaacgatcatttctgtgtgtctacccccgaacgtcgtcgactttctgaccggcttggctcaccggtggacaatcttgaggatatggacagagacgacttgacagatgacagtgtgttcacgcgaagcagccagtgttctcgcggactcgagcggtatatatcccaggaggagggtccactcagcccgtttctgggccagctggacgaggactatcgcacaaaagagacttttttacatcggagcgattattccccccatatttcttgtcatgacgagttgctcagggggactgagcggaaccgagaaaagctcaaaggctactcaatcaggtccgaggagaggagccgagaggccaaacggccccggtatgacgataccgtgaagattaattcaatgggtggagatcatccatcattcaccagtgggacaaggaactacagacaacggcgtcgcagcccatcaccacgattcttggacccagagtttagggaattagatctggccagaagaaagcgagaggaagaagaagaacgtagtaggtctctgagtcaggaactggtgggggttgatgggggcggcactggatgcagtatcccagggctgagcggagtcctaactgcttctgaaccaggatattcgttgcacaggccagaggaagtgagtgtcatgcctaaaaagagcatactgaaaaagaggatagaagttgacattatggagcccagtatgcaactcgagtctttttcaagttcaacttcaagcagccaagaccacccgctctattcaggccatccttctctgcctttgtctggagccattgctgctttcgcgagtgaaattgagaacaaaggcaccatggtcgagactgccctgaaggaaccccagggaaatctgtaccagtggggcccattgcccggaatccccaaggataattcgccccttagagagaaattcgggtcattcctgtgtcacaaggacaatttggacctaaaagcagagggaccggaacggcatactgactttttactgccccatgagagggcttctcaagacgggagtggattttccagaatcctgagcatgctcgccgactccaccagcacgcaagaaaagcgacgacgatcatttcctgatatcgaggatgaagagaagtttctgtacggagatgaggaagaggatcttaaagctgaaagcgtgcccaagcccttaggcagtagcgagagcgaagtcatgcggcagaaggctagctcgcttccgtcttctgccccagccgtgaagctggagtccctggaggagaccaacccggagtatgctaagatccacgatcttctgaagactatcgggctcgatattggcgttgctgaaattagccaactggccgcccgaacccaagaacgactccatggaaagaagccatcactgaggagctccgcagataggcgcagctccgtcgatcggtacttctccgcagaccattgcagcagcgtagatcaccgtttcagcgcagacaggtgctccagcgtggatcactgctttagcgctgaccggcggtcttccgaccctcacagactcgaaagccgggaggcccaccatagcaatacacattccccagaagtcagccatccccatccaccatctcccgtggacccatatttgctaacaaagaacagccctccatttctgaaaagcgatcatccagttggccacatcagcggaccagaggtggtcggatctggcttccaatcttcagttgccgtcaggtgcatgctgcccagcgcaccttcagctcctatccgtctcccccataccgctgccttatcccagttccacatgccgcgggccagtcaattcgccgccgcccggatacctccaaattatcaaggccctgccatcccacctgcctcttttgacgcttatcgtcactacatggcttatgccgccagcagatggccaatgtacccaacctcacaaccttccaaccacccagtgccggagcctcaccgtataatgccaattacgaagcaagccacaaggtcgcggccaaatctaagagtcatccctactgttaccccagataaacctaaacagaaagagtccctgagaggatccattccggccgcccaggtgcccgttcaggttagcatcccttctttaattcggtacaaccctgagaagatatccgacgaaaagaatagagcttctcagaagcagaaggtgatcgaggagagagagaaattgaagaatgacagggaagccagacagaaaaagatgtactatctccggactgaactggaacgcctgcacaaacagcagggagaaatgctccggaaaaagcgccgtgagaaggacggccacaaagacccccttctggtcgaggtctctagactgcaggataacatcatgaaagatatcgcagagctccggcaggaggctgaggaggccgagaagaagcagtccgagcttgataaagtggctcagatcctgggtatcaatatcttcgataagtctcagaaaagcctgagcgatagtcgtgaaccaactgaaaaaccaggtaaggccgaaaaatcaaaaagcccagaaaaagtgtcttcgttctcaaattcaagcagcaacaaggaatccaaggtgaacaacgaaaaatttagaaccaagtctccgaagccggcagagtctcctcagagtgctacaaagcagctcgaccagccgaccgcagcatatgaatattatgacgccggcaatcattggtgtaaggattgcaataccatctgtggaacaatgtttgacttcttcactcacatgcataataaaaagcacacgcaaggacaattccagaagagctccgattttcaaaaagagggacttcagcagacattcctcccaccggagaggcagggttag

SEQ ID NO: 14432 - DNA, 576 bp, Artificial Sequence
  Description of Artificial Sequence: Synthetic coding sequence
atgtatgtgtgcctatgcgtgtccgtcgctaaagtcacgatggccgatcgcgccgctgccgagcgagcatgtaaggacccgaaccctattatcgacggccggaaagcaaatgttaacctcgcctatctcggcgccaaaccaagaatcatgcagcctgggttcgcattcggagtgcagcagttgcacccagcgctgatacagcggcctttcgggatccccgcccattacgtgtacccccaggcatttgtgcaacccggcgttgtgatcccacacgtgcagcccaccgcagccgcggctagcacaaccccctacatcgactacaccggggcagcctatgcccagtattctgccgccgccgccgctgcggctgcagcggctgcctatgatcagtacccctatgccgcatccccggctgccgccggctacgtgaccgcaggaggatacggatatgctgtgcaacagccgattacagccgctgcaccaggcactgctgccgcggctgccgccgcggctgcagccgctgccgcttttggccaatatcagccgcaacaattacagacagaccggatgcaatag

SEQ ID NO: 14433 - DNA, 330 bp, Artificial Sequence
  Description of Artificial Sequence: Synthetic coding sequence
atggccggcgctcctactgtctctctccccgagttgaggtctctccttgccagcggccgagcacgactattcgacgtgcgttcacgggaagaagcagctgctggaacaattcctggggcactgaacatacccgtctctgaactagagtcggccctgcaaatggagcccgcagccttccaggctctctacagtgccgagaagccgaagttggaagatgagcatttggtctttttctgccagatgggcaagaggggccttcaggctacacagctggcacgctcactggggtacactgggtatggcgaagtttggttgcttgcaggccgatag

SEQ ID NO: 14434 - DNA, 630 bp, Artificial Sequence
  Description of Artificial Sequence: Synthetic coding sequence
atggcgctgctagctgagcacttgctgaaaccacttccagcagacaaacagattgagaccggaccatttcttgaagcggtctcacacctgccaccattttttgattgcttgggctctccggttttcacaccgattaaggcggatatttctggcaacatcacaaagattaaggccgtctatgatacgaatccggccaagttccgaacactccagaacattctagaagtcgagaaagaaatgtacggcgcagagtggccaaaggtgggggccacactcgccctaatgtggcttaagcggggcctcagattcattcaggtctttctgcagtccatctgcgatggcgagcgcgatgaaaatcatcctaatctgatcagggtgaatgccacaaaggcttatgaaatggcacttaagaagtaccatggctggatcgtccagaagatttttcaggcagcattgtatgccgccccctacaagagcgacttccttaaggcgctctctaagggtcagaacgtgacagaggaggaatgcttggaaaagattcgtcttttcctcgtgaactatactgccacaatcgatgtcatctacgagatgtacacacaaatgaacgcggaactgaactataaagtttag

SEQ ID NO: 14435 - DNA, 474 bp, Artificial Sequence
  Description of Artificial Sequence: Synthetic coding sequence
atggaagaggcccagaggaaaagaacccagctgcgcgaggctttcgagcagttgcaggctaagaagcagatggccatggagaaaagaagggctgtccagaatcagtggcaactgcagcaggaaaagcatctccagcacctggccgaggtctccgccgaagtacgcgagcgaaaaacaggtacccagcaagagctagaccgggtctttcagaaattgggcaatctgaaacagcaagccgagcaggaaagagacaagttgcagagataccaaacgttcctgcagctgctctacacgctgcagggaaagctcttgtttccggaggccgaggcagaggccgagaatcttccagatgacaaaccccagcaacctacccgacctcaggagcagagtactggagacacaatgggcagagacccgggggtgtcttttaaagccgtgggcttacagccggccggcgacgtcaatctgccatag

SEQ ID NO: 14436 - DNA, 639 bp, Artificial Sequence
  Description of Artificial Sequence: Synthetic coding sequence
atggaagttctccgcaggagttcagtcttcgccgccgaaatcatggatgctttcgaccggtcaccgaccgataaagagctggttgctcaggctaaagccttgggaagagagtatgtccatgctagattgctcagggctggtctgtcctggtcggccccggagagagctgcccccgttcctggtagactggctgaagtatgtgctgtcctcctccgtctgggtgacgagttggaaatgatacgaccttccgtctatcggaatgtcgcgcgacagttgcacatctccctgcaaagcgaacctgttgttactgatgcgtttctagccgtagctggtcatatctttagcgctggcatcacatggggcaaagttgtgtccttgtatgccgtcgcagcgggccttgcggtcgactgcgttcggcaagctcagcccgctatggtgcacgctctggtcgattgtctgggggagttcgttcgcaaaacccttgccacatggcttaggcgtcgcggcgggtggacagatgttctgaaatgcgtggtgtctaccgatcccggcctgagatctcactggttggtggctgctttgtgctctttcggccgattcctcaaagccgccttttttgtgctactccctgaaagatag

SEQ ID NO: 14437 - DNA, 2148 bp, Artificial Sequence
  Description of Artificial Sequence: Synthetic coding sequence
atgtcccagtccggggccgtgtcttgttgcccgggtgctacgaacggtagcctcggaagaagtgatggcgtagctaaaatgtctccgaaggacctctttgagcaaagaaaaaaatatagcaactctaacgtcatcatgcacgaaacatcccagtatcatgtgcagcacctcgcaacattcataatggacaagtccgaagcaattacaagcgtcgacgacgcaatcaggaaactggtccagctgtcgtctaaggaaaagatctggactcaagagatgctcctgcaggtgaatgatcagagtctccggctgcttgatatcgagtcccaggaggaactggaggattttcctcttcctacagtgcagcggagtcaaactgtgctcaatcaacttcgctatccctccgtgctgctgctcgtgtgtcaggatagcgagcaatctaagccagatgtgcacttcttccactgcgacgaagttgaagcggagctggttcatgaggatatcgagtctgctctggctgattgcaggctggggaaaaaaatgcgcccacagaccttaaaaggacaccaggagaaaatccgtcaaaggcagtctatcttacccccaccgcaaggtccagctcccatcccatttcaacacagaggcggagactctcccgaggccaaaaaccgagtgggcccacaggtcccattgtcagaacccggatttcggagaagggagagccaggaggagccgcgcgccgttctcgcccagaagattgagaaagagactcagatcctgaattgcgcattggacgacattgagtggttcgtagccagactccagaaagccgctgaggcctttaaacagctgaaccagagaaagaaaggcaaaaagaagggaaaaaaggctccagcagagggtgtgcttactctgcgggctcggccgcctagcgagggagaatttattgactgtttccagaaaataaaactggctatcaacttattggccaaactacagaaacacattcagaaccccagcgcagctgagctggtgcactttctgtttgggccccttgatcttatagtgaatacctgttccgggcccgatatcgcaagatccgtatcttgccctttgttatctcgcgacgccgtggactttttgcgaggccacctcgtgccgaaagaaatgtctttatgggagtctcttggtgagtcctggatgcgaccgagatctgaatggcctagggaaccgcaggtccccctatatgtcccaaaattccacagtgggtgggagccgccagtggacgtgttgcaggaggcaccatgggaggttgagggactggcttccgcaccgatcgaagaagtttctccagttagcagacagagcattcgtaacagtcagaaacacagtcccacatcagaaccaactcctcccggtgatgcattgccacccgtgagttcaccacacacccataggggctatcagcccacgccagccatggccaagtacgtgaaaattctctacgatttcaccgctagaaacgcgaacgagttgtctgtactgaaagacgaggtgttagaggttctggaagatggtaggcaatggtggaagctgaggtctaggagcggccaagcaggctacgtgccttgcaatatcctgggtgaggccagacccgaagacgccggagctccgttcgaacaagccgggcagaaatactggggcccagcatccccaacccacaagctgccaccctcttttccggggaataaagatgagctcatgcagcatatggatgaggtgaacgacgaattaatccgaaaaattagtaacatccgggcccaaccacaacgccactttagggttgaaaggagtcaacctgtcagtcagccactgacctacgaatccggacctgatgaggtgagagcctggctggaggccaaggccttcagcccacggatcgtggaaaatctggggatcctgaccggaccacaactgtttagtttaaacaaggaggaactcaaaaaagtatgcggcgaggagggagtccgggtgtatagccaactgaccatgcagaaggcatttcttgaaaagcagcagtcagggtccgaactcgaagaattaatgaacaagtttcactccatgaatcaacgccggggggaagattcttag

SEQ ID NO: 14438 - DNA, 600 bp, Artificial Sequence
  Description of Artificial Sequence: Synthetic coding sequence
atggcctggccctgcatctccagactgtgttgtctagccagacgatggaatcagcttgataggtccgatgttgcggtgcctctgaccctgcacggctactctgatctggactccgaggaacctggaactggaggagcagcgtcaagacgtgggcagcctcctgccggcgcccgggacagtggccgggatgtcccgttgacgcagtaccaacgggactttggcctgtggactacccccgcagggccgaaggatcctccccctggtcgcggaccaggggctgggggccgtagggggaaaagttcagcccagtccagtgcgccacccgcaccgggtgccagaggggtgtacgttctgccgataggcgacgccgatgcagctgccgcggtcacaactagttatagacaagaatttcaggcatggacgggcgttaagccttcacgatcgaccaagaccaagcccgctagagtgatcacaacacacacatctggttgggattctagccccggggcaggtttccaggtccccgaagttaggaaaaaatttacacccaatccctcggccatcttccaggcctccgccccccgtattcttaacgtctag

SEQ ID NO: 14439 - DNA, 5106 bp, Artificial Sequence
  Description of Artificial Sequence: Synthetic coding sequence
atgggtaattcagacagtcagtataccctgcaaggaagcaagaatcattctaataccataacaggtgccaagcagattccttgttcactgaagatccgaggcattcatgcaaaagaggagaaaagtcttcacggctggggacacggcagtaacggtgcggggtacaagtcccgttcgctggcacggtcatgtctttcccatttcaagagcaatcaaccctatgcatcaagactcggcggcccaacatgtaaagtatcccggggggtggcctatagcacacaccgtaccaacgccccaggaaaggatttccagggtatctccgcagccttttccaccgagaacggtttccactccgtgggacacgagcttgccgataaccacatcacgtcaagggattgtaacggccaccttctcaactgctacggccgtaacgagtctatagcatcaacacctcccggcgaggacagaaagtctcccagggttctcataaaaaccctggggaaacttgatggatgtttgcgggttgagttccacaacggcggaaacccgagtaaggtccccgccgaggattgttcagagccagtccagctcctgagatattccccaacactggcatccgaaacctctcctgtgccagaggcccgccgcggctcttcagccgactctcttccctcccaccgtccctcacccaccgatagcagactgcgctcttcgaaggggtccagcttaagctcggaaagttcttggtacgacagcccttggggtaatgcaggggagctatctgaagcagaaggatcttttcttgccccaggcatgcctgacccatcactacatgccagtttcccgccaggcgacgctaagaagcctttcaaccaaagctcatctctctcaagcttgagggaactgtataaggacgctaacctcggctcactgagtccatccggcattcggctgtccgatgagtatatgggcacccacgccagtttgtcgaatcgggtgagcttcgcttcagatatcgatgtcccttctagagtggcgcacggagacccaatccagtactcctcctttaccctcccctgccgaaagcccaaagcatttgtggaagatacagccaaaaaggattcactgaaagcgcgcatgagacgcattagcgattggacaggttccctgtcacgtaaaaaaaggaagctgcaggagccacgttctaaggagggttcagattacttcgactcccggtcagatggacttaataccgatgtccaaggctcatcacaggcatcagcctttctgtggagcgggggttctactcaaatcctgtcacagcggagcgagtccacgcatgctatcggttccgacccgctgcgacagaatatctacgaaaacttcatgcgagaactggaaatgtcaagaaccaacactgaaaatatagaaaccagtaccgagacagcagagtcttcttcagagagtctgtcaagcctcgaacaactcgacctgctgtttgaaaaggagcagggagtggtgagaaaggccggctggcttttcttcaagcctctggtcacagtccagaaggagaggaaactggaactcgtcgcacggagaaaatggaagcagtattgggtcacattgaaaggatgcacactacttttttacgagacctacggaaaaaactctatggatcagagtagcgccccaagatgtgcactctttgctgaggatagtatcgttcagtcggtgccagagcaccctaagaaggagaacgtgttctgtctgagcaactcatttggagacgtatatctgtttcaggctaccagccagaccgatctggaaaactgggtcacagctgttcactcagcgtgcgccagcctgtttgctaaaaaacacgggaaagaagataccctgagactgctgaagaatcagacaaagaatctgctccagaagatagatatggactccaagatgaagaagatggctgagctgcagctgagcgttgtgtcagaccccaagaataggaaagccatcgagaatcagattcagcagtgggagcagaacctagaaaagtttcacatggatctgttccggatgcggtgttacctggcctcccttcagggcggcgaactgccaaatcccaagtcactgctcgccgccgccagtcggccctccaaattggccctcggccgattgggtattctctcagtgagctctttccatgccctggtatgtagtcgcgacgattccgctcttaggaagaggacgctgtctcttacacagcgaggacggaacaaaaaaggtattttcagcagtctgaaagggcttgacaccttggccaggaagggcaaggaaaagcgtccttcgatcactcaggtggacgagctcctgcacatctacggctccacagtggatggcgtgcctcgcgataacgcttgggaaatacagacatatgtgcactttcaggataatcacggggtaactgtgggaatcaagccggagcatcgggtcgaggacatcctgacactggcatgcaaaatgcgccagctagagccctctcactatggactccagctgagaaagctggtggacgataacgttgaatactgcatcccagcaccatatgaatacatgcagcaacaggtttacgatgagatcgaggtctttcctctgaacgtctatgatgtccagctcactaaaacaggatcagtgtgtgatttcggatttgctgtgaccgcacaggttgacgagcggcagcatctgtcgcggatcttcatcagtgatgtgcttcccgacggcctcgcctacggagaaggactccggaaaggaaatgaaattatgaccctcaatggtgaagctgttagcgatcttgatctaaaacagatggaggctctgttcagcgaaaagagcgtcggcttgacccttattgcccggcctccagacactaaggccacactttgtaccagttggagtgacagcgacctcttttctcgcgaccagaagtccctgctccctcctccgaaccagagtcaactgctggaggagttcttggacaacttcaagaagaacaccgccaatgatttttcgaatgtgccagacattactactggacttaaaaggagccaaaccgatggtacactcgatcaagtctcacacagagagaagatggaacagacattcaggtccgcagagcagattaccgccctgtgtcgctcattcaatgacagtcaagccaatggaatggaggggccaagagaaaaccaagaccctcctcccagaagccttgcgagacatctcagcgacgccgacagacttcgaaaggtcatccaggagttagtagatacggagaaaagctatgtaaaagacctatcctgtctgttcgaactgtatctcgagccactccagaacgagaccttccttactcaggacgagatggagagcctcttcggttccctgcccgaaatgttagaatttcagaaagtattccttgagaccttggaagatgggatttcagcttcatcagatttcaatactctggagacaccgagccaatttaggaaactcttgtttagcctggggggctccttcttatactacgcagaccacttcaaactgtatagcggattttgcgccaatcacattaaggtgcaaaaggttctagaacgcgccaagaccgacaaggcattcaaagccttcctagacgcccggaatcccactaagcagcattcgagtaccctggaaagctacttgatcaagcccgtgcagcgggttctcaagtacccattgctgctgaaagagctagtttctttaactgatcaggaatcagaagaacactaccacttgacagaagccctgaaggccatggaaaaggtcgcctctcacataaacgagatgcaaaagatttacgaagactacggtactgtcttcgaccagctcgtcgccgagcaaagtggcacagaaaaagaagttaccgagctcagtatgggagaactcctgatgcatagcaccgtgagttggctgaatccttttctgtcactgggcaaagcccggaaagacctagaactcactgtgttcgtctttaaacgcgccgttatcttggtgtataaggaaaattgcaagctgaagaaaaaactaccctcaaatagccgccccgcccataattccacagacctggacccattcaagttcaggtggctgatacccatctcggcacttcaagttaggttgggcaaccccgcagggacggagaacaattccatttgggaacttatccacacaaaatccgagatagaggggagacctgagaccattttccaactgtgttgtagcgactctgagagtaaaactaacatcgttaaagtgatcaggtctatcttaagggaaaactttcggagacacataaaatgcgagttacccctcgaaaaaacttgtaaagatagactggttcccctcaaaaaccgggttccagtgtctgccaagttagcgtcctcacgcagtttaaaagtgctgaagaacagtagcagtaacgaatggacaggggagacgggcaaaggcactctgctggacagcgacgaaggatccctcagctcgggcacccagagctccggttgtcctacggccgagggtagacaagactcaaaaagcacttcacccggaaagtacccccatcccggccttgctgatttcgccgataacctaatcaaggagtccgatatcttaagcgatgaggatgatgatcacagacagaccgtcaagcaggggagccccacaaaggacattgagatccagttccaaagactgcggatttccgaggacccggatgtccatccggaagccgaacagcaaccaggacccgagtccggagaaggccagaagggcggggagcagcctaaactggttagaggccatttttgcccaattaaacggaaggccaatagcacgaagcgcgatagaggaacactgctgaaggcccagatacgccaccagagtttagacagccagtcagagaacgctaccattgacttgaattccgtgctggagcgagagtttagcgttcagtctctgacttccgtggtaagtgaagaatgtttctatgagaccgaatctcatgggaagtcttag

SEQ ID NO: 14440 - DNA, 3177 bp, Artificial Sequence
  Description of Artificial Sequence: Synthetic coding sequence
atggacttgggaccattgaacatctgtgaggagatgacgatcctgcacggtgggtttttactggctgaacagctattccacccgaaggccctggccgaattaaccaagtcggattgggagagggtggggagaccaatcgtggaggccctccgagagatttcctcagccgctgcccatagccagccatttgcttggaagaagaaggctctgattattatatgggccaaggttctccagccacatcctgttacaccaagcgataccgagacacgctggcaggaggatctgtttttctcggtgggcaacatgattccaaccattaatcacaccatactctttgagttgctcaagagcctggaagccagcggcctgtttatacagctgcttatggccttgcctacaacaatctgccatgctgaacttgaacgatttctggagcacgtgactgttgatacttcagccgaggatgtggccttcttcctggatgtttggtgggaggtgatgaaacacaaaggtcacccgcaggatcctctgttgtcgcaattctctgcgatggcccacaagtatctgcctgctctcgacgagtttccacaccccccgaaaaggctccggtcggatcctgatgcctgtcccactatgccgcttctggcgatgctactgcggggtttaactcagatccaaagtagaattttgggacctggcaggaaatgctgcgccctagctaatttagctgatatgctgactgtctttgctctgaccgaggacgacccacaagaagttagtgcaacagtctaccttgataaactcgctaccgtaatctcagtttggaattcagacacccagaatccctatcaccagcaagcactggcagaaaaggtgaaggaagcagaacgggacgtgtccctgaccagcctggctaagctcccatctgagaccatctttgtgggctgcgagtttctgcaccacctcttgagggagtggggcgaggagctccaagctgtgcttagatcatcgcagggaacatcctatgactcttaccgactgtgtgactctttaacgtctttctctcagaacgcaacactctatctgaaccggacctccctgtccaaggaggacagacaggttgtttccgaactagccgagtgtgtacgcgactttctccgcaaaacctccaccgtccttaagaatcgtgccctggaggacattaccgcctccattgccatggccgtcattcaacagaagatggacaggcacatggaagtgtgttatatattcgccagcgagaaaaagtgggccttttctgacgagtgggttgcatgcttagggagcaaccgggccttattccgtcaacccgacctagtgcttcgattacttgaaactgtcatagatgtgtcaactgcagatagggctatcccggaatctcagattagacaggtaatccatcttatcctcgagtgctacgctgatctcagcttgcctggcaagaacaaggtgttggcgggcatcctcaggtcttgggggcggaagggcctgtccgaaaaacttttagcttatgttgagggttttcaggaggaccttaacacgacctttaatcaactgacgcagagtgccagtgagcaggggttggccaaagcagtcgcctccgtagccaggcttgttatcgttcaccccgaagtgaccgtgaagaaaatgtgttccctagcagtggtcaacttaggcacacataaatttcttgcccagatcctgaccgcttttcccgccctcaggtttgtcgaggaacagggaccgaacagctcggcaactttcatggtgtcatgtctcaaagaaacagtctggatgaagttttcgacccccaaggaggagaaacagttccttgagctgctgaactgtcttatgtcccctgtgaaaccacaggggattccagtcgccgccttgctggagccggatgaagtactgaaagagttcgttctacctttccttagattggacgtagaggaggtcgatttgagtctccggatattcatacagacactcgaggccaacgcttgtagggaggaatattggctgcagacttgctccccctttcctctgctctttagcctttgccagctcctcgatcgtttctccaaatattggcagctgccgaaagaaaaacggtgtctttccctcgatcgcaaggacctcgccatccatattttggaactgctatgcgaaatcgtttccgcaaatgccgaaaccttctccccagacgtgtggatcaaatcgttgtcatggctgcatcggaagctagagcagctggattggacggttggattacggctgaaatcattctttgagggtcacttcaagtgcgaagtgcccgccaccctattcgaaatctgcaaattatccgaagatgaatggacaagccaggcccatcctgggtatggggctggaactggcctcctggcatggatggagtgctgctgtgtttccagtgggatatctgaacggatgctttccctgcttgtggtcgacgtggggaaccccgaagaggtccgactgttttctaaaggtttcctcgtggcactggttcaggtcatgccgtggtgttctccccaggagtggcagcggctgcaccagctgactagacggctgctcgaaaagcaactgctacacgtgccctacagtcttgaatatatccagttcgtccccctgctgaacctgaagcctttcgcccaagaattacagctttcggtacttttcctgcgcacattccagttcctgtgctcacattcttgtcgcgactggctccctctggaggggtggaatcacgtcgtcaaactcctgtgcggcagcttgacccgtctgctggactccgtgcgggcaatacaagccgccggcccgtgggtgcaaggacctgagcaggatctgacccaagaagcactctttgtttatacacaggtattctgccacgcactacatatcatggccatgctgcaccctgaggtctgcgagcccttgtacgttctagccctggaaacattgacctgctatgagacactgtctaagacaaatccctccgtctcatcccttctccaaagggcccatgaacagaggtttctgaagtctatcgccgagggaattggtcctgaagaacggcggcagacgttgctgcaaaagatgagttccttctag

SEQ ID NO: 14441 - DNA, 267 bp, Artificial Sequence
  Description of Artificial Sequence: Synthetic coding sequence
atgtctgggctgcgggtctattccacgtctgttaccggcagtagagaaattaagtcccagcagtccgaggttacccgtatcctagacggcaaaaggattcagtaccagctcgtcgacatcagccaggacaatgctcttcgggacgagatgagagccctggcaggcaaccccaaggccactccaccccaaatcgtgaacggagaccagtactgtggcgtctgggctgggggtcgtggtggcggtggttcagtggggaggggcctctag

SEQ ID NO: 14442 - DNA, 933 bp, Artificial Sequence
  Description of Artificial Sequence: Synthetic coding sequence
atggatggatcttttgtccagcacagcgtccgggtacttcaagagctgaataagcaacgcgaaaaaggccagtactgcgatgccacactcgatgttggtggcttggtgttcaaggcacactggtccgtgctggcatgctgttcacatttttttcaaagtttatacggtgatggatcaggaggttccgtcgttttacctgccgggtttgctgaaatttttggcctgttactagattttttttatacaggccacctggcattgacatccggcaatagggaccaagtcctgctggcggcgagagaactccgagtcccagaggccgtggagctgtgtcaatcattcaagcctaagacctcggtcggacaggctgcggggggccaatctggcctgggtccgcccgcatcccagaacgtgaatagccacgtcaaggagccagctggcctggaagaagaagaagtaagtaggactcttgggcttgtcccgcgggaccaggagccaagaggcagccactccccacagcggccccagcttcactctccagcacagtctgagggcccgagtagcttatgtggcaaacttaaacaggccctaaagccctgtcccctcgaggataagaagcctgaggattgtaaagtgccacctcgccctctcgaagcagagggtgcccaactccaggggggtagcaacgagtgggaggtggtggtgcaggtggaggacgatggggatggcgactacatgagcgaaccagaggcggtgttgacccggagaaagtctaatgtcattagaaaaccatgcgctgccgaaccggccctgagcgcaggaagtctcgctgctgagcctgcggagaaccggaaggggacagccgtccccgtcgaatgtcctacatgtcataagaagttcctgagcaagtactatctcaaggttcacaactag

SEQ ID NO: 14443 - DNA, 600 bp, Artificial Sequence
  Description of Artificial Sequence: Synthetic coding sequence
atgagtagcggtaacgctaaaatcggccacccagcgcctaattttaaggcaaccgcggtgatgcccgatggtcagttcaaggatatctctttgtctgattacaaggggaaatacgtcgttttcttcttttaccccttggattttacattcgtctgtcccacggagatcattgccttcagtgaccgcgccgaagaatttaagaagctcaactgccaagtgattggtgcaagtgtcgattcacacttctgtcacctcgcatgggtgaatacacctaaaaagcaaggcggcctgggtcctatgaacatcccccttgtaagcgatccaaaacgcaccatcgcacaggattacggcgtgttgaaggcggatgaagggatatcgtttcggggcctctttatcattgatgataaggggatactgaggcagattactgtgaatgacctacccgtgggaagaagtgtggatgagacgttaaggctggtccaagcctttcagttcactgacaaacacggcgaggtgtgccctgcgggatggaagcctggcagcgacactatcaaaccagatgtgcagaaatcaaaggagtacttctccaagcaaaagtag

SEQ ID NO: 14444 - DNA, 513 bp, Artificial Sequence
  Description of Artificial Sequence: Synthetic coding sequence
atgtccgtagccggcggcgagatacgaggcgacactggcggggaggacacagcagctcctggacgcttttccttttccccagagcctaccctggaagatatccgccgcttgcatgccgaattcgctgccgagagggactgggagcagtttcaccagcctcgcaacctcctgcttgccctggttggggaagtcggcgaactggccgagctctttcagtggaagacggacggggagcctgggccacaaggctggtcacccagggagcgggctgctctgcaggaggagctgtccgatgtgttgatctatttggtggcactggccgctagatgtcgggttgatctgccactcgccgtcctgtctaaaatggatatcaataggcggagatatcctgctcacttagctcgcagctcaagccggaaatatacggagctgccacatggggcaatctccgaggatcaggcagtaggccctgccgatattccttgtgattccactggccagacaagtacttag

SEQ ID NO: 14445 - DNA, 702 bp, Artificial Sequence
  Description of Artificial Sequence: Synthetic coding sequence
atgagcgctaagcgagctgaactcaaaaagacacacctttcgaagaattacaaggcagtctgcctggagctaaagccggagcccaccaagacttttgattacaaggccgtgaagcaggaggggcgatttaccaaagcaggggtcactcaggacctgaagaatgaactcagggaagtgagggaggagctgaaagaaaaaatggaagaaatcaagcagatcaaagacctaatggacaaggatttcgataagctgcacgagtttgtggaaatcatgaaggaaatgcagaaagacatggacgagaaaatggacatactgataaatactcagaagaactacaaattgccattgcggcgcgctcccaaggaacaacaggaattaaggttaatggggaagacccaccgcgagcctcagctccgcccgaaaaagatggacggggccagcggagtgaacggcgccccatgcgctcttcacaagaagaccatggctccccaaaaaacaaaacagggcagtcttgaccctctgcaccactgcgggacctgttgtgagaagtgcttgctttgcgcactcaaaaacaattacaatagggggaacatcccaagtgaagcgtccggtctttacaaggggggcgaagaacctgttacaacccaaccgtctgtaggacacgctgtccctgcccctaagtcccaaactgaaggacggtag

SEQ ID NO: 14446 - DNA, 2196 bp, Artificial Sequence
  Description of Artificial Sequence: Synthetic coding sequence
atgtccgtcacacttacttctgtgaaaagggtgcagtcttctcccaatctgctggccgcaggtagagacagtcagtcgccagacagcgcatggcgcagctacaatgatggcaaccaggagaccctgaatggtgatgcgacgtactcttccctcgccgctaaaggttttagatccgttcgccccaacctccaagataaaagatcccccactcaaagccaaatcacagtgaatggcaattcagggggggctgtatcaccgatgagttattaccagagacccttcagccctagtgcatattcactgcctgcatcccttaatagcagcattgtcatgcagcacggaacctccctggactccactgacacatatccgcagcatgctcagtctctggacggcactacgtcttcctcaatccctctctaccgcagttcagaggaagagaagagagtaacagtcattaaggcccctcactaccccggtattggacctgtggacgagagcggcatccctactgctattagaaccaccgtcgaccgacccaaggattggtataagacaatgttcaagcagatacacatggtgcacaaacccgatgacgacactgacatgtacaacaccccctacacctataatgcggggctgtataaccccccgtattcagcccaatcgcacccagcagccaagactcaaacctaccggcctcttagcaaatctcactccgacaactccccaaacgcctttaaagacgccagttccccggtgccaccacctcacgtgccaccaccagtgccccctctgagacctcgtgaccgtagcagcacagagaagcatgattgggatcctcccgatcggaaggtggacacacggaagtttcgaagtgagcctcgaagcatttttgagtatgagccaggcaaaagttccatccttcagcatgagcggcctccccctctacctactactccaactcccgtacctagagagcctggacggaaacctctgtcttcatcacgccttggagaagtgacaggctccccttcgcccccacccagatccggtgcccccaccccatctagcagggcgcccgccctctcacctacacgcccccctaagaagcctttagactacgtgcaggaccacagttctggcgtgtttaatgaggcctccctttaccagtctagcattgatcggtcgttggaaagacctatgtctagcgcatctatggcatccgattttaggaagagacggaagtccgagcctgcagtcggcccgccaagaggactgggagatcagagtgcgtctagaacgtctcccggaagagttgatctgccaggcagctcgaccactctgaccaaatcctttacttcttctagtccatcttctccttcacgcgcaaaagacagagaaagcccccgatcctactcgagcacgctgacagacatgggaagaagcgcccctagagagcgacgaggaactccagaaaaggaaaagctgcccgcgaaggcagtttatgattttaaagctcaaactagtaaagagctctcatttaagaaaggggacactgtatacattctgcgaaagatagaccagaattggtatgaaggtgagcaccatggccgcgtggggatcttcccaataagttacgtggagaaactgacacccccagagaaagcccagcctgcacgcccacccccacccgcccagccaggagagatcggcgaggctattgccaaatataacttcaatgccgacacaaatgtggaactgtccctgcgcaaaggcgatcgagtcatcctactcaagcgtgttgaccagaattggtacgaaggtaaaattcccggcacgaacaggcagggaatctttccagttagttatgttgaagtggtgaagaagaacaccaagggcgccgaggattatcctgatccgcctattccacactcatattcctccgatagaatccacagcctcagttccaataagccacagcgccccgtgtttacacatgagaacatccaggggggcggtgaaccctttcaggccctgtataattacacccctagaaatgaagatgaattggaactgcgggagagcgatgttatcgatgttatggaaaagtgcgacgacggctggttcgtaggaacatctcgacgcaccaaattctttgggaccttccccggcaattatgtcaagaggctgtag

SEQ ID NO: 14447 - DNA, 969 bp, Artificial Sequence
  Description of Artificial Sequence: Synthetic coding sequence
atgaccctggaggcgatccgatactctcgaggtagccttcagatcttggatcagctgctcctgccaaaacagagcagatatgaggccgtggggagcgtgcatcaggcgtgggaagcgatccgggcaatgaaagtgcgtggagccccagctattgccttagttgggtgcctgtcgctggctgtggaattacaggcaggagcaggcgggcccggtttggccgctctggtagcattcgttcgggacaaactgtcatttctagtgaccgcccgccccacggctgtgaacatggctcgcgcagcccgggatctggccgacgttgccgcacgggaggcagagagagaaggtgcgactgaggaggccgttcgtgagcgtagagagactgaactttgcgagcattgggaggaacacaccaggcagcgagagcttccgcttagaggtcccctgggcggaaccgttctagagacgcgcccttacaaccagggggcgagactgaccgccttcgagctagtatacgaacaaattcctgcaacgctgattacagattcaatggttgccgctgccatggcccacagaggagtgtctgcagttgtcgtgggagctgatcgggtcgtggcaaacggcgacacagctaacaaagttgggacctatcaactagccattgtcgctaagcaccatggcatccccttctatgttgcagctccaagctcttcatgcgacctccggttggagactggaaaagagatcattatcgaagagcgacctggccaggaactaacagacgtgaacggggtgagaatcgccgccccaggcatcggagtgtggaaccccgcatttgacgtgactccacacgatctgattacaggaggtatcataacagaactaggagtgttcgctccagaggagcttcgcaccgcattgactacaaccatttcgagtcgggacgggaccttggatggaccccagatgtag

SEQ ID NO: 14448 - DNA, 5169 bp, Artificial Sequence
  Description of Artificial Sequence: Synthetic coding sequence
atggggaatcaagatggtaaacttaagaggtccgcgggagatgccctccacgagggcgggggcggagccgaggatgcgctgggaccgcgcgacgtagaagccactaagaagggcagtgggggaaaaaaggcactgggaaaacacggcaagggtggcggggggggtggtggtggaggcgagtcaggcaaaaaaaaatcgaagtcagacagtagggcgagcgtgttctccaacctaagaatcaggaagaatcttagtaaaggaaaaggcgcaggggggtccagggaagatgtcctcgattcgcaggctctgcagacaggggaattagattcagcccatagtctgttgacaaaaactccggacctgagcctctctgctgatgaagccggtctgagcgacacggagtgtgctgacccctttgaggtgaccggccccggtggccctggtcctgccgaggccagggtgggcgggcggcccatcgccgaggatgttgagactgctgctggagcccaagacggtcagcgcacttcaagtggtagtgacacggacatctatagctttcattccgcgactgaacaggaagaccttttgtcagacatccagcaggccataagactccaacagcaacagcagcaacagctacagctccagctccaacagcaacagcagcagcagcagctgcaaggtgctgaggagcctgccgccccccctacagctgtgtccccccagcccggcgcattcttaggtttggaccggtttctgctcggcccttccggtggagccggggaggcgcctgggagccctgatacagagcaggcccttagtgccctgtccgacctgcctgagtctttggcagccgaacccagagagccacaacagccaccatcgccaggcggcttgccggtatctgaggccccatccctgcctgccgcccagcccgctgcaaaagacagcccaagtagcacagcctttcctttcccagaggcagggcccggggaagaggcagctggtgctccagttcgtggagccggggacaccgacgaagagggtgaggaggacgctttcgaggacgcccccaggggtagcccaggggaagaatgggcacccgaggtgggagaggatgctccccagagacttggagaagagccagaggaggaggctcaagggccggatgcacctgccgccgctagtttacccggcagtccagccccatcccagagatgtttcaagccatacccgctcattaccccttgttatatcaaaaccacaactcgccagttatcgagtcctaatcactcccccagccagtctcccaaccagtcaccgcgcatcaagcgccggccagagccttccttgtcaagggggtcacgaacagccctggcgtcggtggctgcgccagcaaaaaagcaccgcgcagacggcggcctcgctgctggcctctcacgctctgcagattggaccgaagagctgggggcacggactcctcgggtcggaggctctgcccatcttctggaaagaggagtggcttccgattcaggtggcggcgtctcccctgccctcgctgctaaagcctcaggcgctcctgcagccgccgatggcttccaaaatgtctttactggccggacgctgttagagaaattattctctcagcaggagaatgggccccccgaggaagcagagaagttttgctcccgtataattgccatggggctgctattgccattctctgattgcttccgagagccctgcaatcagaacgcccagaccaatgccgcgagcttcgatcaggatcagctgtacacttgggccgccgtaagtcaaccaacacatagcttggattattccgaaggccagttcccccgaagggtgccctccatgggtcctcccagcaagcctcccgacgaggaacatcggctggaggacgcagagaccgaatcccagtctgccgtgtctgaaacgcctcaaaagaggtcagacgccgtgcagaaagaagtagtggatatgaaatcagagggtcaggctactgtgattcagcaactggagcagactattgaagatctgcggacaaaaattgcggagcttgagcggcagtaccccgcactagacaccgaagtggccagcggtcaccagggactggagaatggcgtgacagccagcggagacgtgtgcttagaggctttgcggctcgaagagaaagaggtgagacaccaccggatcctggaggctaaatctatccagacttcacctactgaggaaggtggcgtcctgactctgccgcctgtagatgggctcccaggtcggccgccatgtcctcccggcgccgagtcaggaccgcagaccaagttttgctccgaaatctctttaattgttagtccccggcgcatctcagttcaactggacagccatcaaccaactcagtctatttcccagccaccaccacctccatctctgctctggagcgcaggccagggccaacccggcagtcagcctccacactccatctcaacagaatttcaaacatcacatgagcatagcgtttcgagtgctttcaagaactcctgcaatatcccttcaccaccgccactgccatgcacagagagctcatctagtatgcctggcttaggcatggtgcccccacctcctccgcccctgccaggcatgacagttccaacgctgccaagcactgccattcctcagccccctcctcttcagggtaccgagatgttgccaccacccccacctcctctgccaggggctggcatacccccgccgccacctttgcctggcgcaggtatcttgccgttgccccctctccccggggcaggcatcccaccaccaccgcctctgcccggtgcagccatccctcctcctccacctctgcccggagccggaattccccttcctcctcctcttcccggagcagggatcccgcctcctcccccgctgcccggtgctgggatccctcctccgcccccgctgcccggagcagggatcccacctccaccgccactcccaggtgcagggataccaccccctcccccccttcccggggctggtatccccccgccacccccgctgcccggagcaggaatccccccccccccgccgctgcccggcgccggaattccacctcccccacccctcccaggcgccggtataccgccccccccacctctaccgggagccgggattccacccccaccacccctccccggggcagggataccacccccccctcccttgccgggcgctggaatcccgccgccgcctccattgccaggcgccggcattccacccccaccgcccttacccggcgtcgggatcccaccaccaccacctctgcctggcgccggcatcccccctccgccccccttgccaggtgcgggtatacccccccccccccccttacctggagccgggataccccccccaccacctcttccacgggtgggcatccccccccccccaccactgcccggggccggtatcccccctcctccccctctgccaggcgccggaatacccccaccccctccgctgccaggagtgggaatccctcctcctccccctcttccaggtgttggcattccaccccctccacctttacccggcgccggcatacccccaccaccgcctctgcccgggatgggtatcccacctgcccctgccccccccctgccgcctcccggcactgggatcccaccaccccctctgcttcccgtatctggccctccccttttaccacaagttggatcctctacgctgccaactccgcaggtgtgcggcttcctgcccccccctctgccctccggactgttcgggctaggcatgaatcaggacaaagggtcccggaaacaacccattgaaccctgtcgccctatgaagcctctctactggacgcgtatccagctacacagcaagcgggattccagcacctccctgatctgggaaaagattgaggaacccagcattgactgccacgaatttgaggagctcttttctaaaaccgccgttaaggagcgcaagaaacctatatccgataccatttctaaaacaaaggctaagcaggtagtgaaactgctaagcaataaaagatctcaggccgttggcatcctcatgtcctccctgcatctggatatgaaagacatccagcatgccgttgtgaatttggataatagcgtcgtggatttagaaacactgcaagctttatatgagaaccgggcgcagtctgacgagctggagaagatagaaaagcacggaaggtccagcaaggataaagagaacgccaagtcactcgacaaaccagagcagtttctttacgagctcagtctgatcccaaatttttctgaacgggtcttctgtattctgttccagtctacgttctcagagtcaatctgttccatccggcggaagctggagctgctgcaaaagctgtgcgaaactctgaagaacgggccaggcgttatgcaagtactgggcttagtactggcctttggaaattacatgaacggcgggaacaagacaagaggccaagcagacggctttggcctagatatcttgcccaaactgaaggacgttaagtcatcagacaattcgcgatctttgctgagttacatcgtctcctactaccttcgcaatttcgatgaggacgccggtaaagagcaatgcctctttcccctgcctgagccccaggacctcttccaggctagtcagatgaagtttgaggatttccagaaggatctaagaaagctgaagaaggatctgaaagcttgcgaggtcgaggccgggaaggtctaccaggtgtcctctaaggaacacatgcagcctttcaaagagaacatggaacaatttattatacaggctaaaattgatcaggaggcagaagagaattctctgactgagacccacaaatgcttccttgagaccaccgcatatttttttatgaaacctaagctcggcgaaaaagaggtcagccccaacgccttcttctctatttggcacgaattcagtagcgacttcaaagacttttggaagaaagagaacaagcttctcctacaggaacgcgtgaaagaggccgaagaagtgtgtcgtcagaagaagggaaagagcctctacaagataaaacccaggcacgacagcggaatcaaggccaaaatttcaatgaagacctag

SEQ ID NO: 14449 - DNA, 3048 bp, Artificial Sequence
  Description of Artificial Sequence: Synthetic coding sequence
atgaccgtcagccagaaggggggtccgcagccaacaccatcacctgccgggccagggacgcagctgggccccataactggtgaaatggacgaggcggattctgcgtttttgaagttcaagcagacagcggatgattctctgtcacttacctctccaaacaccgagtccatctttgtggaagatccttatactgcctcgttgcgatctgagatagaatcagacggccatgaattcgaagctgaatcttggagcctggccgttgatgctgcgtacgcaaagaaacagaagcgagaagttgtcaaacgccaggacgtgctctacgagctgatgcaaactgaagtgcaccacgtgcggacactgaaaataatgttaaaagtctacagtcgggccctccaagaggagctgcagttttcaagcaaagcgattggacggcttttcccttgtgccgatgacctacttgagactcactctcatttcctggcacgtcttaaggagagacgccaggagagcctcgaggagggaagcgaccgtaattacgtgatccagaagattggcgatctgctggtacaacagttttctggggagaacggagagagaatgaaggagaagtatggagtgttctgttcagggcacaatgaggcagtatcccattacaagttactgttacagcagaacaagaagtttcagaatctgatcaagaagatcggaaacttcagtatcgttcggcgtctgggagtgcaggaatgcattctccttgttactcagagaatcacgaaatatcccgttctggtggagaggatcattcagaatactgaagctggaacagaggattacgaagatctgacacaggcccttaacttgattaaggacatcatttctcaggtggacgcgaaagtgtccgaatgcgagaaggggcagcgtcttagagaaattgccgggaagatggatttaaagtcgtcctccaagctaaaaaatggcctgactttccggaaagaggatatgctgcagagacagctccatcttgaagggatgctgtgctggaaaaccactagtggccggctcaaggacatcctggctatcttgctgaccgacgtcctgcttctcctgcaggaaaaggaccagaagtacgtgtttgcttcagtcgacagtaagcccccagttatttcgctacagaaactgatagtgcgagaggtggccaacgaagaaaaggccatgttcctgattagtgcatctctgcagggcccagagatgtacgaaatttacactagcagcaaggaagaccgaaatgcctggatggctcacatacaacgggccgtggaatcgtgcccagatgaggaagagggtcctttctcgctgccagaagaggagcgaaaagtggtggaggccagagcgacaagacttcgcgactttcaggagagattgagcatgaaggatcagctgatcgcccaaagtcttctagaaaaacaacagatctatctggagatggcggaaatgggcggcttagaggatctccctcagccccgcggattgttccggggcggtgacccatccgagaccctccagggagaactaatcctcaagtctgccatgagcgaaatcgagggcatccaaagcctcatctgcagacagttagggtcagcaaacggccaggccgaagatggtggatcctccactggccccccacggcgcgccgagacatttgctggctatgactgtaccaacagcccaaccaaaaatggcagcttcaaaaagaaagtaagcagtaccgatccccgcccaagggattggaggggaccgccaaacagtccagatctcaaactcagtgacagcgacatccctggaagctcagaagaatcacctcaagtggtggaggctccagggaccgagtctgatcctagactgcccacagtgctggaatccgagctagtgcagcggattcagaccttgagtcagttgttgctgaacttacaggcagtgatagcacatcaggacagctatgtcgaaacgcaacgggctgccatacaggagagggaaaagcagttccggctgcagtctacacgtggcaaccttttgctggagcaagaacgtcaaagaaattttgaaaagcagcgcgaagagcgcgctgctcttgagaaactccagtcccagctgcgacacgagcaacagcgctgggagcgcgagcggcaatggcaacatcaggagttagagcgcgctggggcgcggctgcaggagcgcgagggagaggcgcgacagttgagggaaagactggagcaagagcgggccgaactggagaggcagcggcaagcctatcagcacgacctggagagactgcgtgaagctcagcgagccgtggagagagaaagagaaagattagaactactgagacggctgaagaaacagaacacagccccaggggcactcccacccgataccctggccgaggcccagcctccaagccatccaccgtcatttaacggcgaagggcttgaaggaccaagggtttccatgctgccatccggggtcggacctgagtacgctgagcgaccagaggtcgctagaagggactccgcgccaactgaaaataggctcgccaagtcagatgttcccattcagttgctaagcgcgacgaatcagtttcaacggcaggccgctgtgcagcaacagattccaactaaactggcagcctccacgaagggcggaaaggataagggggggaagtctcgcggatcgcaacggtgggagagttctgcaagctttgacctcaagcagcagctattactgaacaagttgatgggcaaggacgaatccacatcccgtaaccggcggtcgctcagccctattctccccgggaggcactctcctgccccaccaccggatcccggattcccagcccccagcccacctcccgcggactcaccttccgagggcttcagcttgaaggccgggggtacagctctgctgcccggtcctccagccccatctcctctacccgcaaccccgctgtccgcaaaggaagatgcctccaaagaggacgtgattttcttctag

SEQ ID NO: 14450 - DNA, 2544 bp, Artificial Sequence
  Description of Artificial Sequence: Synthetic coding sequence
atggaggcgctggggcctggcggcgaccgggcaagcccggcatcaagtacaagcagtctcgatttatggcaccttagcatgcgagctgattcagcatattcttcattttccgcagcaagtggcgggccggagccaagaacccagtcaccgggaaccgatctcctgccatatttagactgggattacgttcgcgtcgtgtggggcggacccggccctgcccctcccgacgctgccttgtgcacctcaccacgaccacggccggccgttgcagctcggtctggaccccagccaaccgaagttccagggactccagggccccttaataggcaggccactccgctcctatacgccctggccgctgaagctgaggccgcagcccaggcagccgagccacctagtcctcctgcctcacgggccgcttaccgccaacgcctccagggagctcagcgcagggtcctccgggagactagcttccaacgcaaggagctgcgcatgtccctgcccgcccgacttagacctacagtgcctgcacgccccccggcgacgcatccaagaagtgcgagtctgtcccatcctgggggggagggagagccggcgcggagccgggcaccagccccaggcaccgccggcagggggccactggccaaccagcaacgtaaatggtgcttctctgagcccggaaaactggaccgggtcggcaggggtggtgggcctgcccgtgagtgcctgggggaagcatgcagctcttctgggctccctggaccagaacccttggagttccaacatccggccttggctaagttcgaagatcatgaggtcggctggctccctgagacacaaccacagggcagcatgaatctcgactccggttccctgaagttgggcgacgcattccgacctgcgtcaaggtctagaagtgcaagcggcgaggtgctgggtagctggggaggaagtggcggtacaataccaatagtgcaggcggtgccccagggggcagagacgcctcgccccctcttccagactaaactgagccgcttcctcccacaaaaggaggctgctgtaatgtaccccgccgagctgcctcagagtagccccgcggatagtgagcagcgcgtttcggagacgtgcatagttcctgcctggctccccagtttacctgacgaggtttttctggaagaagcgcccctggtccggatgcgttctccaccagatccccatgcctctcaaggtcccccagccagcgtgcacgccagcgaccagccttatggtaccggtctaggacagagaactggccaggtgacagttcccacggagtaccccctccacgagtgccccggaaccgctggcgccgacgactgttggcagggtgtgaacggttcggttgggatttcccgtcccacctcccacacgcccaccggcaccgctaacgataacataccaacaatcgacccaaccggcctcaccacaaatccccctacggcagctgagtcggatttattaaagcccgtaccagccgacgccctgggacttagtggaaatgatactcccggaccatcccacaatactgctctggccagagggaccggacaacctggctccagaccgacctggcctagtcagtgcctggaggagctggtacaggagttggctaggctcgatccgagcctgtgcgaccctttggctagtcagccatcacctgaaccacctctcggattgctggacggactgatacctttggctgaagtccgggccgcaatgcgacctgcctgtggcgaggcaggggaggaggccgcatctacctttgagcccgggtcttaccagtttagttttacacaactcctgccagcccctcgagaagaaacacgcctggagaatcccgcaacacaccccgtgctcgaccagccatgtggccagggcctcccagccccaaacaactcaatccaggggaagaaagttgaacttgccgcacgcctgcagaaaatgctacaggacttgcacaccgagcaggaaaggttgcagggggaagcccaggcctgggccagaaggcaggctgcactggaggcagcagtgagacaggcctgcgccccccaagagctggaaagattttcaaggttcatggccgatctcgagcgcgttctgggcctgctccttctgctagggagccggttagcccgcgtgagacgggcgctcgccagagccgctagtgattcagacccagatgaacagcgccttcggctccttcaacgccaggaggaggatgccaaagaactgaaggaacacgttgccaggagggagcgggccgtgcgtgaggtcctcgtccgagccctgcccgtcgaagaattgcgcgtgtactgtgcactgctcgctggcaaggcagcagtgttggcccagcagagaaatctggacgagcgcattcgccttcttcaggatcagctcgatgcaattagagatgacttaggccatcatgcccctagccccagccctgccaggccacctggcacttgtcccccggttcagccaccgttcccccttctgctgacctag

SEQ ID NO: 14451 - DNA, 2502 bp, Artificial Sequence
  Description of Artificial Sequence: Synthetic coding sequence
atgaagttcaccaatacaaaggtccaaatgatgcagaatgtacacctggccccagagactgacgaggacgacttgtattccgggtacaacgattacaaccctatctatgatattgaggagttagagaacgatgctgcatttcaacaggcggtgcggacatcccacggccgccgccctccaatcaccgccaaaatcagctctaccgccgttactcggccaattgctacaggctacggctcaaagaccagtctcgccagttccataggcagacctatgacaggcgctatccaggatggggttaccaggcccatgacagccgtccgcgccgccgggttcaccaaagccgccctgcgaggatccgcatttgatcctctcagccagtctaggggtcccgcttctcccctagaggccaaaaagaaggactcccctgaggaaaaaatcaagcagcttgaaaaggaagtcaatgaattggtggaggagagctgtatagccaattcttgtggtgatctgaaattggcccttgaaaaggcaaaggatgctggccgcaaagaaagggtgttagtgaggcaaagggaacaagtgactactccagagaatatcaacctggacttgacctactcagttctctttaacctggcctcccagtacagtgttaacgagatgtacgcggaagctctgaacacctatcaggtaatcgtgaagaataagatgttcagcaacgctggcatcctgaagatgaacatgggtaatatttatctgaaacagagaaactacagtaaggcaataaaattttatcggatggctttggatcaagtgccatccgttaacaagcaaatgcgaatcaaaatcatgcagaatattggagtcacattcatccaggcaggccagtattcagatgctattaatagctatgaacacatcatgagcatggcgccaaacctgaaggccggatacaaccttacaatatgttatttcgcgataggcgatagggaaaaaatgaagaaggcatttcagaaattgataactgtgcccctggaaatagacgaagataagtacatttccccctcagacgaccctcataccaatctggtgacagaggccatcaagaatgaccaccttaggcagatggagcgcgagaggaaagccatggctgagaagtacatcatgacaagcgcgaaactcattgctcccgtcattgaaacttctttcgcggctggctatgattggtgcgtggaggtggtaaaggcctctcaatacgtggagctggctaatgatctggagatcaataaggccgttacctatctcagacaaaaggattacaaccaagcagtcgaaattctcaaggtgcttgaaaagaaggatagccgcgttaagtccgctgccgcaactaacctctccgccttgtattatatggggaaggacttcgcccaagccagttcttacgcggacatcgccgtcaactcggatcgctataacccagccgccctgaccaataagggtaacaccgtattcgccaatggggattacgaaaaagcggccgagttctacaaggaagccctgcgcaatgatagctcctgtacggaagccctgtacaacattgggctcacctacgaaaagctgaatcgcctggacgaagccctcgactgttttctcaagctccatgcgatcttgcggaattctgccgaagttctttatcagattgctaacatctacgagcttatggagaatcccagccaggccatcgagtggttaatgcaggtagtatcagtgattcccaccgatccccaggtactctctaagctgggcgagctttacgacagagaaggagataagtcccaagccttccaatactattacgaaagttaccgctatttcccatgtaacattgaagttatcgaatggcttggcgcttactacattgacacccagttctgggaaaaggcgattcagtacttcgagagggcatctctcattcagccaacacaggtgaaatggcagctgatggtggctagctgtttccgcagaagcggaaactaccagaaagccctggacacatacaaagacacacatcggaaattccccgaaaacgtggagtgtcttaggttcctcgtgcggctgtgcacagacctcgggctgaaggatgcgcaagagtacgcgcggaagctaaaacggcttgagaagatgaaggagatccgcgagcaacggatcaaaagcggcagagacggcagcggtggctcccggggaaaaagggagggctctgcaagtggcgacagcgggcagaattactccgccagttctaagggggaacggctgagtgcgcgtctgcgggcactccctgggacaaatgaaccttatgagtcatcctccaacaaggagatcgacgcctcttacgttgaccctctcggtccccagattgagaggccaaagaccgccgccaagaagagaattgatgaggacgacttcgcagatgaggagttaggtgatgatttgcttcccgagtag

SEQ ID NO: 14452 - DNA, 918 bp, Artificial Sequence
  Description of Artificial Sequence: Synthetic coding sequence
atggacttatctggggtgaagaagaagtccctgctcggagtgaaagagaacaacaaaaagagtagtaccagggccccaagccccaccaaacgcaaggaccgttccgatgaaaaaagtaaggacagaagtaaggacaaaggcgctacaaaggagtcttctgaaaaggatagaggcagggacaagactcgaaaaagaaggagcgcaagctctgggagttcctctacccgctccagatcttcaagcaccagcagctctgggtcttcgacttccacgggatcaagctccggaagttcttcatcatccgcaagcagcagatcagggtcctcctccactagccgatcttctagttcttcctcctcgtcaggttccccgtcccctagtcgtcgccggcatgataaccgtcggcgatctcggtctaaaagcaaacctcccaagcgggacgaaaaggaacggaaacgtaggagtcccagtcccaagccaactaaagtccatataggcagattgacacggaacgtgaccaaggaccacataatggagatctttagtacatatggcaagattaaaatgatcgacatgcctgtcgagaggatgcatccacatctttccaagggatatgcctatgtcgaatttgagaacccggacgaggctgaaaaggctctcaaacatatggatggcggccagattgacgggcaggagatcactgccactgccgttttagctccctggccacggcctccccctaggagattcagccctccacggcgcatgctgccccctcccccaatgtggcgcagaagtccacccaggatgcgtagaaggagtcgctctccacggcgaaggagtcccgttaggcggaggtcccggagtcccggcagacggcgacaccgtagcaggtcttccagtaattcaagtcgatag

SEQ ID NO: 14453 - DNA, 1119 bp, Artificial Sequence
  Description of Artificial Sequence: Synthetic coding sequence
atggacgtgctgtctccactttcgtttatcaaggtgtcgcacgtgcgaatgcaggggatcctgctcctggtcttcgctaaataccagcaccttccatacattcagatcctgtctacaaagtccacccccaccggcctgttcggttactgggggaacaagggcggcgtcaacatctgtctgaagctttacggctattacgtttctatcatcaactgccatctcccaccccacatcagtaataactaccagaggctggagcactttgatcggatcctcgagatgcagaattgcgaaggcagagatatccccaatatcttggaccatgatctgatcatctggtttggagatatgaactttcgcattgaagatttcgggctgcattttgtccgcgagagtatcaaaaatcggtgttacggcggtctatgggaaaaagaccagctaagtatcgctaaaaagcacgaccctctgcttagggagttccaggaaggccggctgctgttccctccaacatataagtttgaccggaactctaacgactatgatacatctgagaaaaagagaaaaccagcttggacagaccgcatactgtggaggctgaagcggcagccttgtgccggaccggacaccccaatccccccagcttctcatttctcactgtccctcaggggctattcaagccatatgacgtatgggatctccgatcacaagcctgtgagcgggacgtttgacttagaattaaaaccactggtcagcgctcccctcatcgtgctcatgcccgaagatttgtggactgtggagaacgatatgatggtctcttactcttccacttctgactttccttcatccccctgggactggatcggactctataaagtaggacttcgcgatgttaatgactacgtgagttatgcttgggtaggtgatagtaaggtgtcctgcagtgataacctcaatcaggtgtacattgacatatccaatatccctacaactgaagacgagttcctgctgtgttactacagcaacagccttcgcagcgtcgttgggataagccgcccttttcagatccctccaggatccctgcgggaagacccactcggagaagctcaacctcagatttag

SEQ ID NO: 14454 - DNA, 1692 bp, Artificial Sequence
  Description of Artificial Sequence: Synthetic coding sequence
atgcgcctggacctggcatctctgatgtctgctcctaaaagtctcgggtctgcattcaagagttggaggctggacaaggcccccagtccccagcacacctttcccagcacttcgataccgggcatggctttcgcgttactagcctcagttcctccagtctttgggctgtacacttctttctttccagtactgatctactccttacttgggaccggtcggcacctcagcacaggcacttttgcgatccttagtctgatgacaggatccgcggtggaaaggctggtgccagaaccactcgtcggcaacttgtccggcatagagaaggaacagctagatgctcagcgcgtgggggtagccgcagcagtcgctttcggatcaggagcattaatgctggggatgttcgtgcttcaacttggcgttttgagtaccttcctgtccgaaccagtggtgaaagctctgacgtcgggggccgccctccatgtgcttctatcccagctgccgtccctgctggggctcagtcttccgcggcaaattggctgcttcagcctctttaagacactagcctcattgctgacggcgctgcctcgttcttcacccgccgaacttaccatcagcgcactgagtcttgcattgcttgtgccagtgaaggagctgaacgtccgcttcagagatcggctccctacacctattcctggagaggtcgttctcgtgctgttggccagtgtactgtgcttcactagttcagtggataccagataccaggtccagatcgtggggctgctccctggcgggttccctcagccattacttcctaatctcgctgagctccctaggatacttgcagatagcctgccaattgctctggtgagcttcgcagtctccgcgtctctggcatccatccacgccgataagtactcttatacaattgactcaaatcaggaattcttagctcatggagccagcaacctgatcagctccttattcagttgcttccctaactctgccaccctggccaccaccaatcttctggtggatgccggtggaaaaacacagttggccggacttttcagctgcacagtggtgttgtctgtgctgctttggctaggaccttttttctattatcttccaaaagcggtgctggcatgtataaatattagttccatgcgtcaagttttctgtcagatgcaggaactgccgcagctgtggcatattagccgggtggatttcctacttcaggtgcccggtttatgcatccttagttacccgacaccattgtatttcggtacccgaggccagttccggtgcaatttggagtggcatctgggtttaggagagggtgaaaaagagacaagtaagccagacggccccatggttgccgtggccgagcccgttcgcgtagtcgtacttgacttttcgggcgtaacctttgcagacgctgcaggggcccgagaggtagttcaggtgcgggagagattagcctccagatgtagggacgcccgtattcgtcttttattggcacagtgcaatgccttggttcaagggactctcactcgggtcggtcttctagacagggtcactcctgaccagttatttgtctctgtccaggacgcggccgcttacgctcttggcagcctgttgcggggctcaagtactaggtcaggaagccaggaggccctcggatgcggtaagtag

SEQ ID NO: 14455 - DNA, 2892 bp, Artificial Sequence
  Description of Artificial Sequence: Synthetic coding sequence
atggccgagagaggcggcgccggaggcggtcctggaggtgctgggggcggatcggggcagagaggaagcggagtcgcacaatctccccagcagcccccaccccagcaacaacagcaacagccccctcagcagcccacaccccccaagctggcacaggccacctcctcttcgtcgagcacatccgccgccgcagcatcctcttcctccagttcaacaagcaccagcatggccgtggccgtagcttccggcagcgccccccccggcggcccgggacccggtaggaccccggcccccgtccagatgaatttgtatgctacatgggaagtagacaggtcaagtagcagctgcgtgccccggctgttctctttaactttaaaaaagctagttatgctgaaagagatggacaaggacctgaacagcgtggtgatagcagttaaactccaaggcagtaaacgaatcctccggtccaacgagatagtcttgcccgcatctgggctggtggagacagagctgcagctgactttctccctccagtatccacactttttgaagagggacgctaataagctccagattatgcttcaacggagaaagagatacaaaaaccgtaccatactggggtataaaaccctcgcggtcggtctcattaacatggccgaagtcatgcagcaccctaatgagggcgcactggtgctgggactgcactctaatgtcaaggacgtgtccgttcccgtggctgaaatcaaaatttattcactgagtagtcagcccatcgatcacgagggaattaaatctaaactgtcagacagatctccggacatagacaactactcagaggaggaagaggagtctttctcgagcgagcaggagggttctgatgatcctcttcacggtcaggatctgttctacgaagacgaggatctgagaaaagtcaagaagaccaggaggaagctgacctcaacttcagctatcacccgccagcctaatatcaagcaaaaatttgttgccctgctgaaaaggttcaaggtttcagatgaggtgggcttcggattggaacacgtgagccgagaacagattagggaagtggaagaggatttggatgagctgtacgacagtttggaaatgtacaatccaagtgacagcggacccgaaatggaggagaccgaaagcatcctgtccacgccaaaaccaaagctcaaaccattcttcgagggtatgtcgcagagttcgagtcaaacggaaatcgggtcattaaacagtaagggatccctaggaaaggatacaaccagtcctatggagctcgccgcattggagaaaattaagagcacatggattaagaatcaggacgattccttgaccgagacagatacgctcgagatcaccgatcaggacatgtttggcgacgcttcaacgagtctggtggtgcccgagaaggtaaagacaccaatgaagagtagtaaaacagatctgcagggcagcgccagcccatcaaaggttgaaggggtgcatacccctaggcagaagaggtctaccccactcaaggagcgccagttgagtaaaccactttccgagcggacaaattcaagcgacagtgaaagaagtccggacctgggccattctactcaaattcctcgaaaagtcgtatacgaccaactgaatcaaattctggtgtcagatgcggcgcttcccgaaaacgttattctagtgaatactactgactggcaggggcagtacgttgccgaactattgcaggatcagaggaagcccgtggtgtgcacctgctccaccgttgaagttcaggctgtgctgtcagccttgttaacgcgcattcagaggtactgtaattgtaactcaagtatgcctcggcccgtgaaagtcgccgcagtgggcgggcagtcatatttgtccagcattctgagatttttcgtaaagtctcttgcaaacaaaaccagcgactggctaggttacatgcggtttcttattattccccttggaagccacccagttgctaagtatttgggctctgtggactccaaatatagctcgtcattccttgacagcggctggagggacctgttctccagatcagaaccgcccgtgtccgagcaactggatgtggccgggagggttatgcaatatgttaatggcgccgctaccacacatcaactcccggtagccgaagccatgctcacttgccggcataagttcccagacgaggattcttatcagaagtttattccttttatcggagtggtcaaggttggactggtggaagatagcccaagcactgcgggggacggggatgactccccagtcgtgagcctgactgtgccatctactagcccaccctcctcttccggtttgagtcgagacgccacagccacaccacctagttcccctagtatgagctctgcacttgccatcgttggaagccctaattccccctatggcgacgtcatcggattgcaggttgattattggctggggcatccaggagaacgaaggcgcgaaggagacaagagggacgccagctccaaaaacaccctgaagtcggttttccgatccgtccaagtatcacgactaccccattccggggaagcccagctgagcggaaccatggcaatgactgtggtgactaaggagaagaataaaaaggtacccactatctttctcagcaagaaacccagagaaaaggaggtggattccaagtcacaagttatcgaaggcatatcccggttaatctgctcagccaagcaacagcagacaatgcttagagtgtccatagatggcgtggagtggtctgatataaaatttttccagctcgccgcccagtggcccacccacgtaaagcatttcccggtcgggttgttctccggttctaaagccacatag

SEQ ID NO: 14456 - DNA, 546 bp, Artificial Sequence
  Description of Artificial Sequence: Synthetic coding sequence
atggaggagatacccgcacaagaagccgccggaagcccaagagttcagttccagtccctggagacccagagtgaatgtttgagtcctgaaccccaattcgtccaggacacagacatggaacagggtctgactggagctcctcctgtgccccaggtcccagccttgccccgggagggtagtcctggcgaccaagctgccgcgctgctgactgccagataccaggaattcgtgacctttgaggatgtcgccgtgcatctaaccagagaagagtggggctatctcgatcccgttcaaagagatctctatcgggaggtcatgctcgagaactacgggaacgtggtgagcctcggaatcctgctccggcttccaaccactcgaattcattcagtcaactcctgcccagcactgagccatacacaagcaagtgctttttcaggtgagacactggccgtcttgaccgccggaatatctaagagatggccaaagtacagacttcccatcgatatcgctaggccatgttcggagacccccttccctcggttatag

SEQ ID NO: 14457 - DNA, 1410 bp, Artificial Sequence
  Description of Artificial Sequence: Synthetic coding sequence
atggtgctggagggcaaccctgaggtgggctcccctagaacatcagacctgcagcatcgaggcaataaaggaagttgtgttcttagctccccaggagaagatgcccagccaggggaagaacccatcaagtatggtgaactgatcgtgctgggatgctgcgaagaaggtggggaggaaacagaggctcaacggggggaggtcactggcccaagggctcattcatgttacaacgggtgccttgcatcaggtgataagggtcgacgtcgaagcagattagcactttcccgcaggagccacgccaatggcgtcaaaccggacgtgatgcaccacataagcacccctttggtgtccaaggcattgagtaacagaggccaacactcaattagttatactttatcaaggagccactcagtcatcgtggaatacacccacgatagtgataccgacatgttccagattggacgtagcactgagaatatgatcgattttgtggtgactgatacaagcccaggcggcggagctgcggagggcccaagcgcgcagtctacgatctcacggtatgcctgtaggattctgtgcgacagaagacccccctacacggccaggatctacgccgcgggctttgatgcatccagtaatattttcctgggcgaacgcgccgccaaatggaggacaccagacggtttgatggatggacttactactaatggagtgctggtaatgcatcctgcggggggtttttctgaggacagtgccccgggagtctggcgtgagattagcgtctgtgggaacgtttacacactgagagactcccggagcgcccagcaaagagggaaacttgtcgaaaacgagagcaatgtgcttcaagacggatcccttatcgatttatgtggagctaccctcctgtggcgcacccccgccgggttgcttagagccccgaccctcaaacagcttgaagctcagcgccaggaagctaacgctgcgcgaccacaatgtccagtcgggctgagcactctcgccttcccttcaccagcgagaggccgaactgcacctgacaagcagcagccgtgggtgtacgtgcgatgcggccacgtgcatggttatcacggctgggggtgccgcagagagcgtgggccgcaggagagggaatgcccgctgtgtaggttggtgggaccatacgtgccactgtggctcggtcaagaggctggactgtgcctcgaccctggacccccttcacacgcattcgccccatgcggccatgtgtgttcagaaaagacagcgcggtactgggcgcagaccccactaccacatgggacccatgcgtttcatgcagcctgcccgttctgcggcgcctggctaacgggcgaacatgggtgcgtgcgcctgatattccaaggcccgctagactag

SEQ ID NO: 14458 - DNA, 3312 bp, Artificial Sequence
  Description of Artificial Sequence: Synthetic coding sequence
atggccggtgccagcgtcaaagtggcggtgcgcgtgagaccgttcaacgcccgggaaacaagccaggatgccaaatgtgtggtgtccatgcaggggaacactacatctataatcaatcctaaacaatctaaggatgctcctaaatcctttacgttcgattacagctactggtcccacacctccactgaagacccacagttcgcgagtcaacagcaggtatatagggatatcggcgaagaaatgctgttgcatgcattcgagggatacaatgtgtgcatcttcgcgtatggtcagacaggagccgggaaaagttacactatgatgggcagacaagagccaggccagcagggaatcgtgccacagttgtgcgaggatctgttcagtcgcgtctctgagaaccaaagtgcccagctgtcatatagcgttgaggtgagttacatggagatatactgcgagagagttcgcgatttgctcaatcctaagtcccgtgggagcctgcgggttcgcgaacaccctatcctaggtccttacgtgcaggacctctcaaaactagcggttacttcatatgcggacatcgcggacctcatggattgtggaaacaaagctcgcaccgtggctgctaccaacatgaatgagacatctagcaggtctcacgcagtgttcaccatcgtattcacccagcggtgtcacgaccaactgactggtctggacagcgagaaggtgagtaaaatcagtctggtggatttggcaggcagtgagcgggccgacagctctggcgcgcgcgggatgaggttaaaagaaggcgcaaatatcaacaagagcctgactacactgggcaaggtgatttcagcgctcgccgatatgcaatctaagaagaggaagtcagatttcattccttacagagacagcgtgcttacttggctgctgaaagaaaatctgggaggcaactcaagaactgctatgatcgccgctttatcacccgcagatattaactacgaggagacactctctacactgaggtacgctgatagaaccaagcaaatcaggtgtaacgccattatcaatgaggacccgaacgcacgcctcatcagggagctgcaggaggaggttgcccgccttagagaactgttgatggctcagggtttgagcgcatcagcattggagggacttaaaaccgaagaaggttcagtaaggggggctcttcccgcagtttcatctccccccgcgcctgtttctcccagctcccccaccacccacaacggcgagctggagccaagctttagcccaaacactgaatcccaaattggacctgaggaggcaatggagagactgcaagaaaccgagaagattatcgcagagctgaacgagacgtgggaggagaagctgcggaaaacagaggctcttcgcatggaacgggaagccctgttagccgagatgggagtagccgtgcgcgaggacggcggcaccgtgggggtcttttcacctaagaaaacaccccatctcgtgaatctgaatgaggacccactgatgagtgaatgtctgctgtatcatatcaaagacggcgttacacgagttggccaagtggatatggacatcaagctgaccggtcagttcatcagagaacagcactgtctgtttaggagcatcccacagcccgacggcgaggtagtggtgaccttggaaccttgtgaaggcgcagagacctacgtgaacggtaaactagtgacggaacctctggtgctcaaatccggcaatcgcatcgtgatgggcaagaatcatgtttttcggttcaatcatccggagcaggctcgactagagcgggagaggggcgttccacctccgcccggtcccccgtctgaacctgtggattggaattttgcacaaaaagaactcctcgagcaacagggcattgatatcaagctggagatggaaaagcgcctgcaggacctcgaaaaccaatacaggaaagagaaggaagaagcagatttattattagagcaacagcggctgtatgccgattctgactccggggacgacagtgataagcgcagctgcgaagagtcgtggaggctaatctcaagcctgagagaacaactgccccccacaacggttcagaccatcgtcaaacgatgtggtctcccaagtagtggcaaaagacgagcccctaggcgggtgtatcagattcctcagagacgcaggctgcagggaaaggatcccaggtgggcaacaatggccgatctgaagatgcaggccgtcaaggagatatgctatgaggttgctctcgcagattttcgccacggaagggctgagatagaggctctcgcggccctgaagatgcgggagctgtgcaggacctacggcaagccagacggccccggtgatgcatggcgcgctgtagcccgtgacgtttgggacactgtaggcgaagaggagggtggcggcgctgggtcaggaggtggctctgaagaaggggcaaggggtgctgaagtcgaggacctgcgtgcccatatcgacaagctgaccggcattttacaggaagttaagcttcagaactcttccaaggacagagaactgcaagcgcttagggatcggatgctgcgcatggagcgcgttattcccctcgcacaggatcacgaggacgagaacgaggagggaggagaggtgccatgggcacctcctgagggatccgaagccgctgaggaggcagcaccgagcgaccgaatgcctagtgccaggccaccttcacctcccctgtcttcatgggagcgggtgagccggcttatggaggaagatcccgctttccgccgaggccgccttaggtggctcaagcaggagcagctaagactgcaggggctgcaaggcagcggcgggcgcggaggaggcttgagacgaccccctgctagattcgtgccaccgcacgattgcaaactgcgctttccttttaagtcaaacccccagcaccgggaatcctggcccggcatgggaagtggcgaggccccaacccctttgcagccgccagaggaagtaacgccccatccggccacacctgcacggcgccctccatcacctcggagatcccaccatccccggaggaattctctggatggaggcggtaggtcaagaggcgccggatccgcccagcccgaaccacagcatttccaacctaaaaagcataattcatatcctcagccccctcagccctaccctgcccagcgaccccccgggccaagatatcccccctacactacccctcctcggatgagacgtcagcgtagcgcgccagacttgaaggagagcggggcagcagtgtag

SEQ ID NO: 14459 - DNA, 1260 bp, Artificial Sequence
  Description of Artificial Sequence: Synthetic coding sequence
atggccgagcctgtaggcaaaagagggcgatggagcggcggctcaggagctggccggggggggcgcggcgggtggggcggcaggggtcgcagaccccgggcacagagatcgcctagtagggggaccctcgatgtggtaagcgtggacctggttactgacagcgacgaagaaatcttggaggtagccactgctagaggggccgctgacgaggtggaggtagagcctcctgaaccccccggcccagtggcctcacgggataattctaattctgacagtgagggcgaggaccggcgtcccgctggcccgccccgcgaacctgtacgtaggaggagacgactcgtactggaccctggggaggccccgttagtgcctgtgtattcaggaaaagtgaaatcgagtctgcgattgattcctgacgatttatcccttctgaagttgtatccaccaggcgacgaggaggaagccgagctggctgactcatccggactttatcacgagggatccccctcacctggctccccatggaaaaccaaacttcgaaccaaggataaggaggagaaaaagaaaacggagtttctggatctcgataattcacccctgtccccaccatcgccgcggacaaagagccgcactcacactagagctttaaagaagctgtccgaggtgaacaagcggctgcaggacctgcgtagttgtctctcaccgaagccaccccaaggccaggagcaacaagggcaggaggacgaggtagtcctggtcgagggcccaaccctgcctgagacacccaggctgttcccccttaagatccgctgtcgagcagatctcgttcgactgcctcttaggatgtcagagcctctccaatccgttgtcgatcatatggctacacatctgggtgttagcccttcacggatattgctgctgttcggtgaaacagaactttctcccaccgctacaccccggaccttgaagctgggcgtcgccgatataatcgactgtgtggtgcttacaagctcgccagaagccacagagacatcccaacagttgcagctccgggtacaaggtaaggagaaacaccagacactggaggtttctctctcaagggattctccgttaaaaaccctgatgagccactatgaagaagccatggggctgtcaggccgaaagctgtcatttttctttgatggaacaaaactgtcaggtcgagaactgcctgctgacctgggcatggagagtggcgatctcattgaggtgtggggctag

SEQ ID NO: 14460 - DNA, 384 bp, Artificial Sequence
  Description of Artificial Sequence: Synthetic coding sequence
atgaggcccctggatatcgtggaactagccgagcctgaggaagtcgaggtccttgagcccgaagaagactttgagcagttcttgctgcctgtcatcaatgagatgagggaagacattgcaagtctgacccgtgagcacggaagggcgtaccttagaaatcgcagcaaactctgggagatggacaatatgcttattcagatcaaaacacaggtagaggcgtctgaggaatccgccctcaatcaccttcagaatccaggggatgccgcagaggggcgggctgctaagcggtgcgaaaaggctgaagagaaagctaaggaaatcgcaaagatggccgaaatgctggttgaattggtgcgccgaatcgagaagtccgagtctagctag

SEQ ID NO: 14461 - DNA, 1263 bp, Artificial Sequence
  Description of Artificial Sequence: Synthetic coding sequence
atgcccttgcaggtcagcgactattcatggcaacaaaccaagacagccgtatttctgtcactacctctcaagggagtctgcgtcagagataccgatgttttctgtacagagaactacctgaaagttaatttccctccctttttgttcgaagcctttctgtacgcgcccatcgacgatgaatccagcaaggccaagatcggtaacgacaccattgtgttcacactttacaagaaagaggctgctatgtgggagaccctctccgtaaccggtgtggacaaggagatgatgcagagaatacgggaaaagtcaattctgcaggcccaagagcgcgctaaggaggctaccgaggccaaggccgctgctaagagagaggatcagaaatacgcactgagcgttatgatgaaaattgaagaagaagaaagaaaaaagattgaagatatgaaggaaaatgaaaggattaaggctactaaagccttagaggcgtggaaggagtatcagcgaaaggccgaggaacagaaaaagatccagcgcgaagagaagctctgccagaaggagaaacagatcaaggaggaacgcaaaaagataaaatacaagagtctgacccgcaacttggccagcagaaacctggcacccaaaggaagaaactctgagaacatttttaccgagaagctcaaggaagacagtatccctgcgccgagatctgtgggaagtatcaagataaacttcaccccgagggtgttcccaaccgcacttcgggagtcccaggtcgcagaggaggaggagtggctccacaagcaggcagaggccaggcgggccatgaacaccgacattgctgaactgtgtgacctcaaggaggaagagaaaaaccccgaatggcttaaagacaaggggaacaagctgttcgcaaccgaaaactatttggccgctatcaacgcctataacctggcgattaggctcaacaacaagatgcctcttctatacctcaatcgggcagcttgtcacttgaagcttaagaatctccacaaagccattgaggactcctccaaagctctggagcttctcatgccacctgtgactgataacgccaacgctcggatgaaggcgcacgttcgtagagggaccgcattttgccagctggagctgtacgtagaagggttgcaggactacgaagctgctttgaagattgatcctagtaataagattgtacagattgatgcagagaaaatcagaaacgtgatccagggaactgagttgaaatcgtag

SEQ ID NO: 14462 - DNA, 348 bp, Artificial Sequence
  Description of Artificial Sequence: Synthetic coding sequence
atgcgctacgtggctagctacctgctagcagccctcggagggaactccagccctagcgccaaagacattaagaaaattcttgactcggtggggattgaggctgatgacgacaggcttaacaaggtgatctcagagctgaatgggaaaaacattgaggacgtaattgcgcagggaattggtaagctcgcctccgtccccgctggcggcgctgtcgcagtctccgccgcaccagggagcgcagctccagcagcgggcagcgccccggcggctgcagaagagaaaaaagatgaaaagaaggaggaatctgaagagtccgacgatgacatgggtttcggacttttcgactag

SEQ ID NO: 14463 - DNA, 1233 bp, Artificial Sequence
  Description of Artificial Sequence: Synthetic coding sequence
ctgaacagggcgtgtttttgcgttaccggggtccccgagctggaggtcatctgcggcctgcaacaagctgagtggccaagactcggattgtctcacctgggcgccgtgggcggcggatggggtgggctgcccacctccacttgggtctccctgcatacccaggaagtggatttggcctccgaagtggcactggaagtggtgaggaccgccgagccgggcgtttggctagaagctcaagcccccgtcgcacttgtggcccagcctgaacccctgcccgccactgcaggcgtcaaacgcgaatctgttggaatggaggtggcggtgttaaccgatgaccctctgcctgttgtggaccaacagcaagtattggccaggctgcagctacttgagcagcaggtagtggggggcgagcaagctaaaaacaaagatctgaaagaaaagcacaagaggaggaagcgctacgccgacgaacgcaggaagcagttagtcgctgctctccagaattccgatgaggacagtggagattgggtcctcctgaacgtgtacgactccatccaagaggaagtaagagcgaagagtaagttattggagaagatgcaacgaaagctgcgggcggccgaagttgagattaaagatctgcagtccgagtttcaattggagaaaatcgattatctagctaccattcggaggcaggaacgagattccatgcttttgcaacagctgcttgaacaagtccaacccctgattcgtcgggattgcaattattctaacttagagaagatcctgagagagagctgctgggacgaggacaacgggttctggaaaattccacaccccgttattacaaagaccagcctgccagtggctgtctccacaggcccacagaataagcctgccagaaagacttcagctgctgacaatggcgagccaaatatggaagatgacagatatagactcatgctttcccggtctaacagcgaaaacattgcctcaaattacttccggtcaaaaagagcaagtcagattctgtctactgacgcacgtaagtctcttacacaccataactcccccccgggcctaagctgccctttgtccaacaacagcgctatcccccctacgcaagcccccgagatgcctcagccacggccgttccgcctggagtccctggatattcccttcaccaaggcaaaacggaaaaagtcaaaatcaaactttggatccgagcctctgtag

SEQ ID NO: 14464 - DNA, 1353 bp, Artificial Sequence
  Description of Artificial Sequence: Synthetic coding sequence
atgcgggaatgtatcagcatccacgtcggacaagccggcgttcaaatcggcaacgcatgttgggagctgtactgcctcgagcatgggatccagcctgacggccagatgcccagcgacaagactattggtggaggcgatgactcatttaatacttttttttcagaaaccggcgccgggaagcacgtacctcgggctgttttcgtcgatctggagcccactgttgtcgacgaagttcgcaccggaacatataggcagcttttccatccagagcagctgataacaggcaaagaggatgcggccaacaattacgcccgcgggcactatacgatcggcaaggagatagtggatctggtcttggaccgcattcggaaactagccgacctgtgtacaggactgcagggctttctgattttccattcgttcggaggcgggacaggcagcggctttgcctccctcttaatggagcgcctgagtgtggattatggcaaaaagagcaagctggagtttgctatttatccggcccctcaggtgtccaccgctgtggtcgaaccatacaatagcatcctgaccacccacactacccttgagcatagcgactgtgcttttatggtggacaacgaggccatttacgatatttgccggcgcaatttagatatagagcgaccaacgtacactaaccttaacaggttaatcggccagattgttagctcaatcacggctagcctgcggttcgacggcgccctgaacgttgacctaaccgaattccaaacaaatctcgttccctaccctagaatacattttccactcgccacttatgctcctgtgattagtgcagaaaaagcataccacgagcagctcagcgtcgcagagattaccaatgcttgtttcgaaccagccaaccaaatggtaaaatgtgatccaagacatggcaaatacatggcttgttgcatgctttatcgtggggacgtcgttcccaaggatgtcaatgcagcaatcgccactattaaaacaaagcgaaccatccagttcgtggattggtgtccaacaggcttcaaggtggggattaattatcaaccccccaccgttgtgcctggaggagaccttgccaaggtgcagcgggcggtgtgtatgctatccaacacaacagcaatcgcggaggcgtgggcccggcttgaccataaatttgatctgatgtacgccaagcgggctttcgtgcactggtatgttggcgagggcatggaggaaggcgaattcagcgaggctcgggaggatctggcggccctggagaaggactatgaagaagtgggcgttgatagtgtggaggctgaagccgaagaaggagaggagtattag

SEQ ID NO: 14465 - DNA, 471 bp, Artificial Sequence
  Description of Artificial Sequence: Synthetic coding sequence
atgtcaggtggactgcttaaagccttacgctcagactcatatgtggaactgtcacaatatcgggaccaacactttcgtggagacaacgaagaacaagagaagctgctgaagaagagttgcacgctctacgtcggcaatcttagtttttacaccacagaggaacaaatctatgagttattttctaaatctggggatattaagaagatcatcatgggcctggataagatgaagaagacggcctgcggattttgctttgtcgagtattacagcagggccgacgctgaaaatgccatgcgatacattaacgggaccagattggacgataggattatcagaaccgactgggacgctggctttaaggaaggcagacagtacgggaggggccggtcagggggccaggtaagagatgagtatagacaagattacgatgccggccggggaggatatggtaagctggctcagaatcagtag

SEQ ID NO: 14466 - DNA, 996 bp, Artificial Sequence
  Description of Artificial Sequence: Synthetic coding sequence
atggggggcgagcaagaggaagaacgctttgatgggatgcttctggcaatggcccagcagcacgaaggcggggtccaggaacttgtgaatacctttttcagcttcctgaggagaaagaccgactttttcatcggcggggaagaaggcatggcagagaaactcattacccagacattttctcaccacaaccagctggcgcaaaagacccgtagagagaaacgggccagacaggaagccgaacgccgcgagaaggcagagagagctgcccggctggctaaggaggcaaaatctgaaacaagcgggccgcagatcaaagaactgaccgacgaggaggcagagcgattgcagttagagatcgatcagaaaaaagacgccgagaaccatgaggcccaactcaagaacggctcacttgactctcccggtaagcaggatactgaggaagatgaagaggaagacgagaaagacaaaggaaagctgaaacccaaccttggcaatggcgccgatcttcctaactatagatggacacagaccctgagcgagctggacctagccgttcccttttgcgtgaacttcagactcaagggaaaggatatggtcgtcgatattcaacggagacacctgagagtagggctgaagggacagcccgccatcatcgacggggagctctataacgaagtcaaggtggaggaatcatcctggctaatcgaagatggcaaagtggtgaccgtgcacttggagaagattaataaaatggagtggtggagtcgcctggtgtcaagtgaccctgaaatcaatactaaaaaaattaacccagagaattctaagctcagcgatctggatagcgagacccggtctatggtggagaaaatgatgtacgatcaacggcaaaagtcgatgggcctccccacatccgacgaacaaaagaagcaggagatcctcaagaagttcatggaccagcacccagagatggatttttcgaaagcaaagttcaactag

SEQ ID NO: 14467 - DNA, 1860 bp, Artificial Sequence
  Description of Artificial Sequence: Synthetic coding sequence
atggccggcccaggcgtcccaggggcccctgccgcgcgttggaagagacacatcgtgcgccaactgcggctccgggacaggacgcagaaagccctatttctggaactggtaccagcctacaaccaccttctcgaaaaagctgagctactggataaattctctaagaaactgcagccagagccgaattctgtgacgcctaccacacatcagggcccctgggaggaatccgaactggatagcgaccaagtcccgtcacttgtcgccctgagagtaaagtggcaagaggaggaagaaggcctgagactggtgtgcggtgagatggcctatcaggtagttgaaaagggggccgccctagggaccctcgagtccgagttgcagcagcggcagagcagactggccgccttggaggctcgggtggcacagctgcgcgaagcacgcgcacagcaagctcagcaggtggaggaatggcgagctcaaaacgcagtccagcgcgctgcctatgaggctctgagagcccacgttggtctgcgcgaagccgcactgagaaggttacaggaagaagcgagggatttgctggaacgcttggttcagagaaaagcaagagcagcagctgagcgcaacttgaggaacgaaagaagagagcgcgctaagcaagctcgtgtcagccaggaactaaagaaggccgccaaacgcaccgtatctattagcgaaggcccggatacattgggagacggcatgagagaacgccgcgagaccctcgccctggcgccagagcccgagccactggaaaaggaagcctgtgagaagtggaagagaccgttcaggagtgcctctgctacgtctttgaccctgtcacactgtgtagatgtagttaaaggactcttagacttcaaaaaaagaagggggcactccatcggaggtgctccagagcagcgataccaaatcattccagtatgcgtagccgcccgtctaccgacacgtgcccaggacgttcttgacgcacatctgtctgaagtgaacgcagtgcgattcggccccaacagcagcctgttagcgactggcggggccgaccggctgatccacttgtggaatgtggtcgggagccgcctggaggccaatcagactctggaaggcgctggtgggagcattacctctgtcgactttgatccatctgggtatcaggtcctagccgctacttacaaccaggccgctcagttatggaaggtaggtgaggcccaaagcaaagagacactgtcggggcacaaggacaaggttactgcggcgaaattcaaactgacccgccaccaggccgtgaccggatcacgggaccggacagttaaggaatgggatctgggccgcgcctactgcagcaggaccatcaacgtgctgtcttattgtaatgacgtggtttgtggggaccacatcattatctctgggcataacgatcagaagattcgcttttgggactcccgggggccccactgtacacaggtgatcccggtccagggccgggttacgtctctgtccctatcacacgaccagctccacctgctgtcctgttctcgggataatacactgaaggttatagatcttagggtctcgaacatccggcaggtttttagggcagacggcttcaagtgcggcagtgattggaccaaggccgtatttagccctgacaggagctacgcccttgctggcagctgcgacggagccctgtacatctgggatgtggacaccggcaagctggagagcagattgcagggaccccattgtgcagcggtaaacgctgtggcttggtgctacagcggttcacatatggtgtcagtggaccagggtaggaaggtggtgctttggcagtag

SEQ ID NO: 14468 - DNA, 5049 bp, Artificial Sequence
  Description of Artificial Sequence: Synthetic coding sequence
atggagggaaatgggacagagaactcctgtagtagaacccggggatggcttcagcaggacaatgacgccaagccatggctgtggaaattctctaactgcttcagtaggccagagcagacactgccgcactctcctcaaacaaaagagtatatggagaataaaaaggtcgccgtcgagttgaaagacgtgccatcacctctgcacgcggggtccaagctgtttccggcagtgcccctccccgacatacggagcctgcagcaaccaaagatccagctctcaagcgtccccaaagtgagctgctgcgcccattgtcccaacgaacctagcacttcccccatgcgcttcgggggaggcggcggcggaagcgggggcacatcctctctcatacaccctggtgcgctcctcgactcccagagcacccgcaccataacctgtcaagtcggctctggctttgccttccagtctgcgtcaagcctgcaaaacgcctccgcccgaaacaatctcgcgggcattgcgagcgactttccctcaatgtgtcttgagagcaatctgtcttcttgcaaacacctgccatgttgtggaaagctccatttccagtcctgccacggtaatgtgcataagctgcaccaattcccttcactgcagggttgcacaagcgccggttacttcccctgctctgattttacttccggggcaccaggccacctagaggagcacatctctcagtccgaactgaccccacacttatgcaccaattctttacacctcaatgtggtgccacccgtctgccttaaaggaagcctgtattgcgaggattgtctgaataaaccagctcgcaacagcataattgatgccgctaaggtgtggcccaatatcccccccccaaacactcagccagcacctcttgcagttccactctgcaatggctgtggcactaaaggaaccggcaaagaaaccacccttttactggcaacatctctgggaaaagctgctagcaagtttggatcgcctgaagttgccgtggctggacaggtgctcgaaaatctaccaccgattggtgtgttctgggatatcgagaattgctcagttcccagcggaaggagcgccaccgcagtggtccagaggatccgagaaaagttctttaaaggacaccgcgaagcagagttcatctgtgtttgcgacatcagtaaagagaacaaagaggttattcaagagctgaacaattgtcaggtgacggtggcacacattaacgccactgcgaaaaatgctgccgatgataagctgaggcagtcattgaggaggtttgccaacacccacactgcccctgctacagttgtgctggtctctaccgacgtcaatttcgccttggaactgtctgacctgcggcacagacacgggtttcacatcattttggttcataaaaatcaggcgtcagaggccctgttgcaccatgccaacgaattgatacggttcgaggagttcatctcagatttgcctccccgtctgccactcaagatgcctcagtgtcatacactgctctacgtttataacctgcccgcaaacaaggacgggaagagcgtcagcaaccgcctacgaaggctatcagacaactgtggtggtaaggtgctcagcataaccggctgttctgccatactcagattcattaaccaggattctgccgagcgggcccaaaaaagaatggaaaatgaggacgtgtttggcaaccgcattatcgtgtccttcacccctaagaaccgagagctctgtgagacaaaatcttcaaacgccatcgcggataaggtgaaatctcccaagaagctaaaaaaccctaagctctgtttaatcaaggatgcttcagaacagtcttcttctgctaaggcaacccctggtaaaggttctcaggctaatagtggctcagccacgaagaatacaaatgtcaaatcccttcaggagctgtgccgaatggagtctaagactggacacaggaactccgagcatcaacaggggcatcttaggttggtggtgcccacccatggcaactcttctgctgcggtgtctacccccaagaattctggtgttgctgaacctgtctacaagacatcacagaaaaaagaaaacttaagcgctagaagcgtgacatcctcacctgtggagaagaaggataaagaggagactgtatttcaagttagctacccatctgctttctccaaactggtcgcttccaggcaggtgtcacccttattggccagtcaatcatggagctcgagatctatgagccctaatctgctgaaccgtgcttctcctttagccttcaacatcgccaacagcagtagtgaagctgattgtccagaccccttcgcaaatggagcagacgtccaggtctctaacattgactacaggctcagtcgaaaggagcttcagcagcttttgcaggaggcttttgcacgccatggaaaggtgaaatccgtcgagttgagccctcacacagattaccagctcaaagctgtggtccagatggagaacctacaggatgctataggggctgttaattcactgcatcgttataagatcgggtcaaagaaaatcctggtgagtctggctacgggcgcggcgagcaagtccctttcgctgctctcagcagagacaatgagtgtgttgcaggacgcccccgcttgctgtctccccctttttaagttcacagatatatacgaaaagaagttcggacacaaactgaacgtaagtgacctgtacaagcttacggatactgtcgcaatacgggaacagggtaatggcagacttgtttgtttgctgccgtcttctcaagccaggcagtcaccattaggaagttcccagtcacacgacggttcttccactaactgtagtccgattatttttgaagaattggagtaccacgaaccagtgtgccggcagcactgttctaacaaggattttagtgaacatgaatttgatcctgactcatataaaataccctttgtgatattatcccttaaaacctttgccccacaggtgcattctctacttcagacacacgagggtacagtgcccctcctggacccttggctgctaagatcaaaatcaccggtaggaaatccgcagctgatccaattttcaagagaggtgattgatctcctcaagtcacagccatcctgtgtaatacccattagtcattttatccctagctatcatcaccatttcgctaagcagtgccgggtgtcagactacgggtactctaaactcatcgaactgctggaagctgtcccacacgtgcttcagatactgggtatgggctccaaacggcttttgactttaacccaccgcgcccaggtgaaaaggttcacgcaagatcttctcaaattgctgaaatcacaagctagcaagcaggtaattgttagggagttttcccaggcctatcattggtgtttttccaaggattgggatgtcactgaatatggggtctgcgaactgatagacattgtcagcgagatcccggacacaacaatctgcctgagtcagcaggacaacgaaatggtaatatgcatccccaaacgggaaagaacccaggatgaaatcgagcggacaaagcaatttagcaaggatgtcgttgatttgctgcggcatcaaccacacttcaggatgcctttcaataaattcatccccagctatcaccaccattttgggaggcagtgtaagctcgcctactacgggttcaccaaactgctcgagctctttgaggcaatcccagacacgttacaggtactcgagtgtggcgaagaaaagattttgacgcttaccgaggtagagcgctttaaggcccttgcggctcaattcgtcaagttactgcgaagccagaaggataactgtcttatgatgacagacctgctgactgagtacgcaaaaacatttggatatacgttcagacttcaggattatgatgttagctctatcagcgccttgactcaaaagctatgtcatgttgtcaaagttgcagatatcgaaagtggccggcaaatacagctgatcaatcgcaaatccctccggtcactgacagctcagcttttagtgctcctgatgtcctgggaggggacaactcatctctcggtggaagagttaaaaagacactacgaatctacccacaacaccccactcaacccttgtgagtacggtttcatgactttgactgagctccttaaatcactgccatatctcgtggaggtcttcaccaatgacaaaatggaggagtgtgtcaagctgactagtttgtacctctttgccaaaaacgtcaggtcattgttgcatacctatcattaccagcagatattcctccatgagttcagtatggcatatacaaaatacgtcggcgagacactgcagccaaaaacctatggccattcatcagtagaggagttgctgggcgcaatacctcaggtcgtgtggattaaggggcacggacacaagcgcattgtcgtgctaaaaaatgacatgaagtctagactttcgtcattatcattaagcccagccaaccacgaaaatcagccctcagagggcgagaggattctggaggtcccagagagtcacacggctagtgaattgaaactgggtgctgacggaagcgggccgtctcacacagaacaggaactcctaaggttaaccgatgactcaccagtggacctgttatgcgccccagttcccagctgcctcccatccccacagcttaggccagatccggtgatcctccagagtgctgatctgatccagtttgaggagcgcccacaagaacccagcgagattatgattcttaaccaggaggagaaaatggaaataccgatcccaggtaagtcaaaaacacttacctcagacagttccagttcttgcatctctgcagcagtgcctgtccccccgtgcccatcatccgaaactagcgaatcgttactcagtaaggacccagttgaaagcccagccaagaaacagcccaagaatcgagttaagctcgccgcaaattttagcctggcccctatcaccaagctgtag

SEQ ID NO: 14469 - DNA, 735 bp, Artificial Sequence
  Description of Artificial Sequence: Synthetic coding sequence
gggggcgggtatgatctaaatctgttcgctagtccacccgatagcaatttcgtatgctcagtgtgtcacggcgtgttgaagcggcctgcgagactgccttgtagccacatattctgcaagaaatgtatactccggtggttggcacgtcaaaaaacttgtccctgttgcaggaaggaggtgaagcggaagaaagtggtgcatatgaataaattgcggaaaaccataggacgactggaagtaaagtgtaagaacgccgacgccggttgcatcgtcacatgtcctctggcgcataggaaaggacaccaggatagttgtccttttgagttaacggcttgtccgaatgaggggtgcacctcccaggtcccgagaggaactttggccgaacataggcagcattgccagcagggctcgcaacagcggtgtccacttggatgcggggccactctggaccctgcagagcgcgctcgacacaactgctaccgtgagttgcacaacgcttggagtgtgagacaggagaggaggagacccttgttgctttcactcctgcgacgagtgagatggctggatcaagcaacctctgtcgtgagaagggaattggctgaactttccaacttcctcgaggaggacactgctctgctggagggggcccctcaagaagaggctgaggccgcccccgaggggaatgtcggggccgaagttgtgggcgagccacgggccaacatcccctgtaagtag

SEQ ID NO: 14470 - DNA, 705 bp, Artificial Sequence
  Description of Artificial Sequence: Synthetic coding sequence
ttgccctgtaagcgatgtcggccctcagtgtactccctcagctacataaaacgtgggaaaacacgcaattacctttatccaatatggtctccatacgcctattacctctattgttacaaatatagaatcacactgcgagagaaaatgttgccccgatgctacaaaagcattacatacaaagaggaggaagatctgacattgcagcctcgatcatgtcttcaatgcgaaagtctggtgggacttcaagagggcaagtctaccgagcaagggaatcacgatcaattgaaagaactctacagtgccggcaacctgacggtgctggcaacggatccccttctgcatcaggacccagtgcagctcgatttccactttaggctgactagccagacttctgcacattggcacggccttctgtgcgatagacggctgttcctggacataccatatcaggcactagatcaggggaaccgagagtctctgaccgcaaccttggagtatgtggaagaaaagacgaacgtggactctgtctttgttaactttcagaacgatcgcaatgacaggggtgcactgttgcgcgccttcagttacatgggtttcgaggtggtaagacccgatcatcccgcccttcccccacttgacaacgtcatcttcatggtgtacccccttgaacgcgatgtgggccatttgccctctgagcccccttag

SEQ ID NO: 14471 - DNA, 2403 bp, Artificial Sequence
  Description of Artificial Sequence: Synthetic coding sequence
atggcagcagcggcctccgtgactgggagagtgacttgggcagcgagcccgatgagatccctaggcctgggccgccgactgtctcttcctggtcccagactggatgcagtaaccgctgcggtcaaccccagcctttccgatcatgggaatggcctcgggagggggacccgggggtctggttgctcaggaggttctttagtggccgactggggcggcggcgccgcagctgctgccgctgttgccctggcgttggcccctgctcttagcaccatgaggagaggttcttcagagtctgaactcgctgctcgctgggaggcagaggcggtagctgcggccaaagcagccgccaaggccgaggctgaagcgacagccgaaaccgtggcggaacaggtacgagttgatgctggggcggccggcgagccagaatgtaaggccggcgaggagcagccaaaggtactggccccagcgcctgcgcaaccctctgccgccgaggagggcaatacacaagtgctgcagcggccccccccaacgttaccaccaagcaagcctaaacccgtgcaaggcctctgtccacatggaaaacctcgcgacaagggcaggtcatgcaaaagatcctcaggccatgggtcaggggagaacggttcacaacgtcctgtcaccgtcgatagtagtaaagcccgaaccagtttggacgccctgaagatctcaatccgccagctaaagtggaaggagttcccgttcggtcgtcggctcccctgcgacatctattggcacggggtaagttttcacgacaacgacattttttctggacaggttaacaagttcccaggtatgacggagatggtacgtaaaataacacttagcagagcagtgaggacgatgcaaaacctgtttcccgaagagtataatttctacccgaggtcatggatcctcccagatgaattccagctgttcgtggcccaggtgcaaatggtgaaagacgatgatccctcgtggaagcctacatttatcgtcaaaccggacggaggttgtcagggagatggcatctacctcattaaagatcctagtgacattcgcttagccggcactctgcagtcaaggccagccgtggtgcaggaatacatctgcaagccccttctcattgataagcttaaatttgacattcggctgtatgttctccttaaatccctggatcctttggagatttacattgccaaggacggattgtcccggttttgcacagagccctatcaggaacccacccctaaaaacctccacaggatatttatgcaccttacgaattatagtctgaatatccacagtggcaattttatccacagcgactccgcgtctactggctccaagcgaacctttagctctattctctgcagactaagcagtaagggcgttgatatcaagaaggtctggtccgacatcatttccgtggtaattaaaacagtaatcgccctgacaccggaactcaaggttttctaccagtctgacattccaactggccgtccaggacccacctgcttccagattttaggattcgatattctgttgatgaaaaacctcaagcctattcttctcgaggttaatgctaatccctccatgcggattgagcatgagcacgaattgtcgccaggcgtgtttgagaacgtgcctagtttggtcgatgaggaggtgaaggtagcagtgatcagggacacactgcggctaatggacccactgaaaaaaaagcgcgagaaccagagccagcagctcgaaaagcctttcgcaggaaaggaggatgctctggatggagagctgacaagcgcacctgattgcaacgctaaccccgaagcacatttgccaagcatctgcctcaagcaggtcttcccgaagtacgctaagcagttcaactatctgcgtttggtggatcgaatggccaatctctttatacggttcttgggcattaaaggaaccatgaaactaggccccactggcttcaggacattcatacggagttgtaaactgagttcttctagcctgtctatggctgcagttgatatcctgtacattgatatcaccaggagatggaactccatgacactggatcagagagactccggcatgtgcctccaggccttcgtggaggcatttttcttcttggcccagcgcaagtttaagatgttgccattacacgagcaggtggcatccctgatcgacttatgcgaatatcacctgtcacttctagatgaaaaacgcttggtgtgtggccggggcgtcccctctggaggccggccaccccaccgcggtcctcctcaggaaccatctccttctgcgcaacctgccggcgacaacccaccaccaagaacctcctgtgcaaataaactgagccaccccagacatactctgtcatag

SEQ ID NO: 14472 - DNA, 981 bp, Artificial Sequence
  Description of Artificial Sequence: Synthetic coding sequence
atgagggagtgtatctctatccatgtcgggcaggcaggcgtacagatcggcaacgcatgttgggagctctactgtcttgaacacggcatccagccggacggacagatgccatcggacaaaactatcggaggtggcgacgacagctttaatacatttttcagcgagacgggcgcaggcaagcatgtccctcgcgcggtttttgtcgacctcgaaccaacggtgatagacgaggtgcgcacaggtacctacaggcagctattccatccagagcaacttatcactggaaaagaggacgctgccaacaactatgccagaggccattacaccatcggcaaggagattattgacctggttctagatcggatccggaaattaaaaagttttttcgcaacgaagccccgcatccattttccattggccacttacgctcctgtgatctccgcagagaaggcctaccatgaacagctgacagtcgctgaaatcaccaatgcatgcttcgagcctgctaaccaaatggtgaagtgtgatccgagacacggaaagtacatggcttgctgcctgctgtacaggggggatgtggttcccaaggacgtgaacgcagcaattgctaccatcaaaacgaaacgaacaattcaattcgtggactggtgccctaccgggtttaaagtcggtattaattaccagccaccaactgtggtgccaggaggtgaccttgctaaggtccagagggcagtttgcatgttgagcaatactacagccgtcgcagaagcttgggcccgacttgatcataagttcgacttgatgcccctgagaagaatcatgaggcgactggaacagatcgtactcaccgagagaatgcgggtgaagagcataaatttgtgcgccgtcctactgcacagcttcgtgcttgagctctcttatttttgtagcgtcaacgtatactgcagaaaactgctgataaagctgaaatttccattctag

SEQ ID NO: 14473 - DNA, 1005 bp, Artificial Sequence
  Description of Artificial Sequence: Synthetic coding sequence
atggttggacgggaaaaggagctgtccatccacttcgtgcccggcagctgcagactcgtggaggaggaggttaatatccctaaccgcagggtgcttgtcactggagccacggggctcttaggccgggccgtccataaggaatttcaacagaacaactggcatgccgttggctgcggtttccgcagagcccggcctaagtttgaacaggtcaaccttctggattcaaatgcggtgcaccacataatacacgacttccagccccacgtgatcgtgcactgcgccgcagagagacggcccgacgtcgttgagaatcaaccagacgctgcaagccagcttaacgtggatgctagtgggaatctcgccaaggaagcagctgccgttggcgcgtttttgatttacatctcttctgactacgttttcgatgggaccaacccaccatatcgcgaagaagatatccccgcacctctgaacctctatgggaagacaaagctagatggcgaaaaagcagtacttgaaaacaatctgggcgccgctgtactcaggatccccattctctacggtgaggtggaaaaactggaggagagcgccgtaacagtgatgtttgataaagtacagttctcgaacaaaagtgctaacatggatcattggcaacagcgatttccgacacacgtgaaggatgtggcgacagtctgcagacagctcgctgaaaaacgcatgctggatccctctattaaggggacttttcactggtctggaaatgaacagatgacaaagtacgaaatggcttgtgctattgctgacgcgtttaacctgccctcttcccatttgcgtccaattaccgatagtccagtgctaggcgcacaacgtccgcgaaacgctcagcttgactgctccaaactcgaaacattggggattggccagaggaccccatttaggatcggaatcaaggagagcttgtggcctttcctgatagacaagcggtggaggcagaccgtcttccactag

SEQ ID NO: 14474 - DNA, 513 bp, Artificial Sequence
  Description of Artificial Sequence: Synthetic coding sequence
atggcttctgaggctgagaagacattccatcgctttgccgcattcggggaatcctcgagctcagggaccgagatgaacaacaaaaacttcagtaagctatgtaaggattgcggcataatggatggcaagaccgtgacttcaacagacgtagacatcgtgttctccaaggtcaaggcaaagaatgcacgcactatcacatttcaacaattcaaagaagctgtgaaagaacttggccagaaacgctttaaaggcaagtctccagacgaagtcctggagaatatatatggtcttatggaaggaaaggatcctgccaccacgggggcaacaaaggcgacaactgtgggcgccgtggaccgactgactgacacaagcaagtatactggaactcacaaagaacgctttgatgaatccggtaaaggcaaaggaatagccggtcgcgaagagatgaccgataatactggctacgtgtccggttacaaaggaagcgggacttacgataagaaaacaaagtag

SEQ ID NO: 14475 - DNA, 3582 bp, Artificial Sequence
  Description of Artificial Sequence: Synthetic coding sequence
atgtggagagtcaagaaactgtctctttccctcagcccctccccacaaaccggaaaaccctcgatgcggactcccctgcgggagctcacgctccagccgggagccttgactaattcggggaaacgcagtcccgcctgcagctctctgacaccttctctgtgtaaacttgggttacaggagggtagcaataacagctcgcccgtggacttcgtgaacaataaacggactgacctgagcagtgagcactttagccacagttcgaaatggctggaaacctgccagcatgaatccgatgaacagcccctggatcccattcctcaaatttcttcaacccctaagacatccgaggaagccgtggacccacttgggaactatatggtgaaaaccatcgttctggtaccaagccctttgggacagcaacaggacatgattttcgaggcccgtttggacaccatggcagagaccaacagcattagcctgaatggccctctccgaacagacgatctggtccgagaggaagtggccccctgtatgggggaccgatttagtgaggttgcagccgtaagtgagaagcccatatttcaggagtcccccagtcatctgttagaagaatctccccccaacccgtgctctgaacagctgcattgtagtaaagagagtttatcatcgcggacggaagcagtccgggaagacctcgtaccctcagaatctaacgccttcctgccaagttcagtgctctggctcagtccatcaacggccttagcagccgacttcagggttaatcacgttgatccagaagaggagatcgtggagcacggcgcaatggaagagcgggaaatgcgctttccaacccacccaaaagagtccgagactgaggaccaagctttggtgagttctgttgaagacatactgtcaacatgtctcacacccaacctggtggagatggagtctcaagaggcccccggccctgctgttgaagatgtaggccggattctgggaagcgacaccgaatcctggatgagtcctttggcatggctcgagaaaggggtgaacaccagcgtgatgcttgagaatctgaggcaatccctctccctgcccagcatgctaagggacgctgcaatcggcacaactcctttctcgacgtgcagcgtcgggacttggtttaccccaagtgccccccaggagaaatccaccaacacctcacagactggattggtgggtaccaagcacagcaccagcgagacggagcaactgctgtgtggcaggccaccagaccttactgctctttcacggcatgacctggaggataatctgctcagctccttagtgatcctggaagtcctgagccggcagctgcgcgactggaagagtcagctggccgtcccccacccagagacccaggattcttcaacccaaacagacacaagccacagtgggattaccaacaagctgcagcacctgaaggagtcccacgagatggggcaggcactgcagcaggctcgaaacgtgatgcagtcatgggtgttaatttctaaggagctgatctctcttttacatttaagtctgctccatttggaggaagacaagacaacagtaagtcaggagtcacgacgcgccgagacactagtgtgctgctgcttcgacctcctaaagaagctgagagcaaagctgcagagtctgaaggctgaacgcgaagaggctcgccacagagaagagatggcgctgcgcggtaaggatgctgcagagatagtgcttgaagctttttgcgcacatgcctcacagcggatttcccagcttgaacaggacctggcatccatgcgcgagttcagaggcctgctgaaagatgcccagacccaactggtgggtctccatgccaaacaggaagaactcgtgcagcaaacagtgagcctcacctcaactctgcagcaggactggcggagcatgcagctggactacactacgtggacggcgctgctctcccggagccggcagctgactgaaaagctaaccgtgaagtcccagcaggccttgcaggagagagacgtggccatcgaggagaaacaggaggtaagccgcgtgctggaacaagtgtcagcacagctggaagagtgtaaggggcagacggagcagctcgagctggaaaattcccggcttgctacagacctcagggcccaattgcagatactcgcaaacatggatagtcagctaaaggagttgcagtcccagcatactcattgtgcgcaggacctggccatgaaggacgaattgttgtgtcagctgactcaatccaacgaggagcaggcagcccagtggcagaaggaagagatggctctcaaacacatgcaggcagaactgcagcagcagcaggctgttcttgccaaagaggtcagggacctcaaagagaccttggagttcgccgatcaggagaaccaagtcgcccatctcgagttggggcaagttgagtgccagctcaagacaactctggaggtgcttcgagaaaggagcctgcagtgcgagaacctaaaagacacagttgaaaacttaactgccaagctcgcctctacaattgctgacaaccaggagcaggacctcgagaagactaggcaatactctcagaagcttggccttctcaccgagcaactgcagagcttaaccctctttttgcagacaaaactgaaggagaaaacagagcaggagaccctgctactatctacggcgtgcccaccgacacaggaacacccattgcccaatgatcggacattcctgggctcaatcctgactgctgtggccgacgaggagccagaatctacccccgtaccactgcttggctccgataagtcagctttcacgcgggtcgcgagcatggtctcccttcagcctgccgagacgcccggaatggaagagagcctggcagaaatgagtattatgacaacagagctgcaaagtctctgcagcctactacaggaaagcaaggaggaggctattagaacgctccagcgtaagatttgcgagttgcaggctagacttcaagcccaggaagagcaacaccaggaagtgcagaaggctaaggaggccgatatcgaaaagttgaatcaggcattatgcttgcgctataaaaatgaaaaggaattacaagaggttattcaacagcagaatgagaagatcctcgaacaaattgataagagtggggagctgatctctctacgggaagaagtcacacacctaacacgctccctccgccgggccgaaacggagactaaagtgctccaagaggctttggctgggcagttggactcgaattgccaacccatggctaccaactggatccaagagaaggtgtggctttcccaggaagtggacaagctcagagttatgttccttgaaatgaagaatgagaaggagaagcttatgattaaatttcagtctcatcgaaatatacttgaggagaatctgagacggtctgacaaggagctggagaagctggacgacattgttcaacacatctacaagacgctgctttctatccctgaagtggtgaggggatgcaaggaactccagggactgcttgaatttctctcttag

SEQ ID NO: 14476 - DNA, 9141 bp, Artificial Sequence
  Description of Artificial Sequence: Synthetic coding sequence
atgcgcggcagaagaggtaggccacccaagcagcccgccgcaccagcagcggagcgatgtgcacctgccccgcctcccccccccccaccccctacttccgggccgattgggggcttacgttctcgacatagaggaagctctcgtggaaggtgggctgctgctcaggctgaagtcgcacctaaaacacgcctgtcctcccctcgcggggggtcaagcagccggaggaaaccccctccccctcctcctgcaccccccagtacttctgccccaggacgcggcggtcggggcgggggaggaggacgcactggtggcggtgggggcgggggccatttggcccgcacaaccgctgctcggcgggctgtgaacaaagtcgtatacgacgaccatgagtccgaggaggaagaggaggaggaagacatggttagcgaggaagaggaggaggaagacggcgacgccgaggaaacccaggattctgaagatgacgaggaggacgagatggaagaggacgatgacgattctgactaccccgaagagatggaagatgatgacgacgacgccagttactgcaccgaatcatcatttcgttcacatagcacctattcttcaacccccggccgaagaaaaccaagggtgcacaggcctagatcccccattctggaagagaaagatattcctccattggaattccccaagtcctctgaggacttgatggtacccaatgagcacatcatgaatgtaatcgctatctacgaggtcctgagaaactttggtacagtgctcagactgagccccttccgcttcgaggacttctgtgctgccctcgtgtcccaggaacagtgcacattaatggctgaaatgcatgtagtgctcctgaaagcagtcctccgcgaagaagatacctcaaatacgacattcggccccgcagatctcaaggattctgttaatagcactctctattttatcgacggtatgacctggcccgaagtgttacgcgtgtattgcgagagcgataaggaatatcaccatgtgctcccctaccaggaggctgaggactatccctatggccctgtggagaataagatcaaggtgttgcagttcttggtcgaccagttcttgaccaccaacattgccagagaggaactgatgtccgaaggagtgattcagtacgatgaccactgtcgagtatgtcataaactgggtgaccttctgtgctgcgaaacatgctccgccgtttaccacctggaatgcgtcaagccccccttggaagaggttccggaagacgaatggcagtgcgaagtctgcgtcgcccacaaagtgcccggtgtaactgactgcgtcgctgagattcaaaagaacaagccctacatccgacacgagcccataggatacgaccgatccagacgcaagtattggtttctaaatagaagacttattatcgaagaagataccgagaacgagaatgagaaaaagatctggtactattccactaaggtgcagctagctgaactcattgattgcctcgacaaagactattgggaggccgagctctgtaaaatactggaagaaatgcgcgaggagatacaccgccacatggacataactgaagacttgaccaataaggccagaggttcaaacaagagctttctggccgccgcaaacgaagaaatcctggagagtatacgtgcgaagaaaggcgacatcgataacgtcaagagccccgaggaaacagaaaaagataaaaacgagacagagaatgactctaaagatgcagagaagaatagagaggagttcgaagaccagtccctggagaaagactccgacgataagactcctgatgatgatccagaacaaggtaagtctgaagaacccaccgaggtaggagacaaagggaacagtgtctccgcaaacctgggggacaacacaacaaatgctacatccgaggagaccagtcctagcgagggcagatcacccgtcgggtgtctgtcagaaaccccggattcttcaaacatggccgaaaagaaggtggcatcagaactgcctcaggatgtgcccgaagagccaaacaagacgtgcgaatccagtaatacgtcggctaccacgaccagtatccagccaaaccttgagaacagtaatagtagttcggaattgaatagctcacaatccgaaagcgccaaagcagctgatgatcctgaaaacggcgagcgcgagtctcacacgccagtgtctattcaggaggaaatagtaggagattttaagtcggagaaatcaaatggcgaactgagcgaatcaccaggggcaggcaagggagctagcggcagcacccgtattatcacacgactgcggaaccctgacagcaagctgtctcagttgaagagccaacaagtggccgctgcggctcacgaagctaacaaactgttcaaggagggtaaggaggtcctagtggtgaactcacagggagagattagccggctctcaaccaagaaggaagttattatgaagggcaacatcaacaactacttcaaactcggacaggaagggaagtatcgggtctatcataatcaatacagcacgaattcctttgctctgaacaagcaccagcatagagaagatcatgataaacgacgccatctggcgcataagttctgtctgactcccgcaggggagttcaaatggaacgggtcggtacatggtagtaaggtgctgacaatttctacactccgccttactattactcagctggagaataacatccccagttcctttcttcatcccaattgggctagccaccgggctaactggattaaggccgtccagatgtgcagtaagccccgtgaatttgcactagcactggccatcctggaatgcgccgtgaaaccagttgtgatgctgccgatctggagagagagcctcgggcacaccagactgcataggatgacttcaatcgaaagagaagaaaaagagaaggttaaaaagaaagagaaaaaacaggaggaggaagaaaccatgcagcaggctacctgggtgaagtatacattccctgttaaacaccaggtctggaaacaaaaaggcgaagagtatcgcgtaaccggctacggcggatggtcctggatttccaaaacacacgtgtataggtttgtcccaaaactgcccgggaacacaaacgtcaactatcggaaatctcttgaaggtaccaagaacaatatggatgagaacatggatgagtctgataagaggaagtgctcgcgtagcccgaagaagattaaaatcgaaccagactcggagaaggatgaggttaagggctctgacgcagcaaaaggggcagaccagaacgaaatggatatctccaagatcactgagaaaaaggaccaggacgttaaggagctcttggattcagacagcgacaagccatgcaaggaggaaccaatggaggttgatgacgacatgaagacagaaagtcacgtaaattgccaggagtcttcacaggtagatgtggtgaatgtctctgaggggtttcacctgcggacatcttataagaaaaagaccaagagctctaaattagatggcctgttggagcgccggattaaacaattcacattagaggagaaacagagactggagaaaattaagcttgagggagggataaaggggatcggcaaaacttctacgaattcctcaaagaatctatctgagtccccagtcattaccaaggctaaagaaggctgccagtcggacagcatgcggcaggaacagagtcccaacgccaacaacgatcaacctgaggacctgattcagggctgttcagaaagtgacagttccgtcctgaggatgtctgacccaagccataccacaaacaaactctatcccaaggatcgcgtgttggacgacgtcagcataaggtctccagaaacaaagtgtccgaagcagaattcaattgagaatgatatagaagaaaaagtatcagacctcgcctcacgggggcaggagccctcgaagagcaagacaaaaggaaatgatttttttattgatgatagcaagttggcctctgccgatgacatcgggacccttatatgcaaaaataagaagcccctgatccaggaggaatccgacactattgtcagctcttctaagagcgctctgcactcctctgtgcccaaatccacaaacgaccgtgacgcaactcccctgagtcgtgcaatggattttgagggcaagctgggctgcgatagcgagtccaattctactctcgagaactcttcagatactgtgtctatccaagactcgtctgaagaagacatgatagttcagaattccaacgaatcaatcagtgagcagttcaggaccagggagcaggacgtcgaggtgttagaaccgttgaaatgcgagctggtgtctggtgaaagtacaggtaattgcgaggaccgtcttcctgtgaagggcacggaagctaacggcaaaaagcctagtcaacagaagaagctggaagagcggcctgtgaacaagtgcagtgaccaaattaagctgaagaacacgaccgataagaaaaataatgaaaacagggaatccgaaaagaagggacagcgcacctctaccttccaaattaatggaaaggataacaagccgaagatatacctcaagggcgaatgcctcaaagagatctccgagagtcgggttgtctcagggaatgtagaacctaaggtgaacaacatcaacaagattattcccgagaacgacatcaaatccctaacagttaaagagagcgctattcgacccttcatcaatggcgacgtgatcatggaagatttcaatgagcggaactcctccgagaccaagagccacctgctctcgtcatccgacgccgagggaaattaccgtgacagtctcgagacactcccgagtaccaaggagagcgactccacccagacaacaacaccctccgccagttgtccagaatcaaatagtgtaaaccaggtggaggacatggagatagagaccagtgaggtaaaaaaggttacctcttcccccatcacctcagaggaggaaagcaatctgagcaacgactttatagacgaaaatggcttgccaataaacaaaaacgagaacgttaatggcgagtctaaacgtaagactgtaataacagaagtgactactatgacctcaaccgtcgccactgaaagcaaaacagttataaaagtggaaaagggagacaaacagaccgtagtgagctcaaccgagaactgcgcaaagtccaccgtgaccaccaccacaaccacagtgaccaagttgtctacaccaagcaccggtggatccgtggatataatctctgttaaagagcagagtaaaaccgtggttacaaccacagtgactgattccctgaccaccactggagggacgctcgtgactagtatgacggtgtccaaagaatactctacccgggacaaagttaaattaatgaaattctctagacccaaaaagacccgatcagggactgccctccccagttatcgcaagttcgttactaagagctctaagaaatctattttcgtcctacccaacgatgacctgaagaagctcgcccgcaaaggcggcatcagggaggtcccatactttaattataatgccaagccggcgctagacatctggccatacccgtccccgagacctacattcggaataacttggcgttatcgcttacagaccgttaaatccctggctggggttagtcttatgcttcgcttgctttgggcctccctccggtgggacgatatggcagccaaagccccaccagggggtggcaccaccaggacagagacttccgagaccgagattacaactaccgagatcattaaacgcagggacgtgggcccatacggcatacggtcagagtactgcattaggaaaataatctgtccaataggcgttcctgaaacccccaaggaaacgccaaccccacaaaggaagggccttcgttcctccgccttgcggcctaaacgaccagaaacaccaaagcagactggccctgtgataatcgagacttgggtcgctgaggaagagctcgagctgtgggaaatacgtgcctttgcagaacgggttgaaaaggaaaaagcccaagccgtggaacaacaggccaagaaacgcctggagcagcagaagccgaccgtaatcgccacatccaccactagtcccaccagcagcaccacgagcactatttcccccgcccagaaggtgatggtggcgcccatcagcgggtcagtcacaacgggcaccaagatggttctgactaccaaagtgggcagtcccgcaactgtgacctttcagcagaacaaaaatttccaccagacgtttgctacttgggtgaaacaggggcagtcgaattccggcgtggttcaagtgcagcagaaagtgttgggtataatcccctctagtactggtacgagccagcagacattcacctctttccagcctcgcacagccaccgttaccatacgtcccaatacctcgggcagcggaggaactacaagcaacagtcaggtcatcactggccctcagataagacccggaatgactgtgatcaggaccccgctccaacagtccactctgggcaaggctataatccggacccccgttatggtgcagccgggcgctccacagcaggttatgacgcagatcatacgcggtcagcctgtgtccactgcggtttcagctccaaacaccgtcagctccaccccaggccaaaagtcattaacctccgctacgtcgacttctaatattcagtcctcagcatcccagccacctcgcccacagcagggccaggtgaagttgaccatggcccagctcactcagttgacacaggggcatggaggcaatcagggactcacggttgtcatccaggggcaggggcagactacagggcaattgcaattgatcccccagggcgtaaccgtgctgcctggacccgggcagcagctcatgcaagctgctatgcctaacggcaccgtgcagagattcttgtttacacccctggctacaacagcaaccacggctagcacaacaaccacgactgtatccacaacggctgccggaaccggcgagcaacgccagtccaagttgagcccacagatgcaggtacatcaagacaagacactcccaccagcccagagttccagtgtggggccggccgaggcacagccccagactgcccagcccagtgcccagcctcagccgcagacccaaccgcagagccctgcacagcccgaggtacaaactcaacctgaggtgcagactcagaccaccgtgtccagccacgtcccctcagaggcgcagccaacacacgcccagagctctaaaccacaagtggcggcacagtcacagccacagtccaacgttcagggccagtccccagtcagggtgcagagcccttctcagactagaatcaggccaagtaccccaagccagctgagtcccggacagcagtctcaggtgcaaaccaccacaagtcagccaatccccatccaacctcacacaagccttcaaattcccagccagggtcaacctcagagccagccccaggtccagtctagtactcagaccctgagcagcggccagaccctcaaccaggtgacagtgagcagcccctcaagaccacaactgcagatccaacaaccacaaccacaggtgattgcagtcccgcagctacaacagcaggtgcaagttctctcacaaatccagagccaagtagtggcccaaatccaggcccaacagtccggggtcccacagcagattaaattgcaactgcctatccagatccagcaaagttctgcagtccagacgcatcaaatccagaacgtagtcactgttcaggccgcttcagtgcaggagcagcttcagcgggttcagcagttgcgcgatcaacagcagaagaagaagcaacagcagattgaaataaagcgcgagcacaccctgcaggctagcaatcaaagcgagatcattcaaaagcaagtcgtgatgaagcacaacgctgttattgagcatctgaaacagaagaaatctatgacgcccgctgaaagagaggaaaaccagcggatgatcgtttgtaatcaagtcatgaagtatatattagataagattgacaaagaggaaaaacaggcagctaaaaaacgcaaaagggaagaaagtgtggaacaaaaacggtctaaacaaaacgccaccaagcttagcgcactgctgttcaagcacaaagagcaactcagagctgagattctgaagaagcgcgcgttgctggataaggaccttcaaattgaggttcaggaggaactaaagagagatttaaagattaagaaagagaaggacctgatgcaactggcacaagctactgccgtggccgccccctgtcctccagtaacacctgcgccacccgcccctcctgcacctcctccctccccccctccgcccccggctgtgcagcatactggactgctgagtacaccaactctgcctgccgccagtcaaaaacggaagagggaggaagaaaaggatagcagcagcaaatcaaagaagaagaagatgatctctaccaccagcaaagagacaaaaaaagataccaagctttattgtatctgtaaaactccatacgacgagagtaagttttatattggatgcgatcggtgccagaactggtaccatggccggtgcgtggggattctgcagagcgaggcggaactaattgacgagtatgtctgcccccagtgccagagcaccgaggacgcaatgaccgtcctcacgcccttgaccgaaaaagactacgagggtctaaaacgggtgcttaggtcactacaggcgcataaaatggcctggccttttttggaaccagtcgacccaaatgatgcacctgactattatggcgtcattaaagagcccatggacctggccactatggaggagagggttcagcgccgatattacgagaagttaacggagttcgttgcggacatgaccaagattttcgacaattgtagatactacaatccaagtgattcccctttctaccaatgtgcagaggtgttagaatcattctttgtgcagaagctgaaaggatttaaggcctcccgatctcataataataagctgcaatcaaccgcgagctag

SEQ ID NO: 14477 - DNA, 927 bp, Artificial Sequence
  Description of Artificial Sequence: Synthetic coding sequence
atggcttctagcaacaccgttttaatgcgcttagtggccagcgcatactctatagctcagaaggcaggcatgattgtgaggagggtaattgccgagggggatttgggcatcgttgagaaaacatgtgcaacggacctacagacgaaggcggaccggctggctcagatgtcaatctgtagctctctcgcgaggaaatttcccaagctgaccatcatcggcgaggaagacctgccctcggaggaggtcgatcaagagttgatcgaggatagccaatgggaggaaatcctgaaacagccgtgtccatcacagtatagcgcaatcaaagaggaggaccttgtggtgtgggtggaccctcttgacgggactaaagagtatacagaaggcctgctggacaacgtcactgtccttatcgggattgcctacgagggaaaagccattgccggcgttattaatcaaccgtactataactatgaggcagggcccgacgccgtattaggccgaacgatttggggtgtacttggcctaggcgccttcggcttccagttgaaggaggttcctgccggtaagcacattatcaccacaaccagaagccattccaataagctggttacagactgcgtggccgcaatgaatcccgatgccgttctcagggtggggggggcgggaaacaaaattatccagttaatcgaggggaaagccagcgcttatgtgtttgcctctccaggttgcaaaaagtgggacacatgtgcacctgaggtgattctccacgctgtcggagggaagttgacagacatacatggcaacgtcctgcagtaccacaaagacgtgaagcacatgaattccgccggcgtcttggccacattaaggaattacgattactatgccagccgagtgcccgaatccataaagaatgcgctggtaccctag

SEQ ID NO: 14478 - DNA, 1212 bp, Artificial Sequence
  Description of Artificial Sequence: Synthetic coding sequence
atgagtggctctgatgggggacttgaagaggagcctgaactgagtatcaccctgacactccgcatgctgatgcacggtaaagaagtgggctccataatcggtaaaaaaggggagactgtgaaacggattcgggagcagagctcagctaggatcaccattagcgagggctcttgtcctgaacggatcacgaccattaccggatctacagccgccgtgttccatgccgtgagcatgattgcgttcaaactggatgaggacctgtgcgccgcaccggcgaacggcgggaatgtatccaggccgcctgtgaccctgaggctcgtcattcctgctagccagtgcggcagcctcatcgggaaagcgggaactaaaattaaagagatccgtgaaaccacgggagcgcaagtgcaagttgccggagacctcttgcctaactccactgaacgagcagtgaccgtttccggggttcctgacgcaatcatcctctgcgtgcgtcagatctgtgcggttatactggagagcccacccaaaggagctacaattccctatcatcctagcctctctctcgggactgttctgctcagtgcaaaccaagggtttagtgtgcaaggccagtacggagccgttacacctgctgaagtcaccaagctacagcaactgtccagtcacgcagtcccctttgctacaccttctgtcgtgccaggtctcgaccccgggacgcagacgagctctcaagagttcctggtgccgaatgatctgataggttgtgttatcggtcggcaggggtctaaaattagtgaaatcagacagatgagcggagctcacatcaaaattgggaaccaggcggagggcgccggtgaaaggcacgtcacaatcaccggctctcctgtttccatcgcgttagcacagtacctgattactgcctgtctggagactgctaaaagtacgagcggagggacacccagctccgctcctgccgatctccccgccccgttttcacctcctctcaccgcactgccaactgctccacccggactgctgggaaccccttatgcaatctctcttagtaacttcatcggtctaaaacctatgcctttcctagccctcccccccgcgtcccctggaccgccacccggtctggcagcttatacagcaaaaatggctgctgccaatggcagtaagaaagccgaaaggcagaagttcagtccctactag

SEQ ID NO: 14479 - DNA, 654 bp, Artificial Sequence
  Description of Artificial Sequence: Synthetic coding sequence
atgtcaagtaaggtgtcacgcgacaccctctatgaggccgtgcgagaggtgttacatggtaatcagcgtaaacgccgcaaattcctggagacagtcgaactgcaaatcagcctgaagaattacgatccgcaaaaggacaagcgattctcaggcacagttcggcttaaaagtacccctaggcccaagttttctgtctgtgttctcggggatcaacaacactgtgacgaagcaaaggccgttgacattccccacatggacattgaagctctcaagaaacttaataagaacaagaagctggtgaaaaagctcgcgaagaaatatgacgcttttctggcatctgaaagcctgatcaaacagattcccaggattctggggcctggattaaacaaagctggcaagttcccctcactgttaactcacaatgagaacatggttgccaaagtggacgaggtcaagagcacgattaagtttcagatgaaaaaagtattgtgtttagcagtcgccgtgggacacgtcaagatgacagatgatgagctcgtgtataatatccacctagctgtgaatttcttagttagccttctgaagaagaactggcagaatgtacgagctctctacattaaaagtacaatgggaaagcctcaacgtctgtattag

SEQ ID NO: 14480 - DNA, 3159 bp, Artificial Sequence
  Description of Artificial Sequence: Synthetic coding sequence
atggaagggtcagagcccgttgccgcgcaccagggcgaagaggctagttgttcatcctggggcacaggttctacaaacaagaatctacccatcatgtctactgcaagcgtcgaaatcgacgatgcactatactccaggcaacgttacgtgctgggagacactgctatgcaaaaaatggccaaatcacacgtttttctgtcagggatgggcggcctgggcttggaaatcgccaaaaacctcgtgctggctggtattaaagcggtgacgatccacgacacagagaagtgccaggcttgggatttaggtaccaactttttcctgtctgaggacgacgttgtgaataaacgcaacagggccgaggccgtgcttaagcatattgcagaactcaacccatacgtccacgtgacaagttcaagtgtgcccttcaatgaaacgacggatttgtcctttctggacaagtatcaatgcgtggtgctgactgagatgaaattacccttgcagaaaaaaattaacgatttctgtcggagccagtgtccccccattaaattcatctccgccgacgttcacggcatttggagtagattgttctgtgatttcggggatgaattcgaagtactggataccacaggagaagaacccaaagaaatctttatctccaatattacccaagccaaccccggcatcgtcacatgcctggaaaaccaccctcacaaacttgagacggggcagtttctgacattcagggagataaacgggatgactggcttgaacggcagcattcaacagatcacggtgatatccccattctctttcagcataggtgatacaaccgagcttgagccctacctgcatggcgggatagcggttcaagtcaagacgccaaaaactgtcttcttcgagtccctggagaggcagcttaagcaccccaagtgtttaatcgtggatttttctaaccctgaggctccgctggagatccatactgccatgctggccctggaccagttccaggagaaatatagccggaagccaaatgtcggctgccaacaggactcagaggagctcttgaaactggccacttccataagtgagactctcgaggagaagccagatgttaacgcggatatcgtccactggctcagctggacagcgcagggtttcctgtcacctttagctgccgccgtcgggggggttgcatcccaggaggtactgaaggcagttaccggcaaattttcccccctctgccaatggctctatctggaagctgccgatatcgttgaaagtctgggaaagcctgagtgcgaggagtttcttccccggggggatcgctacgatgctcttcgagcctgtataggagatactttgtgccagaagttacagaatcttaatatctttctagtagggtgtggcgctattggctgtgagatgctcaagaatttcgccctcctgggagtaggtacctccaaagagaagggtatgatcaccgtgaccgatccagatcttatcgaaaagagtaatcttaatcgacaatttcttttccgtccccaccatatccagaagcccaagtcgtatacggctgctgatgccacccttaagattaattcgcaaataaagattgacgcccatctaaataaagtttgtccgactacagaaacaatctacaacgacgaattctacacgaaacaggacgttataattaccgctctagataacgtggaggctcggaggtacgttgattctcgctgcctcgctaacttgcgccctctgttggattcaggcacaatgggtaccaagggccacacagaggtgatagtccctcatctaactgagtcttataattctcatagggacccaccagaagaggagatccctttttgtaccttgaagtcatttccagccgctatagagcataccattcagtgggctcgagacaagtttgagagttcattcagtcacaaaccttccttatttaataagttctggcagacctattcgtccgctgaggaggtgttgcagaagatacagagcggccactcattagaaggctgtttccaagtgatcaaactgctgagccgccggccgaggaattggagccaatgcgttgagcttgcgagattgaagttcgaaaaatatttcaaccataaagcgctgcagttactgcactgttttcccctggacattaggcttaaggatggtagcttgttctggcaaagtcctaaacggccccccagccccattaagttcgacttgaacgagcctctccacctgtcttttctgcagaatgccgcgaagctgtatgccacagtttactgcatcccattcgcagaagaagatctctctgccgacgctctccttaacatcctctcagaggtcaagatacaagaattcaagcccagcaataaagttgttcaaactgacgaaaccgcccgcaagccggaccatgttccgatctcctctgaggatgagcggaacgctatcttccaactcgaaaaggccatcctctccaatgaggcaactaagtcggatctacaaatggccgtgctcagctttgaaaaggacgatgaccataacggacacatcgattttatcacagccgccagcaacctccgcgccaaaatgtactcaatagagcccgccgatcgattcaagactaaaaggatagctggcaagattatccccgcaatcgccacaactaccgctacagtctctggactggtagcacttgaaatgatcaaggtgactggcgggtatccattcgaggcctataagaattgcttcctcaacttggccatccctatcgtagtgttcaccgagactacagaggtcagaaagaccaagatccgcaacggcatctcattcaccatttgggaccggtggacggtgcacgggaaggaggactttaccctgttagactttatcaacgcggtcaaggaaaagtacggaatcgaacccaccatggtggtgcagggtgtcaaaatgttatatgtacctgtcatgcccggccatgctaagaggttgaagctgacaatgcataaactcgtgaagcctacaacggaaaagaagtacgtagaccttaccgtgtctttcgccccggatattgatggcgacgaagacctgcccggtccaccagttcgttactatttctctcacgacacagattag

SEQ ID NO: 14481 - DNA, 1134 bp, Artificial Sequence
  Description of Artificial Sequence: Synthetic coding sequence
atgttaaggctagtgccaaccggagctcgagcgatcgtggatatgtcatacgcaagacattttttggatttccagggatctgcaattcctcaggccatgcagaagctggttgtcacccgcttgagcccaaactttcgcgaggccgtgacgttaagccgagactgcccggtgccactccccggagacggcgatctcctggttcgaaataggttcgtgggtgtaaatgcatccgacatcaactattcagctggcagatatgacccatctgtcaagcccccttttgatatcggttttgaaggaatcggcgaagttgtcgccctgggattatctgcttctgcccggtacactgtagggcaggctgttgcctatatggctccaggctcatttgcggagtataccgtcgtgcccgcctcaatagccaccccagtgcccagcgtcaagccagaatacctgactcttctcgtgtccggtacaacagcctacatcagccttaaggaactgggcgggctcagcgaagggaagaaggttttggtgacggcagctgctggcggcacagggcagttcgctatgcagctcagtaaaaaagcaaaatgtcatgtgattgggacttgctcctccgatgaaaaaagcgcgtttctaaagtctctcgggtgtgacagacctatcaactataagaccgaacctgtgggcacagttctcaagcaggaataccccgagggtgtggatgtggtgtatgagtctgttggtggtgccatgttcgacttggcagtagacgcgctggccaccaaaggtcggctcatcgttatcggatttatatcaggctatcagacaccaacaggactgtctcccgtcaaggccggaactctgccggccaagctcctgaagaaaagcgcttcagtgcaggggttcttccttaatcattacctgtcaaaatatcaggcggcaatgtcacacctactcgagatgtgtgtgagtggagatctggtgtgcgaagtcgatctgggggacttgtctccagaaggccgtttcactggattagaatctatcttccgagcagtcaactacatgtacatggggaagaacaccgggaagatcgttgtcgaattaccccacagtgtgaattctaagctatag

SEQ ID NO: 14482 - DNA, 2538 bp, Artificial Sequence
  Description of Artificial Sequence: Synthetic coding sequence
atgtccaatagtcgcccccgatcgcgccgggacgccggcggcggtgctggagccgccgggcgggatgagctggtgtccagatctttgcagagcgccgagcactgtctaggcgtgcaggattttgggacggcctacgcccactaccttctggtgctgtctttagctcccgagttgaagcacgacgtcaaagagacatttcagtacacacttttccgctgggccgaagagctggacgcactcagcagaatccaggatcttttgggatgctatgagcaggccttagagttgtttcccgatgatgaggtgatctgcaactcaatgggggagcacctgttccgaatgggttttagggacgaggccgcagggtatttccacaaagctgttaagcttaatcctgatttctctgatgccaaggaaaatttttatcgagtagctaactggctggtcgaaagatggcacttcataatgttgaacgataccaagcgcaatactatctacaatgctgccatccagaaagccgtatgtctggggtccaagtctgtactggatataggagccgggactggaatcttaagtatgttcgccaagaaggccggcgcccactctgtatacgcatgtgagctatctaagacgatgtacgaactggcatgcgatgtagtggccgccaataagatggaggcggggatcaaattgctgcacaccaaaagcctggacatcgaaatccctaaacacatccccgagcgcgtttccttggtggtcaccgaaacggtggatgcaggtctgtttggagagggtattgtcgagtccctaatccacgcctgggagcatctgctgctgcagcctaagacaaagggtgagtccgccaactgcgagaagtacgggaaagtaatccctgcgtcagccgtgattttcggaatggctgtggaatgcgcagagatcagaagacaccaccgcgtgggcattaaggacatagctggcattcatttgcccactaacgtcaagttccagtcccccgcctattcaagtgttgataccgaagaaaccattgaaccgtacacgaccgagaaaatgagtagggtgcctggtggttacctagctctgactgagtgctttgagataatgacagtggattttaataacctgcaagagttgaaatccctcgccaccaagaaaccagacaaaatcggaatccctgtcattaaagaaggaatcttagatgctatcatggtttggtttgtgctgcagctcgatgacgagcattccctttcaacgagccctagtgaggaaacatgctgggaacaggctgtttatcctgttcaggatttagccgattattggatcaaacccggagatcatgtcatgatggaagtcagctgccaggattgctatttaaggatccagtccatctccgtgctcgggctcgagtgtgaaatggatgtcgccaagagttttacccaaaacaaagatttactgagcttgggaaacgaggccgaactttgctccgccctggccaacctccaaacgtctaaacccgacgcagtggagcagacatgtattctagagagcacagagattgctctcctgaataacatcccatatcacgaggggtttaaaatggcaatgtctaaggtactgagtagcctgacccctgagaagctgtaccagacaatggacactcattgccagaacgagatgagctcaggtacaggacagtcaaacactgttcagaatatcttagaaccattttatgtgttggatgtgtcagaaggattctctgtgctccctgtgattgccggaaccctcggccaggtcaagccttatagcagcgtagagaaggatcagcaccggatcgccttagacctcattagcgaagcaaatcatttcccaaaagagactctggaattctggttacgacacgtggaagatgaatccgcaatgcttcagcgtcccaagagtgacaagttgtggtcaattattattttggatgtgatcgaacccagcggccttatccagcaggagatcatggaaaaggccgctatttctagatgcctgcttcagtccggcgggaaaatcttccctcagtacgtattgatgttcgggctcctggtcgagtctcagacgctgctggaggaaaatgccgtccaggggacagaacgaactctcggactgaacatagcccccttcatcaaccagttccaggtacccatcagggtctttcttgatctgagtagcctcccatgcatcccacttagcaagcccgtagagctgctgcggctggatttgatgacaccttacctcaacacctctaacagggaggtcaaggtttacgtgtgcaagagcgggcgattgactgcaattcccttctggtaccacatgtacctcgatgaggaaatacgcctcgacacctcaagtgaagcctcacactggaagcaggccgcagtagtgcttgataaccccattcaggtcgaaatgggggaagaactcgtactttcaattcagcaccacaagtctaatgtatccatcaccgttaagcagtag

SEQ ID NO: 14483 - DNA, 756 bp, Artificial Sequence
  Description of Artificial Sequence: Synthetic coding sequence
atggcggatctgacatctgtgctgacgagcgtgatgttttcacccagttccaagatgtttattggaggattatcctggcagacatcaccagactccctcagggattatttttcgaagtttggtgaaattcgggaatgcatggtcatgcgcgatccaaccaccaaaaggagtcgcggcttcggtttcgtgacgttcgcggatcccgcaagcgtggataaagtgttagggcaacctcaccatgaacttgactccaaaaccattgatccaaaagtcgctttcccccgtagagcccagcctaagatggtcacccgtacaaaaaagatcttcgtcggtggcttaagcgccaatacagtcgtggaggatgtgaaacaatactttgagcaattcggaaaggtggaagatgccatgcttatgtttgacaagacaaccaacaggcatagaggcttcggctttgtcacctttgagaatgaggatgtagtggaaaaagtctgcgaaatccacttccacgagattaacaataagatggttgaatgtaaaaaggctcagcctaaggaagtgatgttcccgcccggaacccggggaagagcccggggattaccatataccatggacgcatttatgctgggtatggggatgttaggatacccaaatttcgtcgcaacgtacggccgggggtatccaggatttgctccttcctacgggtaccagttccccgactatctgcctgtgagtcaggacataatttttataaattag

SEQ ID NO: 14484 - DNA, 510 bp, Artificial Sequence
  Description of Artificial Sequence: Synthetic coding sequence
atggccccaaaacgggctaagcgacggaccgtggaaggtgggagtagctccgtgttttccatgtttgaccagactcagattcaggagtttaaggaagcattcaccgtgatcgaccaaaacagagacggtattattgataaagaagatttaagggatacattcgcagcaatgggaagattgaacgttaaaaacgaagagctcgatgcgatgatgaaagaagcttctggtccaatcaactttaccgtgtttcttacgatgttcggtgagaagttgaaaggagccgatcctgaagacgtgattaccggcgcttttaaggtgctggaccccgagggcaaggggaccattaagaaaaagttccttgaggagctgttgactacacaatgtgatcgatttagccaggaggagatcaaaaacatgtgggccgccttccctcccgacgttgggggcaatgtggactataaaaatatctgttatgtgataacacacggggacgccaaggatcaggagtag

SEQ ID NO: 14485 - DNA, 546 bp, Artificial Sequence
  Description of Artificial Sequence: Synthetic coding sequence
atggctaccgagcctgaagctgctgagcccgtcgtacccagtttggtcgatcgctattttactcgatggtataagcctgatgtgaaaggcaagttttgtgaggatcactgtatccttcaacattctaaccgtatttgcgtgatcactcttgcagagtcacatccggtgctgcagtccggaaaaactatcaaatctatttcttaccagatttctacgaactgtagccggctgcagaacaaggtaagtggcaagtttaagaggggcgcccagtttttaaccgaattagcccctttgtgtaaaatctattgctccgacggtgaagaatacacagtgagcagttgtgttcgaggccgcctcatggaggtcaacgaaaacatcctccacaaaccctccatcttgcaggaaaaaccctccacggagggctatatcgcagtggtgttgcccaagtttgaggagagtaaatctattaccgaggggctccttactcagaagcagtatgaagaggtgatggttaagagaattaacgcgactacagccacatcatag

SEQ ID NO: 14486 - DNA, 2154 bp, Artificial Sequence
  Description of Artificial Sequence: Synthetic coding sequence
atggagctgcggtgtgggggcctacttttttcgagtcggtttgacagtgggaatctcgcccacgtagagaaggtggagagcttgtcttccgacggcgagggggttggcgggggagcatcagcgctgacgtcaggaatcgcgagctcacctgactacgaattcaacgtttggacgaggcccgactgcgccgagactgagttcgagaatggaaaccggtcttggttttactttagtgttcgtggaggaatgcctgggaagttgatcaaaattaacatcatgaacatgaacaaacaaagcaaactctacagtcagggcatggctccattcgtgaggacacttcctacccggccaaggtgggagaggatccgtgatcgccccactttcgaaatgacagagacccaatttgtcttatccttcgtacaccgctttgtcgaggggcgtggggcaacaacctttttcgcattctgctacccctttagctattctgattgccaggagttgttgaaccagttggatcagcgtttcccagaaaaccacccgacccactcttccccgctggacaccatatactatcaccgcgaattactgtgttactccctggatggcctaagagtggacttacttacgattacctcctgtcatggtttgagggaggatcgggagccgaggttggaacagttgttcccggatacgtctacaccaaggcccttcaggttcgcgggcaagcggatctttttcctgagtagccgcgtgcatccgggggaaacgcctagcagtttcgttttcaacggattcttggattttatattgcggccagatgacccacgcgctcagaccctcaggaggctctttgtgttcaaactgatccccatgctgaatccagacggagtggtccgtggacactacagaaccgatagccgtggcgtgaacctcaatcgccaatatctgaagccagatgcggttcttcaccctgccatttacggcgcaaaagccgtgttgttgtaccaccatgtgcattcaaggctaaatagtcagtcttcctctgaacaccagccctcgtcttgcctaccacccgacgcccccgtgagcgatctggaaaaggccaataatctccagaatgaagcccagtgtggccatagtgctgaccgccataacgcagaggcctggaaacaaacggagccagctgagcagaagctgaacagcgtgtggatcatgccacagcagagtgcggggctggaggaatctgcccctgatactataccccccaaggagtccggtgtagcttattacgtagatcttcatggccacgcctcgaaacgaggatgcttcatgtatggtaactctttttccgatgagtccactcaggtcgagaacatgttataccctaagcttattagtctaaatagcgcccacttcgattttcaaggctgtaacttttctgagaagaatatgtatgcccgcgaccggcgggacggccagtccaaggaaggcagtggccgagtggcaatctataaggcatcagggatcatccatagctacacgctggagtgcaactataacacaggccggtccgtgaactccattcccgctgcctgtcacgataacggtcgtgcatctccacctcctcccccagctttcccctccaggtatacagtggagctcttcgaacaggtgggcagagccatggctatagctgcacttgacatggcagaatgtaatccttggcctaggatcgtgctgtccgagcactcttctctgacgaatttgcgtgcctggatgctgaaacacgtgcggaattctagagggttatcctccaccttgaatgttggcgtgaacaagaagcggggcctccgcacaccgcctaagagccataatgggctgcctgtttcctgctctgagaataccctatcaagagccaggagtttctccaccggaactagcgccggtggcagcagctcgtcacagcagaattctccgcagatgaagaattccccttctttcccctttcatgggagcagaccagctggcctgcctgggctgggatcatcgactcagaaagtgactcatcgggtgctcgggccagttagaggtaaacctgtttgggagccgctgcagcacgtcttcggttgcttaggacactgctggggcaagtag

SEQ ID NO: 14487 - DNA, 678 bp, Artificial Sequence
  Description of Artificial Sequence: Synthetic coding sequence
atggtgatggcagaaggcaccgccgtgctgaggagaaatcgccccggcactaaggcgcaggacttctataattggccggatgagtctttcgatgaaatggatagtacactggccgtccagcagtacatccagcagaatatccgggcagactgcagtaacatagataaaattctggagcctccagagggtcaggacgagggagtctggaagtacgagcatctacgccagttctgcctagaactgaatggcctggcagtgaaactgcagtcagagtgccacccggacacgtgtactcagatgactgctaccgaacagtggatatttttgtgtgctgctcataaaacgcccaaggagtgccctgcgattgactatacaagacatacacttgatggagctgcttgccttctcaacagcaacaagtacttcccatcacgtgttagcattaaggagagctctgtggcgaagctggggtcagtttgtagacgcatctacaggattttttcacatgcatacttccatcatcgacagatcttcgatgaatacgagaacgaaaccttcctgtgtcatagattcactaaattcgtgatgaagtacaatctgatgagtaaagacaatctgatcgtccctattctggaagaagaggtgcagaacagcgtgagcggagagagtgaggcctag

SEQ ID NO: 14488 - DNA, 1173 bp, Artificial Sequence
  Description of Artificial Sequence: Synthetic coding sequence
atggccgcccagaaggatttatgggatgcaattgtgatcggtgctggaattcaggggtgtttcaccgcgtaccacctggcgaagcacaggaaaaggatcttgctcctagaacaattctttctcccacattccagggggtcttcccacggtcagagccggatcattcgaaaggcctatctcgaagatttttacacccggatgatgcacgagtgctatcagatttgggcccagctggagcatgaagccgggacccagctgcaccggcagactgggttgctgcttcttggtatgaaagagaatcaggaactgaaaaccatccaagcaaatctgtcccggcaaagagtggagcaccagtgcctctcatccgaagagctgaaacagaggttccccaatattcgactcccacgcggtgaggttggcctgctagacaactctgggggggtgatctacgcatataaggccctcagggctctccaagacgctatccggcagcttggtggaatcgtaagagacggagaaaaggtggtggagatcaatcctgggctcctggtcaccgtcaaaaccacttctcggtcataccaagctaagagcctagtgatcaccgctgggccatggacaaatcagctgcttcgcccactcggcatcgaaatgccactccagaccttacggatcaacgtatgttattggagggagatggtacctggtagctatggtgtgagtcaagcgtttccatgttttctgtggctgggtctgtgcccacaccacatttatggcttgcctacaggggagtaccctggattaatgaaagtttcctaccatcacgggaaccacgctgaccccgaggagagagactgccccacagctcgcacagacataggggatgttcagatcttgtcatctttcgtgagggatcacctgcctgatctgaagccagagcctgccgttatcgagagctgtatgtatacaaatacaccagatgaacaattcatcttagatagacacccgaaatacgataatatcgtgataggggccggcttcagcggccacggattcaagcttgcccctgtggtgggcaaaattctgtatgagctcagtatgaaactgacccccagttacgacctggcacctttccgtatttcacggtttccgtcgctcggcaaagcccatctgtag

SEQ ID NO: 14489 - DNA, 135 bp, Artificial Sequence
  Description of Artificial Sequence: Synthetic coding sequence
atgagcgataagcctgacatggctgagatcgagaagtttgataaaagcaagctaaaaaagaccgagatgcaagagaagaaccctctccccagcaaggagacgattgagcaagagaagcaggctagcgagtcttag

SEQ ID NO: 14490 - DNA, 1323 bp, Artificial Sequence
  Description of Artificial Sequence: Synthetic coding sequence
atgcctatccctcctcctccacctccaccacccggtccacccccccctcctacattccaccaggcaaacacagaacaaccaaaactatcaagggacgagcaacgaggccgcggggccctcctccaggatatttgtaaaggcactaaactgaaaaaagtcactaatataaatgaccgaagcgcacccatcctggagaaacccaagggctcttcaggggggtatggatcgggtggggccgcacttcaaccgaaaggcggcttgtttcagggaggagtgctgaagctgcggccagttggtgctaaggacgggagtgaaaacctcgctggcaagccggccctccagattcctagcagccgcgccgcagctccccgaccaccggtcagcgctgccagcggtcgaccgcaggacgatactgactcttcccgcgccagccttcccgagctgcctcggatgcagcgcccctccctcccggacctgtccagacctaataccacctcgtctacggggatgaaacactccagttccgctcccccaccaccaccaccagggcgaagggccaacgcacctcctacccctcttcccatgcactcctcaaaggcccctgcctataatcgggaaaaacctcttcccccaaccccagggcagcgcttgcaccccggacgtgagggcccaccggcaccaccgccagtgaaaccgcctccttccccagttaatattcgcactggcccctcgggccagagcctcgcgcctccaccgcccccctaccgccaacctcctggagtgcctaacggcccaagctctcctacaaacgaaagtgccccagagctgccgcagcgtcacaattctctgcatcgcaaaaccccaggaccagtacgaggtctggcgccgcctccacctactagcgcgtccccatctttattgagtaatcgcccacctcccccagcgcgcgatcccccatcaagaggagcggcaccaccacccccacccccagtgatacgcaatggcgcacgggatgcaccccccccgccaccaccctatcggatgcatggctccgaaccaccatctcgcgggaagccaccaccaccgccatcgcgaactcctgcagggccaccccctcccccccctccgcccctccggaacggccatagggacagcatcacgacggtgaggtcttttctggacgatttcgaaagtaaatatagttttcatcccgtcgaagattttcccgccccggaggagtataagcattttcagaggatttacccgtctaagactaatcgagccgctaggggtgctccgccattgccgcctatcctgaggtag

SEQ ID NO: 14491 - DNA, 2703 bp, Artificial Sequence
  Description of Artificial Sequence: Synthetic coding sequence
atgaattatcccggaagagggtctcccaggagccccgaacataacgggcgggggggcggaggcggagcttgggaactggggagcgacgctaggcccgcgtttggaggaggggtgtgctgctttgagcatcttcctggaggagatcccgacgatggagacgttccactagccctcttacggggagagcccggtctgcacctggcaccaggaactgacgaccataatcaccacctcgctctggatccgtgtttgtcagatgaaaactacgacttcagttcagctgaatcggggtcaagcttgaggtactatagtgaaggtgagagcggtggaggaggctcatctctgagcctccatcctccacaacaacctcctctggtgcccaccaattccggaggcgggggagcgactggtgggtctccgggggagcgcaagcgaaccaggctggggggacccgcggcccgccacagatacgaagtggtgactgagttagggcctgaagaagtaaggtggttctacaaagaagataaaaaaacctggaaaccatttataggctatgattccctaagaattgagctggcctttcgaactcttttacagacaacaggcgctcgcccacagggcggggatcgcgatggcgatcacgtctgctccccaactggacctgcatcttcttcaggtgaagatgatgacgaggaccgggcctgtgggttctgccagtctactactggccatgaaccagaaatggttgaacttgttaacattgagcccgtgtgtgtgagaggtggcttatacgaggttgacgtgacacagggagaatgttacccggtgtactggaatcaggcagacaagatcccagtgatgcggggtcagtggtttatagacggaacatggcaaccactagaagaggaggagtctaatctaatcgagcaggaacatctgaactgttttagaggacaacagatgcaggaaaatttcgacatcgaggtatctaagagcatcgacggaaaggatgccgtccattccttcaaactgtctaggaaccatgtggactggcacagcgtggatgaggtctacctttatagcgatgccacaacgtctaaaatcgcccgaacagtgacacagaagttaggtttcagtaaggcctcctctagcgggacacggctccatcgcggctatgtggaagaagccacactggaagacaaaccctcccagacaacacacatagttttcgtggtgcacgggataggacaaaaaatggatcaaggcagaataataaaaaacacagctatgatgcgggaggcagcccgcaagatcgaagaaaggcacttcagcaaccacgctacgcacgtggaatttctgcccgttgaatggcggtctaaactgacactagacggggatacggtggattcgataaccccggacaaggtccgtgggttaagagatatgctgaacagctccgccatggacatcatgtattacactagccctctgtaccgggatgagctggtaaaaggcctccagcaagagctgaaccgcctctatagcctcttctgcagtcggaatccagacttcgaggaaaaggggggtaaggtgtcaatagtgagtcattcacttggttgtgttatcacctatgacattatgaccgggtggaaccccgttcgtctctatgaacagctattacagaaagaggaagagctgcccgacgagcgctggatgtcttatgaggagcgccacttgctcgacgaactttacatcaccaaacggcgattaaaggaaatagaagaaagattacatgggcttaaggctagttctatgacccaaactcctgcgttaaagttcaaagtcgaaaacttcttctgcatgggtagtccattagctgtatttcttgccttacgcggaattcggccggggaacacaggctctcaggaccatatactgccacgcgaaatttgcaatagactgttgaacatctttcacccgaccgaccccgtcgcatataggctggagccgctgatactgaaacactatagtaatattagcccagtgcagattcactggtacaacactagcaaccccttgccttatgaacacatgaagccctctttcctgaacccagctaaggaacccactagcgtaagcgagaacgaagggatctccaccatccccagccccgttaccagccccgtcctgagccgcagacactacggcgagagtattacaaatattggcaaagctagcatcctgggtgctgcaagcattggtaagggtctgggtggaatgctgttctctaggttcggacggtctagcactacccaatcttccgaaacctcaaaggatagcatggaagatgagaaaaagcctgtagcgtcaccatctgcgaccactgttggtacacagacactgccacattccagcagtgggttcctggactccgcctatttccgcctgcaggagtcgttctttaacttgccacaattactgttccctgagaacgtaatgcagaacaaagataatgctctggtcgagctagaccatcggattgactttgaactgagggagggtctcgtggagagtaggtactggtcagcggtaacctcccacacagcgtactggtcaagcttagacgtggctctctttcttcttactttcatgtacaagcatgaacatgacgatgacgcaaagcccaacctggacccgatttag

SEQ ID NO: 14492 - DNA, 1278 bp, Artificial Sequence
  Description of Artificial Sequence: Synthetic coding sequence
atgaacaaaatgccagccggcgagcaagaatgcgagtataataaagaggggaaatactactcaaagggagtaaaactcgtgcgcaagaagaaaaaaattcctgggtaccgatggggagatattaaaattaacattattggtgagaaagacgacttacccattcatttctgcgataaatgtgatctaccaatcaaaatatatgggcggataatcccctgcaagcatgctttttgttaccattgtgctaatctgtatgataaagtcgggtacaaagtttgccctcgctgtcggtatcctgtcttaagaatcgaagcccataagagaggaagtgtgtttatgtgttccattgttcagcaatgtaagaggacttacctgagtcagaaatccctgcaggcacatataaagcggagacacaaaagggctcgaaagcaagtcacgtccgcgtctcttgaaaaggtacgcccccacattgccccaccacaaactgagatctcagatattccaaaacggctccaggaccgcgatcatctgagctacattcctcccgaacagcataccatggtgagcttgccatcagtgcagcatatgttacaggagcaacataaccagcctcataaggatatccaggcaccgccccccgagctcagtttaagcttgccattcccgatccagtgggaaacggtcagtatcttcacccgaaagcatggcaaccttaccgtcgaccacattcagaacaactcagattccggagcaaaaaagccaactcctcccgactattacccggaatgccagtcacagccggccgtctcttccccacatcacattatccctcagaagcagcactacgctcctcctccctctccgtcgagccccgtgaatcaccagatgccctacccccctcaggatgtggtgaccccaaatagcgttcggagtcaggtaccggccctcacgacaacctacgacccctcatcagggtacataattgtcaaggtgccgcccgacatgaatagcccccccctcagagcaccacaatctcagaacggtaaccctagcgcctctgagttcgcctctcatcactataacctcaacatactgccacaattcactgagaaccaggagacactttctccacagttcacacaaacagacgcaatggaccatcgacggtggcccgcctggaaaaggctttcaccatgtcctcctacccggtcaccacccccttctacactacatggcaggtcgcaccactcccatcagcggagacatcgccgatattag

SEQ ID NO: 14493 - DNA, 1926 bp, Artificial Sequence
  Description of Artificial Sequence: Synthetic coding sequence
atgggaccccccctgaaactgttcaagaatcagaaataccaggaactaaagcaggagtgtatcaaggactctaggcttttttgtgatccgacctttctaccagagaacgactcattattttataaccgtctgttgccaggtaaggtggtctggaagcgaccccaggatatctgcgacgacccgcacctgatcgttggcaatataagcaaccatcagcttacgcaaggacgactggggcataagccaatggtgtctgccttttcttgtctcgccgtccaggagagccactggacgaaaaccattccgaatcataaagagcaggaatgggatccacagaaaacagagaaatatgccggaattttccattttcgattctggcattttggggagtggactgaagtggtcatcgatgatttactccctactatcaacggcgatcttgtgttcagcttttctacaagcatgaatgagttctggaatgctctgctggagaaagcctatgcaaagctgctgggatgctacgaagcccttgacggcctcactattacagacattatcgtcgattttacggggaccctggctgaaacagtggacatgcaaaaaggccgctataccgaactagtggaagagaagtataagctattcggggagctgtacaaaactttcaccaagggaggccttatttgctgtagtattgagtctcctaatcaagaagagcaggaggtggagacagattggggactcctgaaaggtcacacctacactatgaccgatatcaggaaaattcgtctcggcgagcggctggtagaggtctttagcgccgagaaggtgtatatggtgcggctcaggaatccactgggccgccaggagtggagtggaccatggtcggaaatttccgaagagtggcagcaactgactgcctctgacaggaaaaatctgggactggtaatgtctgatgacggcgaattctggatgtccttagaagacttttgtcgaaacttccacaaactaaacgtgtgcagaaacgtgaacaaccctatcttcggcagaaaagagcttgaaagcgtgttgggctgttggaccgtggatgacgacccattaatgaacagatccggcggttgctacaacaacagagatacgttccttcaaaacccgcagtacatttttaccgttcccgaagatgggcacaaggttatcatgtctctccagcagaaagacctgcggacctacaggagaatggggcgccccgacaattacataatagggtttgagctgtttaaagtggaaatgaataggaagttccgtctgcaccacctttacatacaggaacgagccgggacatctacctacatcgatacgcgaacagtgtttctgtccaagtacctgaaaaaagggaactacgtactggttcccaccatgttccagcacggacggacctctgagttcttgctgcgaatcttttctgaagtgcccgtgcagctgcgggaactcacccttgacatgcctaagatgtcttgttggaacctcgccaggggctatcccaaggtggtgacacagattaccgtccactccgcagaggatctagagaagaaatacgctaatgaaaccgtcaatccatatctggttatcaaatgcggaaaggaggaagtgaggagcccggtgcagaagaacaccgtacacgctattttcgacacgcaggcgatattctatagaaggacaaccgacattcctattatcgttcaggtctggaactccagaaaattctgtgatcagttcctaggccaggtcactctggatgccgacccgtctgactgtcgggatcttaaaagcctctatctgaggaagaagggcggccccacggccaaggtcaaacaaggacacatcagttttaaagtcatctcttctgatgatttaacagaactctag

SEQ ID NO: 14494 - DNA, 3180 bp, Artificial Sequence
  Description of Artificial Sequence: Synthetic coding sequence
atggccgcagtagccgggagtggagccgcagccgccccaagcagcctgcttctggtggttgggtcagagtttgggtcacccgggctgctgacatacgtgctggaagagctcgagcgaggaattcggagctgggacgtggatcctggggtttgcaacctggacgaacagctgaaagtatttgtttccagacactccgctacattttcctcaattgtgaagggacaaagatctttgcatcataggggtgataacctggagactctggtgcttttaaacccgagcgacaagagcctgtacgacgagctgaggaatctgctgctggatcccgcgtctcataaacttcttgtcctcgccggcccatgcctggaagagacaggtgagctgcttctgcagaccggtggcttctcacctcaccatttcctacaagtgctgaaggatcgggaaatacgcgatatcctggcaaccactcccccccccgtccagccacctatcctaactatcacgtgcccaacatttggagattgggcccagcttgcgcctgctgtgccaggactccagggcgccctgcgtctgcagctgaggttaaacccacctgcgcagctgccaaattccgagggcctctgcgaattccttgagtacgtggccgagtcactggaaccacccagccctttcgagttgctggaaccacctacctccggcggatttctccgtctagggcgtccatgctgctatattttccctggaggtttgggggacgcagcatttttcgccgtcaatggattcactgtcttagtaaatggcgggtcaaaccctaaatcttctttttggaagttagtgcggcacctcgaccgcgtggacgccgtattggtgacccatccaggagcagacagtctgcctggattgaatagtcttctccgacgcaaacttgcggagcgtagcgaagttgctgccggggggggcagttgggatgaccgacttcggaggctgatatcacccaatctcggggttgtgttctttaatgcctgcgaggcagcctctaggctcgcccgcggcgaagatgaggcggagctggcactgtccctgctcgctcagctgggaattaccccgctccccctgagccggggcccagtgccggctaaacctacagtccttttcgagaagatgggtgtggggcgtctggatatgtacgtcctgcacccaccaagcgccggagcagaaagaaccctcgcctctgtgtgcgcgctgcttgtgtggcaccccgcagggccgggcgagaaggtggtgcgggtgctttttcccggatgtactcctccagcatgcttactagatggactagtacggctgcaacatttgcgatttcttcgcgagcccgtcgtaacaccacaggacctggagggcccagggcgcgccgaaagtaaggagtctgtcggatcccgagactcatcaaagcgcgaaggcctgctcgcaacccaccctagacctggccaggaacgaccaggtgtggcccggaaggagccagccagggctgaggcccctcggaaaaccgagaaggaggcaaaaaccccacgggaactgaagaaggacccaaaaccgtccgtgagccggactcagccgagggaagtgaggagagccgccagctccgttccgaatctgaagaagacaaacgcacaggctgcgcccaaaccccggaaagccccgagcacatcacattcagggtttcctcccgtcgcaaacggcccccggtcccccccgtccctccgctgtggagaggcatctcctcctagcgcagcttgtggcagccctgcaagtcagctggtggccacgccctcccttgaacttgggcccatccctgcaggagaagagaaggccctcgagttgcctcttgcggcttcaagtatcccaagaccccgcaccccttcaccggagtctcacaggtctccagccgagggcagtgaacgtttatcattgagccccctgcgaggaggcgaggcgggcccggacgcctcgccgaccgtgactacccccactgtgaccacgccctccttacccgcagaagtgggaagtccccattcaacagaagtggatgagagtttaagcgtgtcattcgaacaggtactgccaccaagcgcacccacatccgaagcgggcttgtcacttccactgcgaggccctagagccagaaggagtgctagtcctcatgacgtggatctatgcctcgtcagcccatgcgaattcgaacataggaaggcggtgcccatggcccccgcacctgcctccccaggctcttccaatgactccagcgccagaagtcaggagcgcgccggcgggctcggcgcagaagaaacccctcccacttccgttagcgaaagtctacctactctgagtgatagcgacccagtccctctcgctcccggggccgccgattcagacgaagacacagaaggatttggggtgccaaggcacgaccccctgcccgaccccctgaaggtcccccctccactcccagacccctcgtccatctgcatggtggatccagaaatgttgccaccgaagactgcccgacagacggagaatgtgagtcggactagaaagccgctggccagacctaattcgagagccgccgcccctaaagctacccctgtcgccgcggcaaaaacaaagggactggcgggaggggaccgagccagtcgacctctgagcgcacggtcagagccttcagagaaaggcgggcgagctcctctctctaggaagagctctactcctaagaccgcaaccaggggcccctccgggtccgccagctctaggcctggcgtgtctgcaaccccccctaagagtcccgtgtatttagaccttgcttacctgccatctggaagttcagctcacttggtggacgaggagttcttccaacgcgtacgggccttgtgctacgtcatctcaggacaggaccagagaaaggaggaaggcatgagggccgtattagacgctctgctggcttccaagcaacactgggacagagatctgcaggtgactctcatccctacctttgattcggtagcaatgcatacttggtacgctgaaacgcatgcgagacaccaggcactgggcatcacggtgctgggtagtaacagcatggtttctatgcaggatgacgcctttcctgcctgtaaagtggaattttag

SEQ ID NO: 14495 - DNA, 4734 bp, Artificial Sequence
  Description of Artificial Sequence: Synthetic coding sequence
atggaagcgggctccgtggtccgcgccatctttgacttttgcccgtcagtctccgaggaactcccactgtttgttggagacatcattgaagtgttggctgtggttgatgaattctggttactgggtaaaaaggaggacgtcacaggccagtttccttcctcttttgttgagatcgtaactattccaagcctgaaggaaggagagagactttttgtgtgcatctgtgaatttaccagccaggagctggacaatctgcctctgcatcgaggagatctggtaatcctggatgggattccaacagctgggtggctccaggggcgtagttgctggggcgcccgcggcttctttccctccagctgcgttagggaactgtgtctgtcctctcagagcaggcagtggcattcacagagcgcgctgttccagatacccgaatactccatgggtcaagcgcgtgctctgatgggattgagcgcccagctcgacgaggaactggattttcgcgagggggacgtgatcacgatcatcggcgtccctgagcccggctggttcgagggcgaactggaaggccgtcgcggcatattcccagaaggctttgtggagttgctcggccccctcaggacagtggacgagagcgtgagcagtgggaaccaggacgactgtatcgtcaacggggaagtggacactccagtcggtgaagaagaaataggcccagatgaggacgaagaagaaccgggcacttatggcgttgccttgtaccgcttccaggccttggaacctaatgagctggattttgaggtcggtgacaagattcgtattcttgcaaccttagaggatgggtggttggaagggagtttgaaaggcagaaccggaatcttcccataccgcttcgtcaagctgtgtcctgatactagagtagaagaaacgatggcgctacctcaggaagggtctctggccaggatcccagagaccagcctcgattgcctggagaataccttgggagtggaagagcagcgccacgagacatctgatcacgaggccgaggagcccgattgcattatctcagaggctccgacctctcccctcggacaccttacaagcgaatacgacaccgatcggaattcttaccaggacgaagacacagcaggtggtccccccaggagcccgggagtggagtgggagatgccgttagccaccgactcaccaacctctgatcccaccgaggtggtcaatggaattagctcccaaccacaagtacccttccacccaaacctccagaagagccagtactatagtaccgtcggggggagccacccacactctgaacagtatcccgatttattaccgctcgaggcacgtacccgcgactacgccagcctaccacccaaacggatgtacagccaactgaagacgttgcagaagccagtgctgccattgtaccggggctcatccgtgtccgctagtcgcgtggttaaaccgcgccagtcctccccacagctacacaatctcgcctcctataccaagaaacatcacacctcttccgtgtacagcatctctgaacggttggagatgaagccagggcctcaagctcaggggctggtcatggaggccgcaacccattcacagggtgatggaagcactgacctggattcgaaattaacgcagcagcttattgagtttgagaagagtctcgctgggcctggaaccgaacctgacaaaatccttcggcacttctctatcatggactttaactctgagaaggatatcgtgagggggtcaagtaaattgatcacggaacaggagctgccagagcggcggaaagcgctgagacctccgcctcccaggccttgcacacccgtaagtacctctccccacttgctggtggatcagaacttgaaacccgccccaccgctcgtggtacgtccttcccgccctgccccactgccccctagcgctcagcagcgcactaacgccgtgtcgcccaagttgctatccagacatcgacccacatgtgaaaccttagagaaagagggcccgggacacatgggccgctctttagaccagactagcccttgcccccttgtcttagtccggattgaagagatggaaagagatcttgatatgtacagcagggcacaggaggaattaaatctgatgctggaagaaaagcaggacgaatcttcacgggcagaaactctagaggacttgaaattctgcgagagtaacattgagagcctaaatatggaacttcaacagttaagagagatgaccctgttaagtagccagagctcatccctggtggccccctcggggtcagtaagtgccgagaatccggagcaacgaatgctggaaaagcgcgccaaagtgatagaggaattgctccagacagagcgagactacattcgcgatctcgaaatgtgtatcgaaaggatcatggtgcccatgcagcaggctcaagtacctaatatcgactttgagggcctcttcgggaacatgcagatggttatcaaagtttcaaagcagcttctcgccgctcttgagatttctgacgcagtcgggccagtatttttaggacaccgcgatgagctggaaggaacatacaaaatttactgccagaatcacgacgaggctatcgcactcctcgaaatatacgaaaaggacgaaaagattcaaaaacacctccaagattctctcgcggacttaaagtcactatataatgaatggggttgcacaaactatatcaacctgggaagtttcctgatcaaacccgttcagcgggtgatgagataccctctcctcctcatggaactcctaaatagcacacccgagagtcatccagacaaagtgcccctcacgaacgcggtgcttgcagttaaagaaattaatgtgaacattaatgagtacaagcgcaggaaggacctcgtcctgaagtatagaaaaggcgacgaagatagccttatggaaaagatttctaagctgaatatccattcaataatcaagaaatctaatcgggtgtcatcacaccttaagcacttaacaggctttgccccgcagattaaggatgaggttttcgaagagactgagaagaattttcgcatgcaggagaggcttataaagagcttcatcagagacctgtctttatatcttcaacacatcagagaatccgcatgtgtgaaggtggtggccgctgtctctatgtgggatgtttgtatggaacgcgggcaccgtgatctcgaacagttcgagagagtgcacagatacatctcggaccagctgtttacaaattttaaggagcgcacagagcgccttgttatatctccactgaaccagctgctgagcatgtttaccggacctcataagctcgtgcaaaaaagatttgacaagctgttggatttctataactgcacagagcgtgccgagaagcttaaggataaaaaaaccctggaggaactccagagtgctaggaataattacgaggccctgaatgctcaacttcttgatgaactgccaaagtttcatcagtacgcacagggactcttcactaattgtgtgcatgggtatgccgaggctcactgtgattttgtccatcaggccctagagcagcttaagcctctcctgagcctcctgaaggtagccggtcgtgagggtaatcttattgctatctttcacgaggaacattcacgggtgctgcaacagctgcaagtcttcaccttctttccagagagtcttccagctaccaaaaaaccatttgagcgaaaaaccatcgatagacagagtgcacgtaagcccctgttggggctgccatcatatatgcttcagagcgaggagctaagagcgagcttactggctcgttatcccccagagaagttgttccaagcagaacggaacttcaacgccgcacaagacttggatgtgagtctacttgagggagatctggtgggtgttatcaaaaaaaaggaccctatgggctcacagaatcggtggctgatagacaacggcgtaaccaagggattcgtgtactcctcatttctgaaaccgtataaccctaggcgttcacattcagatgcttccgtgggttcacatagttctaccgaatctgaacacggaagtagcagtccacgattcccgaggcagaattctgggagtacactgaccttcaacccttccagtatggcagttagcttcacttccggttcctgccagaaacaaccacaggatgcatccccccctcccaaggaatgtgatcaagggaccctgagcgcaagcctcaatccctcaaactctgaatcaagtccaagtagatgtcccagcgatccggacagtacctcccaacctaggtcgggcgactcagctgatgtcgcaagggacgtcaagcagcccaccgccactcccagatcatatcggaatttcagacacccggagattgtgggctactctgtcccaggcagaaacggacagagtcaggacttggttaaggggtgtgcccggaccgcgcaggcgcctgaggataggagcacagagccagacggcagcgaggccgaagggaaccaagtgtacttcgcggtgtacacatttaaggcacggaatccaaatgaattgtccgtctcggcaaaccagaaactgaaaatcttggagttcaaggacgtcaccggaaatactgagtggtggctagcagaagtcaatggtaaaaagggttacgtaccatccaactatatcagaaagaccgagtatacttag

SEQ ID NO: 14496 - DNA, 3186 bp, Artificial Sequence
  Description of Artificial Sequence: Synthetic coding sequence
atgctgcgaacggccggacgggacggcctatgtcgcctctctacatatctggaagagctagaggccgttgagcttaagaagttcaagctgtacctcggcactgcaacagaattaggtgagggcaaaatcccttggggcagtatggagaaggcgggcccccttgagatggcccagctcctaattactcattttggcccagaggaagcctggcgtttggccctctccaccttcgaacggatcaacaggaaggacctgtgggagaggggtcaaagggaggacctagtccgcgacacaccgccggggggaccctccagccttggaaatcaatctacgtgcctacttgaggtgtctttagttacacctaggaaggacccacaagagacatatcgggactatgtcaggaggaagttccggctgatggaagataggaacgcccgtcttggagagtgcgtcaatctctctcatcgatacaccaggcttttgctagtgaaagaacactccaatcccatgcaagtccagcagcagcttctcgatacaggcagggggcatgcgaggaccgttggtcaccaagcgtcgcctattaaaatcgagacattgttcgaaccagatgaagagcgtcccgagcctcccaggacggtcgtcatgcaaggcgcagccgggatagggaaaagcatgctggctcacaaagtcatgctagactgggccgatggcaagctatttcaggggagattcgattatctgttctatataaattgccgggaaatgaatcagagtgcgaccgaatgtagcatgcaggaccttattttttcttgctggcccgagccatccgccccattacaggagctgatacgcgtgccagagaggttgctattcatcattgacgggttcgacgagctgaaaccctcattccacgatccccaggggccatggtgtctgtgctgggaggaaaagcggcctactgaactgctcctcaactccttgatccggaaaaagctattacctgagctgtccttgttaattaccactcggcccactgctcttgagaaactgcacagactgttggagcatcctagacacgtggagatcctgggattctccgaggctgagcggaaagaatatttctataagtactttcataacgcagaacaggccggtcaagtgtttaactacgtgagggataacgagccgttattcacaatgtgcttcgtgccgctagtatgttgggttgtctgtacatgtctgcagcagcagctggagggcggaggtctgttgcgacaaactagccgaaccacaactgccgtgtatatgctctatctgctgtcactgatgcagccaaaacctggcgccccaagattgcagccaccccctaaccagcgaggtctctgcagcctggccgccgacggtctgtggaaccagaaaatcttatttgaagagcaggacctgaggaagcatgggcttgatggtgaagacgtgtccgccttcctgaatatgaatatcttccagaaggacattaattgcgaacgatattattcctttatccacctctctttccaggagtttttcgcagcaatgtactacattctggatgaaggagaggggggcgccggtcctgatcaggatgtgactcggctattgaccgaatatgccttcagcgagcgatcattcctggccctgaccagtcggtttctgttcggattactgaatgaagagacgcgcagccatctggaaaagtctttgtgctggaaggtttcaccccacattaaaatggatctcttacaatggatacaaagtaaggcccagtctgacgggagcaccctgcagcaggggtcactcgagttcttttcctgtctgtatgaaatccaggaggaggagtttatccagcaggccttgtcacatttccaggtgatagtcgtctctaatattgcctccaaaatggaacacatggtatccagcttctgcctgaagcggtgccggtccgcccaggtgctgcacttgtatggtgccacatattctgctgacggggaggaccgggcgcgatgtagtgcgggggcccacacccttttggtgcagctacccgaaagaacggtcctgttagacgcatatagtgaacatctagccgcggccttgtgtacaaacccaaatctgatcgaactctccttatacaggaacgctctggggtcccgtggcgtgaaactcctgtgccagggtctgaggcacccgaattgtaaattgcagaacctaagactcaagcgttgccggatctcttctagcgcttgtgaagacctctcagccgctctgatagctaacaagaatctcacaaggatggacttgagtgggaatggtgtgggttttcccggaatgatgctgttatgcgagggtctccggcacccacagtgtaggctccaaatgattcagctgcggaagtgccagctggagtctggtgcttgccaagaaatggcgtccgttttgggaactaacccacacctggtagagctcgatctgaccggcaacgcgttagaagacctagggcttaggcttctatgccaggggctgaggcatccggtttgccggctaagaacgctttggctgaagatttgcaggttgaccgctgcagcctgcgatgaactggcaagcactctgtccgtaaatcaaagtctgcgggaactggatttgagtctcaacgaactgggcgacctaggggtgctgttgctgtgtgaagggttgaggcaccccacatgcaagcttcagaccctgcgtttaggcatttgcagattggggagcgcagcgtgtgaggggttgtctgtggtgctgcaggctaaccacaatttacgcgagcttgacctttcattcaatgacctcggggattggggcttgtggttgcttgccgaaggactgcagcatcccgcgtgccgcctgcagaagttgtggcttgatagctgcgggctgaccgccaaagcatgcgaaaatctatatttcacgttaggaataaaccagactttaactgatttatacctaacaaataatgccctgggcgacaccggtgtaagattgctctgcaagcgtctctcccacccgggctgcaagctccgagtgctgtggctattcgggatggatctgaacaagatgactcactcgagacttgctgcgttaagggtaacgaagccctacttagacatcggttgttag

SEQ ID NO: 14497 - DNA, 3963 bp, Artificial Sequence
  Description of Artificial Sequence: Synthetic coding sequence
atggctaatgactcccccgccaagtcccttgttgacatcgaccttagttcactgcgagatccagccggaatcttcgaactggtggaagtggtggggaatggcacgtacggccaggtctacaaagggcgacatgtgaagacagggcagcttgctgctattaaggtcatggatgtcaccgaagatgaagaggaggagatcaagttagaaattaatatgctcaagaagtactcacaccacagaaatatcgctacctattacggcgcctttattaagaagtctccgcctggacatgacgaccagctctggctcgttatggaattttgcggtgcgggttctatcactgacctggttaaaaacactaagggtaacactctgaaagaagattggatcgcctacatatctcgggagattctgcgtggcctcgcccacctacatatccaccacgttatacaccgagatatcaaagggcagaacgtcctgctgaccgagaatgctgaggtgaaactcgtagacttcggtgtttcagcccagctggatagaacggtgggccgccgtaacacttttattggcaccccatattggatggctcctgaagtgatagcctgtgacgagaatccagacgctacctatgactatcgctccgacctgtggtcatgcggcatcacagccatagagatggccgagggcgctccaccactgtgcgatatgcaccccatgagagcattgttcctgataccaagaaatccacccccccgcctgaaatctaaaaagtggtcaaagaaattcttcagcttcattgaaggatgcttggtcaaaaattacatgcagagaccttcgaccgaacagctgttaaaacacccatttatcagggatcaaccgaacgagaggcaggtacgtatccagctgaaggatcacatcgaccgcacgaggaagaaacgcggagaaaaggacgagactgagtacgaatattctggttctgaggaagaagaggaggaagtgcccgaacaggagggtgaaccaagctctattgtcaacgtgccaggggagagcaccctgcgaagggactttctcagattacagcaagaaaataaggagcggagcgaagccctacgcagacagcagctgctccaggagcagcagttgcgagagcaagaagaatacaagcggcaattactggcagagcgtcagaagcgcatcgagcagcaaaaggaacagcggaggaggctggaagaacaacagcggcgcgaacgcgaggcccgtcgacaacaggaaagggagcaacggagaagggaacaagaggagaagcgtcggcttgaagaattggagcgccggagaaaagaggaggaggaacgtaggagagccgaggaggaaaagcgcagagtcgagcgggagcaggagtatatcagacggcagttggaggaagagcagagacacttggaggtgctgcagcagcagctgctgcaggaacaagccatgctattggaatgtagatggcgagagatggaggaacatcgacaggctgagaggctgcagagacagctgcagcaagaacaagcctacctactttcgttgcagcatgaccatagaaggccccatccccagcatagccagcagcctcctcctccccaacaggaacgttctaagcccagcttccatgccccagagcccaaggctcattatgagcccgccgaccgagcgcgcgaagttgaagatcgatttagaaagactaatcacagctcccccgaggcacaatccaaacagacagggcgggtgctcgagcctcccgtgccttcaagaagcgaatcattttctaatggcaactccgagtctgtccaccccgctcttcagaggcccgcggagccacaggttcagtggtcacatcttgcaagtctcaaaaataacgtgagccccgtgtctaggagccactcattcagcgatcccagtccaaagttcgcgcaccaccacctcagatcccaggacccctgtccgccttcccggtctgaggtcctgtctcagagctctgattctaaatctgaagctccggaccccactcagaaagcgtggtcccggtcagatagcgacgaggttccgcctagggtgcccgtaagaacaactagcaggtcacccgtgctgtcacgcagggactctcctctgcaaggctcagggcagcagaacagtcaagcaggccaaagaaactccacctcatcaatcgagccacgtctgctttgggagagagtcgaaaaactggtcccccgacctggttcaggttctagctcgggatctagcaactctggctcgcagccaggaagccatccaggatctcagtcgggatcaggcgagaggttccgggttcgttcaagttcaaaatctgaaggcagcccttcccaaagactggaaaatgctgttaaaaagcccgaggacaaaaaggaggtattccgtcctcttaagcccgccgtccggatcgatctcacagctcttgccaaggaactccgcgctgtggaggacgtccgacctccccataaggttacagactatagcagttcctctgaagaatccggaactactgatgaggaagatgatgacgttgaacaggagggagcagatgaatccacgtctggtcctgaagacacaagagcagcctccagcttaaacctgtcgaacggcgagaccgagagtgtgaagaccatgatcgtccatgacgacgtggaatccgaacccgccatgactccctcaaaagagggtacgctcattgtgaggcaaactcagtctgcctcatccaccctgcagaaacataaatcttcatcctctttcacgccattcattgaccctcgcctgcttcaaattagccccagtagcggcactacggtaacctctgtggtgggcttcagttgcgacggtatgaggcccgaggcgatccgtcaagaccccacccgaaaggggagtgtggtgaacgtcaacccgacaaacacacgtccacagtctgataccccggagatcagaaagtacaaaaaacgcttcaactcagagatcctctgcgccgccctgtggggtgtgaacctgctggtcggtactgagtctggtctgatgttgctcgacagatcaggacagggtaaagtctacccactaatcaacaggaggcggttccagcagatggacgtgttagagggactgaatgtgctggtcacaatatccggtaaaaaagataaactgcgggtctattatctatcatggcttaggaacaagattctacacaacgatccggaggtcgaaaaaaagcagggctggacaacagtgggtgaccttgagggctgcgtgcactacaaggtcgtaaagtatgagcggattaagttcctggtgatcgccctgaagtcctccgtggaagtgtacgcttgggcccccaagccttatcacaagttcatggcctttaagagtttcggcgaactggtgcacaaaccgctgttagtcgacctgacagtagaggaagggcaacgtctgaaggttatatacggatcgtgcgctgggttccacgcagtggatgtggatagtgggagtgtctacgatatttacttgcctacccatatccagtgcagcatcaaaccgcatgccatcattatactgccaaacactgacgggatggagctactggtctgttacgaggacgagggggtctacgtaaacacttacggaagaatcactaaagacgttgttctgcagtggggagagatgccaacatccgtcgcctatattagatctaatcagactatgggctggggggaaaaagcaatcgagattcggagcgtggaaaccggacatctggacggcgtcttcatgcacaagcgagcacagcgactaaaattcctttgcgagaggaacgataaagtgtttttcgctagtgtgcggagcggcggaagcagtcaggtctatttcatgaccctgggaagaacctcattactcagttggtag

SEQ ID NO: 14498 - DNA, 606 bp, Artificial Sequence
  Description of Artificial Sequence: Synthetic coding sequence
atgtacactctgttgtcaggcttgtataagtacatgttccagaaggatgaatactgcattctaatcctaggcttagataacgctgggaaaaccacattcctggaacaaagtaagacaagatttaataaaaactacaaaggaatgagcctctcaaagataaccactactgtcggtctcaacattggaactgttgacgtgggcaaagctcgcctgatgttttgggacttggggggccaagaagaactacagtctttgtgggataaatactatgctgagtgccatggcgtaatttacgtcattgacagtaccgatgaagaacgactagccgagagcaagcaggccttcgagaaggtggttacatcagaggcactgtgcggcgtgcctgtgctcgtgctggcgaacaagcaagacgtagagacgtgtctgtcaatacccgatataaaaactgctttctctgattgcacatccaaaatcggtcggcgggactgtctgactcaggcctgtagcgctctgacgggaaagggagtgagggaaggaatcgagtggatggtgaagtgtgtggtgcggaacgtgcaccggccaccccgccagagggatatcacctag

SEQ ID NO: 14499 - DNA, 1329 bp, Artificial Sequence
  Description of Artificial Sequence: Synthetic coding sequence
atgcgaggagcaatggagttggaacctgagctcctcctgcaggaggcaagggagaatgtggaggccgcacagtcttatcgacgggagttaggccacaggcttgaagggctgagagaggcacgtcgacagataaaagaaagcgcatcacaaactagggacgttctgaagcaacatttcaatgacctgaaggggactttggggaaacttctggacgaaaggcttgtcactctcctgcaggaagtagatactattgaacaagagactatcaaacctctggatgattgtcagaagctcatcgagcatggagttaacacagctgaagatctggtgcgtgagggggagatcgcgatgctggggggcgtaggcgaggagaatgaaaaactctggagctttaccaagaaggcctctcatattcaactggatagcttgcctgaagtgcctctgctggtagatgttccatgcctcagtgcacagttggacgactcaatcctgaacatcgtaaaggatcatatcttcaagcacggtacagtggcgtcccggccacccgtacaaattgaggagctcattgagaagcccgggggcatcatagtgcgttggtgtaaggtcgacgacgatttcaccgctcaggactatcggctgcagttccggaagtgtacgagcaatcactttgaggatgtctacgttggctctgagaccgagtttatcgtcctccatatcgacccaaatgtggattatcaatttagagtctgcgcacggggcgacggcaggcaggaatggtctccgtggtccgtgccccagatcggccattccacactggtgccacacgagtggactgctgggtttgaaggatactccctgagctccaggcggaacattgccctaaggaatgatagtgaatcctccggagtactgtatagcagggcccctacctacttctgtgggcagacgctgacatttcgcgtcgagaccgtggggcagcctgatcgaagagactctatcggagtctgcgccgaaaagcaggacggctacgacagtttacaaagagatcaggcggtatgtattagtacgaacggggcggtatttgtaaacggaaaagagatgactaaccagcttccggcagtgacgagcggatcgaccgtaaccttcgatattgaggcagttacgctagggaccaccagcaacaatgagggaggccacttcaagctgcgcgtgacgatttcttccaacaaccgcgaggttgtgttcgattggttgttagatcagagctgcgggtccctatactttgggtgcagcttcttctacccagggtggaaagtgcttgtattctag

SEQ ID NO: 14500 - DNA, 1428 bp, Artificial Sequence
  Description of Artificial Sequence: Synthetic coding sequence
atggcagcattgaccacactgtttaagtatatcgatgagaaccaggatcgttacatcaagaagcttgccaaatgggttgcaatacagtccgtgagcgcatggccagaaaagaggggcgaaataaggcggatgatggaagtggccgctgctgacgtgaagcagttgggagggtcagtggaactggtggatatcgggaagcagaaactgccagacggctccgaaattcccctgccccccatcttgttgggccggttaggctccgatccccaaaagaagaccgtgtgcatctatggccatctggacgtccaacccgcagccttggaagatggatgggacagtgagcccttcacactcgtcgaacgtgacggaaaactgtacggtcgaggaagcaccgatgataaaggtcctgtggcagggtggatcaacgctctggaagcttaccaaaagacaggacaggagatcccagtaaatgtccgcttctgcctggaaggcatggaagaaagcggaagcgagggtttggacgaattgattttcgctaggaaagatacctttttcaaggacgtcgactacgtctgtatttcagataactattggctcggcaaaaagaagccatgtataacatatggcttgcgcgggatatgctactttttcatagaggttgagtgttccaacaaggacctgcactcaggcgtctacggcgggagtgtacacgaggccatgactgatttgattctcctgatgggatcacttgtcgacaagcgtggaaatattctgatacccggcattaacgaagcggtcgctgctgttaccgaggaggagcacaaattgtatgacgatatcgacttcgacatcgaggagttcgctaaggacgtcggcgcacagattctcctgcactctcacaaaaaggacatcctcatgcaccgctggaggtatccctccctcagcttgcacggtatcgaaggagccttttcgggatcaggagcgaagactgttattcctcggaaagtggtaggaaaatttagtatccgcctcgtacctaacatgaccccagaagtggtgggggagcaagtgacctcgtacctgacaaagaaattcgcagagctcagatctccaaacgagtttaaggtatacatgggccatggaggaaagccttgggtgtcagatttttcccatcctcactacctggcaggccgacgcgccatgaaaaccgtctttggcgtggagcccgatttgaccagggagggtgggtccatccctgtaaccctcacctttcaggaagctactggtaagaatgttatgttgctccccgttggcagcgcagatgacggcgcccatagccaaaacgaaaaacttaacagatacaattatatcgaggggacaaagatgcttgctgcctacctttatgaggtcagccagcttaaggattag

SEQ ID NO: 14501 - DNA, 6291 bp, Artificial Sequence
  Description of Artificial Sequence: Synthetic coding sequence
atggccgaggttaccgtgcctagagtgtatgtcgtatttggcatccattgtatcatggccaaagcatcgtcagatgtccaggtgtcgggatttcaccggaaaattcaacatgtgaagaacgaactgtgtcacatgctgtccctggaggaagtcgccccagttctccaacaaaccctgctccaggataatttgctgggtcgtgtgcattttgatcagttcaaggaggctcttatcctgatcctgtctcgtaccctgagcaatgaagagcatttccaggaacctgactgttcactggaagcccaaccaaaatacgtgcggggagggaaaagatatgggcggcgctccctgcccgaatttcaggagagcgtggaggagttcccagaagtgacggtgatagaacctttggacgaagaggcacggccctcacacatccccgccggcgactgttctgaacattggaagactcaacgcagtgaggagtacgaagccgagggtcagctccggttctggaaccctgacgacctgaacgcgtcacagtccggcagctctcctccccaggactggatcgaggagaaactgcaggaggtgtgtgaggacctcggaatcacaagggacggccatttaaatcgcaagaaactcgttagtatctgcgaacaatacggactgcaaaatgttgatggagaaatgctggaggaggtattccataacctagaccccgacgggaccatgtctgtggaggactttttttatgggcttttcaagaacggcaaaagtctcaccccatcagcctctaccccatatcgccaactgaaacggcacctgtcaatgcagagttttgatgaatctggcaggagaactaccaccagcagcgccatgacgtctactattggattccgagtgttctcttgccttgatgacggtatgggacacgccagcgtggagcgcattctagatacctggcaagaggaggggatcgaaaattcccaggaaattctcaaggcacttgatttttctctcgatggtaacattaacttgaccgagctgacccttgccttggaaaacgagttgcttgtcaccaagaactcaatccatcaggctgccttagcgagttttaaagccgagattcgccatctgttggaacgtgtcgaccaggtggtaagagaaaaagagaaactgaggtcagatctggataaagctgaaaagctgaaatcactgatggcctctgaagttgacgatcaccatgccgccatcgaaagacgcaatgaatataacctgaggaagctcgacgaggaatacaaggaaaggatcgcagcgctgaagaatgagcttcgcaaggaaagggagcagattctccagcaggccggcaagcaacgcctcgaattggagcaagagattgagaaggctaagaccgaggagaactacattcgggacaggctggcactctcactcaaagagaatagcaggctggagaacgaactactcgagaatgctgagaaactagcagaatatgagaacctgacaaataaacttcagcggaatttagaaaatgtgttggccgagaagttcggcgacctcgatccctcctccgctgagttttttctccaggaggagcgcctgacccagatgcggaacgagtacgagcggcagtgccgggttctgcaagaccaagtggacgaacttcagagcgagctggaagaatacagagctcaggggcgagtcctgagactcccactgaagaattcacccagcgaggaggtagaggccaacagcggtggcatagaaccggaacacggactcggcagcgaggaatgtaatcctcttaatatgagcattgaagctgaattggtgatcgaacagatgaaggaacagcatcatcgtgatatctgctgtctgaggctggaactggaagataaagtgaggcactacgaaaagcagctggatgagacagttgttagttgtaaaaaggcacaggagaatatgaagcagcgacacgaaaatgagactcatactctggaaaaacagataagcgaccttaaaaatgaaatcgcagagctccagggccaggctgcggttcttaaggaagcccatcacgaggcaacttgccgccacgaggaagagaaaaagcagctgcaagtgaaattagaagaagagaagacacacttgcaagagaaactgaggctccaacacgagatggagctcaaagccagattaacacaggcgcaggccagctttgagagggagcgtgaagggcttcaaagcagcgcttggaccgaggagaaggtgcgaggcctcacacaggagctcgaacagtttcatcaggagcagctgacatccctggtcgagaagcacacactggagaaggaggagcttcgcaaggagctgctggaaaagcaccagcgcgaactacaggaagggagagagaagatggaaactgaatgcaacagaagaactagccagatcgaagcgcaatttcagtccgattgccagaaggtgaccgaaaggtgcgagagtgcacttcagagcttggagggacgttaccgccaagagctaaaagatctacaggagcagcagcgcgaggagaagtcgcagtgggaatttgaaaaggacgaattaacccaggaatgtgctgaggctcaggagcttctgaaagagacacttaagcgcgagaagaccacctcacttgtactaactcaggaacgggagatgctagagaaaacctacaaagagcatctgaatagcatggtggttgaacgacagcagctgctccaagacctcgaagatctacgaaacgtcagtgaaacacagcagtctctgttgtccgatcagattctggaacttaaaagttcccacaaacgcgaactccgcgagagagaggaggtgctgtgccaggccggggcctcagagcagttagctagccagagattggagcgcctagagatggagcacgaccaagaacgacaagagatgatgagtaagctactggccatggaaaatattcacaaagcaacttgcgagacagctgaccgcgaaagggccgaaatgtcaacggagattagccgtctccagagcaagataaaggagatgcagcaggcaaccagccccttgtcgatgttgcaaagtggatgccaagtgattggcgaggaggaagttgagggggatggtgccctttctctactccagcagggggagcagttactggaggaaaacggggatgtcctgctgtccctgcagcgagctcacgaacaggccgttaaggagaatgtgaagatggccacagagatttctaggctgcagcaacggctccagaagctggagccaggactggttatgtcctcctgcctcgatgaaccggctaccgaattcttcgggaacactgcggaacagacagaacagttcctccagcagaacaggacgaagcaagtcgaaggcgtgactaggcggcacgtgctgtctgatctggaggatgatgaagtacgtgacctggggtccactgggacatcgtcggtacagcgccaagaagtgaagatcgaggagagcgaggcttccgtagaagggtttagcgaacttgagaactctgaagagactagaacagagagctgggaactgaaaaaccagataagccagctgcaggagcagttgatgatgctctgtgcagattgcgaccgtgcttccgagaagaagcaggatcttctcttcgacgtgtcagtcctcaagaagaaattgaagatgttggaacgcattcccgaagcttccccaaagtataaactgctctatgaggacgtgagccgtgagaacgattgcctgcaggaagaactccgcatgatggaaactagatacgatgaggccctcgagaacaacaaggaactgactgcagaagtatttagactgcaggatgagctgaaaaagatggaggaggtgacagaaaccttcttaagcctggagaagtcttacgacgaagtgaagatcgagaacgagggtcttaacgttttggtactgaggttgcagggtaaaattgagaaattacaggagtctgtggtacaaagatgcgactgttgtctttgggaggcaagcctcgagaatctggaaattgagcccgatggtaatattcttcagctgaatcaaacactcgaggagtgtgtcccaagagttagatctgttcaccatgtcatcgaggagtgcaaacaggaaaaccagtatctggaaggaaacacgcagctactggagaaagttaaggcacacgagatagcctggcttcacggcacgatccagacgcatcaggaacgacccagagttcagaatcaggtcattctagaggaaaatacaaccctgcttggattccaggataagcacttccagcaccaggctaccattgccgagttagagctggaaaagaccaagcttcaggagctgactcgaaagcttaaggagcgcgtgactattctggtgaagcagaaggacgtgctgagtcatggtgagaaagaggaggagctcaaggctatgatgcacgatctccagatcacatgctcagagatgcagcagaaagtagagctgctgcggtatgaatccgagaagcttcaacaggagaactctatcttgcggaacgaaatcaccaccttgaacgaagaggacagtatttctaatttgaaacttggcacactcaatggatctcaagaagaaatgtggcagaagacagaaacagtcaagcaggagaacgctgcagtccagaaaatggtggaaaacttaaaaaaacagatttcggagttgaagattaaaaaccaacagctggatttggagaacacggagctgagtcaaaaaaactcccaaaatcaagaaaaattgcaggagctgaaccaacgactgaccgaaatgctttgccagaaagagaaggaaccaggcaattcagctctggaagagagagagcaggaaaaatttaatttgaaggaagagctggagaggtgtaaagtgcagtccagtactcttgtaagcagtctcgaagccgagctctctgaggtcaagatccagacacatatcgtgcaacaggaaaatcacctgctgaaggatgaactggagaaaatgaagcagctccacaggtgccccgatctgagtgattttcagcagaagatctcctccgtgctgtcctataatgaaaagctgctgaaggagaaagaagccctgtctgaagagctgaattcatgcgtggacaaactagcgaaatcatccctgcttgaacaccgaatagctacaatgaagcaggagcagaagtcctgggagcatcagtctgcaagtctgaagtcgcaacttgtggcgagtcaggaaaaggtccagaatctggaagatactgttcagaacgtaaacctgcagatgagtaggatgaaatcagatttgagagtgacacaacaggagaaagaagctcttaagcaggaggttatgtccctgcacaaacagctgcagaatgctggaggaaagtcttgggcacccgagatcgcgacccacccttccggtcttcacaaccaacagaagcggctttcttgggacaaacttgaccacctgatgaatgaagagcagcagctgctttggcaagagaatgaacgactgcagacaatggttcagaacacaaaggctgagctaactcacagtagagaaaaggttcgccaactcgaaagtaatctcttacctaagcatcagaaacacctgaatccatcaggcacaatgaatcctactgagcaagaaaaactctctctgaagcgggaatgcgatcaattccaaaaggaacagtccccagctaacaggaaagtctctcaaatgaatagcttggagcaggaattggagactatccacttggaaaatgaaggattgaagaaaaaacaggtaaagttggatgaacagcttatggagatgcaacacctgagatcgacggctacccccagcccctccccacacgcctgggacttgcagctgctgcaacagcaggcgtgtcctatggtgccccgagagcaattcctgcagctccaaagacaattactccaggcagagcgtatcaatcagcacctacaggaagaattggaaaatagaactagtgagaccaacaccccgcagggtaatcaggaacagctcgtgaccgttatggaggagagaatgattgaggtagagcagaagttgaaacttgtaaagcgactgctgcaagagaaggtgaatcagctaaaagagcaagtctccctcccgggacacctgtgctcaccgacctctcatagttccttcaatagctcctttaccagtctttactgccactag

SEQ ID NO: 14502 - DNA, 1176 bp, Artificial Sequence
  Description of Artificial Sequence: Synthetic coding sequence
atggctgctctgaccacactgttcaaatacattgacgaaaaccaagatcggtacattaagaagttggctaaatgggtggccattcagagcgtgagcgcgtggccagaaaaacgtggcgaaatcaggcgaatgatggaggttgcagccgctgacgtcaaacagctaggcgggagcgtagagctggtagacattggtaagcagaaagagattcctgtgaacgtacggttttgccttgagggcatggaagagagtggtagtgaaggactcgacgaactgatctttgcccggaaagatactttttttaaagatgtagactatgtttgtataagcgataattactggctgggaaagaaaaaaccgtgtattacatacgggttgcgggggatctgctacttttttatagaagtagagtgcagcaataaagacctacactccggggtgtacggcggcagcgtccacgaagccatgaccgatctcattctgcttatggggtcactagtagacaaaagagggaatattctcatacccggcattaatgaagctgttgccgccgtgacagaggaagaacacaaattgtatgatgatatcgatttcgatatcgaagaatttgcaaaggacgtgggcgcccagatactgctccatagccacaagaaggacatactgatgcaccggtggagatatccatccctgagtcttcatgggattgagggggccttctctggcagcggagcgaaaacagtgataccgcggaaggtggtgggaaaatttagtatccgattggtccccaatatgactcccgaggtggtaggggagcaggtgaccagctacctcacgaaaaagttcgcggagctgcggtcccctaatgaattcaaggtgtatatggggcatggtggcaagccctgggtttcagatttttcccatcctcactatctggccggccggcgggctatgaaaaccgttttcggcgtcgaaccagacctgacgagggagggaggctcaatccccgtaaccctcaccttccaagaagccactggcaagaatgtgatgctacttccagtgggcagtgcggacgatggcgcccacagccaaaatgaaaaattgaatcggtataattacatcgaggggacaaagatgctggctgcctatttgtatgaggtgagccagctgaaagactag

SEQ ID NO: 14503 - DNA, 5970 bp, Artificial Sequence
  Description of Artificial Sequence: Synthetic coding sequence
atggacgaggtggagcaggatcaacacgaagccaggttgaaggagctcttcgatagctttgacaccaccggcactgggtctctcggacaggaggagttaaccgacctttgtcacatgctgtccctcgaggaagttgctcctgttttgcaacagacacttcttcaggataacctgcttgggcgtgtacactttgaccaattcaaggaggccctcatactgatcctttcccggactttgtccaatgaggagcattttcaagagccagattgcagtctggaagcacagcctaaatacgtgcgggggggtaaacgctacggccgcagatcccttcccgagttccaggagagcgtggaggagttcccagaagttaccgtcatcgaaccactggacgaagaggctaggccctctcatatccccgcaggtgactgtagcgagcactggaaaacacaaaggagtgaggagtacgaggctgaagggcagctacgtttttggaaccccgacgacttaaacgcatctcaatctggaagctccccacctcaggattggatcgaagaaaagctgcaagaagtttgtgaggacctgggcattacccgggatggacacctcaatcgcaagaagcttgtaagtatttgcgaacagtacggcttgcaaaacgtcgatggcgagatgctcgaagaagtgttccacaaccttgacccagatggaactatgagtgtagaggattttttttacggactatttaaaaacggcaaaagcctgacaccaagcgcttccacgccatatagacagctgaaaagacatctgagcatgcagagtttcgatgaaagcggcaggagaaccactacttcaagcgcgatgacctccacgattggatttagggtcttttcctgtttggacgatggcatggggcatgctagcgttgaacgtatcctggacacctggcaggaggaaggcattgagaactcccaggagatcctgaaagcgctggatttcagcctggatggcaacatcaatctaactgagctaactctggctctggaaaacgagctgcttgtaaccaagaacagcattcaccaggctgcactcgcaagttttaaggcggagataaggcatcttttggagcgcgtggatcaggtggtccgtgagaaagaaaaattgcgctcagatctggacaaggctgaaaagttgaagagtttaatggcctctgaagtggatgaccatcatgccgccatcgaaaggcggaatgaatataaccttagaaaattggacgaagaatacaaagaaagaattgccgctcttaaaaatgagttgaggaaagaacgggaacagattctgcaacaggccggaaaacagcggctagagctggagcaggaaattgaaaaggccaaaacggaagagaactatatacgcgaccgcctggctctttcattaaaagagaactctcggctggagaatgaactgctcgaaaatgcagagaagctcgctgagtacgagaatctgacaaacaaattgcaacggaacctcgagaatgtcctcgctgaaaaattcggggatctcgacccatcttcagctgaatttttcttgcaagaggagcgacttacacagatgcgcaacgaatacgaacgacagtgccgggtgcttcaggaccaagtggatgaactgcagtccgagctggaagagtatagagcacagggaagggttctgagactgcccctgaaaaactctcctagcgaggaggtcgaagcaaattcaggcggaatcgaacctgaacatggcctgggcagtgaggagtgcaatcccttgaacatgagtatagaagccgaactggtgattgagcagatgaaagaacagcatcaccgcgatatatgctgtctgcgcctggagctcgaggacaaagtgcgacattacgagaagcagcttgacgagacggtggtgtcgtgcaagaaagcccaggagaatatgaaacagaggcatgagaacgagacacacaccctcgagaaacagatttctgacctgaaaaatgagatagccgaacttcagggtcaggccgcggtgctaaaagaggctcatcacgaggcgacatgccgccacgaggaggagaaaaagcagttacaagtgaaactcgaagaagagaaaacacacctgcaggagaaactgcggctgcagcacgagatggaactcaaggcccggctaactcaggctcaggcctctttcgagagagaacgcgaggggctgcaatcctcggcgtggacagaggaaaaagtacgggggctcactcaggaattagagcagttccaccaggagcagctcacttctttggttgaaaaacacacccttgagaaggaggaactgcggaaagagctactggaaaaacatcagcgtgaactgcaggaaggccgcgaaaaaatggaaaccgagtgcaatagaaggacctcacagattgaagcccaatttcaaagcgactgccagaaggtgaccgaaagatgtgaatctgccctgcaaagcctggagggaagataccgccaggagcttaaagacttgcaagagcagcagcgggaggagaaaagccagtgggagttcgaaaaagatgagttgacacaagaatgcgcagaagcgcaggaattgcttaaggagactttgaagagagaaaaaaccacctcgttggtgttaacccaagaaagagagatgttagagaagacttataaggagcacctgaatagcatggtggtggaacggcagcagctgttgcaggatctggaggacctgcggaatgtgtctgagacgcagcagtctctccttagtgaccagatactggagctaaagtcttctcacaagcgagaactccgggaacgggaagaggtgttgtgccaggctggtgcttccgagcaactggcctcacaacgactggagcggcttgaaatggaacacgaccaggagagacaggaaatgatgtctaagctgttggctatggagaatattcacaaggctacatgcgagacagcagatagggaaagagcggagatgtccaccgagatctctagacttcagagcaagattaaagagatgcaacaagccacttctcccctgtcaatgctgcagagtggatgtcaggttatcggagaagaggaggtagagggggatggcgccctgtcattgttgcaacagggagagcagctgctcgaggagaacggtgatgtgctgctgtcgcttcagcgtgctcacgagcaggcagtgaaggagaacgtgaaaatggccacggagatctctcgtctccagcagagattgcagaagttagagcctgggcttgtgatgtctagctgcctcgacgaacctgctactgagttttttggtaataccgctgagcaaaccgaacagttcctgcagcagaataggacaaaacaagttgagggtgtaactaggcggcacgtactgtctgaccttgaagacgatgaagtaagagatcttgggagcaccggcacatctagtgtacagagacaggaagtaaagatagaagagtcagaggccagcgtggaggggttttccgaactcgagaattctgaggaaactcgaactgagagctgggagctaaagaaccagatctctcaactgcaggagcagctgatgatgctgtgcgctgactgtgatcgcgcttctgaaaagaaacaggacctgctatttgacgtgagcgtgctgaagaaaaagctgaaaatgttggagaggattcccgaggcttctcctaaatataagttactgtatgaggacgtgagcagggaaaatgattgcctccaggaagagctgcggatgatggagacccgctacgatgaggcgctcgagaataataaggaattgaccgcggaggtctttcgtctgcaggacgaactgaagaagatggaagaggtgactgagacgttcctgtcactagaaaaaagttatgacgaagttaagatagaaaatgaggggctaaatgtccttgtgcttagacttcaggggaagattgagaaactgcaggagagcgtggtgcaaagatgtgattgctgcctctgggaggcatccttagagaatctggaaatcgagcccgacggcaacattctgcagctgaatcaaacattggaggagtgcgtgcccagggtacggagcgtccaccacgtgattgaggagtgtaaacaagaaaatcagtacttagaagggaacactcagctgctggaaaaagtcaaagctcacgagattgcttggctccacggtacaatccagacacaccaggaaagaccaagggtgcaaaaccaggtcattctcgaagaaaacaccactctactggggtttcaggataaacacttccagcaccaagcgactatagcggagctggaactcgaaaaaaccaaactgcaagaattgaccagaaagcttaaggagcgggtgaccatcctggtcaaacagaaggacgtcctgagccacggcgaaaaggaggaagagctcaaggctatgatgcacgacttgcaaattacatgtagtgaaatgcagcagaaagtcgagctcctcaggtacgagtccgaaaaactgcagcaggaaaattcgattttacgtaatgagattacaaccctgaatgaagaggatagtatttcaaatctgaagctaggcacactgaacggctctcaggaggaaatgtggcagaagaccgaaacagtgaaacaggagaacgccgcagtgcaaaagatggtggagaatctgaaaaaacagatttctgagcttaaaataaagaatcagcagcttgaccttgagaacaccgagttgagccaaaagaattcacagaaccaggaaaaactgcaggagttgaatcagcggctaacagagatgctctgccagaaagagaaagagcccgggaacagcgccttagaggagcgtgagcaggaaaaatttaaccttaaggaggagcttgaacgctgcaaagtgcagtcttcaacactggtgtcgagtttagaagccgaactgtcagaagtaaagattcaaacccatatcgtccagcaggaaaatcatctgctcaaagatgagctggagaaaatgaaacagctgcacagatgccccgacctgtccgactttcagcagaagattagtagcgtgcttagctataatgagaagctgcttaaggaaaaggaggctctctctgaagaactgaactcatgcgttgataagctcgctaaaagtagcttgctcgagcatcggattgccactatgaagcaggaacagaaaagttgggaacaccagtcagcgtcactgaagagccaacttgtggcctcccaggaaaaagtgcaaaatttggaggatacagtacaaaatgtgaacttacagatgtccaggatgaaatccgatttgcgcgtcactcaacaggaaaaagaagctctcaagcaggaggtgatgtccctgcataaacagctccagaatgccggcggcaagtcttgggctcctgaaatcgccacacacccgagcgggctccacaatcagcagaaacgactgtcatgggacaagctcgaccacctcatgaacgaagagcagcagctgttgtggcaggaaaatgagcgccttcaaaccatggttcagaataccaaggcagaattgacacacagtcgggaaaaagtccgccaacttgagtctaatctcctcccaaaacatcagaagcacttgaatcctagcggtactatgaaccctaccgagcaagaaaaactgagtctgaaaagggagtgtgaccagtttcagaaggagcaatcacccgctaataggaaagtctcccagatgaattccttggagcaagagctggagactatccacctggagaacgagggcctgaagaagaaacaagtgaagctcgacgagcagctaatggagaactctgtcgtcggaagttctcgagagggctgctcctccctccctgaaattgtctgcgaagacgcagcacctgaggtccactgtgacgcctag

SEQ ID NO: 14504 - DNA, 915 bp, Artificial Sequence
  Description of Artificial Sequence: Synthetic coding sequence
atgggacaatgtgtgacaaaatgcaagaacccctcttctaccctcggatcaaaaaacggagaccgggaaccttcaaacaagtctcactcaagacgaggcgctggccaccgcgaagaacaagtgcctccttgcgggaaacctggtggcgacattcttgtcaatggaacgaagaaagctgaggccgcaaccgaagcctgccagctgccaacatccagcggagacgctgggcgggaatcaaaatccaacgcagaagagagtagcttgcagcgcctcgaggaactgttcagacgttacaaagatgaaagagaagacgctatcctagaggaggggatggagcggttttgcaacgacctgtgcgtggatccaacggaatttagggtgctacttctagcttggaaatttcaggcggccactatgtgtaagtttactcgcaaagaattcttcgatggttgtaaggccatttctgccgactctattgatggtatctgcgcacgcttcccaagcctgttaactgaagccaaacaagaagacaagtttaaggatctgtatcgtttcacttttcagtttggtcttgatagcgaagaagggcagcgaagtcttcaccgcgagatcgccatcgcattgtggaagctggtgtttacacagaacaatcccccagtgctcgatcagtggcttaattttctgaccgagaatccgagcggtataaagggaatctcaagagatacatggaatatgtttcttaactttacgcaggtgatcggtccagacctctctaattattctgaggacgaagcctggccatccctgtttgatacgtttgtagaatgggaaatggaacggcgcaaaagagaaggggagggtagaggtgcgctctcctcgggccccgaaggcctgtgccctgaagaacagacctag

SEQ ID NO: 14505 - DNA, 1914 bp, Artificial Sequence
  Description of Artificial Sequence: Synthetic coding sequence
atggctgcaatggctgttggcggcgctggtgggagcagagtttcatctggcagggatctgaactgcgttccggagattgctgacaccctgggagcagtggctaaacaagggtttgacttcctgtgcatgcctgtgtttcacccacgatttaagcgtgagttcattcaggagccagcaaagaaccgcccaggcccgcaaacccgatcagatctgctgctgtcaggccgggactggaacactcttattgtcgggaaactgtcaccatggatcaggcccgatagcaaagtcgaaaaaatacggcgcaatagcgaggcggccatgctgcaagagctgaattttggggcttacctcggtctcccagccttcctgctcccacttaaccaggaggacaacacaaacctcgctagagtactgaccaaccacatccacaccggccatcacagcagcatgttttggatgagagttccactcgtggccccagaagacctgcgggatgatattattgaaaatgctccaacgacacacaccgaagaatactctggagaggaaaagacctggatgtggtggcataatttcaggactctgtgcgattatagtaagcgcattgctgtggcgctagagattggggctgatcttcctagcaatcatgttatcgacagatggttaggcgagcccatcaaagcggctatcctgcccacctcaatcttcctaacaaacaaaaaagggttcccggtactgtccaaaatgcaccagaggttgatatttcgtttattgaagctcgaagtccagttcatcataaccggaaccaaccaccactctgaaaaagagttttgttcttatttgcaatacctcgagtacctgagtcaaaatagacccccccctaatgcctatgagctcttcgctaaaggttatgaggactatctgcagagccctctgcagccattgatggacaatctcgagtcacagacatatgaagtgttcgagaaagacccgataaagtatagccagtaccagcaagcaatttataagtgcctgctagatcgtgtgccagaggaggagaaggatactaatgtccaggtcctcatggtgttaggagcaggccggggtccgttggtgaatgcatctctgcgggcggccaagcaggccgacagaagaattaaattgtacgctgtggaaaagaaccccaatgcagttgtgacgctcgagaattggcaattcgaagaatggggttctcaggtaactgtagtctcttctgatatgcgagaatgggtggctcccgaaaaggcagacataatcgtcagtgagctgttgggcagttttgccgataacgagctgagtcctgaatgtctagatggggcacagcacttcctgaaggacgatggcgtgtctataccgggggaatatactagctttctggctcccatctcatcatccaagctttacaacgaggtgcgagcatgccgagaaaaggatcgggatcctgaggctcagtttgaaatgccgtacgtcgtgaggttgcacaattttcaccagctctcggccccacagccttgctttaccttcagccatcctaatcgtgatccaatgattgataacaaccgatactgcacactggagtttcctgtggaggtgaataccgtgctgcacggcttcgctggttatttcgagactgtgttataccaagatataaccctgagtatcaggcccgagacccacagtcctgggatgtttagctggtttccaatattgtttcccattaagcagcctattacagtgcgggaaggacaaaccatatgtgtccgcttttggcggtgcagcaactcaaaaaaagtttggtacgaatgggccgtaaccgccccagtttgctcagccattcacaaccctacgggccggagctatacgattggactatag

SEQ ID NO: 14506 - DNA, 1041 bp, Artificial Sequence
  Description of Artificial Sequence: Synthetic coding sequence
atggcacctggtagtgtgacgtccgatatttccccatctagtacatctacagcaggctcatcacgatccccagagtcagaaaagcctggaccatctcacgggggcgttccccctggcgggccatctcattcttctctccccgtgggacgccgccatcccccagtactgcgtatggtattagaagcactacaggctggagaacaacggagaggcacatcagtggcagcaattaaactctatattctacacaagtaccctaccgtcgacgtcctgaggttcaaatacctgttgaagcaagccttggctacaggtatgcggcggggcctgctggctagaccactcaatagcaaagcaaggggcgcgactgggtcttttaagctggtgcccaagcacaaaaagaaaatccagccacgcaaaatggcacctgccactgctcccaggcgtgctggggaagcaaaaggaaaaggacccaagaagccgtccgaggccaaggaagatcctccgaacgttggaaaggtgaaaaaagccgccaagcggcctgctaaggtccagaagcctccaccaaaacctggggccgctacagagaaggccaggaaacagggaggcgccgctaaggacacgagagcacaaagtggagaggcacgaaaagtgcctcctaaaccagacaaagcaatgcgggctccatcatccgccggggggttaagtcgaaaagctaaggcaaagggaagcagatccagccaaggagacgcagaagcgtatcgtaagactaaagctgaatcaaagagcagcaagcctactgcgtctaaagtgaagaacggggccgcctccccaactaaaaagaaggtggtggcaaaggccaaggcacctaaggccggccagggcccgaacaccaaggctgctgctcccgccaagggctccggcagtaaggtggtcccggcgcatctgagccgcaagacagaggcccctaagggtccccggaaagccgggctaccaatcaaggctagttcaagtaaggtttcctcccaaagggccgaggcctag

SEQ ID NO: 14507 - DNA, 1869 bp, Artificial Sequence
  Description of Artificial Sequence: Synthetic coding sequence
atggccatggcgccctcaccttccctcgtgcaagtctatacctctcctgccgcggtagcagtgtgggagtggcaggacggactgggaacatggcacccatacagcgctaccgtctgtagtttcatcgagcagcagtttgtgcaacagaaaggccagcgcttcggtcttggtagcctggcccacagcatacccttggggcaggccgatccgtcgctggctccctacatcatcgacctgccaagctggacacagttccgtcaggataccggcactatgcgcgcagttagacggcatctgtttcctcagcactccgcccctggtagaggagttgtatgggagtggctcagtgacgatggcagttggacagcttacgaagcttccgtctgtgactatctggaacaacaagtcgctaggggaaaccagctggtggacctggcgccgctaggatacaactatacagtcaattacacaacacacactcagactaacaagacttccagtttctgccggagtgtgcgcagacaggccgggccaccttaccccgtgacaacaatcatagcacctccaggtcatacaggagtagcttgttcttgccaccagtgtctctcaggtagtcgaacagggcctgttagtggtcgctatcgtcactccatgacgaatctgcccgcataccccgtcccacaacatccgccccatcgtaccgcctccgtcttcggcacccaccaggccttcgcaccctacaacaagccttccctgtccggcgctagatccgccccccggttaaatacgacaaacgcctggggtgctgcccctccatctctaggcagccaaccactgtatcgcagcagtctctcacatctgggccctcagcacctgccgcctggaagttccacatctggggccgtcagtgccagtctccctagcggccccagcagcagccctggctctgttccggcaaccgtgcctatgcaaatgccaaaaccttcgcgggtccagcaagccctcgccggaatgacatctgttctcatgtcagctattgggctgcccgtttgtctgtcgagggctccgcagccaacttcaccccccgcctctagactcgcaagcaaatcccacgggagcgtgaagcgcctccggaaaatgtcagttaaaggtgcaaccccgaagcccgagccagaaccggagcaggtgattaagaattatactgaagagctaaaggtcccccctgacgaagactgcattatttgcatggagaagctgagcacagctagtggctattctgacgtcacagatagcaaggcgatcggatccctggccgtcggtcatctgaccaagtgcagccacgccttccacttactgtgcttactggccatgtattgtaatggcaacaaggacggttcactccaatgtcccagttgtaaaacaatttacggggaaaaaactggaacacaaccacagggcaaaatggaagttctgcgcttccagatgagccttccagggcacgaagactgcggcactattctgatcgtttattcaataccccacggcattcaaggcccagagcaccccaatcctggcaaacctttcaccgccaggggattcccccggcagtgttacctgcctgacaatgctcagggtaggaaagtgctggagctcctcaaagtcgcgtggaaacggcgactgatctttaccgtgggaactagttccaccacaggcgaaactgacaccgttgtgtggaacgaaattcaccacaagaccgaaatggaccggaacatcactggccacggatacccagatccaaactacctacagaatgtcctggcagaattggcagcacagggagtgactgaagattgtctggagcaacagtag

SEQ ID NO: 14508 - DNA, 786 bp, Artificial Sequence
  Description of Artificial Sequence: Synthetic coding sequence
atggccgccactgcaagggaagacggcgcatctggccaggaacgagggcaacgcggctgcgagcactacgatagaggatgcctcttgaaggcaccgtgctgtgataagttgtacacttgccgcctgtgtcatgataacaacgaagatcatcagctggaccggtttaaggtgaaggaggtgcagtgtattaattgcgagaagattcagcatgcacaacagacctgtgaggaatgctctactctcttcggcgaatactattgcgacatttgtcatctatttgacaaagacaagaagcaatatcattgtgagaattgcgggatctgtcgcatcggacctaaggaagatttcttccactgcctgaaatgcaatctgtgtctcgctatgaatctccaaggacgccacaaatgcatagagaatgtcagccgccagaattgccctatttgcctcgaggacatccacacctcccgagtggttgctcatgtcttgccctgcggccatttacttcatcgaacttgttacgaggaaatgttaaaagaagggtaccgttgtcccttgtgcatgcactcggccctcgacatgacaaggtactggagacagctggatgacgaggtagctcaaactcctatgccctccgagtatcagaacatgaccgtggacatcctgtgtaatgattgtaacggccgaagcactgtgcaattccacattctaggaatgaagtgcaagatatgtgagagttataacacagcccaggcgggcggccggcgtattagcttagaccagcagtag

SEQ ID NO: 14509 - DNA, 1983 bp, Artificial Sequence
  Description of Artificial Sequence: Synthetic coding sequence
ctaagcctcccgagtgtgacgtatctgctgttagaggtgattccggactctatgcggaaacaagaggtgaggaccggacgtgaggccggccagggccacgggacgggtagtcctgccgaacaggtaaaggctctgatggacctactcgctggaaaggggtcacaggggtctcaggcccctcaggcgctggaccgaacccccgacgcacccttaggcccctgcagtaatgacagccgcatccagcgccaccggaaagccctcctcagtaaggttgaagctacacggggcggcggacacccagctcggacagtagcattggacaggctgttcttgccgttatcccgagtttctgtgccacctagggtcagcattaccatcggggtcgcaggcatgggcaaaacaaccctggttaggcacttcgtgcgcctgtgggcccatggccaggtcggcaaggatttctccctggtgctgcctttgactttccgagacttgaacacccatgaaaaattgtgcgccgatcgcctcatctgttcagtgtttccccatgtaggcgagccctccctggcagttgcagtccccgctcgggcactactgatactggacggtctcgacgagtgcagaactccattggatttctccaacactgtggcctgtactgacccaaagaaggaaatacccgtggaccatcttatcaccaatattatccggggcaacttatttccagaggtgagtatctggattacgtcgcgtccttcagcaagcggccagattcctggaggactcgtcgatcgcatgaccgaaattaggggctttaatgaagaagaaattaaggtttgtctggagcagatgtttccagaagaccaggccctcctcggctggatgctatctcaggtgcaggccgatagagccctctacctcatgtgcaccgtgcccgctttctgccgcctgacgggcatggccctgggccacttgtggcggtccaggacaggcccccaggacgcagagctgtggccacctcgaaccttgtgcgagctttacagttggtactttaggatggctctgtccggagagggacaggagaagggcaaggcatcaccaaggatcgaacaggtggcacacggcggccgaaagatggtcgggacgttaggacggctggctttccacgggctcctgaaaaagaaatacgtgttttacgaacaggacatgaaggcctttggagtggatctcgccctgctgcaaggcgcgccatgctcatgcttccttcagcgcgaggaaaccttagcatcgagcgtggcgtactgtttcactcatctcagtctccaggaattcgtggccgctgcctactactacggagcctctagacgcgccattttcgacctctttacagagtcaggggtgtcgtggccaagactcggctttctgacgcacttccgctctgccgcccagcgagctatgcaggccgaagacggccggctcgacgtgttcctcaggtttctgagcggccttttatctcccagagttaacgcactactggccgggtccttattggcccagggggagcaccaggcctatcggactcaggtggctgagctccttcaggggtgcttgcgccccgatgctgcagtatgcgcccgtgctattaacgtgcttcattgccttcacgaactccagcacaccgagctggccaggtcagtcgaagaagccatggagtccggcgcactggcccggctcactgggccagcccatagagctgcactggcatacctcctacaagtgagcgacgcctgtgcccaggaagcaaatctgagccttagcctgagccaaggcgtccttcagtccctgctgccccagctcctgtactgcaggaagcttcggtggatcccgggtcagggggccggggccggcgagggtgcggaggagagagccgaggcggtcccttctccccctccaagcttctccgtaagcctgctgggcctcccatag

SEQ ID NO: 14510 - DNA, 1152 bp, Artificial Sequence
  Description of Artificial Sequence: Synthetic coding sequence
atgctgtcccgaaaaaagacaaaaaatgaggtctccaagccggctgaggttcagggcaaatacgtgaagaaggagacttccccattgctgaggaaccttatgccttctttcatccgtcacggacctaccattcctagacggactgacatatgcctgccagacagcagcccgaacgccttctccacttccggggatgtcgtgtctcgaaatcagagctttctgcgcacccccatccagaggaccccccacgagattatgcgtcgcgaatcgaaccgattatctgcacctagctaccttgccaggtcgctcgcggatgtgccgagagagtacgggagcagccaaagcttcgtcaccgaggtatcctttgcggtcgaaaatggcgactcaggctctaggtattactattctgataacttcttcgatggtcaacgcaagcggcccctgggagacagagcccacgaggattatagatattatgagtacaatcacgacctctttcagagaatgccacagaaccaaggcaggcacgcttctggcattggccgcgttgcagccaccagcctcggcaatctgaccaatcatggctccgaggacttgccattaccacccggttggagcgtggattggacgatgcggggtcgcaaatactacattgaccataacacaaataccacgcattggagtcaccccttagagcgggagggtctgcctcctggatgggagcgggttgaatcatccgaattcgggacatattacgtggaccatactaataaaaaggctcagtaccggcatccatgcgccccctctgtgccacgttatgaccaacctcctcccgtcacatatcagccacagcagacggaaagaaaccaaagcttgttggtgccagcgaacccttaccacacagcagaaattccagactggctgcaggtctacgcaagagctccggtcaaatacgaccacatcttaaagtgggagctgtttcaactggcagacctcgacacttatcaggggatgctgaagttgctatttatgaaagaactggagcagatagtgaagatgtatgaagcttataggcaagctttgctcacagagttggagaaccgcaaacagagacaacagtggtacgcccagcagcatggaaaaaatttctag

SEQ ID NO: 14511 - DNA, 2376 bp, Artificial Sequence
  Description of Artificial Sequence: Synthetic coding sequence
atgtccaatcaacaagagaaatatgaagcgcagaacatcgtcaactccacagaggagagcgatgatgccttcgacacggtcacgattcctgtcccttctgaggaaccccaggagtctgatcagacagaggagcatgaatccggcattgagcagttttccgaatctcatgcaatccatgttgaggaacagtctgatcaaagtttctcctccttggaacctgacaatgaacagctgatggaagaagtgatctctccgcgccaggtgagctacacaccgcagcaccacgaaaagcagtacgccatgcagaggcccaacgatgacagccttgctttcctggataaaattaaatctgtgaaggagagcttgcaggagtctgttgaagactcattagctacagtgaaggtggtgctaattccagttgggcaggagattgtcattcctttcaaggtagacacaatcttgaagtatctgaaggaccactttagtcacttactcggcatacctcattctgtcctacagattcgatacagcggtaagattctgaagaataacgaaaccctggtgcagcatggcgtaaagccccaggagattgtgcaggtggaaatttttagcacgaatccagatctctatccagtacgtcgcatagatgggttaactgatgtgtctcagattatcacagtcactgtccagacaggtctcgaccagtatcagcaggtacccgtggaaattgtaaagagcgactttcacaaacctttcctgggcggtttccggcacaaagttaccggggtggagtatcacaacgccggtacccagacagtccctaagcgcattccagaaagactgagcattttttgcagggacacacagacagtgtttcaaaagaagaatctacaacagaccactaacaccaccagcacacagatgaccaatatcggcgtgtacgtgagcaatatgaccgataaactggttacccccggtaaatactttagtgctgcagagtatcatgctcaaagattgaaagcagtgattgtgatccagacatattataggcagtggcatgccaagatctttgtggaaaatctgagacgccagaagtctctcagactcgagtgggagacccaacaggaacttagaaagataagggagaaagaggagtggatcaaactcgattatcatagacgccataatcccaagacgaacgaggatttcgaattcctatataatgccctagagttctggcgccaggaagagctcacgcgtataaaccagtcatttacaggagccgagcggaaggcagccctctgtgaactgttagagaaggagacccagatcatcgctagtattggccgacaccgctatatagcctacatggcgaatcaagaggcagcgattcaggcgttccttgataagtgttcagctcccaagatatggagaacccccaatggtaagaccatcgaaatggatactcagttcaccatcagggccagggagcttcagaacatctacaaatgtatcatgctgaaaaatatctctcaggacgaacgcctagacgtacttctcacgctgaaacatacagtgaaagagcacgagtgcaaactcacccaggagatcctagagctgattgacagagaggtggacctcatgatgcgcggtgtgaagcaccacaacttggaggggctcaggaaacgtatagcaacgctattcttccattacataaagacccctctattcaatcctgaagtggccaagtacttaaaggtccctcaggaccctctcaagttttacaagaaaatctatttttgccatagctgccagctgtacttgccaagcacagagttttcagtttctagtacctccaggcgtatctatagatgtcgtaactgcatcaatctgcagaacgaggctcagaaaagggaatcattcttgaagtataagtgccttctccaacagctgtattacaccgaagccgactatgaagatgattccaaaattgctttcctcatgcagctgcaagacatacaatatcttacagaaaacatttgggcatcccagtctgtgctctccgcctgcgataacttgagtgatcttgtgatggtgcgatggaataaatccctcgagtggagcccttggaattgcattttactcacgaaagacgaagccgcagcccacctgaaactgacttctattgaggaaggatacgaacgaagcttcattcacaaaattaagcataagcatatactcgccaaaaactacttctcccaggtccctgttttagcgtcttttatcctcgatgacggagaaatcgatgaaatccgttggaaatatcacagcgataccacgcccaagatcattgaaagtcagaggcctcctcattag

SEQ ID NO: 14512 - DNA, 1767 bp, Artificial Sequence
  Description of Artificial Sequence: Synthetic coding sequence
atgtcctcttgcgttagctcacagccttctagcaatagagcggcaccacaggatgaactggggggacgaggaagctcaagctccgagtcgcagaagccctgcgaggcactccgcggacttagctctctgagtattcacctgggtatggaatctttcattgtagtgacagagtgtgagcccggatgcgctgtcgacctcgggctggctagagaccgcccgctagaggcagatggtcaggaggttcccctggacacatctgggtcacaggccaggccacatctgtctggtcgaaagctgagtctgcaggagcggagtcaggggggcctcgctgctgggggctccttggatatgaatggccggtgcatttgcccctcactgccctatagccctgtatcctctcctcagagcagccccagactacctagacgccctactgttgagagccaccatgtgagtatcacagggatgcaggattgcgtacagctgaaccagtacaccctgaaagacgaaataggcaagggatcttatggcgtggtgaagcttgcttataatgaaaacgacaatacatattacgcaatgaaggtgctgtccaaaaaaaaactcatccgccaggcgggttttcccaggcggccgccaccaagaggcacaagacctgccccggggggttgcatccaacctagggggcctattgaacaggtataccaggagatcgctatcctcaaaaaactagatcatcctaacgtcgtgaagcttgtcgaggttctcgatgatcctaacgaggaccatctgtatatggtgttcgagctagtgaatcagggacccgttatggaagtgcctacattgaaacccctgtccgaggatcaggcccggttttattttcaagacctgattaagggaattgagtatctccactaccagaagataatccaccgagatatcaaaccttctaacctgctcgtaggcgaagatgggcatataaagatcgctgatttcggggtgtctaacgagtttaagggttccgatgccttactgtccaacactgtgggcacgccagcattcatggccccagagtccttgtccgagacacgcaagatcttcagtgggaaagcattagatgtatgggctatgggagtgacactgtactgcttcgtattcggacaatgtccatttatggacgaaagaatcatgtgcctacactcgaaaattaagagccaggccctagaatttcctgaccaacccgatatcgcggaggacctgaaggatctgatcaccaggatgctggacaaaaatcctgagagccgaatagtagtccccgaaataaagctacacccgtgggttacccggcacggtgcagagccccttcctagtgaggatgagaactgcactctcgtggaagtcaccgaggaggaagtagagaactctgtaaagcatatcccctccttggccactgtaattctggtgaaaaccatgataaggaagcggagtttcggcaatcctttcgagggttcacggcgcgaagagaggtccttgtccgcccccgggaacctactgaccaagaaacctaccagagagtgtgagtctctgtctgagctgaaggaggctcgacagcgacggcagccccctggccacagacctgcccctaggggcgggggagggtccgcactggtccggggctccccctgtgtggagagctgttgggctcctgcccccgggagtcctgcacgaatgcatcccttgcgtcccgaagaggctatggagcctgagtag

SEQ ID NO: 14513 - DNA, 2052 bp, Artificial Sequence
  Description of Artificial Sequence: Synthetic coding sequence
atggccctaagtaaacgggagcttgatgagctgaagccttggatagagaagacggtgaagagagtgctgggcttctccgaacctaccgtcgtcaccgccgccctcaattgcgtcgggaagggtatggataaaaagaaggccgctgaccacctgaagccatttctggacgactccacccttcggtttgttgataaactttttgaggctgtggaggaaggacgcagttctcggcactcaaagtcctcttccgacagaagccgcaaacgcgaactgaaggaagtgttcggcgacgatagcgaaatttccaaggagtcctcaggcgtgaagaagcgtcgaattccccgcttcgaggaagttgaggaggagcccgaggtgattcccggacctccatccgagtctccaggaatgctcaccaaactgcagatcaagcagatgatggaggcggctacacgtcagattgaggaaaggaaaaaacaactgagctttatatccccacctactccccagccaaaaacaccatcttcctctcagccagagagattacctatcggtaacaccatccagccttctcaggccgccactttcatgaatgacgccattgagaaagcccgaaaggctgccgagttacaggctcgcatccaggctcagctggccctgaaacctggcctcattgggaacgctaatatggtgggcctggcgaaccttcatgcaatggggatcgcgcctcccaaggtggaactgaaggatcaaactaagcccacacctctaatccttgacgagcaggggagaacagttgatgccacgggtaaggagattgagctgacacatcgcatgcccacccttaaagcaaacattcgtgctgtcaagagagagcagtttaagcagcagcttaaggagaaaccgtcggaagacatggagagtaataccttcttcgacccccgcgtttcaatcgccccctcccagcgacaacgccgcaccttcaagtttcatgataaggggaaattcgaaaagatcgcacagcggctgcgaacaaaggctcagttagaaaagctgcaggccgaaatcagccaagccgcccgtaaaaccgggatccatacctctacccgcctggcccttatcgctccaaaaaaagagttgaaggagggggacatccctgaaatcgaatggtgggacagttatatcatacctaacgggtttgatctgaccgaggagaatccaaagagagaagactactttggaattactaacttggtggaacaccccgcacaattaaatcccccagtggacaacgatacgccagtaacattgggggtctacctgaccaaaaaggaacagaaaaagcttagacggcagaccaggcgcgaggctcagaaagagctccaagaaaaagtgaggcttgggctaatgcccccgccagagccaaaagtgaggatttcaaacctcatgagagtactgggcaccgaagccgtgcaggaccccacaaaggtggaagcacatgtgagggcgcagatggcaaagcgccagaaggcccatgaagaggctaacgccgccaggaaactgactgcggagcagcgcaaggtcaaaaaaataaagaaactcaaggaggatatcagtcagggtgtgcacatcagcgtgtatcgcgtgaggaatctatctaacccagccaaaaagttcaaaattgaggctaacgctggccagctgtacctgacaggggtcgtggtgttacacaaagatgtcaatgttgttgtggtggaaggaggacccaaagctcagaagaagttcaagaggctaatgttgcaccggatcaagtgggatgaacagactagtaatacaaaaggggacgatgatgaggaatcagatgaagaggccgtaaagaagacaaacaagtgtgtcctggtatgggagggtaccgccaaggaccggagtttcggggagatgaaatttaagcaatgtcccaccgagaatatggcccgggagcattttaagaaacatggggccgagcactattgggatctcgctttgtccgaaagcgttctggagtctaccgactag

SEQ ID NO: 14514 - DNA, 1938 bp, Artificial Sequence
  Description of Artificial Sequence: Synthetic coding sequence
atgagcgacaagagcgatctgaaggctgaattagagcgcaagaagcagcggctggcacagatccgggaggaaaagaagcggaaagaagaagagaggaagaaaaaagaggctgatatgcagcagaaaaaggaacctgtgcaggatgactcagatctcgataggaagagacgggagactgaggccctgcttcagtcaatcggtatctctccggagccaccgctcgtgcagccgctgcacttcctgacgtgggatacctgttacttccactacctggtccccacgccaatgtctccatcgagcaagagtgtcagtactccctccgaagctggcagccaggattctggcgatctggggcccctgacaagaaccctgcagtgggacacagacccttctgtcctgcaactgcagtcggatagcgagctgggccggagactgcacaaactgggggtttccaaggttacccaggtggactttctgccacgagaggtggtctcctactctaaagaaacccagacgcccttagccacacatcagtccgaagaggacgaggaggacgaggagatggtggagtctaaggtcggccaggatagcgagcttgagaaccaggacaagaaacaggaagtgaaggaggcacccccgagggagttaactgaagaggagaaacaacagatcctgcatagcgaagagttccttattttttttgatcgaaccatcagggtgatagagagggctttggccgaggacagcgatattttttttgattatagcggcagagaactcgaagagaaagacggagatgtccaagcaggagccaaccttagtttcaatagacagttctatgatgaacattggagcaagcaccgagtggtcacatgcatggactggtcactccagtatccagaactcatggtggcaagttacaacaacaacgaagacgcaccacatgagccagacggagtcgccctcgtatggaacatgaagtttaaaaaaacaactcccgagtacgtttttcactgtcagtcttccgtgatgtctgtgtgttttgcacggttccacccaaacttagttgtgggaggcacatacagcggccaaattgttctgtgggataaccgttctcatcggaggactccagtgcaaaggacaccattatcagccgcagcccacactcatccagtatactgtgtgaacgttgttggaacacagaatgctcacaatctaattacagtttctacggacggcaagatgtgcagttggtccctagatatgctcagcacaccacaggaatctatggaactggtgtataacaagagcaagcccgtggcggtgactgggatggcgttccctaccggagatgtgaacaattttgttgtgggaagcgaggagggtacagtgtacacagcttgcaggcatggctctaaagctggcattggagaggttttcgagggacaccagggccctgttacagggatcaactgtcacatggcagtcggcccgatcgatttctctcacctttttgtgacctcctctttcgattggacagtgaagttgtggacaaccaaacataataagccactttactcttttgaggacaacgcagattacgtctacgatgtgatgtggagtccggttcatccagcactattcgcttgtgtggacgggatgggtcggctggatctgtggaatctgaataatgacaccgaggtgcccactgctagtgtggccatcgagggagcctccgcccttaatagggtaagatgggcccaagccgggaaggaggtggccgtaggcgactctgagggccgcatctgggtttacgacgtgggcgaacttgctgtaccacacaatgacgagtggaccagattcgccaggaccctcgttgagattcgggccaatagggccgactccgaagaagaaggaacggtggaactgtccgcttag

SEQ ID NO: 14515 - DNA, 7806 bp, Artificial Sequence
  Description of Artificial Sequence: Synthetic coding sequence
atgaagaggaaggtggttaatacccataagctgcgtctgtctccaaacgaggaggctttcattctcaaagaggattacgaacgccggcgcaagctccgcctactgcaggtccgtgagcaggaaagagatatcgcgttacagatccgcgaggatatcaagcagaggaggaatcagcagtttacaaggctagcggaggagctcagagctgagtgggaagagtcacaaacacagaagatccagaatttggagaagctctacctggcctctctaaggtcaatgggcgagggacacaggcaggccaaagagaatgaaccagatctggatgcgctcgcccagcgcgccgctgagcggaagcgcaaggcagatctgaggcataaagaggcccttaaagttcaaaaaaatcagaaggagatcctactcaaacaaaaaacatggcatatcaaagcaaggaaagaggctctgcttgtggaaaaagagcggagtgctaagatcacttccctgccccctcctcctccgactctgttcgagaacatcgaggttaaacgtatctccgccgttaagaccaacagctctacgtatcaccatctgcatacattcgtcaaccgcgaaaccgataccaagcgaccagacgcccgactggctgccgaggaggaagcaaaacggctcgaggaactccagaaacaggccgcccaggagcggatggagcgattcgagaaagcacatgtcagaggttttcaggctatgaagaaaattcacctcgcccagaatcaggaaaagctgatgaaggagttaaaacagctgcagcaagaagatctcgctaggcggaggcagaccgtggcacaaatgcccccgcagcttgtggagctaccttataagcggagcgaaatgaaagaggattggcaacgagagctggagttcgcattcgaggacatgtacaatgccgatcggaaggtgaagggtaatctgatcctgcacctggaaccagaacctctcccaactgtgacaaatcagatccaggacgaggaactggacctgagcatggagcaggagaatctaggagcagctgaggatctgccagttaccgaagccgagatctgctcgagcgagaccgacgtgcctctggtgatgaagacccaacagattccgagtaaggtgctgttcaaaaagctgctgaataagattcggtcccagaaatccctctggacaatcaaaagtatgtctgaggacgaaagtgagatgatcaccacagtttccgagattgagtctaaggcccccactgttgagagcgggaccatcgcgtcgaaggagcgcactctctcttccggccaggagcaagtcgtggagagcgatactctgaccatcgagagcgggccgcttgccagcgaagacaagccactgtcttgtggtactaatagtggtaaagaacaggaaatcaatgagactctgcccattacgacggtagcacagtcttccgtgctcctccaccctcaggaagcggccgccaggatccgcatgagcgcacgccagaagcagatcatggagatagaagaacaaaagcagaaacagctggagctcttagagcagatcgaacagcagaagctcaggctggagacagattgcttccgggcacagttggaggaggagaagcgcaagaagactcaaccaacaggcgttgggatcgcaccggcttcctgtccagtgatctccgatgaggacagtcacaggcagatgattaggaattatcagcatcagctcctgcagcaaaatcgactccacaggcagagcgtagagacagccaggaagcagctacttgagtatcagacaatgttgaaaggcaggtgcccctccgtctccgctccatcactgatcaccgacagcgtcatttctgtgccaagttggaagtcggaaaggcctaccgctatctctgaacactgggaccagggacagcgactgaaactttctccgaacaagtatcagccaattcagcccatccagactagtaagctggaacaagaccattttcaggttgctcggcagaaccactttccccagaggcaggttgagacaaccgaaactctcagggccagcgatattctgaccaatcaggcactggaatcacaggaacatctgcggcagtttagccaaactgagacacagcaaagggactacaagcttgtgccgaaggactcagagacgcttagtagggcattatcccacgacaggcagttgatcagtcaggacgcaaggaagatctccgagactttcggtgcaactacctttcagagcctcgagtcacaacagctgttttctgagaattctgagaatatcagctatcaccttacggaaccatcaagcttcgtgccattggtgccccagcacagcttctctagcttgccagtaaaagtggagagcggcaaaatccaagagccatttagtgccatgtccaagtccaccgtgtcaacttctcactctattatctcccaaatgcacgatcgtcctctgcttccttctgagaatattacagcacagcagggcaatatgaaagccctacaggagcagctcgacctacaaaagaaagtgctgcaggccacccaggaggcccaggaacagctcctgctctgtaagcaaaaggaggtggagcagcagaccgggctctctgtgttcctgcccctagttacacccgacagtagtgcacttttacctagcgcaaaagctgatctcggccgcatacaggagagctcccccacaaagaataatatcgctgtatcctcagaccatcacgtcatctcccaattgcaagacaaaagactgagcctcagtcaacccatcctgtcccagcagaataatttcaaattcttgcaagagcagctcaacatccagaaagattccctccaagctcgcagggaggcccaggaggttctatacgtgcataagcaaagcgaactggatcgaagggtgtgtagcgagcaggcggaaccttcttttccattccaggtggctcagcacactttcacgtctttgccatccgccgacaccaaatctggcaaaatacaagagcagcatagtagtaagtctgaaaaaggattggtgtcctgccagtccgacattcccatttcccaggatggcagcctctcgttcctccagcagttcctgccccttcatgatagtctgaaactgctacaagaacagctgactaaacagagagacacacttcaggctagacatgaggcccaggtggagctcctgttacatcggcaacgcgatcttggcgattcaaagagcggtctggtcagctcttcgagctcaccggtcgtcgtccagcactccgtggcatcgcaggcttcggcaaaggcagagccgagaagaattcaggagctttacttgtccgaaaaggagaacgtaggaccctcctgccacctcatcattccaaccttccaggacaagagccttagttttccccaacatagtctggctcagcaggaaaatctcacaatcctccaagagcagagccagatccaacgggtaattctgggcgcaaaagaaggtacacaggagttcgttcacaccgagtccgagctggagaaaagaatttcttctgagcagactggaacctcctcatcattgtctcaagtggacgagagcgaacgcttccaggaatgtatttccatcaaatccgacagtaccatacctctctcgcacccaaagattccccggtgtcaggagaggctgctccgggttagtcagcacatgcttccattacaggacaaccttgaggaacatcaggcatggctcgacaccgaaaaagaagcattccatttcagccagaaaacacaggaaaatacgtcgtcagagcagactggatcaagtagcttcattccacagctggtccagttatcattcactagtctggccagcgctgagagtggcaccatcttggaaccgctgtttacggaaagtgagtccaagattttttcaagtcacctccaaattccccagctgcaggataggctcctgcgcatctcgcagctcatccagccccagcaggacaatttgaaagcactgcaggaacaactcgctacacagagagaagcaataatactagctcgccaagaagctagggaggagctgctgcttcaccagagcgaatgggaggggcgcatctccccggagcaggtggatacttcaagtttgcctctggtgccccagcactccttcgctagcctgcctttgaatgaaagcgagcgaaaccaggagccatgcagtataaattctgataacatagtatcgtcagggcatagcgaaatcccaacgttgcctgacggcctcctgggcctgagtcacctggttctcccacaacaggacaatcttatcgccttagaggagcacctgcatgcacaaacagactttctgcccagcatagaaaaaacgcagaaagaactggtgctctctaaaccatgtaagtttgaagagaaagtttcttccgagcactttatccagagtcaccacggagatctgcaggcccttcagcagcagctggatacacaaaagaaagctataaggtcgatccaggaagtacaggaggagctgctgttgcagaggttgtctgaactggagaagcgcgtttcctctgaacaggtctgcagtagctcattcgtgtctcaggtgcccgtggcggactctgaaagaacacagaagagcttccccactaagagtaatgatacactccctagctctcatcgtgaaatcccccggctccaggatcggctgctgtccttatctaagcccatcctgcctcagcaggacaatatgaccgcgcaattagacgcccagcgggaggtgatgtatagctatgaaaagcctcaggaggaactcagcctaaacaaacagcgaaaactgaacaagtcagaatcagctgaacacaccattccttctttatttcttcccaaagagactgagcattccttcattccactgcctttcgctgaggccaaacccaagtctacttgtgagctgtatagttctcagaatgagcacgcagcgccaccgtcgaacccggtgatcccaggatttcaggatagattgctgagtttctcacaatcggtccttacccagcaggacaatctggggcttcagaagcaactggacctgcagagggaagttctgcactatagccagaaagctcaggagaagcttcttgtccaacgacagaccgcactccagcagcagatccagaaacacgaggaaacattaaaagatttctttaaagactcccaaatttcaaagccaaccgttgaaaatgatctgaagacgcagaaaatggggcagctgagggactggttccctaatacgcaggacctggccggcaatgaccaagaaaatattcggcacgcggaccgtaataattccgatgacaaccatctagcctctgaggacacaagtgccaaacagagcggggagcaccttgaaaaggatctcggccggaggtcaagtaagccccctgttgcaaaggtaaagtgcggattagatctaaatcagcatgaattatcagcaatacaggaagttgagagtcccgccattggtagaacaagtatcctcggtaagccgggcatttacgaggacagggatcctctcagagtgagcatatcacgcgaacagtctttcttcggtagccccctggcacacgatccttttagttgcctccagctcgtcggacaagagaacgtgtgcggcgatgattatgatgaggctgtcaagttaaaggagtcagttgtagagaatcacgccgtgttatcatacgctgttgaagaggagcatgcatatctgggtccgaccgtaaaaccggacgacaaagcaaaaaccctctcatacgagccgttatcaagcgccactgtgtctacaggaagtcttctgagctatgaaaacaccgacctgagcctgactgacccagagtccttctccgaacacatggacgatagcaagcaggagagtaccacatcgaaggaggaagagacaaacattatttcgagtattgtgccgtccacacaggacatctatcagagacagaatagcagtgatgtgcacaaatccttgctacccgctgtcgacgagacaacctgcggtcacacacactttcaacagatgatcgacaaatacattaatgaagctaatctgatcccggagaagaccgatctgcaagagttagagcatatctttcccaacctgcatcatcaattattcaagcctcttgaacctcaccccgacttcgatctgagcagcagcagttcgggtatcagccccgataaccgggatttctaccagaggtccgattcaagcagtgagtctcactgcgctactggtctctctaagtcaaccgtgtacttcactgctctgcggcgaacttcgatgcacagcagtctcaatactagccctaatcagcagcccgatactaatctggcccatgtgggcgcccatagcttcgccaccgagaacatcatcgggggctcggagcagtgttttgagcagctccagcctgaatacagctctcaggaagagtcccagcacgccgacctgccttcaatatttagcatagaggccagagatagcagccagggcatgaaaaaccagaactaccccagcgaagagcacaccgaaatactacagaacaaaaaaaagatcgtccatttccagttgagcattgggaacctcagcagcgtctactcctcatctgatgaagcaaacgtgtttgaccaactgaatgtccagcacagcactccctgtggcagtaactcctccgagtgttctaccaagcaccagctggagtcccgaaaggagagcatgggttttgaagagctttcaaaacgcggggtggtgacaatgttgcaaagccaaggtctgattgaggataataagaacgagacatgccgggtgctcgatattaacccacaggtggaggaaactgactcaagactgtgcgtccggaccgtcgagatgggtacttccattcaggccccatacagtctcacgactcagaatgagaaatattttgaaaactcggcggagactgatatcccgaaaatcacgaaaaagctgtctcagcttggcgagtctgaactgttcgcctctagcgggtcgttttcccttcaatcgtctattccggtttgggagacagagaccggccacggaattatggaggaacccgagctgacactgatcagcactaccgatacatctattgcagagatggatttcgctaacttaacacttgaagaaaaatctgagaacgaggctaaatgcttcttccaagtatccgaattcctgccgctggtctctgcaaccgaggcatccgattacccagcagtcagcgagctgtcaattgagaaacctcggaccgccagtaccgagactcctaggcgtctgactcccgtacctggcagcctccaggaagctttcattaaacgcaagaagtctttcatggaacggtctcaccaacggcagaaagagattcggaataagatccatgtgtccgaaaattcacaaattaaaactgtgaaggagaagcctagtatttctagctccgtgtcacgcctgaagggagtgaacaaggtccgagcctccttccccgaggatcggaagacgacgcaggcattacgccaccagcgcggcctgcggctgtacaaccagctcgccgaagtgaagcagcaaaaagaggaaaaaaccaaacaggaggcgtacgcccaaaatcgcgcaagggccaaggaatttcacaagaaaacgctggagaagctcagggccaaaaacacatgttag

SEQ ID NO: 14516 - DNA, 2397 bp, Artificial Sequence
  Description of Artificial Sequence: Synthetic coding sequence
atggcggctagcctacccgggccgggatctcgcttgtttagaacctacggagctgcggatggacgtcggcaacgacgacccggcagagaagcagctcagtggttccctccccaggatagacgccggttctttaacagcagcggctccagcgatgcctcaattggtgatcccagccagtctgatgatcccgacgaccctgatgaccctgattttccaggtagtccggtccgaagacgacggcggcgtcccggtggccgggtgcccaaagacaggcctagcctcactgtaacacccaaaagatggaagctgagagcaagaccctcactgacggtaacccccagaaggctgggtctgcgtgcacggccaccccaaaaatgttccactccctgcggtccactgaggctccccccctttccctccagggattcgggccggcttagccctgacttgtcagtgtgtggccagccccgcgacggggatgaattagggatctccgctagtctgtttagctccctcgcatccccctgccctggctcacccacaccaagggatagcgtcatcagcattggcacatcagcatgcctggtggctgcaagcgctgtcccctccgggttacacctcccagaggtaagtctcgaccgggcctccctcccctgttctcaggaggaggccactggcggcgccaaagacactaggatggtccaccagactcgcgccagcctgaggagcgtgctgtttggattaatgaattcagggacgcctgaggattcagagtttcgcgcagatggcaagaacatgagagaatcttgctgtaagcgtaaactggtggtcggaaacggaccggaaggcccaggactgtcttctactgggaagcgccgtgctacaggacaggatagttgccaagagcgcggactccaggaggccgtgcgtcgtgagcaccaagaggctagcgtgcctaaggggcgaatcgtcccccggggcattgatagactggagcgaacccgctctagtcggaagtccaagcatcaggaagcgacagagacaagtctcctacacagccacagattcaaaaagggtcagaaactcggcaaggactcatttcccactcaagatcttacccccttgcagaacgtgtgcttttggaccaaaacaagggcttcattttcctttcataagaagaagatagtcactgacgtgtcagaagtctgtagcatttacacgacagctacctctctttccggctctctgctttctgagtgcagcaacaggccagtcatgaaccgaacctctggtgcaccttccagctggcacagcagtagtatgtacctgctttctcccctcaacactttgtctattagtaacaaaaaggcttcagacgccgagaaggtgtacggtgaatgttcacagaagggaccagtacctttctcacactgcctgcccaccgaaaaactgcagcggtgtgagaaaattggtgagggcgtgttcggcgaggtgtttcagacaatagctgaccacacacctgtagctataaagataatcgctatagagggccctgatctggtgaatggaagccaccagaaaacgttcgaggaaatacttccagagatcattatttccaaggagctgtcacttttaagcggtgaggtgtgtaaccggacggaaggattcattgggttaaacagcgttcactgcgtccaaggatcttatccaccactgctgctcaaggcctgggaccattacaattcaacaaagggctccgccaacgataggcctgatttttttaaggacgatcaactgttcatcgtgcttgaattcgaattcggaggaatagacctagagcagatgaggaccaaattatcatctttggccacagccaaatcaatcctgcatcaacttactgcgtcactcgccgtggcagaagcttctctgcgtttcgagcaccgggacttgcactgggggaatgttttactgaagaaaacatcactgaagaagctgcattacacacttaacgggaagtccagcacgattcccagctgcggcttgcaagtaagcataatcgactatactctgagcaggctggagcgcgatggcatcgtagtattctgtgatgtcagcatggatgaagatctctttactggcgacggagattaccaattcgacatttaccgccttatgaagaaagagaataacaataggtggggagagtatcacccctatagtaacgtgctgtggctgcattacctgactgataagatgttaaaacagatgacctttaagaccaaatgtaacacacctgcaatgaagcagattaagcgtaaaatccaggaatttcacagaaccatgctgaacttttcaagcgctactgacctgctgtgccaacactccctttttaaatag

SEQ ID NO: 14517 - DNA, 765 bp, Artificial Sequence
  Description of Artificial Sequence: Synthetic coding sequence
atggttcgggaggccaatataaagcaggctaccgctgagaaacagctgaaggaagctcagggcaaaattgacgtgcttcaagccgaagttgctgcccttaagacactggtgctgtcatcttcccctacgtctcctactcaggagcctctgccagggggcaagacccctttcaaaaagggccataccagaaataagagcacttcctctgctatgtctggatctcaccaggatctctccgtgattcagccaattgttaaggactgtaaggaggcagacttgagcctctataatgagtttagactgtggaaagacgagccaactatggacaggacctgcccattcttagacaagatctaccaagaggacattttcccctgcttgaccttttccaagagcgagctggctagcgccgtactcgaagcggtggagaataataccctgtccatagaacctgtcgggcttcagcccatacgttttgttaaagcatctgctgtggaatgcggggggcccaaaaaatgtgctcttaccgggcagtccaaatcctgcaagcaccgcataaagctgggagactcctctaattactactatattagccccttttgtcgctaccgcattacaagtgtgtgcaatttcttcacctatattagatatatccaacaggggctggtgaagcagcaggacgtagaccagatgttttgggaagtgatgcaactgcgcaaagagatgtcactcgcaaagctgggttacttcaaggaagaactatag

SEQ ID NO: 14518 - DNA, 1077 bp, Artificial Sequence
  Description of Artificial Sequence: Synthetic coding sequence
atgtatgcttctcagtggttcttgacattatttaccgcgaagttccccctttgcatggtctttcatattattgacctgcttctctgtgagggactcaacatcattttccatgtagctctcgcactgctgaagactagtaaggaagacctacttcaggcagacttcgaaggtgccctcaagtttttccgcgtgcaattgccaaaacgctatagagcggaagagaacgcacggcggttgatggaacaggcctgcaatattaaggttccaaccaagaaacttaagaaatacgagaaagagtatcagacaatgagagagtctcagctccagcaggaggaccccatggatcggtataagcgagagaaccggaggctccaggaagcctccatgcgtctggaacaggagaacgatgacctcgctcatgagcttgtcaccagcaaaatcgcacttcgtaatgaccttgatcaggctgaggataaggccgacgtgttgaacaaggagctgcttctgacaaagcaaaggttagttgagaccgaagaagagaaaaggaaacaggaggaagagaccgctcaactgaaggaggttttccggaaacaacttgaaaaagccgaatatgaaatcaagaaaaccactgccataattgcggagtataaacagatctgctctcagctttcaacacgcctggagaaacagcaagctgcctccaaggaagaactcgaagtggtgaaggggaagatgatggcctgcaaacactgttccgatatctttagcaaggagggtgcattaaagctggccgcgactggccgggaggaccagggaattgagacagacgatgaaaaagattctctgaaaaaacagcttagagaaatggaattggaactcgcccagaccaagctgcaattggttgaagccaagtgcaagatacaggagctggaacaccagcggggggctctgatgaacgagattcaggccgccaagaactcttggttctctaagacgttaaactcaatcaaaacagcaaccggcacgcagcctcttcagcccgcgcctgtgacccaaccaccaaaggaatctacatag

SEQ ID NO: 14519 - DNA, 2436 bp, Artificial Sequence
  Description of Artificial Sequence: Synthetic coding sequence
atgcccctgagctctccaaacgccgctgccacagcaagcgatatggacaaaaacagtggttctaactcttcctccgctagtagcggaagttccaaagggcagcagccgcccagatctgcatctgccggacctgccggcgaaagcaaacctaagagtgacggaaaaaacagcagcggatcgaagagatataatagaaaacgagagctctcatatccaaagaatgaaagtttcaataatcagtcgaggaggtcttcttcacagaagtcaaagactttcaacaagatgcctccacagaggggcggggggtcatccaagctttttagctcctcctttaacggcggaaggcgggatgaggtcgccgaagcccagagagctgagttcagccccgcacaattttcaggccctaaaaaaatcaatttgaatcacttgctgaacttcactttcgagcctcgtggccagactggccactttgagggttctgggcatggttcctgggggaaacggaacaaatggggacacaaacctttcaataaagaactcttccttcaagcaaattgtcagttcgtcgtgtccgaggatcaggattatacggctcacttcgcggatccagacactctcgtgaactgggacttcgtcgagcaggttagaatctgctctcacgaggtcccaagctgtccaatatgtctatacccacccacagctgcaaaaatcacccgctgcggacacatcttctgctgggcctgtattcttcattatctgtcgctcagcgagaaaacctggagcaagtgccccatctgttatagcagcgtccacaaaaaagatttaaagtcagtggtcgcaactgagagtcaccagtatgtcgtaggagacacgatcacaatgcagctcatgaaacgggagaagggcgtacttgtagcactccctaaatcaaaatggatgaatgtagaccaccccatccacctgggagacgagcagcattcccaatactcgaagctcctcctggcatccaaggagcaggtgcttcacagggtggtgttagaagaaaaggtcgccctggaacagcaactggccgaggaaaaacacacgcctgagagctgctttatcgaggccgccattcaggaattgaagacaagagaagaggccctcagtgggctggcagggtcccgacgggaggtgactggggttgtcgccgccttggaacaattagtgcttatggcccccttggctaaggaatctgtttttcagcctaggaagggtgtgctggaatatctgagcgcctttgatgaggaaactacagaagtgtgttctctggatactccctccaggcctctggctctgcccttagtggaagaggaagaggcagtgtctgagcccgaacctgagggcctgcctgaagcctgtgacgacttggaactggccgatgacaatttaaaagaaggaacaatttgcactgagtcatcgcagcaagagccaattactaagtcgggttttacaagactgagctcaagcccctgctactacttctaccaagcggaagacggccagcatatgtttttacacccggtgaacgtccgttgtctcgtaagagagtatggcagccttgaacggtcacccgaaaaaatcagcgctaccgtggtggagattgctgggtactcaatgtccgaggatgttaggcaaagacatcgatacctgtcacatctcccgctcacctgcgaattctcgatctgtgagctcgccctgcagccccccgtcgtttccaaggagacactggagatgttcagcgacgacatcgagaagcggaagcggcagagacaaaagaaagctcgagaagaaagaagaagggaacgacgtattgaaatcgaagaaaacaagaaacaaggaaaatacccggaagtgcacatacccttggagaacttgcagcagttcccagccttcaactcctacacctgctcctctgatagcgcgctaggccccacttctaccgagggccacggggccttatcaatttctccacttagccgaagcccaggttctcatgcagactttttacttacaccactgagccctacagcatcacaaggcagcccctcattttgtgtgggttcacttgaggaggattctcctttccccagcttcgcccagatgttacgagttgggaaagctaaagcagacgtgtggccaaagacggcgcctaaaaaagacgagaactctctcgtgccgccagccccagtcgatagcgatggagaatccgataactccgatcgagtgcccgtgccttctttccaaaattccttcagccaggctatcgaggccgctttcatgaaactggacacccctgccacaagtgatcctctgagcgaagagaagggagggaagaagaggaagaagcagaagcaaaagttgcttttctcaaccagtgtcgtgcacacgaaatag

SEQ ID NO: 14520 - DNA, 5826 bp, Artificial Sequence
  Description of Artificial Sequence: Synthetic coding sequence
atgaaaacatcagaccttgtgcccagtttcgggtatttcattaggtcccctgaaaaaagggaaccaatagccctgattcggaagtcagacgtgtcaaggggaaatctagaaaaagaaatggctcacttgaatcacgatctctactccggggacctcaatgaacagtcccaggctcagctcagcgaaggctctattacgctccaggtggaagccgttgagagtacttcacaggtagatgagaatgatgtgaccttgacagctgacaaaggtaagacagaagatacattttttatgagcaataagccgcagcggtacaaggataagctgcccgatagcggcgattcaatgctacgcataagtaccatagcatccgccatcgccgaagcttcagtcaatactgatccatcgcagttggcggcaatgatcaaggcattgtccaacaaaacccgggataagacatttcaggaagatgagaagcagaaagactattcacatgtgcggcatttcctgcccaacgatctggagaagtctaacgggtcaaatgccctcgacatggagaagtaccttaagaaaactgaagtcagccgttatgaaagtgctttagaaaatttttcccgggcatcgatgagtgatacatgggacctctccttgcctaaggaacagaccactcaagacattcatcccgtggacttgtccgccacttcagtgagtgtgcgtgcccccgaagaaaatacagccgccatcgtgtacgttgaaaacggtgaaagcgaaaatcaagaatcctttagaacaatcaactcctctaatagcgtgaccaaccgagaaaacaattcggctgttgtcgacgtgaaaacctgttcaatcgacaataaactacaggacgtgggtaatgatgaaaaggcgacatccattagcacacctagcgacagctacagctccgtgagaaatcctcgtattaccagtctttgtctactgaaagattgcgaagagatacgcgataatcgcgagaatcagagacaaaacgaatgtgtgtccgaaatttctaactcagagaagcatgtcacctttgaaaaccaccgaatcgtttcaccaaagaacagcgatttaaagaataccagcccagagcacggggggcggggcagtgaggacgaacaggaatcttttcggccgtccacctctcccttgtcacactcatccccatccgagattagcggaaccagtagctctggatgtgcactagaatcatttggctccgccgcccaacagcagcaacctccgtgtgagcaggagctgagccctctggtgtgtagccccgcgggcgtgtctcggctcacgtacgtgagtgagcctgagagctcttacccaaccacggctactgacgacgcattggaggatcgaaagtccgatataaccagtgagctttccacgactattatacaagggtcaccagccgccttggaggaacgtgctatggagaagcttagggagaaggttccatttcagaaccgaggaaaagggactctgtcttccatcatccagaacaacagcgatacccgaaaggcgaccgagaccacctctctgagctccaagccggaatatgtgaagcccgatttcagatggagtaaggatcctagcagcaagtcaggaaacctactggaaacgtcggaggtgggctggacatctaatccagaagaactggaccccattagattagccctcctgggcaagtccgggttatcatgtcaagttggcagcgccacaagccatccagtgagctgccaggaacctattgatgaggatcaaagaatctctcccaaggataaaagcaccgctggcagagagtttagcggtcaggtgtcccatcagacaacttccgagaatcagtgtacgcccatcccctcctccacggtgcactcctccgtcgccgatatgcagaacatgcctgctgcagtgcacgcactacttactcaaccatcgctgagcgccgctccatttgcccagaggtacctcggaaccctgccgtctactggcagtacaacactccctcaatgccacgccggaaacgccactgtgtgcggattctcaggcggcctgccataccctgctgtggctggcgaacccgtccagaacagcgtggctgttgggatatgcctcggttctaacatcggatctggttggatgggaacatcatccctctgtaacccgtatagcaatacccttaaccagaatctgctgtctactacaaagcccttccctgtgcctagcgtggggaccaactgcggaatcgagccatgggattctggtgttacatcaggcctagggtccgtgagggtacctgaggaactcaagctgccacacgcttgctgcgtcgggatagcctctcagaccctgttatccgtgttaaaccctactgataggtggcttcaagtttctatcggtgtgctgtcaatctccgttaatggagaaaaggtggacttgtccacctatcggtgcctggtcttcaagaacaaagctatcataagacctcacgccaccgaggagattaaggtgctgttcattccaagctctcccggggtgttccggtgcacctttagcgttgcgtcctggccctgtagcaccgatgcagaaaccatcgttcaggcagaggccttggccagcactgttacgctcactgccattgcagagtcccccgtgattgaagtcgagacagagaagaaagacgtgcttgactttggcgatctcacctacgggggatggaaggctctcccgctcaagcttattaacaggacccacgctacagtccccatcaggcttattattaacgctaacgcagtcgcatggcgatgctttacattcagcaaggaatccgtccgagcacctgttgaagtggcgccctgcgccgacgtggtcactcgtctggctgggcccagtgtcgtcaaccatatgatgcccgcctcctacgacggtcaggatcccgagtttctcatgatctgggtgctctttcatagccccaaaaaacagatctccagcagcgatatcctcgactctgcggaagaattttctgcgaaagtcgatatcgaggtcgactcccctaatccaactcccgtgctcagaagcgtgtcactgcgggccagagccggcattgcccgtatacatgcacctagggacctgcagacaatgcacttcttagccaaggttgccagtagccgcaagcagcacctgcccctcaagaacgccgggaatattgaggtctaccttgatattaaggtgcctgagcaaggctcccatttctccgttgatcctaagaacctgctgttgaagccgggcgaagaacacgaagtgattgtgtcttttacaccgaaggatcccgaagcttgtgaggagcgcatcttaaagattttcgtacaaccctttggcccacagtatgaggtggtgctgaaaggtgaggtcatctcgtccgggtccaagcctctgagtcccggcccatgccttgacattcctagcatcctttccaacaaacagtttctcgcatggggcggagtaccgttgggcaggacacagttgcagaaactggctctacgtaacaactctgccagcaccacacagcatctgcgtctcctgattaggggacaggatcaggactgtttccagctgcagaacaccttcggctctgagcagcggctcacttctaactgtgagattcggatccatccaaaagaagatatttttatcagcgtcctctttgcacctaccagactatcttgcatgcttgcccgccttgagattaagcagctcggcaatagaagccagcctggaataaagttcacaattcctctgagcggctacggcggaacaagcaacctgatcttagaaggagtcaagaaactgagcgattcatacatggttactgttaacggtctcgtgcccggaaaagaaagcaagatcgtattcagcgttcgcaacactgggtcccgcgcagctttcgtgaaggcagtcggattcaaggatagtcaaaaaaaggtgttgttagacccaaaagtcctgcgaatctttcccgataagtttgtattgaaggagcggacacaggagaacgtgacactcatttacaatccgtccgacaggggaatcaataacaaaaccgctactgagctctcgacagtgtatctgtttggcggggatgagattagtagacagcagtataggcgcgccctgctgcacaaacctgaaatgattaagcagatcctccccgagcattcagtcctgcagaatatcaacttcgtggaagcctttcaagacgaactacttgttactgaggtgtatgacctgccccagcgccccaacgacgtgcagctcttctatggttcaatgtgtaagatcatcctgtcagtcattggagaattcagagactgtatctcttctagagagttcctccagccatccagtaaagcgagcttggagtccacgtccgatctgggtgcatccggaaaacacgggggaaatgtttcactcgacgtgttgcctgtgaaaggtccacagggctcgcccctcttgtcccgagcggctagaccacctctggaccagctcgcttctgaggagccatggacagttcttccagagcacctgatcttggtggctcctagtccatgcgacatggctaagactgggcggtttcagatcgtgaacaactccgttagactgttgagatttgaactctgctggcccgcacactgcctgaccgttacgccccagcacggctgtgttgctccagaatccaaactccagattctggtgagccccaactcaagcctgtcaactaagcaatctatgttcccctggagcggactaatatacatccactgcgatgacggacaaaagaaaatcgtcaaggtacagattagagaggacctgacacaagttgagctgctcactcgccttacctctaaacccttcggaattctttcccctgtgagtgagccatccgtcagtcatcttgtgaaaccaatgactaaacccccttccaccaaagtggagataagaaataaaagtattactttccccaccacggagcccggtgaaacatccgagtcatgtcttgagctagaaaatcacggaaccacagacgtcaaatggcacctttcgtctctggccccaccctacgtgaaaggggtggacgaatcaggtgatgtgtttcgggccacatatgctgcgttcaggtgctcaccaatctctggtctactggagtcacacggtatccaaaaagtcagcatcaccttcttgccaagaggaaggggggattacgcccagttctgggatgtcgagtgccacccgctgaaggagccccatatgaaacataccctgaggttccagctctctggccagtctatagaggctgaaaatgaaccagaaaacgcctgtctgagcacagactccttaatcaagatcgaccacctagtcaaaccacggcggcaggcggtcagcgaagcaagcgcccgcatcccagagcaactcgacgttacagcccgcggtgtatacgctcccgaagacgtttatcggtttcgccccaccagcgtgggcgaaagtaggactctcaaagtgaatctgcggaataatagttttatcacacactccctgaagtttctttccccacgcgagcctttctacgttaagcacagtaaatattcactcagggcacagcattacataaacatgcctgtccagtttaagcctaaatcagccgggaagtttgaggccctgctggtgatccagacggatgagggtaaaagtattgccatccgcctgattggcgaagcattgggtaagaactag

SEQ ID NO: 14521 - DNA, 4167 bp, Artificial Sequence
  Description of Artificial Sequence: Synthetic coding sequence
atggccccaggctgtaaaacagagcttagatcggtgacaaatgggcagtcaaaccagcccagtaacgagggcgatgctatcaaagtgttcgtgcggatacggcctccggccgagcgctcaggctcagccgatggggagcagaatctgtgcttgagtgtactgagttccactagcctcaggcttcacagcaatccggaaccgaagactttcacatttgatcatgtggccgatgtggatactactcaggagagtgtttttgccactgtcgccaaatctatagtggagtcttgtatgtcgggttacaatggaacaatcttcgcgtacggtcagactggaagtgggaaaacatttacaatgatgggaccgtcagagtcagataacttttcacacaacttacggggcgtgatacctagatctttcgagtatctgtttagccttattgacagggagaaggaaaaggcaggcgccggcaagtctttcctgtgtaaatgctcatttatcgaaatttacaatgagcagatctacgatctgctcgacagtgcgtcggccggactgtacctgcgggaacacataaaaaagggcgtcttcgtggttggtgcagtcgagcaagtagtgacttcagctgccgaggcctaccaggtcttaagcggtgggtggcggaaccgtagagtggccagcacaagcatgaaccgagaatcatcacgatcccatgctgtctttaccatcacaattgagtctatggagaaatccaacgagatcgtgaatataagaacctctctgctgaatctcgtcgatctggcaggctccgagcggcagaaagatactcacgcagaaggaatgcgtcttaaggaagctggaaatatcaatcggtccctgtcctgtcttggacaggttatcaccgccctagtagacgtgggcaacggaaaacaacggcacgtgtgttacagggatagcaagctgacgtttcttctaagagactccctgggaggcaacgccaagactgctatcatcgccaacgtgcacccaggatcgaggtgttttggagaaaccctgtctacactgaatttcgcccagagggccaaattgataaaaaacaaggccgtggtgaacgaggatacgcaaggcaacgtcagccaactccaggccgaggtgaaaaggctcaaggagcagctggcagagctggccagtggtcagactccccccgagtcgttcctgactagagataagaagaaaaccaattatatggagtattttcaggaagccatgcttttttttaagaaaagcgaacaggaaaaaaaaagcctgattgaaaaggtaacacagctggaagacctcaccctgaagaaggaaaagtttatacagtctaataagatgattgttaagttccgtgaagatcagattatccggcttgaaaaactgcacaaggagtccagaggcggcttcctcccggaagagcaggacagactgctttctgagctaagaaatgaaatccagactttgagagaacagatcgagcaccatcctcgagtagccaaatacgcgatggagaatcacagcctgagagaggaaaatagaagactgcgcctactagaaccagttaagagagctcaggaaatggacgctcaaacaattgcaaagctcgaaaaggctttttccgaaatttcaggaatggagaagagcgataagaatcaacagggatttagcccaaaagctcaaaaagagccttgccttttcgccaacaccgagaagttgaaagctcaactcctgcagatacagaccgaactcaataattcgaaacaggagtacgaagagtttaaagagctgaccagaaaacgtcagctcgaattggagtcggagctccagagcctccagaaggctaatttgaacttggagaaccttctagaagcaacaaaggcatgcaagagacaggaagtgagtcaactaaacaaaatccatgccgagaccctgaagataattactaccccaaccaaggcctatcagttgcattcccgtccagtaccgaagctatctccagagatggggtcttttggaagtctctacactcagaacagctcgattttggataatgatatattaaacgagcccgttcctccagaaatgaacgaacaggctttcgaggctatctctgaggagctcaggacggtccaggagcaaatgagtgccttgcaggctaaattggacgaggaagagcataaaaacttgaaactccaacagcatgtggataagttagaacatcatagtacccagatgcaggagctcttctcctctgagcgaatcgactggacaaagcaacaggaagaacttctgagtcagttgaatgtactggaaaagcagctccaggaaacccagaccaaaaacgattttcttaagagcgaggtgcacgatttacgggtggtgctgcactctgctgacaaggagctatcaagcgttaaactggagtactcctcctttaagaccaatcaggaaaaagaattcaataagttgtctgaaagacatatgcatgtccagctccagctcgataacctgaggctggagaatgagaaactgctggaatccaaagcttgcctgcaagactcatacgataatctgcaggaaatcatgaagtttgaaatcgatcagctcagcaggaatctgcaaaactttaagaaagaaaatgaaactctaaaatcggatttgaataacctgatggaactcctagaagccgaaaaggaacgcaataacaagcttagtctccagtttgaagaagataaggaaaactcttctaaggagatcctgaaggtgttggaagcggtccgtcaggaaaaacagaaagagactgctaaatgtgagcagcaaatggcaaaggttcagaagcttgaggaaagtctgttagccaccgagaaagtgatttcgtccctcgagaaaagccgggactctgataaaaaagtcgtggccgacctgatgaatcaaatccaggagctccggacctccgtctgcgagaagaccgagaccattgacactctcaaacaagaactgaaggacatcaactgtaaatataatagcgcgctggttgatagagaagagtcccgggtcctcataaagaaacaggaggtggacatcctggatctgaaggagaccttgagactacgaatcctcagcgaagacatcgagcgggacatgttgtgtgaagaccttgctcatgccaccgagcagctgaacatgctcacggaagcctctaagaaacattcaggactccttcaatccgctcaggaggaactcactaagaaggaggctctcattcaggaactgcagcacaagctcaaccaaaaaaaggaggaggtggagcagaagaagaacgaatacaactttaagatgagacagctggagcatgtaatggattcggcagccgaggatccccagtcaccgaaaacccccccgcattttcagacacatctcgcaaaactcctagagactcaggagcaggaaattgaggatggcagggcctcgaaaacttctctggagcatctcgtcaccaaactcaacgaggatagggaggttaaaaatgccgagatcctgaggatgaaagagcaattacgcgagatggagaatctgcggctggagagccagcagctgattgaaaaaaattggttgttacagggccaattggacgacattaagcggcaaaaggaaaatagcgaccaaaaccaccctgacaatcagcagctcaagaatgaacaggaagagagcattaaagagcgtttggccaaatccaaaatagtcgaagagatgctaaaaatgaaagcggatctggaagaggtacaaagcgctctttacaacaaggagatggagtgtctgcgtatgacagacgaggtggaacgcacccaaacgctggagtcaaaagccttccaggagaaggaacagttgcgatccaaactggaagaaatgtacgaggaacgtgaacgaacatcacaggagatggagatgctgaggaaacaggtggaatgcctggccgaggaaaatggcaagctggtagggcaccaaaacttgcatcagaagatccaatacgtggtgagactcaagaaggagaacgtgaggctcgccgaagagactgagaagttgagggctgaaaacgtctttctgaaagagaaaaagcgcagtgagtcatag

SEQ ID NO: 14522 - DNA, 4767 bp, Artificial Sequence
  Description of Artificial Sequence: Synthetic coding sequence
atgttgccacctaaacacctgagcgctacaaaaccaaaaaagtcctgggcccctaatctgtatgagctagatagcgatttgaccaaggagcccgacgtgattatcggcgaagggccgactgacagtgagttctttcaccagagattccgcaacctgatatacgttgagttcgtgggaccaaggaaaactttgattaagcttcgcaacttgtgtctcgattggctacagcccgaaacaaggaccaaagaagagatcattgagcttctggtgttggagcagtacttgaccataatccccgagaaactgaagccctgggttcgcgccaagaaacccgaaaattgtgaaaaactggtgaccctcctggaaaattataaagagatgtaccaacccgaggacgacaataactcagatgtgaccagcgacgatgacatgacgcgaaaccgccgcgagtccagtcccccccactctgtccatagtttcagtgaccgcgactgggatcggcgcggacggagccgggatatggagccccgggacagatggagccacactcgtaatccccgatcaagaatgccccccagggacctctccttacccgttgtcgccaaaacatcatttgaaatggacagggaggatgacagagatagccgcgcatatgagagccgatcccaggacgcagagtcttatcaaaatgtggttgacctggccgaagatcgcaagcctcacaacactatccaagacaatatggaaaactatagaaagttgctgagccttgtgcagctagcagaggacgacggacattctcacatgacccagggccactcctcccggagtaagaggtcagcgtatcctagtacatctcgcggcctgaagactatgccagaagcaaagaagtcaacacatcgccgcgggatctgtgaggatgagtccagccatggggtcatcatggaaaagttcatcaaggacgtgagccggagttctaagtctgggagggccagagagtcaagtgaccgatctcagcgatttcctaggatgtctgacgataactggaaggacattagcctgaataagagagagtcagtgattcagcagagagtgtacgaaggcaatgcctttagaggcggctttagatttaactcaaccctcgtgagtagaaagagagttctcgagcgcaagcgaagatatcattttgataccgatgggaaaggtagtattcatgaccagaaaggctgtccaagaaaaaagcctttcgaatgtggctccgagatgcgaaaggctatgtccgtctcctcgctctccagcctgagtagtccttccttcaccgagagtcaacccattgacttcggcgctatgccatatgtctgtgatgagtgcggcagaagctttagcgtaatctccgaatttgtcgaacaccaaatcatgcatacacgcgaaaacctatatgaatacggcgagtcgtttatccacagtgttgcagtctctgaagttcagaaaagccaggttggcggaaaacggttcgaatgtaaagactgtggtgaaactttcaacaagtccgctgccttggccgagcaccgaaaaatacatgcccgcgggtacctcgtggaatgcaaaaaccaggagtgcgaagaagccttcatgccctcccctacatttagtgaactgcagaaaatctacggtaaagataaattctacgagtgccgtgtatgtaaggaaactttcctgcacagttccgcgctgatcgagcatcagaagattcactttggtgacgataaggacaatgaacgagagcatgaaagagagagggagagagaaaggggagagacatttagaccgagcccggctttgaatgagtttcaaaaaatgtacgggaaggagaagatgtacgaatgtaaggtgtgtggggaaacttttctccactccagctcactgaaggaacaccagaagatccatactcgcggaaatccctttgagaacaagggcaaagtgtgtgaagagaccttcattcccggacagtccctaaaacgcagacaaaagacatacaataaagaaaaactctgcgatttcactgacggaagagacgcattcatgcagagctctgagctctccgagcaccaaaagatacatagtagaaaaaatttgtttgagggcaggggatacgaaaagtctgtgattcactcaggcccctttacagaaagccagaagagtcataccatcacacgtccgcttgagtccgatgaggacgaaaaagcattcaccatctcttctaacccatacgagaatcagaagattccaactaaggaaaatgtgtacgaggccaagtcttatgaaagaagtgtgatccactctctggcctccgtggaggcacaaaagtcccatagtgtcgcggggccatcgaagccgaaagtcatggccgagtcgaccatccagtccttcgatgccatcaatcaccagcgagtgcgggccgggggaaacaccagcgagggtcgcgagtacagcagaagcgtcatccattccctggtcgcgtctaaaccacccaggtctcacaacgggaacgaactggtcgaatccaacgaaaagggggagtcctctatatacatctccgaccttaacgataaacgccaaaagataccagcaagagaaaatccttgcgagggggggagcaagaatcgaaactacgaagattctgttatccagagtgtgttccgcgccaagccccagaagagcgtgccaggtgagggcagtggcgagtttaagaaagatggtgaattttccgttccatctagtaatgtgcgggaatatcagaaggccagagctaagaaaaagtatatagagcacaggtcaaatgaaaccagcgtgatacattccctaccttttggagagcaaacatttcgccctagagggatgttgtatgagtgccaagaatgtggggaatgtttcgcccattcttcagacttaaccgagcatcagaaaatccatgatagagaaaaacccagcggttccagaaactatgagtggtcagtcattcgcagcctggccccgactgacccccaaacttcttacgctcaggagcagtacgcaaaagagcaggcgcgaaataaatgcaaagatttcaggcagttcttcgcgacaagcgaggatttgaacaccaaccaaaaaatttatgaccaagagaaaagccatggcgaagaatcacagggcgagaacaccgacggcgaggaaacacattcagaagagacccatggtcaggaaactatcgaggatccggtgattcagggctctgacatggaggacccacagaaagacgatccggatgataagatatatgagtgcgaggactgtggtctcggattcgtggaccttacagacctaactgaccaccagaaggtgcactcaagaaaatgcctagttgattccagagagtacacccattctgttattcacacgcactcaatctcagagtaccagcgggactacaccggcgagcagctgtatgagtgcccgaagtgcggcgagtcatttattcatagtagctttttgtttgagcaccaacggatccatgagcaggaccaattatacagtatgaaagggtgcgacgatggcttcattgcactgctccccatgaagcctcgcagaaaccgtgccgctgagagaaacccagcactggcaggctcggctatccgttgtttattgtgtggccaagggtttattcacagtagcgccctgaatgagcacatgcggttgcaccgtgaggacgatctacttgagcagtctcaaatggcagaggaggcaataatccccggcctcgctttaacggagttccaacgctctcagacagaagagagactgtttgagtgtgcagtctgtggggagagcttcgtgaaccctgccgaattagcggaccatgtcacggtgcacaagaacgaaccttatgaatatggcagctcttatactcacacttctttcctgacagaaccacttaaaggagcaattcccttttacgagtgcaaggactgcggcaaatcctttatacattcaaccgtgctgactaaacacaaggaacttcacctggaagaagaggaagaggatgaagctgctgctgcagccgcggccgcggcgcaagaggtagaagcgaatgtgcacgtgccacaagttgttctcagaatccaaggtctcaacgtcgaggctgccgagcccgaggtggaagccgctgaaccggaggtggaagctgccgagccggaagtggaggccgccgagccgaatggggaggcagagggacccgatggagaagccgccgagcccattggtgaggccggccagccgaatggagaggccgaacagccgaatggagacgctgacgagccagacggcgccggcatcgaggaccctgaggaaagggctgaggagccagaaggaaaagctgaagaaccagaaggggacgctgatgagcctgacggagtggggatcgaggacccagaggagggagaggatcaggagatacaggtggaggaaccatactatgattgccacgaatgcacagagacgtttacctcctccacggctttctctgagcatctcaaaacgcacgcctctatgataatcttcgagcccgcaaacgcttttggggagtgcagtgggtacattgagagggcctctacaagcactgggggagccaatcaggcagacgagaagtatttcaaatgtgatgtttgcggtcaacttttcaatgaccggttgagcctggcgaggcaccagaatacccacaccgggtag

SEQ ID NO: 14523 - DNA, 2508 bp, Artificial Sequence
  Description of Artificial Sequence: Synthetic coding sequence
atgggcaattataaatcccggcctacacagacatgcactgacgagtggaagaagaaagttagcgagtcctacgtaatcaccattgaaaggctcgaggacgacttgcagatcaaggagaaagagctaacagaactgcggaacatatttggctctgatgaggcttttagcaaagtgaatctgaattacagaaccgagaatggcctatccctcctgcacttgtgctgtatttgtggcggaaagaaaagccacatcaggacccttatgttgaaaggactccggccatctcgtctgactcggaacggttttacagccctgcacctggctgtgtacaaggacaatgccgagctcatcacttccctgctgcatagcggcgcagacattcaacaggttggctatggaggactcaccgcattgcacattgccacaatcgccggtcatctggaggctgctgacgtgttattacagcatggcgccaacgtcaacattcaggatgctgtgtttttcacccctcttcatattgccgcctactatgggcatgagcaggtcacacgcctgttgctcaaattcggagccgatgttaacgtgagcggagaggttggggatcggcctctgcacctggcctctgccaagggttttctcaacatagcgaagctgctcatggaggagggatccaaggctgacgtcaatgcccaggacaatgaggaccacgtacccctccacttttgctctcgctttggacaccacgatatcgtaaagtatcttctgcaatccgatcttgaagtgcagccccacgtcgtgaacatttacggagatactcctcttcacctggcttgctataatgggaaattcgaggtggctaaagagattatccaaatatctggcacagaaagcttgaccaaggaaaatatcttttcagagacagcatttcacagcgcatgtacctacggtaagtctatagaccttgtcaaattcctgttagatcaaaacgtgatcaatattaatcatcagggaagggatggacacacgggcttgcactcagcctgctaccacggccatataaggttggtgcagtttttgctggataacggcgcggatatgaatctggtggcctgtgatcccagccgatccagcggtgagaaggacgagcagacgtgtcttatgtgggcttatgaaaaaggccatgacgcaattgtgactttgctcaagcactacaaacgccctcaggatgagctaccatgcaacgagtacagtcagcccggaggcgatggctcctacgtcagtgtgccatctcctctagggaagattaaatcaatgactaaagagaaggcagatatcctgctgctgagagcaggcttgccgagccattttcacctacagctgtccgaaattgagtttcacgagattattggctccggctccttcggaaaggtgtataaagggcggtgtcgcaacaaaatcgtcgcgatcaaaagatatcgggccaatacctattgctccaagtcagatgtggatatgttctgtagggaagtgtcaatcctgtgccaactcaaccatccatgtgttatacagttcgtcggagcttgtctgaatgaccccagtcaatttgctattgtgactcaatacatttccgggggtagcctctttagcctactccacgaacagaagcgtatacttgatctccagtctaaactgatcatagcagtagacgtagcaaaaggaatggaatacctgcataacctgacccaacctattatacaccgcgacttgaattctcataacattctgttgtatgaggatggccacgcagtggtcgctgatttcggcgaatctagatttctccagtccctcgatgaggataacatgacgaaacaacccggtaatctcagatggatggctccggaggtgttcacgcagtgtacgagatacacaatcaaggcagacgtgttcagctacgccttgtgtctgtgggagatccttaccggggagatcccattcgcccacctgaagcccgcagcagccgcggccgatatggcctaccaccatattcgacccccaattgggtactcaattcctaagccaatcagctccctgcttatccggggatggaatgcctgcccagagggccggccagaattctccgaagtcgttatgaagctggaggagtgtttgtgcaacatcgagctgatgtcccctgcatccagtaatagttctgggtctctcagcccctcgtcttccagcgactgcttggtcaatcgcggtggaccagggcgcagccacgtggctgccctgaggagccgattcgagctcgaatatgctcttaacgcaagaagctatgccgctctaagtcagagtgctggccagtacagctcacagggcctgagcctagaggagatgaagcgaagcctgcagtacacccctattgataaatatggttatgtctccgacccaatgtcctcaatgcattttcactcatgtagaaatagtagctctttcgaagacagttcctag

SEQ ID NO: 14524 - DNA, 1767 bp, Artificial Sequence
  Description of Artificial Sequence: Synthetic coding sequence
atgaacacctctatcccctaccagcagaatccatataatcccagagggagctctaatgtaatccaatgctacaggtgtggtgacacatgtaagggcgaggttgtccgcgtccacaacaatcactttcacataaggtgcttcacgtgccaggtttgcggatgcggacttgctcagtccggattctttttcaaaaaccaggagtacatctgcacacaggactaccagcagttgtacgggacaagatgtgacagctgtcgagacttcatcaccggggaggtgatctccgccctcggaaggacataccatcccaagtgttttgtctgttcactgtgcagaaagccctttcccatcggagacaaggtgactttttcggggaaggagtgtgtttgtcaaacatgctcccagtccatggcatcttcaaagcccatcaagattcgggggccatctcattgcgccggctgtaaggaagagatcaagcatgggcaatccctgcttgcccttgacaagcagtggcacgtgtcctgcttcaagtgtcaaacctgcagcgtgatcctgacaggggaatacatctcaaaagatggcgtgccatattgcgaaagcgattatcatgctcagttcgggatcaagtgtgagacgtgtgatcgctatatcagtggaagggtgcttgaggctggcggaaaacattatcatcccacatgcgcgaggtgtgtgcgctgtcaccagatgttcacggagggcgaagaaatgtatctgacagggtctgaagtgtggcaccctatctgtaaacaggccgctagagcagagaagaaacttaagcaccgtcggacctccgaaaccagtatctcccccccagggtcatctatcggcagtcctaaccgagtgatctgcgatatctatgaaaatctagacctgcgacagagaagagcctcgtcgccaggctacattgattccccgacctacagtcgtcagggcatgagccctacattcagccgttcaccccatcattactatcggagtgctggcgacagtaatatctacaggaagccccctatctacaagcggcacggtgacctgtctaccgctacaaagagcaagacgtccgaggatatctcccagaccagcaaatactcccccatttacagtcccgacccttattacgcttccgaaagcgagtactggacctatcatggctcacctaaggtgccaagagccaggagatttagttctggcggcgaagaggatgatttcgatcgatccatgcataagctgcaatctggtattggcaggctgatcctgaaagaagagatgaaagccaggtcctcttcttacgcagacccttggacgccccctcggtcctctacttcttcccgagaggccctgcatacggccggatacgaaatgtccctgaacggttcacctcgtagtcattaccttgcggatagcgaccctcttataagcaagtccgctagcctgcctgcttatcggaggaacgggttacataggacaccgtcagccgacctctttcattacgattccatgaacgccgtgaactggggaatgcgcgaatataaaatttatccttatgagttactgctggtgactactcgcggaaggaataggcttcccaaggacgtggatcgtacacggctagaaagacatctgtcccaggaggagttctaccaagtcttcggcatgacgattagtgaatttgacagactcgctctatggaaacgaaacgagctaaaaaagcaggccagactgttttag

SEQ ID NO: 14525 - DNA, 1050 bp, Artificial Sequence
  Description of Artificial Sequence: Synthetic coding sequence
atggctatacctattacagtgttagactgtgacctgcttctctacggccggggacaccggacattggatcgattcaaactagacgacgtaactgatgaatacttaatgtccatgtatgggttcccccgccagtttatctactacctggttgaactgttaggtgcaaatctgtctaggccaacacagcgaagccgggccatttcacccgaaacgcaggtgctggctgcactagggttttacacatcaggatcttttcagacgagaatgggggacgccatcggcatttctcaagcttcaatgagtagatgtgtggctaacgtcacagaggcactagtggagcgggcgagtcaattcatccgctttcccgcagacgaagctagcatccaagccttaaaagacgagttttacggccttgcagggatgccaggtgtgatgggggtggttgattgcatccacgtggccatcaaggctcccaatgccgaagacctttcatatgttaataggaagggtttgcactcattaaattgcctgatggtgtgcgatataagagggactctgatgacagtggagaccaactggcccggaagtctacaggactgcgcagtcctccaacagagttctctttccagccaattcgaagcaggcatgcataaggattcttggctcctgggtgatagctctttcttccttagaacgtggttaatgacccccctccatataccagaaacaccagcggagtatcggtataatatggcgcactccgccacacactccgtcattgagaaaacctttcgtacactgtgttcccgttttcgatgtctggacggtagtaaaggagcccttcagtacagcccggaaaaaagtagccatatcatccttgcgtgttgcgtcctgcataacatatccctggagcatggcatggacgtgtggtctagtccgatgacgggtccaatggagcaaccaccagaggaggagtatgaacatatggagtccctggacctagaagccgaccggatacgccaggaactcatgcttacacatttttcctag

SEQ ID NO: 14526 - DNA, 1794 bp, Artificial Sequence
  Description of Artificial Sequence: Synthetic coding sequence
atgagcagcaaaggatctagcacagacggtcggacagatctcgccaacggtagtctctccagtagtcccgaagaaatgagtggggctgaagaaggcagagagacaagcagtggaatcgaggtggaagcaagtgatctctcactgtcactgaccggagacgacgggggcccaaaccgcacatccaccgagtcaagggggacagacacagagtcttcgggcgaggacaaagactcagactcgatggaagataccggacactacagcataaatgatgaaaaccgggtccacgatagaagtgaggaagaagaggaggaggaggaggaagaagaggaagagcagccgcggaggcgagtgcagcgcaagagggccaacagagaccaggacagctctgacgatgaacgagcccttgaggactgggtttcttcggagaccagcgcactcccaagaccaagatggcaggccctgcctgccttgcgcgagagagaactgggatcatccgcacgattcgtgtacgaggcctgtggcgcaagggtgtttgtccagagattcagactccaacatgggctggagggacataccggatgtgtcaacactctccattttaaccagagggggacatggttagcttctggttcagatgatctgaaggtagtcgtgtgggactgggtccgtagacagcccgtcctggattttgaaagcggccacaagtcaaatgtattccaagccaagtttctccccaattccggtgattctaccttagctatgtgtgccagagacgggcaggtccgagttgccgagctttccgctacacaatgttgtaagaacactaagagagtggcacagcacaagggtgcatcccacaagctagctctagagccagatagtccatgcaccttcctatctgcaggcgaggacgcggttgtttttaccatcgacctgaggcaagaccgacccgcatccaaactggttgtgacaaaggagaaagaaaagaaggttgggctctatactatctacgtgaatccggccaatacccaccagtttgccgtgggtggcagggatcaatttgttaggatttacgatcagcgaaagatcgacgagaatgaaaataacggcgttttgaagaagttttgtccccaccatctcgtcaactcagaaagcaaagccaatatcacatgcttagtgtacagccatgacgggacagagttgttagccagctataacgatgaggacatatatctgtttaacagttcccattctgatggggcccaatacgttaaaagatataagggccaccgcaataatgcaaccgtgaagggtgtgaacttttacggcccgaaatctgaattcgtcgttagcggcagcgattgcgggcacatttttctgtgggagaagtctagttgccaaattattcagttcatggagggggacaaggggggagtcgtgaactgtctggagccccatcctcatttgcccgtgcttgcaacatctggacttgaccacgatgtcaaaatctgggcccccaccgcagaggctagtaccgagttaacagggctgaaggatgtgattaagaagaacaaacgggaacgggacgaggactctctgcaccagaccgatctcttcgatagccacatgctgtggtttctgatgcaccatctgcggcagaggcggcaccatagacgctggagggagcccggtgtgggagcgacagacgctgacagtgatgaatctccctccagctccgacacatctgacgaagaggaaggtcctgaccgagtacagtgcatgccgagctag

SEQ ID NO: 14527 - DNA, 933 bp, Artificial Sequence
  Description of Artificial Sequence: Synthetic coding sequence
atgtcccaacagctgaaaaagcgggccaagacgcggcaccaaaagggccttggagggagggccccctctggtgccaaacccagacaaggaaagagcagccaggatttgcaggctgaaattgagcctgtgagcgccgtgtgggctttgtgcgacggatacgtgtgttatgaacctggccctcaagccttggggggggacgatttctccgattgttacattgaatgtgtgattcgcggcgaatttagccaacccatcttagaggaggattcgttattcgagtccctggaatatttgaaaaaagggtccgagcagcagctgtctcagaaggtcttcgaggcaagcagcctggaatgctctctagagtatatgaaaaagggagtaaaaaaggaactgcctcagaagattgtcggagaaaattctctggagtattccgagtacatgaccgggaaaaagctcccccctggcggcattcctggtatcgacttgagtgacccaaagcagcttgcagagttcgcccggaagaagccacccatcaataaggaatatgatagcttatcggccattgcatgcccacaaagtggatgcaccagaaagctgcggaatcgcgctgccttacggaagcacctgttgatccacggtccacgggaccatgtgtgcgcagaatgcggcaaggcatttgtagagtctagcaagcttaaacgccactttctggtgcatactggggagaaacctttcagatgcacatttgaaggatgcggaaagcggttctcactggacttcaatttaaggactcacgttcgcatacatacgggcgagaaacgtttcgtgtgcccttttcaggggtgtaatcggaggtttatacagagtaataacctgaaagcccatatcctgactcacgccaataccaataaaaacgaacaggagggaaaatag

SEQ ID NO: 14528 - DNA, 1149 bp, Artificial Sequence
  Description of Artificial Sequence: Synthetic coding sequence
atgctgcgatggaccgtgcacctcgagggagggcctaggagggttaaccatgcagccgtggccgtgggacacagggtctactcatttggtggctattgctctggggaggattacgagactctacggcagatagacgtgcatatcttcaatgctgtcagcctgaggtggaccaaacttcccccagtcaagtccgccattagaggacaggctcccgtggtgccatacatgcggtacggacattcaacagtgctcatcgacgatactgtcctcttgtggggaggccggaacgataccgaaggagcctgtaatgtactttacgcatttgacgtgaacactcataagtggtttacaccacgcgtcagcgggaccgtacctggggctagagacggacacagcgcatgtgtgctcggcaaaatcatgtatatatttggcggttatgagcaacaggccgattgtttcagtaacgatatccacaagctggatacttctaccatgacatggaccctgatctgcaccaaagggtcccctgctcggtggcgggacttccattccgctacaatgctgggctctcacatgtacgtctttggaggacgcgccgacagatttgggccattccattctaacaatgagatctattgtaatcgtatccgcgttttcgacactcggaccgaagcttggttagactgtccaccaacccccgtgctacccgaaggacggaggtcacactcggcctttggatacaacggagagctgtatattttcggcggctacaatgcccggttaaatagacactttcatgatctctggaaatttaatccagtaagctttacctggaagaaaatcgagcccaaaggcaagggtccctgccccaggcgacggcaatgctgctgtattgttggcgacaagatcgttctgttcggcggcacaagtccaagccctgaagagggcttgggagacgaatttgacctgattgatcactccgaccttcacattttggacttctccccatccctaaagaccctgtgtaaactggcggtcatacagtataatcttgatcagagctgcctgcctcatgacattcggtgggaactgaatgctatgacgactaatagcaacattagcaggcccattgtcagcagccatggttag

SEQ ID NO: 14529 - DNA, 1827 bp, Artificial Sequence
  Description of Artificial Sequence: Synthetic coding sequence
atggcagctgccgccgccgcagttggcccaggagcgggcggcgccgggtctgccgtgcccggaggcgccggcccctgcgccaccgtctcagtgtttcctggagctcggctgcttactatcggcgacgccaacggggaaatacagcgacatgctgagcagcaggccttgaggctggaggtgagggctggccccgattcagcgggcatagccttgtacagccatgaggatgtgtgcgtattcaaatgctccgtttctcgagagactgagtgctccagagtcgggaagcagagctttattattacccttggctgcaattcagtcctgattcagttcgccactcccaacgacttctgttcattttacaatattttaaaaacctgccgcgggcatacgctggaaaggagcgtcttctcagaaaggaccgaagagtctagtgctgtgcagtatttccaattttatgggtacctaagtcaacaacagaatatgatgcaggattacgtcaggaccggaacatatcagcgtgcaattcttcagaatcacaccgatttcaaagacaagatcgtgcttgatgtgggctgcggatctggcatcctcagcttcttcgcagcccaagccggcgctcgtaagatttacgccgtcgaagcgtccaccatggcccaacacgccgaggtgttggtcaaatcaaacaacctgactgacagaatcgtagtgataccgggtaaggtcgaagaagtctctctgcctgagcaggtcgatatcatcatttccgaacccatgggatacatgttgttcaacgagaggatgctcgagagctatttacacgcaaaaaagtacctaaaaccttccgggaatatgttccctaccatcggggatgtccatttagcgcccttcacggacgagcagctctatatggagcagttcactaaggccaatttctggtatcagccctcgttccacggagtcgacctttctgccctgcggggggcagccgtggacgagtatttccgccaacctgtcgttgacaccttcgatataagaattttaatggcaaaaagcgtgaaatacacggtcaactttcttgaggccaaggaaggcgacctacatcgtattgagattccattcaaattccatatgctacactccggactagtgcatggcttggccttttggtttgatgtggccttcatcggctctattatgaccgtgtggctatccaccgcgccaactgagcccttaacgcattggtatcaggtccgttgtctgttccagtcccctctgttcgcaaaagctggggacacattgagcggaacctgtctgctgatcgccaataaaaggcagtcttacgacattagtattgttgcacaagtggaccagacaggatctaagtcttccaatctcctagacctgaaaaacccctttttcaggtatactggaaccacgccttcgccccccccaggttcccactatacatctccctccgagaatatgtggaatactggcagcacctacaacctgagtagtggcatggctgtggcaggtatgccgacggcctatgacctgtcaagcgtaattgcttcgggcagcagcgtggggcataacaacctgatcccgctcgcgaataccgggattgtaaatcatacacatagcagaatgggctctattatgagcacagggatcgttcagggttctagcggagcacaaggctccgggggtggaagcacgagtgcccactatgccgtaaacagccagttcaccatgggcgggccagccatctcgatggcttccccaatgagcatacctacaaacactatgcattacggatcatag

SEQ ID NO: 14530 - DNA, 2913 bp, Artificial Sequence
  Description of Artificial Sequence: Synthetic coding sequence
atgcaatctactgatctgggaaacaaagaatctggcaagatttggcacaggaaaccatccccggcaactcgggacggaattattgtgaacattattcataatacatcagattatcatccaaaggtgctacggttcttaaatgtggcctttgacgggacaggcgactgcttaatcgctggagaccatcagggaaacatttacgtgtttgatcttcatggcaaccgcttcaacctcgttcagcggactgcccaggcctgcaccgcactggccttcaatctaagacggaaatccgagtttcttgtggcgcttgccgactactctatcaaatgctttgatactgtgacaaaagagctggtgagctggatgaggggccatgagtcaagcgtcttctccatttccgtgcatgcttccggaaagtacgcaattactactagcagtgataccgcccaactgtgggatcttgacactttccagaggaagaggaaactcaacattcgccagtccgtgggcattcaaaaagtgttcttcctgccgttaagcaacaccatcttgtcttgctttaaagacaactccatttttgcatgggaatgtgacacactcttttgcaagtatcaactacccgccccacctgagtcttcaagcattctgtataaagtcttcgcagttactcgcgacggcagaattcttgcggctgggggtaaatctaatcacttacacttgtggtgtctggaggcccgccaactgttccgcatcatacagatgcccactaaggtgcgggccattcggcatcttgagtttctgcccgattcatttgatgcaggatccaatcaggtcctcggagtgctgtcacaagacgggatcatgcgctttattaacatgcagacttgtaagctgctgttcgagattggcagtctggacgaaggcattagttcttccgcgatcagcccacatggccgatacatcgcttccataatggaaaacgggtcgcttaacatttatagcgtgcaggccctgacccaggaaattaataaaccccccccaccactggtgaaggtgattgaggatctgcctaagaacaagctctcttcctcagacttgaagatgaaggtaaccagtggtcgagtccaacagccggctaaatccagagagtccaaaatgcaaactcggatcctgaagcaggatctgactggcgactttgagagtaagaaaaacgagcttccagatgggctcaataaaaagaggctacagatcttgttaaagggctacggcgagtatccgaccaaatatcgaatgttcatctggagaagcctactgcagctacccgagaaccacaccgcgttttctacgctcatagataaagggacacatgtggcctttttgaatttacagaaaaaatacccaatcaaaagcagaaaactactccgtgttctgcagcgcactctgtccgccctggcgcactggagtgttattttttcagacaccccttacctgccactgttagctttcccatttgtaaagttgtttcagaataatcagttgatatgcttcgaagtcattgctacactcatcatcaattggtgtcagcactggtttgagtactttccaaatccacccatcaatatactatctatgatcgaaaacgtgctggcttttcacgacaaggagctactgcagcactttatcgatcacgacatcaccagtcagctatatgcctggcctctgcttgagactgtgtttagtgaagtgctcactagggaggaatggcttaaattattcgacaacatatttagtaatcacccaagctttctgctgatgactgttgtcgcttataatatctgcagcaggacccccctgctgtcttgcaatcttaaagacgatttcgagttcttcttccaccaccgcaataatctggacattaacgtggtcatcagacaagtataccacctgatggaaaccactcccaccgatatacatccagatagcatgttgaacgtgtttgtcgcgttgacaaaagggcagtaccccgtcttcaatcagtaccctaaattcattgtcgactaccagacacaggaaagagaaaggatccggaatgacgagctcgattatctaagggaaagacagaccgtagaagatatgcaggccaaggtggaccagcaacgggttgaggacgaagcttggtaccagaaacaagagctgttgagaaaagccgaagagaccagaagggagatgttgcttcaagaggaggagaaaatgattcagcagcggcaaaggttggccgctgtcaagcgtgagctgaaagtgaaggaaatgcacctgcaagacgctgcccgccgcagattcttgaaacttcaacaggaccagcaggaaatggaactgcgccgcctcgacgacgagatcgggaggaagaatttgacagaaaatcaagaggccctcgccaaagaaatgagagccgacgcagatgcttaccggagaaaggtggacctggaagaacatatgttccataaacttatagaagcaggagaaacccagtcgcagaagacacagaagtggaaagaggctgaggggaaggagttccggcttcggtctgccaaaaaggcctcagctttgtctgatgctagccgcaagtggttcttgaagcaggagatcaatgctgctgtggagcatgccgagaacccctgtcataaggaggagcccagattccagaatgaacaggactcaagttgtctcccacgaacctctcaattgaacgactctagtgaaatggacccaagcactcagatctctctcaatcgtcgtgccgtggagtgggataccacaggacaaaacctgattaaaaaggtcaggaacctgcggcagcggctgactgcacgagcaagacaccgttgtcagacacctcatctgctggctgcttag

SEQ ID NO: 14531 - DNA, 648 bp, Artificial Sequence
  Description of Artificial Sequence: Synthetic coding sequence
atgtcctgcaccatcgagaaagccctggcggacgcaaaagccctggtcgagaggttaagggaccacgatgatgccgccgagtcgctgattgaacagacgacagcactaaacaagagggttgaggccatgaaacagtaccaggaagagattcaggagctgaacgaggtcgcgcggcataggccgcggtcaacgctcgtgatgggaattcagcaggaaaacagacagattcgtgaacttcaacaggagaacaaagagttgcgaactagcctagaagagcaccagtctgccttggagcttattatgtcaaaatatcgggaacagatgttccgactgctcatggccagcaagaaggatgacccaggtattatcatgaagctgaaagagcagcatagcaaggaactacaggcccatgtcgatcaaattaccgagatggctgccgtgatgcgcaaagcaattgagatcgacgagcagcagggctgcaaagagcaagagagaatttttcaactggagcaggagaataagggactgagggaaattctccagatcactcgcgagtctttcctcaacctccggaaggacgacgcaagcgaaagtacttcactttcagcacttgtcacaaactccgacctttccttacggaagagctag

SEQ ID NO: 14532 - DNA, 2676 bp, Artificial Sequence
  Description of Artificial Sequence: Synthetic coding sequence
atggccgtggcacgagtggatgcggcgctaccccctggagagggaagtgtcgtaaattggagcggccaggggctgcagaaattaggcccaaatttgccttgcgaggcggatatccacactctgattcttgataaaaaccaaataattaaactggaaaacctcgaaaagtgcaaaaggcttatccaactatccgttgccaacaaccggcttgtcagaatgatgggagttgctaaactgaccttgctccgggtacttaacctccctcacaactcaattggctgtgttgagggtctcaaagagttggtgcacttggagtggctgaatctggccgggaacaacctcaaagccatggaacagatcaattcctgtacagcgctacaacacctggacctgagtgacaacaatatctcacagataggggatctgagcaaactagtcagcctgaaaaccctcttgctccatgggaatatcataacatctctgagaatggcacctgcctacctccccaggtctctggccattctgtctttggctgaaaacgaaattagggacttgaacgagatttccttcctcgcatcattaactgagctggagcagttgtccatcatgaataacccatgcgtgatggccactccatctattccaggctttgactatcggccatatattgtctcctggtgcctaaacctgcgcgtgcttgacggctatgttatctcccagaaggaatctctgaaggccgagtggttatatagccagggaaaagggagggcatacaggccaggccagcacattcaattggtgcaataccttgctaccgtgtgccccctcacttctactctgggcctgcagacagcagaggatgccaagctcgagaagatactgtcaaaacagcgtttccatcagagacagctaatgaaccagtctcagaacgaagagctaagtcctctggtgcccgtcgagacccgtgccagtttgattcccgagcacagtagcccagtgcaggactgtcagatttcacaggaaagtgagcccgtaatccaggtgaactcctgggtaggaataaatagtaacgatgatcagctgtttgcagtcaagaataatttccccgcctccgtacatacaaccaggtattcaaggaacgatctccatctcgaggatattcagacagacgaggataagctcaattgctcattgctgagctctgaatctacattcatgccagttgcaagcggcctaagcccgctgtcacccactgtggaacttcgactgcaggggataaacctcggtctggaggacgatggtgttgccgacgaatcagtgaaaggcctagaatcccaggtgctggataaggaagaggaacaacctctgtgggccgccaacgaaaacagtgttcaaatgatgcgaagcgaaattaacactgaagttaacgagaaggccggactgctgccctgccctgaaccaacaatcatcagtgctatcctgaaagatgacaatcatagcctgaccttttttcccgagagtactgaacaaaaacagtcagacattaaaaaaccagagaatacacagcccgaaaacaaggaaaccatcagccaggctaccagcgagaaattgccaatgatcctgacacaaaggagcgttgccctcggtcaggacaaagtcgccctccagaagctcaacgatgccgcaacaaagttgcaggcttgctggcgcggattctacgcccgtaactacaacccacaggcaaaggacgtgcgatatgagatcaggctccgtcggatgcaagagcatatcgtgtgtttaacggacgagattcggcggctcagaaaggagagggatgaagaacggattaagaagttcgtacaggaagaggcttttagatttctgtggaaccagaaatggggtttggctatcttacccagaccagtgagtaacttctgggctcaagctgtgttccctccccagcctcctaaagtgcggtctctgcaagtttggcagcagactgtggatcaacgcctctcctcctggcatacggatgtcccccccatctcgagcactctagtgccatcgaaacacccactgttcacgcagagtcaggagtcaagctgcgatcagaacgctgattggtttatcgccagtgacgtggccccacaagaaaaaagcctgccagaatttcccgattctggatttcacagcagccttacagagcaggtgcattcactgcaacactcattggatttcgagaaaagttccacggagggttccgagagctcaattatgggcaattccatagatacagtgcgctatggcaaagagagcgacctcggcgacgtctctgaggagcacggagagtggaataaagaatcctcaaataatgaacaggataatagcttgcttgagcagtacttgacatcggttcagcagctggaagatgcagacgagcgtaccaatttcgacacagagacacgggattccaaactgcatatagcctgtttccccgtgcagttggatactctgtccgacggggcgtctgtagatgagtcacatgggatatctccccccctgcaaggggagatctcccagacacaagaaaactctaagctcaatgccgaagtccagggacagcagcctgagtgtgattccactttccagttattacacgtgggtgtcactgtgtag

SEQ ID NO: 14533 - DNA, 828 bp, Artificial Sequence
  Description of Artificial Sequence: Synthetic coding sequence
atggctgaaccagcaagtgttgccgcggaatctctagccggctcccgcgctcgggcggctcgcaccgtgctgggacaggtcgtcctcccaggcgaggagttactccttccagagcaggaagacgccgaaggcccaggcggggccgtagaaaggcctctttcactcaacgcacgagcctgtagcagagtccgggtcgtatgtggacctggtctaagacggtgcggcgatcggttgttggtaacaaagtgcggcagactgaggcataaagagccagggtctggcagcggcggcggggtctactgggtagactcccagcaaaagcgctacgtgccagttaaaggcgaccacgtgatcggcatcgttacagccaaatctggtgatatatttaaggtcgacgtgggcggatctgaacctgcttccttatcttatttatctttcgagggggccaccaaacgcaaccgaccgaatgttcaggtcggcgatttgatctatggccagtttgtggtggctaataaggacatggagccagaaatggtttgcatcgactcttgcgggcgggcaaatgggatgggcgtcatcggtcaggacggcttactctttaaagtgacattaggactgattagaaaactgcttgctccagactgcgagataatccaggaggtgggcaagttataccctcttgagattgtttttggaatgaatggtcggatctgggtaaaagccaaaacaatccagcaaaccttgattttggcaaacattctggaagcctgcgagcatatgacctcagaccagagaaaacaaatcttctcccgtctcgcggaatcctag

SEQ ID NO: 14534 - DNA, 1620 bp, Artificial Sequence
  Description of Artificial Sequence: Synthetic coding sequence
atggccacatcagctcctctcagatcactcgaggaagaagtcacttgtagtatttgtcttgactacttaagggaccctgtcacaatagactgtggtcatgtcttctgtaggagctgtactaccgacgtaaggcctattagtggatccagaccggtgtgtcctctctgcaagaagccctttaaaaaggaaaatattagacccgtgtggcagctggccagcctcgttgagaacatcgagcggctgaaagtagataaaggcagacagcctggagaagtcacacgtgaacagcaggacgctaagttatgcgagcgccaccgggaaaagctccactattactgcgaagatgatggcaaactgttatgtgtgatgtgcagggagtcgagggagcaccgaccacataccgccgtcctgatggagaaggccgcccagccgcatagggagaagatccttaatcacctgagcacgttgcgccgggatcgtgacaaaatccaaggttttcaggctaagggagaagcggacatactggccgctctgaaaaagctgcaggatcagcgtcagtatatagtggctgaattcgagcaggggcatcagtttcttagagaacgcgaagagcatctgctcgaacaactggccaaattagagcaggaactcactgaaggccgggagaaattcaagtctcgcggcgttggagagttggccaggctggctctggttatttctgagctcgaggggaaggcacagcagcccgccgcagaactgatgcaggatactagagactttctgaacagatacccaagaaagaagttttgggtagggaaacccattgcccgcgtggtaaaaaagaagaccggcgaatttagcgataaactgttgagtctccaaagaggtctccgcgagttccaagggaagctgctgcgtgacctcgaatacaaaactgtctctgtgacattagacccgcaaagtgcctcaggatatttacagcttagtgaggactggaagtgcgtgacctataccagtctatacaaaagcgcctatctacacccacagcagtttgactgtgagccaggagtgctggggagcaagggcttcacctggggtaaggtgtactgggaggttgaggtagagagggaaggatggagcgaggacgaagaagaaggggacgaggaagaagagggagaggaagaggaggaagaggaagaagcgggttatggggatggctatgacgactgggagacagatgaagatgaagaatctttaggggacgaggaggaagaagaggaagaagaggaggaagaagtgctggagtcttgtatggtgggggtggctagggatagcgtgaagcgcaagggtgacctgagtctacgccccgaggatggtgtgtgggcgttgaggctctcgtctagtggcatttgggccaatactagccccgaggccgagctctttccagctctgaggcccagaagggtaggcatcgcactggattacgagggaggcactgttacatttaccaacgctgaatcccaagagctcatatacactttcactgccactttcacccggcgcctggtgcctttcctgtggcttaaatggcctggcactaggctcctgcttcggccttag

SEQ ID NO: 14535 - DNA, 1233 bp, Artificial Sequence
  Description of Artificial Sequence: Synthetic coding sequence
atgttcaataatgaattaatggcggatgttcacttcgtcgttggtccaccaggcgcaacaaggactgtgcccgcccataagtacgtcctggcagtagggtccagcgtgttctacgccatgttctacggcgaccttgccgaggttaagtccgaaatacatatacccgatgtggagcccgctgcgttcctgatccttctgaaatatatgtattctgatgagatcgatctggaggcagataccgttctggctaccttatatgccgctaagaaatacatcgtccctgcattagccaaggcctgtgtgaatttccttgaaactagtctggaggccaagaatgcttgcgtcctgctgtctcagtccaggctttttgaggagcccgagttaacccagagatgctgggaggttatcgacgcgcaagcagaaatggcgctgagaagtgaggggttctgtgaaattgatcgacagacactagagatcatcgtcaccagggaggcgctgaacacgaaagaagccgtggtttttgaggcagtgctcaattgggctgaggcagagtgcaagaggcagggtctgccgatcactcctagaaataagcgccatgttctcggccgcgctctgtatcttgtccgaataccaactatgacattagaagagtttgccaatggtgccgcacagtctgacatactgacgctggaagagactcactccatctttctgtggtatacagccacaaacaagccacgccttgactttcctctcactaaaagaaagggtttggcaccgcaacgctgtcaccggttccagtcctctgcctataggtctaaccagtggagatacaggggccggtgtgatagcattcagttcgccgttgaccgacgtgttttcattgctggcttggggctgtatggatcctcaagtggaaaggctgagtacagtgtaaagatcgagttaaaacgcctgggagtggttctggcccagaatctcaccaagtttatgtctgacggcagctccaacacctttcctgtttggtttgagcatcctgtccaagtggagcaggatacattttacaccgcttctgccgtgctggatggcagtgagctctcttacttcggtcaggaaggcatgaccgaggtccaatgtggaaaggtggcctttcagttccaatgctcttccgactccaccaatgggaccggtgtgcagggcggccagatccccgaattgatcttttacgcatag

SEQ ID NO: 14536 - DNA, 966 bp, Artificial Sequence
  Description of Artificial Sequence: Synthetic coding sequence
atgcgcgccctggcagccctatccgcacctccaaatgagcgcttgttaccccgtgatcctgctgccactagggaccccgatgccgcaaggcccgcacgccgaagcgcagtggaacgtctcgccgctgaccgagcaaagtatgttcggggcaggccaggcaccgggcgtggagtggcttctgaaggctccggtcccggcgccattaaatgccccggaaacgaccctggtcccccagctagggctcctgcccccgttgcaagacgggccatcgccaggaaacccctgaggcccgactccctgatcatctacagacaaaagtgcgaatttgtgcgcgggtcaggggccgacggcccacgcgcaagtctcgttaagaagctatttcagggtccaggcaaagacaaggcccccgtcccccgtactggtgacgagggaaaagctggaaatcccgaaaccgtgcctactactccaggacccgccgcagatcccgccatcccggagaccccggcaccagcagcccggtctgcagccccgtctagtgttcctgctgccccgcctggtcccgaacctcgagtcgtccggagacggggcctgcaaagaagccaatctgatctctcatccagatactctgccgcactcgcagaaagtgatactttctttcagtactgtgggctggacccagaagttgtcgaagctctgggaagggaaaacttcacggccgggagcgattgcgtcaccttgaaagtgagatccgtgtccgtggctaccagtggctcgggcttcagtcgccattcaggcggcgatgacgaaggcctccaggaggaggagctcatcgagcaggttccatcaaccacgtccgtcatcgaacgcaatgctagaatcataaagtggctttatacctgtaagaaggcaaaggagaccccaagtcaggagcagtccaggacccgaggtagcaaacctagtagatag

SEQ ID NO: 14537 - DNA, 945 bp, Artificial Sequence
  Description of Artificial Sequence: Synthetic coding sequence
atgtcagagaatgccgccccggggctaatctctgaattgaagctcgctgtcccgtggggccatattgcggccaaagcgtggggctcactgcagggcccccccgttctttgtctgcatggatggctggataatgccagctccttcgaccggctgatccccctgctaccccaggatttttactatgtggccatggatttcgggggccacggcctatcatcacattacagccccggagttccatattacctgcagaccttcgtatccgagattaggcgtgtggtggctgccctaaagtggaatagattttctatcttggggcactccttcggaggcgtggttggggggatgttcttctgtacatttcctgaaatggtcgataagctaattcttttggatacaccactgtttctcctagagagtgacgagatggagaaccttctgacatacaaaagacgagccattgaacacgtgctgcaggtcgaggcgtcacaggaaccgagtcacgtattctcgttgaagcagctgttgcagcgactgcttaaaagcaattcacatctatctgaagagtgtggcgagcttctactgcagagaggcactaccaaagttgccacaggccttgtcctcaatagggatcagaggctcgcctgggcggaaaattccatcgattttatctcacgtgagctgtgcgcccattctattaggaagttgcaagcacatgtgctgctcatcaaggccgtgcacgggtactttgactctcggcaaaactatagcgagaaggagtcactgagttttatgattgacaccatgaaatcaactctgaaagagcaatttcagtttgtggaggtgccaggtaaccattgtgtgcatatgtctgaaccacagcacgtcgcctctatcattagcagctttctccagtgcacccatatgcttccagcgcagctatag

SEQ ID NO: 14538 - DNA, 3945 bp, Artificial Sequence
  Description of Artificial Sequence: Synthetic coding sequence
atggcctctaagggcgctgggatgtcctttagccgaaagagctacagactgaccagcgacgcagagaagagccgggtgacaggaattgtgcaagagaagttgctcaacgactatttgaacaggatctttagtagctccgagcacgccccccccgctgctacatcacggaaaccactaaattttcagaatctaccagagcaccttgaccagttacttcaggtagataatgaggaggaggagagccagggtcaagttgagggccggttgggcccttcaactgttgtgttagaccacacgggtggttttgaaggcctgttgttggtggacgatgacttgctgggtgtgatcggacactccaatttcgggacaattcgctccacaacatgtgtctacaagggtaaatggctgtacgaggttctgatcagctcacagggactaatgcagatcggctggtgtaccattagttgccggtttaatcaggaagaaggagtcggggacactcacaactcatatgcctatgacggtaatagagtgcgcaagtggaatgtgaccacaactaattacgggaaagcttgggccgcgggtgatatcgtgtcatgtttaatagatctcgatgatggcaccctttccttttgtctgaacggggtgtctctgggtacagcattcgagaatctctctagagggctgggaatggcgtacttcccagcgattagcctgagttttaaagagagcgtcgcattcaattttggatctcgtcctttgcgctatcctgttgccggctaccgcccactgcaagaccccccctcagccgacctcgttagggcgcagaggctgcttgggtgtttccgggccgtgctcagcgtcgagcttgatcctgtcgagggacggctgttggataaggagagcagcaagtggaggctgcgaggacagcccacagtcttactgaccttggcccatatctttcatcacttcgctccgttgcttcgcaaggtgtaccttgtcgaagcagtcctgatgtcgttcctcctgggcatagtggagaagggtacaccaacacaggcacagtccgtcgtgcatcaggtcttagatttgctttggctatttatggaggactacgaggtccaagactgtctgaaacagctcatgatgtctttgctgcgtctctaccgattctcacctatagttcctgatcttggcctgcagattcactatttgcggctgactatagcgatcctccgccatgagaagagccgtaagttccttctgtcaaatgtgctttttgatgtcctgcgcagcgtggtatttttttatataaagtctccattaagagtggaggaagccggacttcaggagcttatccctacaacatggtggccacattgcagtagccgggagggcaaggagagcaccgaaatgaaagaagagactgctgaagaacgactgaggcgtcgagcctatgagcgcggctgccagcgcctgagaaaaagaatcgaagtcgtagaggaactccaggttcagatactgaaactcctccttgacaataaggacgacaacggcggcgaggctagtaggtacatctttctcaccaaattcagaaagtttctgcaggagaacgcctccggaagaggcaatatgcccatgctgtgtcccccagagtatatggtttgcttcttacaccggcttatctcagccttgcgatattactgggatgaatacaaagcctctaacccccacgccagtttctctgaggaagcgtatataccaccacaggtgttctacaacggaaaggtcgattactttgatttacagcgcctcggcggcctcctgtctcacctgagaaagactctcaaggatgacctggccagcaaagccaatattgtcattgatcccctggaactacagtcaacggccatggatgatttagacgaagacgaagaacccgcacccgctatggcccaacgtcccatgcaagcccttgccgtcggaggtccgctgcccctgcccaggcctgggtggctgagttccccaactcttgggcgcgcaaaccgatttctgtctacagcggcagttagccttatgactccacgcaggcccttgagtacctcagaaaaggtcaaagtcagaacactatctgtcgaacagagaacgagggaagatattgaagggtctcattggaacgagggcctcttgctgggcagacccccggaagagcccgagcagcctttgactgagaacagcctcctagaagtgttggacggggcagtgatgatgtataatctgagcgtgcaccagcagctgggcaagatggttggggtttcagatgacgtaaatgaatatgccatggccctgagggatacggaagataagctgagacggtgcccaaagcggcgaaaggatatcctggctgagctcacaaagtctcagaaagtcttttccgaaaaactggatcatctgtcccggaggttggcctgggtgcacgctactgtgtactctcaggaaaagatgttggatatttactggctgcttcgcgtctgccttcgaaccattgaacacggggatagaaccggatccctgttcgcctttatgcctgaattctatctcagcgtggctattaactcttactctgccctgaagaattatttcggtccagtgcattctatggaggagctgcctggctacgaggaaacactgacccggctcgccgcgattctggcaaagcacttcgccgacgccaggatcgtcggcacagacataagggactcgttgatgcaggccttagcaagttacgtgtgttaccctcacagcttgagagctgttgagcgaatccccgaggagcagcgtatcgcaatggtgagaaatttgctagccccctacgaacagcgtccctgggcgcaaactaactggattctcgtaaggctgtggagaggatgtggtttcggctaccgatacaccagactgcctcaccttctgaagactaaactggaagacgcaaatctgcctagcctccagaaaccgtgcccctccaccctgttgcaacagcacatggccgatctgctccaacagggacctgatgttgctcctagcttcttgaactcggtgctgaaccagctcaactgggccttcagtgagttcattggtatgatacaagagattcaacaggctgccgagcgactcgagcgcaatttcgtcgattcccggcagttgaaggtgtgtgccacttgcttcgatctttcagtttctttgttgcgcgtgctggagatgacaattaccctggtgcccgaaatctttctggattggacccggcccacttccgagatgttgctgcggaggctcgcgcagctacttaaccaggtactgaatcgagtgacagctgaaaggaacctattcgacagagtcgtcactctccgccttccgggtctcgagtcagtggaccattatcctattctggttgccgttactggtatactggtccagttgctggtgcgtggacccgctagcgagcgcgaacaggcaacaagcgtcttattggcggacccttgctttcaattgaggtcgatttgttacctgcttggacaaccagagccccctgcgcctggaaccgccctcccggcccccgatcgtaagcgattcagtttgcagagttacgccgactatatcagtgcggacgagctggcacaggtggaacaaatgctagcgcatcttacatccgcctccgcacaggcagcagccgcctctctgcccacctcagaggaggatctctgccctatatgctacgcacaccccatttctgctgttttccagccttgtggccataaatcatgtaaggcttgtatcaaccaacatctgatgaataacaaagattgctttttctgtaagacgacaattgtctccgtggaggactgggaaaagggggccaatacttcaacaacctcctcagctgcttag

SEQ ID NO: 14539 - DNA, 2646 bp, Artificial Sequence
  Description of Artificial Sequence: Synthetic coding sequence
atggcaggcgctgccccacgtgtgcggtacttagctggattctgttgtccactgggtggccttgcagcggggaaaccaagggtgctgtgccacgaggcagaggtctttttatcgaccggatcagagttggtgtatgtctacgatcaggagggcggtctcctgacagccgcatttcgcttccctgaccaggtgtggcatctggagttgctagcacctagacgactgctctatgccctgtgtgccaggagagggctctattgtctcagtctggatcatcctggtcggagcagaagtacctcccaggacgatcgcgattctgaggacggagaccagccgagcccagtgatacccgtggaccccgatgcttgtattctgcccgacgctgcattgtgtgccttcacattattagacagcgttctagtgaccctcgtgcaaggccccgccagatggaaaatgcaactattcgagcaaccatgtccgggcgaggaccctcggcctgggggccagatcggcgaagttgaactcagctcctatacacccccagccggcgtacctggcaagccagccgctcctcactttttacctgtgctgtgtagtgtctccccgagtggctctcgggtgccgcacgacctgctgggggggagtggcggcttcactctagaagatgccctgttcgggcttctcttcggcgctgacgcaactctcttgcagtccccagttgtgctgtgcgggcttccagatggccaactgtgttgcgtgattctcaaggcactggtaacgagtaggtctgctcccggagatcctaacgccttagttaagatcctacatcatttggaggagccagtaatcttcatcggcgcactcaagactgaacctcaggctgctgaagccgctgagaactttttgccagatgaggacgttcattgtgattgtctggtggccttcggacatcatggcaggatgctggctatcaaggcctcctgggacgagtcgggtaagctcgtgcccgaactgcgggaatactgtctgcccggaccagtgctatgtgctgcctgtggtggagggggacgcgtctaccatagtacccccagtgacctgtgtgtggtagacctgagcaggggttcaaccccgcttgggcccgagcagcccgaggagggcccgggggggctgcccccaatgctgtgccctgccagccttaatatatgtagcgtagtgagccttagcgcgagccctaggacccatgaggggggaacaaaattgttggctttgagtgcaaaaggcaggctgatgacctgcagtcttgatcttgacagcgaaatgcccggacctgctagaatgaccaccgagagcgctggccaaaaaatcaaggagctcctgtccggcattggaaatatcagcgagcgagtgtcctttttgaagaaagctgtggatcagcggaataaagctctcacgagcttgaacgaggcgatgaacgtgtcctgtgcgcttctatcaagtggtactggacctaggccaatttcgtgcactacaagcactacgtggtcccggcttcaaacccaagatgtgctgatggccacatgcgtgttggagaattcctcaagctttagtctcgaccaaggctggaccttgtgtattcaggtattgacatcgtcatgtgcccttgatttggatagtgcgtgctctgcaatcacctacacaatccccgtggatcagctggggcccggagcccggagagaagtaaccttacccctcggccccggggaaaacggaggcctagatctgccagttaccgtatcctgcactctgttttatagtctgagggaggtcgtaggtggtgctctggctccttccgattccgaagacccattcctggacgaatgcccctcagatgttctcccagaacaggaaggcgtctgcctacccttatctcgtcacaccgtggatatgctgcagtgcctccgctttcctggcctggccccacctcatacaagagcaccctctccccttggtccaactcgggatcctgtcgccaccttcttggaaacgtgtagggagccgggaagccaacctgcaggccccgccagcttaagagccgaataccttcccccctcagtcgcctccataaaagtctctgccgagctcctgagggccgcactaaaagacggacactctggcgtaccactctgttgcgcaacactccaatggctattggccgagaatgccgccgtcgacgttgtccgcgctagggcactgagctctattcagggcgtggcaccagatggggctaacgtccaccttatagtgcgcgaggtggctatgaccgacttatgccctgccggtccaattcaggctgtggagatccaggtggaaagctcgtcgttagctgatatctgccgcgcccaccatgccgtggtgggcagaatgcagacaatggtgactgagcaggccacccagggtagttctgccccggatctacgggtgcagtacttaagacagattcacgccaatcatgagaccctgttacgcgaagttcagacgctgcgcgacaggctgtgtacggaggatgaagcttccagctgcgccaccgctcaacggctactgcaggtgtataggcaactccgacacccatctctcatcctgctgtag

SEQ ID NO: 14540 - DNA, 471 bp, Artificial Sequence
  Description of Artificial Sequence: Synthetic coding sequence
atgggtgataagaaatcccccacacgccctaaaaggcaacctaagccatcaagcgatgaaggttactgggactgctctgtctgcaccttcagaaattccgcagaggctttcaaatgtatgatgtgtgacgtgcgcaagggtacctccactcgtaaggagaaaaaggataaggtggagaaagagaagtccgaaaaagaaaccacctccaagaagaacagtcacaagaaaacccgaccccgactgaaaaatgtagatagatcttcagcacagcacctggaagtgacagtcggcgacctgactgtgattatcaccgattttaaagaaaagaccaagtcacccccagcttccagtgcagcttccgcggatcagcacagccagagtggtagctccagcgacaacaccgagcgagggatgtcccgatcttcatctccccgaggcgaggcctctagcctgaacggtgaatcccactag

SEQ ID NO: 14541 - DNA, 777 bp, Artificial Sequence
  Description of Artificial Sequence: Synthetic coding sequence
atgtgcgcacttgagatggccgtcctggaaatccagaccaacggtgacaccagagtgacagaagaggccatagcccgggcgcggcactctttatcagatccaaacatgagagaattcattttgtgttgtctcgcccgcgatcctgcaagacgccctagcgcccactcattgctgttccacagagtcctcttcgaggtgcatagcctgaagctgttagctgctcactgtttcatccagcaccagtatctcatgcccgagaatgtggtggaagagaagacaaaggcaatggacctacatgcagtgcttgcagagctccccagacctcgtcggcctcctctgcagtggagatactccgaagtatcatttatggagctggacaaatttctggaggatgttagaaacggtatttatccgctaatgaatttcgctgctacaagaccactgggattgccaagagtcctagctcctcccccagaagaggtccagaaagctaagacaccaacacctgagcccttcgactcggagactcgcaaggttatccagatgcagtgcaacctggagaggtccgaagacaaggcgagatggcatctgacactgctcttggtgctggaagaccgcctgcacaggcaactcacatacgacctactccccactgactctgcccaggacttggcaagcgagctggtccactacgggtttctgcacgaagatgatagaatgaagctcgcagcgttcttggaatccacatttctcaaatatcgaggaactcaggcgtag

SEQ ID NO: 14542 - DNA, 564 bp, Artificial Sequence
  Description of Artificial Sequence: Synthetic coding sequence
atgctgggccgatacagggaatacagcaatggccaggctggggctatcgagcacctcaaggaaagcctggaacagagcattgaccagctgaggtcacaacgccttttaaggaattcaggtggtcgttcaatttctgtgacttccttatctgcttccgacctggacgggggaaccggctccgaactgcaccatttcccaccaacaagccccttgaaggattacggagatcctcagggaattaaacggatgagaagtcggacaggagttagattcgtgcaggaaactgatgatatgactcagctgcacgggttccaccagagcctccgcgacctgtcctccgaacagattcggctcggagatgatttcaacagagaactctctagacgtagtaggagcgatgccgagacgaagcgcgccctggaagagctgacagaaaagcttaatgaagcccagaagcaagaggtgttcttcgtcaaaagtcttggcaaagtgaagattcagtgcctgagttctgccgaggtggacaatgtctttcctataaatgtgtggcagtgcggcatctag

SEQ ID NO: 14543 - DNA, 927 bp, Artificial Sequence
  Description of Artificial Sequence: Synthetic coding sequence
atgatggacgtgagtggggtggggttcccctctaaagtcccatggaagaagatgagcgcagaagagctggagaatcagtactgcccgagccgctgggttgtccgattgggagccgaggaggccctgaggacatacagccagattggcatagaagcgacgacgcgcgctagggctacaagaaaaagcctactccacgtgccctacggtgatggcgagggcgaaaaggtggacatatactttcctgatgagtctagtgaggccctccctttttttctgtttttccatggcggctattggcaatctggtagtaaggacgaatcagcttttatggtgcatcctttgactgcccagggagttgcagtcgtgattgtggcctatggcattgcacccaaaggcactcttgatcacatggtggatcaggtgaccaggtcagttgccttcgtacaaaagcgttatccttctaacaaagggatatatctatgtggacactcagccggcgcgcatctcgcagccatgatgcttttagctgattggaccaagcacggggttacccccaacctgcgggggttctttcttgttagtggcgtgttcgacttggagccaatcgtttatacatctcagaacgtagcactccagttaactctggaggacgcccagcgcaacagcccacagctcaaggtggctcaggcccagcctgtggatccaacgtgtagagtgctcgtggtcgtgggtcagttcgacagtcctgaatttcatcggcagagctgggagttctaccaggtgcttccagtccagactctttgtcagggggagtggaaggcttcttttgaagagttgcatgacgtggaccactttgaaatcgtagagaatttgactcagaaggataacgtcctgacccagataattttgaaaacaatcttccaatag

SEQ ID NO: 14544 - DNA, 1461 bp, Artificial Sequence
  Description of Artificial Sequence: Synthetic coding sequence
atgagtgggagtacccctttccagatgcggttggttcacctcgacttgaagggagctccccccaaagtgtcctatctgtccgagattttcccactgttcagagcactgggtgctaatggattgctgatcgagtacgaagacatgttcccttatgaaggtccgctgagactgctgcgggccaaatatgcttactccccatccgaaattaaggagattcttcacctggctggcctcaacgagcttgaagtaatacccctcgtgcagacattcgggcatatggagtttgtcctgaaacacactgcctttgcacatctgcgggaggtgggctcttttccatgcacactgaatccccatgaagccgaatcattggccctggtgggcgctatgatcgatcaggtcctagaactccaccctggcgcccagagattgcatataggctgtgatgaggtgtattacttgggtgaaggcgaggccagccgtcggtggctacaacaggagcagaatagcacagggaaattgtgtctttctcacatgcgggctgtagcgagcggcgtgaaagcccgacgcccgtctgtaacgcccttagtatgggacgacatgctgcgggaccttcccgaagatcagctggcagctagcggcgtgccccagttggtcgaacccgtcctgtgggactataccgcagatctcgatgtgcatgggaaagtgcttctgatgcaaaagtataggcggtgcggcttcccgcaattgtgggccgcttctgcctttaagggcgcgacgggaccatcgcaggctgtgccacctgttgaacatcacttaagaaaccacgtacagtggctgcaagtagccggctctgggcctaccgatagtcttcaaggtatcatcctgacaggatggcaacgctacgaccattactcagtgctgtgtgaactcctccctgcgggagtcccctcactggcggcttgcctgcaactgctgcttaggggcgggttcgatgaagacgtcaaagccaaagtcgagaatctccttgggatctcctcattagaaaagacagacccagtgcgggagggcgcaggatcttttcctggttcaaatatccttgcactagtgacacaagttagcctgcacctgcgaagctctgttgacgcccttctggaaggaaacagatacgttaccggatggttcagcccatatcacaggcagaggaagctgatccatcccgtaatggtgcagcacatccaaccagcggccctgtctctgcttgctcaatggagtactctggtccaggagctcgaagcggccctccaactggctttttatcctgatgccgtcgaagagtggctggaagaaaacgtgcacccttctctgcagaggttacaggcgctgctccaggacctgtctgaggtctctgccccccctctgccaccaactagccctgggagagacgtcgctcaagacccatag

SEQ ID NO: 14545 - DNA, 240 bp, Artificial Sequence
  Description of Artificial Sequence: Synthetic coding sequence
atgtcaagccagcagcagcagcgacagcagcaacaatgtcctccacagagggcacagcagcagcaggtcaagcagccatgccagccaccacctgtgaagtgccaggaaacatgtgcccctaagacaaaagacccttgcgcccctcaagtgaaaaaacagtgtccccccaaagggaccatcattcccgctcagcagaaatgcccatcggctcaacaggcgtctaaaagcaaacagaaatag

SEQ ID NO: 14546 - DNA, 822 bp, Artificial Sequence
  Description of Artificial Sequence: Synthetic coding sequence
atgggtcagaaggtaacgggaggaattaaaacagtggacatgagagatcccacctatcgtcctcttaagcaagaattgcagggcctcgattattgcaagcccacacgcttggatttactgcttgatatgcctcccgtgtcctacgacgtgcagttgttgcattcctggaataataacgatagatccctgaatgtattcgtgaaagaggacgacaaactgatattccatagacatccagtggctcagagtactgacgcgattcgcggcaaagttggatatacacggggcctgcacgtgtggcaaattacatgggcaatgagacagcgggggactcacgctgtggtcggggttgccactgccgacgccccgctacactcagtcggttatacaactctagtcggcaataaccacgaaagctgggggtgggacctcggacgtaatagattgtaccatgatggaaaaaaccagccaagcaagacctatccggcattcctggaaccagatgagacttttatcgtaccagatagcttcctggttgccctcgacatggatgacgggacactgtccttcattgtcgacggtcagtacatgggagtcgccttccgcgggcttaaaggtaaaaagctgtatccggtggtgtctgcggtgtgggggcattgtgaaattaggatgcgatatctgaacggattagaccccgaaccgcttccgctcatggacctatgtcgtagatctgtcagactggctcttggacgggaacggttgggcgagatacacaccttgccactccctgcttctcttaaggcgtatctcctctaccagtag

SEQ ID NO: 14547 - DNA, 3315 bp, Artificial Sequence
  Description of Artificial Sequence: Synthetic coding sequence
atgggcaacgccgcagggtctgctgaacagcccgccgggccggcagcaccccctcccaaacagcccgccccccccaagcagcctatgccagctgcgggggagctggaggaaaggttcaatcgagctctcaactgtatgaatctcccccctgataaagtgcagttgcttagccagtatgacaatgaaaaaaagtgggaattgatttgtgatcaggaacggttccaagtgaagaaccctcctgccgcctacatccagaagctgaagtcctacgtagacaccggaggggtgtcacgaaaggtggctgccgactggatgtcaaatttggggtttaaaaggagggtccaagaatcaacccaggtcctcagagaactagagactagtctcagaaccaaccacattgggtgggtgcaggaattcttaaatgaggagaacagaggactggacgtgttgctcgagtatcttgcattcgcccagtgtagcgtgacgtatgacatggagtctactgataacggtgcttccaatagtgagaagaataaacccctcgaacaaagcgtagaagaccttagcaaaggaccaccctcttccgtgccaaagagccgacatctcacaatcaaactcacccctgcgcacagcaggaaggccctgcggaactctaggatcgtttctcagaaggacgacgttcatgtctgtattatgtgcctcagggctataatgaactaccagagtggcttttctctggtgatgaatcaccccgcctgtgtcaatgagattgctctgagcctcaataataagaaccctcggacgaaggccctagtgctagagctcttagccgccgtctgcctcgttcgaggaggccatgacatcatactggctgcgtttgacaactttaaggaagtgtgcggcgagcagcaccgatttgagaagctgatggagtactttcggaatgaagattcgaacattgactttatggttgcatgtatgcagttcataaatattgtggtccactctgtggaaaacatgaactttcgcgtttttctccaatatgaattcacacacctgggcctggatttatatcttgaacgcctgaggttaacagaatccgacaaactccaggtgcagatacaagcttacctcgacaacatcttcgatgtaggcgccctgcttgaagatacagagactaagaacgccgtgctcgagcacatggaggaattacaggaacaggttgcgttgctcacggagcggctgcgtgatgccgagaacgagtccatggccaagatcgccgaactggaaaagcagttgtcacaggccagaaaggaactggagaccttgagagaacggtttagcgagagcacagctatgggccccagccgccgcccacctgagccagagaaagccccacccgctgctcctactaggccaagtgcgcttgagctgaaagtagaggagctggaggaaaaaggcctcattcggattctgcgtggccccggcgatgccgtgtccattgaaattctccctgtggcagtagcaaccccctctggtggcgacgctccaacacctggcgtgccgactggtagcccttcccccgatctggcaccggctgcagagcccgcgcccggcgctgccccccccccaccgccacccctgcctggacttccctcccctcaagaggctccaccctctgccccaccccaagccccaccactgcctgggtcacccgagccaccgccagcaccccccctgcccggcgacctccctcctccgccgcccccccccccacctccccctggcacagacggtccagtgcctccccctcccccacccccccccccaccacccggagggccccccgacgcactcggtcgcagagattccgaactgggaccaggtgttaaggcaaagaagcctattcaaacaaagtttagaatgcccctcctcaattgggtcgcactcaaaccaagccagattactggtacagtgtttaccgagctcaatgacgagaaggtcctacaagagttggacatgtccgattttgaagaacagttcaagacaaagtctcagggtccatctctggacctgtctgcactcaaaagtaaggccgctcagaaagctcccagcaaggcgacactgatcgaggcaaatagggccaagaatctggctataacactgaggaagggtaacttaggagctgaacgtatctgtcaggctatcgaagcttatgaccttcaggctttagggctcgatttcctggagctcctgatgagattcttgcctaccgagtatgaaaggagcctgatcacgcgcttcgagcgcgaacagaggccgatggaggagttgtctgaagaagaccgctttatgctgtgctttagccgcataccacgactgccagagaggatgactaccttgacctttttaggtaacttccccgacactgcacagctgttgatgccccagttaaatgccattatcgccgcttctatgtccatcaaatccagtgacaagcttagacaaattttagaaatcgtcttggcttttggaaattatatgaactcctccaagagaggagcagcatatggctttaggctgcaaagcttggatgccctacttgagatgaaatcaacagaccgtaagcagacactgctgcactatctggtgaaggttatcgccgagaagtaccctcagcttacaggtttccactccgatttacattttctcgataaagcaggctcagttagtctggattctgtgctagcagacgtccgcagtctgcagcgcggactggagctcacacagcgggagttcgtgaggcaagatgattgtatggtgctgaaagaattcttacgcgctaacagcccgacaatggataaactgctggcagactcaaaaactgcacaggaggcttttgaatctgtggtggaatattttggagagaatcccaagaccacaagcccaggcttgttcttttcattgttcagcagatttattaaagcctacaagaaggcagaacaggaagtggaacagtggaagaaggaggcagccgcacaggaggccggcgccgatactcctggtaagggggaacccccagcccctaaatctcccccaaaagccaggaggccccagatggatttgatttccgagctcaagagaagacagcaaaaagaaccattgatctacgagtcagatcgggacggggcaattgaagatattataacagaccttcggaaccaaccgtatattagggctgataccgggcggaggagtgcccgacggcgtccacccgggcctccactccaggtgaccagcgacctttccctctag

SEQ ID NO: 14548 - DNA, 603 bp, Artificial Sequence
  Description of Artificial Sequence: Synthetic coding sequence
atggaggaaaagccttcgaaggtatcccttaagtcatccgataggcagggcagtgatgaagagagcgtgcactctgacactcgcgacctatggaccacgactaccctgagccaggcccaactcaatatgcctttatcagaggtgtgcgaaggatttgacgaagaggggcgcaatatctccaagactcggggctggcacagccccgggcgcggatcactggacgagggatataaagcaagtcacaagcctgaagagctcgatgagcacgccctggttgaactggagctgcatcgcgggtccagcatggagatcaacctgggggagaaggacaccgcctctcaaatagaggcagagaagtcgagttctatgagcagcttgaacattgccaaacacatgcctcacagagcttactgggctgaacagcagtcacgcctccccctgcccctgatggagctaatggagaatgaggctctggagattctcacgaaagcactcagaagctaccagctcggcatcggtcgagaccacttcctcactaaggagcttcagagatatattgagggtttaaagaaaagacgatcgaaaagactctacgtgaactag

SEQ ID NO: 14549 - DNA, 1044 bp, Artificial Sequence
  Description of Artificial Sequence: Synthetic coding sequence
atgaagttaacaagtgagaagcttccgaaaaatcccttctacgcctctgtctcccagtatgcagccaagaatcagaaattctttcagtggaagaaggagaagaccgactatacccacgccaatcttgtagacaaggctcttcaattgttaaaagagcgtatactgaaaggggatacgcttgcctactttttgagaggccagttatacttcgaggagggctggtatgaggaagcccttgagcagttcgaggagatcaaggaaaaagaccaccaagcaacgtaccaactgggtgtgatgtactatgatggcctagggacaaccctggatgccgaaaaaggcgtcgactatatgaagaagattctggattcaccctgcccaaaagcaagacatctgaagtttgcggccgcatataacctgggtagggcttactatgaaggaaaaggagtgaaacgttcaaacgaggaagctgaacgattgtggctaatcgcagcagacaacgggaatcccaaagcttctgtcaaggcccagtctatgttaggcctgtattatagcacaaaggaacctaaagagctcgagaaggcgttctactggcattctgaggcatgcgggaacggcaatctggagagccaaggcgcattaggcttgatgtatctgtatggtcagggcattagacaggacacagaggccgccctacagtgcctccgagaggccgccgaaagagggaatgtgtacgcacagggtaatctggtcgagtactactataagatgaaattcttcacaaagtgtgtagcctttagcaagcggatcgccgactacgatgaagttcatgacattcctatgatcgcgcaggtcaccgactgcctccccgagttcatcgggagaggtatggctatggcctctttctatcacgcacgatgcttacagttagggctagggataacccgggatgaaacgaccgccaaacactattactctaaagcctgtcggcttaatcccgccctggctgatgagctgcattccctgctcatccggcagcgtatctag

SEQ ID NO: 14550 - DNA, 3525 bp, Artificial Sequence
  Description of Artificial Sequence: Synthetic coding sequence
atgccactcccgttcggcctgaagctcaaaaggacaaggagatataccgtgagctccaagagctgtctcgtggcacgcattcagctgctcaataacgaattcgtggagttcacactgtcagtggagagcactggccaggagtcactggaagctgtggcccagcggctggagctgcgcgaagtgacatacttctctctttggtactataacaaacagaatcagcgtcgctgggtggacttggagaagccacttaagaagcagttagataaatatgccctggagcccactgtttactttggcgtcgttttctacgttccaagcgtgagccagttacaacaggaaattacccgttaccagtattatctccagcttaagaaggatatcctggagggctctatcccatgtacactggagcaggccattcagttggccgggttagcagtgcaggctgactttggagacttcgaccaatatgagagccaggactttctgcagaagtttgcattattcccggtggggtggcttcaggacgagaaggtcttagaggaggctacgcagaaagtggccttactgcaccaaaagtatagagggttgactgcacccgatgcagaaatgctctacatgcaagaggttgagcggatggatggctatggagaggaatcatacccagctaaagacagccagggcagtgacatttccattggcgcctgcctggaaggcatatttgtgaaacataaaaatggcaggcatcctgttgtgttccgttggcatgacattgctaatatgtcacacaataagtcctttttcgccctggagcttgctaacaaggaggagactatccagttccagacagaggatatggaaaccgcaaaatatatctggagactgtgtgtcgcccgccataaattctaccgactgaaccagtgcaaccttcagacgcaaaccgtgactgtaaatccaattcggagaagaagctcctctcggatgagccttcccaagccgcagccgtatgtgatgccaccccccccccagctgcactacaatggtcattacacagaaccttatgcttctagtcaggataatttgtttgttcccaatcagaacgggtactattgtcactctcagacctcattagatagggcacagatcgacctgaatggccgcatccgtaacggttctgtttattcggcccactcaactaattccctcaataatccccagccttatcttcagcccagcccaatgagctcaaacccttccatcacaggaagtgatgttatgcggccggactacttgcccagtcaccggcattcagcagtgattcccccctcttaccggccaacccccgactacgaaaccgtgatgaagcagctcaaccgcggcttagtccatgcagaacgccagagtcattccttgagaaacctaaatattgggtcctcctacgcttactctaggcccgcagccctcgtttatagccagcctgagataagagaacacgcacaactcccatcccctgccgccgctcattgtccctttagtctatcatacagttttcactctccttccccctacccctatcccgctgagagacgtcccgtggtgggggccgtttcggtccccgagctcaccaacgcacagctccaggcccaggactatccgtctccaaacatcatgcgcacacaagtgtatcgcccccctccgccctaccctcctccacggcccgcgaacagcactcccgatctttctcgccatctgtatatttcatcttctaacccagatctgatcaccaggagagtgcaccatagcgtacagacctttcaagaggatagtcttccagtcgcacatagccttcaggaggtatcagagcccctcactgccgcaaggcatgcacagctgcataaacgaaactcaatcgaggtggctggtctgtctcacgggctcgaagggctgaggctcaaagaaagaacgctgtccgccagcgccgcagaggttgctccccgggcagtgagcgtcgggtcccagccatccgtatttacagaacgaacgcagcgcgagggccctgaagaagcggaaggattacggtacgggcataaaaaatcattgtccgacgccaccatgctcattcactcatccgaggaggaggaagacgaagatttcgaagaggagtccggggcccgggcacccccggcgagggctcgggaaccccgcccgggcctcgcacaggatccacccggctgtccgagagtcctactcgctggacccttgcacatcctggaacctaaggcacacgtccctgatgccgaaaaaagaatgatggacagttcacccgtcaggacgacagctgaggctcagagaccttggagggacggattgctcatgccttccatgagtgaaagcgatttgaccactagcggaagataccgggcacgaagagactccctcaagaaacgaccagtgagcgatctactgtcgggaaaaaagaatatcgtggaaggattaccaccactcggaggcatgaaaaaaacgcgggtcgacgctaagaaaatcgggccattgaagctggctgccctgaacggtctgagcctcagtcgagtgccccttcccgacgaggggaaggaggttgcaacccgggcaactaacgacgaacgatgtaagattctcgagcagagactcgagcagggcatggtattcacagagtacgaaagaatactgaaaaaacggctggtcgacggtgagtgctcaactgcccggcttcccgaaaacgcagagaggaacagatttcaggatgtgctcccttacgatgacgtgcgcgtagaactcgtacccacaaaggaaaacaacaccggctacatcaacgcttcgcatatcaaggtatccgtatccggtatcgagtgggactatatagcaactcaaggcccattacagaacacttgccaggacttctggcagatggtctgggagcaaggtatcgccatcatcgccatggtcacagcggaggaggaaggcggcagggaaaagtctttccgctattggcctcgcttagggagcaggcacaataccgtgacctacgggcgattcaaaattaccacccggtttcgcactgacagtggttgttatgccacaacgggccttaaaatgaaacacctgctgactggccaggaacgtaccgtgtggcacctccagtatactgattggccagaacatgggtgcccggaagatctgaaaggtttcctgtcatacttagaggagatccagtctgtgaggagacacacaaattcaacatcagatcctcagagtccaaacccacccttgctggtgcactgctccgctggggtagggaggactggcgtggtcatccttagtgaaattatgattgcctgcctggagcacaatgaagtgctggatattcctcgggtgctggatatgctccggcaacagagaatgatgctggtgcagacgctttgtcaatatactttcgtgtatagggtgctcatacagttccttaagagtagcaggctgatttag

SEQ ID NO: 14551 - DNA, 2235 bp, Artificial Sequence
  Description of Artificial Sequence: Synthetic coding sequence
atggcagctgacaagccagccgatcagggggctgagaagcacgaggggactgggcagagttctggaatcaccgaccaagaaaaggagctgtccaccaatgcctttcaggcttttactagcggtaactacgatgcctgcctacagcaccttgcttgtctgcaagacatcaacaaagacgactacaagataattctcaataccgcggtggctgagttttttaaaagtaatcagacaacgaccgacaatctaagacaaacactcaaccagctcaagaatcaggtgcacagtgccgtggaggaaatggatggtctggatgatgtggagaacagcatgttgtactacaatcaggcagtgatactttaccacctccgacagtacactgaggctatcagcgtgggcgaaaagctgtatcagtttattgaacctttcgaggaaaaattcgctcaggcagtctgtttcctgctcgtcgatctctatattctcacctatcaggccgagaaagctctgcatctcctggcagttttggagaagatgatctctcagggaaataataacaagaatggcaaaaacgaaactggtaataacaataacaaggacggaagtaatcataaggccgagagtggagcacttatagaagctgctaagagcaaaattcatcagtataaggttcgtgcctacatacagatgaaaagcctgaaggcttgtaagagagaaattaaatcagtgatgaacacagccggcaactctgccccttccctttttctgaaaagcaatttcgaatatctgcggggcaactacaggaaagccgtgaagctgctcaactcctctaacatcgccgagcaccccggattcatgaaaacaggcgagtgcttgcgctgcatgttctggaataacttaggatgcattcattttgccatgagcaagcataatctgggcatcttttattttaaaaaagctctgcaggaaaatgacaatgtttgcgcacagctttctgccggcagtactgatcccggaaagaagttctcaggcagaccgatgtgtaccttgctgaccaataagcgctatgagctgctgtataattgtggtattcaacttctacacatcgggaggccgcttgcagcattcgagtgcctgatcgaggctgtccaggtctaccatgcgaatcccagattgtggttgaggctggcagaatgttgtatcgccgcgaataaaggaacaagtgagcaggaaacgaaaggccttcccagtaagaagggaatcgtgcagagcattgtcggtcagggataccacaggaagatcgtcctcgcctcccagagtattcagaacaccgtgtacaatgacgggcagtcttcagccattcctgtggcatcaatggagttcgcggcaatctgtcttcgaaacgcactgcttctgcttcctgaagagcagcaggatccgaaacaggagaacggggcaaagaacagtaaccagctggggggaaacacggaatcatctgagtcctctgagacctgctcttcaaaatctcacgatggcgataagttcatccctgccccaccttcctccccactcagaaagcaggaactggaaaatctgaaatgtagtattttagcctgctccgcatatgtggctctcgctctgggggacaatttaatggctctgaatcacgccgacaaactgcttcagcagccaaagctgagtggctctctgaaatttctggggcacctgtatgccgccgaggccctaatctccctcgatagaatcagtgatgcaattactcacctaaacccagaaaacgtcaccgacgtgagccttggaatcagctcaaacgaacaggatcagggtagcgacaaaggagaaaatgaagccatggaatcttctggcaaaagagcccctcagtgctacccatccagtgtgaattccgctcggacggtaatgctctttaatcttggtagcgcctattgtctgcgctccgagtacgacaaagctcgcaagtgtttgcatcaggcagcgtcaatgatccaccccaaggaggtcccaccagaggccatcttgctggctgtgtacctcgaactgcagaacggaaacacacagctggctctgcaaattataaaacggaatcagttactgcctgctgtaaaaacccattcagaggtacgcaagaaaccagtgtttcagcccgttcaccctattcaaccaatccagatgccagcgttcacgaccgtccaaaggaagtag

SEQ ID NO: 14552 - DNA, 363 bp, Artificial Sequence
  Description of Artificial Sequence: Synthetic coding sequence
atgcaccctccaccaccagccgcagcgatggacttctcacagaacagcttgttcgggtatatggaggatttacaagagctgaccatcattgagcgacctgtccgcagaagcctaaaaactccagaggaaatcgaacgcctcacggtggacgaggacctgtcggatatcgagagagctgtctacctcctgtctgccggccaggacgtgcaaggcactagcgtgattgcaaacttgccattcttaatgcgccaaaatcccactgaaactctgcgcagggtgttgccgaaagttcgagtgcacgaggatgctcatctctttattcagagagtgtggatctcacacatgttcgtgcagagggtttag

SEQ ID NO: 14553 - DNA, 1335 bp, Artificial Sequence
  Description of Artificial Sequence: Synthetic coding sequence
atgcgcgagatcgtgctgacacaaatcgggcaatgcggcaaccaaattggagcaaagttctgggaagtgattagtgatgagcatgcaatcgatagtgccggcacgtaccacggcgatagccacctccaattagaaagaattaacgtctattacaatgaggcgagtgggggcaggtacgtgcccagggccgtgctggtagacctcgaacccggcaccatggacagtgtgcgcagcggtccattcggtcaggtttttagaccagataattttatcttcggccagtgtggagccgggaataattgggccaaaggccattacacagaaggagccgagctgatggaaagcgtgatggacgtggtcaggaaggaggccgaatcatgtgactgtctgcaagggtttcagctgacacattccttaggtgggggcactgggtcaggaatgggtaccctccttctgtctaagatcagggaggaataccctgataggatcatcaataccttctctatcctacccagcccgaaggtgtccgacaccgtggtcgaaccttacaacgctaccctctcagtccatcagctcatcgagaatgccgatgaaactttctgtattgataacgaggccttgtacgatatttgctcaaaaaccttaaagctgcccacccccacttacggcgatctaaaccacctggttagcgcaactatgtctggtgtcaccacctgcctgcgttttccaggccagctgaacgctgacctgagaaagctggccgtcaacatggtgcctttccctcgcctccacttctttatgcctgggttcgcccccttgacaagccgcggaagtcagcagtaccgtgccctcacagtggccgagctcacacagcagatgtttgacgccaagaatatgatggccgcctgcgacccgagacatggcaggtatctcacagcggcggcaatattcagaggccggatgcccatgcgcgaagtggatgaacagatgttcaacatccaggacaagaactcatcctactttgcggactggctgccaaataatgtcaagaccgccgtatgtgatatccccccacggggcctgaagatgtctgctactttcattggtaataacacagccatacaggaactctttaaacgcgtgtccgaacagttcaccgctatgtttcgcagaaaagcctttttacactggtacacaggcgaagggatggacgagatggagtttaccgaagcagaatcaaacatgaatgacctggtgtctgagtatcagcaataccaagacgctaccgccgaagaagaagaagatgaggaatacgcggaagaggaagttgcatag

SEQ ID NO: 14554 - DNA, 915 bp, Artificial Sequence
  Description of Artificial Sequence: Synthetic coding sequence
atggctaaaattgaaaagaatgcaccaaccatggagaagaagcccgaactgttcaacatcatggaggtggatggcgtgccaacgttaatactctcaaaggagtggtgggaaaaggtttgtaattttcaggctaaacctgacgatctcatactggccacttaccccaaaagtggcacgacctggatgcacgagatccttgacatgattctgaacgacggtgatgttgaaaaatgtaaaagagcgcagaccctcgacaggcatgcgttccttgaactgaagttcccacacaaagaaaaaccagacctagaattcgtcctagaaatgtcatctcctcagttgattaagactcatctgccctctcacctgatcccaccctcaatctggaaggagaattgcaagattgtgtatgtagcacgaaatcccaaggattgcctggtttcctattaccacttccataggatggctagtttcatgcccgatccacaaaatcttgaagagttttacgaaaagtttatgtctggcaaagtcgtagggggaagttggttcgaccatgtgaagggctggtgggccgctaaagacatgcacagaattctgtaccttttttacgaggacatcaagaaggacccgaagcgggagatcgagaagatactgaagtttctggagaaggacatttccgaggagatactgaacaaaatcatctaccatacttctttcgacgtaatgaagcagaaccccatgaccaactacaccactctgcccactagcattatggaccatagcatcagcccattcatgcggaagggcatgccgggcgattggaagaattactttaccgtggctcaaaatgaagaatttgacaaagactatcaaaaaaaaatggctggctcaactctgacatttcgaacagagatctag

SEQ ID NO: 14555 - DNA, 216 bp, Artificial Sequence
  Description of Artificial Sequence: Synthetic coding sequence
atgtgcggcagctactacggaaattattacggcactcctggatacggattctgtgggtacgggggactagggtacggatacggcggcctggggtgtggttacggctcgtgctgtggatgtgggtttcgacgactgggatgcggctatggatacgggagccggtccttatgcggatatggatacggctgtgggtctggaagcggctactattattag

SEQ ID NO: 14556 - DNA, 2094 bp, Artificial Sequence
  Description of Artificial Sequence: Synthetic coding sequence
atggacaaaaagagcacagctgagaagttaggtaaggaacttgggctgcaggcaaaagagctaagcgcagtccacagcagccatcatgaaatcggggttaacgactctaatctgttcagtctcgagatgcgagagcccctggaaagcagcaatacgaagagtttccattcagctgtggaaatcaagaaccgatctcaacacgaactcccctgcttccagcatcacggcatagatactcccacttctctgcagaagcggtccgcctgttgtcccccctcattactccgactcgaggagaccgccagctcatcacaggatggcgatccccagatttgggacgaccttcccttctccgagtcattgaataagttccttgctgtgctggaatcagagatcgcggtgactcaggccgatgtgagcagccgcaagcaccatgtggataatgatatcgataagttccacgccgaccactctcgcctcagcgttacacctcaaagaaccacgggtgcactacatacaccaccaatcgctctgcgctcaagccaggtcatcgtgaaagcgaattgtagcaaagacgattttctctttaactgcaaggggaacctgtccccttccgtggaaaaagagtcacaacccgataacaaggtcgaggctgtgtctgtgaatcacaacggtagggacatgtcagaatacttcctgcccaacccctacctgagtgctttgtcttctagctccaaagaccttgagacgatcgtgaccctgaaaaaaacaatcaggattagcccccacagagagtctgaccactcttcactgaataataagtatttgaatggctgtggagagatctctgtctcagagatgaacgagaagctgaccaccctgtgttacagaaagtataatgatgtgtcagatctctgtaaactggagaacaaacagtactgcagatggtcgaaaaaccaggatgacagcttcacgatctgtcgtaaattaacttatccgttggaaaccctgtgcaactctccaaacagatcaacgaatacccttaaagaaatgccgtggggccatatcaataacaacgttacccaaagctacagtattgggtacgagggaagttacgacgcttctgcagatctgtttgatgacatcgccaaagagatggacatcgccacagaaataactaaaaagtctcaggacatactacttaagtggggaacttctctggctgaaagccatcctagtgagtcagacttctctctgagaagcctaagtgaagactttatacagccctctcagaaactcagcctgcagtctctcagcgacagccgacactccagaacttgttcccctacaccccactttcagtcagatagcgagtacaacttcgagaattcccaggattttgtgccgtgttcacaaagcacgccaatatccggattccatcaaactagaattcacgggatcaatcgggccttcaaaaagcctgtcttctactctgacctcgatggcaactacgagaagattaggatattcccagagaatgacaaacagcaggcatctccttcttgtcccaaaaatatcaaaacaccctcccagaagattcgttcacccatcgtcagcggggtcagtcagccagatgtgttcaaccattacccttttgccgagtgtcatgagactgattctgacgagtgggtcccgccaactacccagaagattttcccctctgatatgttaggatttcagggaatcggccttggaaaatgtctggccgcttaccacttcccagatcagcaggagctgccacgtaagaagttgaagcatatcagacagggaaccaataagggcctgatcaaaaagaagttgaagaacatgctggccgcagtggtaactaagaagaaaactcataaatacaactgtaagtcaagcggatggatctcaaaatgccccgatatccaagtccttgcagcccctcagctgcaccctatactcggccctgattcctgttctgaggttaagtgctgcctgccattcagtgaaaaaggtccaccatctgtgtgtgagacacgttccgcgtggtcgcctgagctttttagctag

SEQ ID NO: 14557 - DNA, 306 bp, Artificial Sequence
  Description of Artificial Sequence: Synthetic coding sequence
atgtctaacacccaggcggagcggtctattattggcatgattgatatgttccacaagtataccggcagagacgggaagatcgagaaaccatccctgttgacaatgatgaaggaaaacttccccaatttcctatcagcttgtgataaaaagggcattcactatttggccaccgtcttcgagaaaaaagataagaacgaagacaaaaagattgactttagcgaatttctgtctttgttgggagatatagccgctgattatcataagcagtcgcacggggcggcaccctgctctggcggaagccaatag

SEQ ID NO: 14558 - DNA, 678 bp, Artificial Sequence
  Description of Artificial Sequence: Synthetic coding sequence
atggctgtgaggtccctctgggccggacgcctcagagtgcagcgacttctcgcatggagcgctgcctgggagtctaaaggttggcctttacccttttctacagccacacagcgaacggctggagaagattgtcgctccgaggaccctccagacgagttgggacctccactggcagaaagggccctacgagtaaaagccgttaagttggaaaaggaggtccaagacctcacggtacgataccagagagctattgcggactgtgagaatattcgaaggcggactcagcgttgtgttgaggacgctaaaatatttggaatccagagcttttgcaaggacctcgtggaagtggccgacatcttggagaagacaactgagtgcataagcgaggaatcagagcccgaagaccagaaactcaccctggagaaggtattcaggggcttgctgttgttagaggcaaaattgaaaagtgtcttcgccaagcatggcctggagaagcttacccccatcggggataagtacgatcctcatgaacatgagctcatctgccacgtgcccgccggcgtcggagtgcagcccggcacagttgccctggtgcgtcaggacggatacaagttgcatggccgaaccatacggctggcccgagtggaggttgccgttgaatcacagagacgtttgtag

SEQ ID NO: 14559 - DNA, 1203 bp, Artificial Sequence
  Description of Artificial Sequence: Synthetic coding sequence
atgaccacgaagaatctggaaacaaaagtgaccgtcacttcctcccctatccgaggggccggtgacggaatggaaactgaagaaccaccgaagtcagttgaagtgacaagcggagtgcagagtcgtaaacatcactccctgcagagcccatggaaaaaggccgtgcccagtgagtctcccggagtgttgcagctcggtaaaatgctgactgagaaggccatggaagtgaaagccgtccggatcctcgtcccgaaggccgccatcactcacgacatacccaacaagaacaccaaggtcaagagtctaggtcatcacaagggggagtttttgggacagagcgagggagtcattgaaccaaacaaagaattgtcggaagtaaaaaacgtgctggagaaacttaagaactccgagcgtcggttactgcaggacaaggaaggactatccaatcagctgcgcgtgcagaccgaagtgaacagggaactcaagaagctgctggttgcaagtgttggcgacgatctccaatatcatttcgagcgactagcccgggagaagaaccagctaatcctggaaaacgaggcactgggacggaacactgctcagctgagcgagcagctggaacggatgtctatacaatgcgacgtatggaggagtaagttcttggcctcacgcgtcatggccgatgagttgacaaactcccgggcagcactgcagaggcagaaccgagatgctcacggtgccatccaggaccttctgagcgaaagggagcagttccgccaagagatgatcgcaacacagaagcttctggaagagttgctggtaagcctgcagtggggccgagaacaaacatattcccccagcgttcagcctcactccacagctgagttggcgctcactaatcataagttagcaaaagcagtgaattcccatcttctcggcaacgttggtatcaacaaccagaagaagataccatccactgtggagttctgtagtacaccagctgaaaaaatggcggagacagttcttcgtatcctggacccagtcacatgcaaggagtcgtctccggataatccctttttcgaatcgagccccactaccctcctggccactaagaagaacattgggcgattccacccctatacacggtatgaaaacattacctttaactgttgcaaccactgcaggggcgagttgatcgccctctag

SEQ ID NO: 14560 - DNA, 735 bp, Artificial Sequence
  Description of Artificial Sequence: Synthetic coding sequence
atggatccaggagccgccctgcagcgacgagcgggcggtggtggtggtctcggcgccggatcccccgccttaagcgggggtcagggaagacggcgaaagcagcctcccaggccagccgacttcaaactccaagtaattatcatcggaagccgcggcgtaggtaagacgagcctgatggagcgcttcaccgacgacactttctgtgaagcatgtaaatccacagtgggggtggacttcaaaattaagactgtggagttgcgcggcaaaaaaatccggctgcagatttgggacaccgctggtcaggagagattcaatagcatcacttccgcctattatcggagcgcaaaaggaataattctagtctatgatatcaccaaaaaggagacattcgatgatctgcctaaatggatgaagatgatagacaagtatgcttcggaagacgccgaattactactcgtgggcaataagctggattgtgaaacggatcgggaaattacgaggcagcagggcgaaaagttcgcgcagcagatcaccgggatgaggttctgtgaagcaagcgccaaagacaatttcaacgtggacgagatttttcttaaattggtggatgatatcctaaaaaagatgcctctggatattctgagaaacgagctttccaacagtattctcagcctgcaacccgagccagagatcccaccagaattgcctccacctcgcccacacgttagatgctgttag

SEQ ID NO: 14561 - DNA, 1158 bp, Artificial Sequence
  Description of Artificial Sequence: Synthetic coding sequence
atggccctgccccacgatagcaacgagactagttacttgctgccccccaacaacgaagactgggggcgccagactatccctgattttgtttatggccagaaagatctcatggccgaaggcatccagtggccccggaacgcccccgggattcctgacgccctcccacagagcccctttgatgcagcactttgcagtgcctggaagcagcgcgtcgagttgggcttattccgatatagactgcgggagctgcagacacaaattctgcccggtgccgtcgggttcgtggcccaactgaacgtggagcgcggggtccagaggagaccaccccagaccataaagagtgtgcgccaagcctttgaccccgtccagtttaacttcaacaaaataaggcctggcgaggtcctctttcgcctgcaccgtgagcctgacctgcccgggaccctgctccaggaggatattcttgtcgtgatcaatgtctctccgttagagtggggccacgtgctgttggtccctgagccagctcgtcaactgccacagagacttctcccaggcgcccttagagcaggtatcgaagctgtgttactgtcgctgcatcccggatttcgggttggctttaactctctggggggcctggcctccgtcaatcatcttcaccttcatggttactatctggcccatagactccccgtggagcaggcccctagcgagcccttggatcccggcggtcatctgcatctgctgcaagatttgcctgcccctggctttttgttctacactcggggtcctggtcctgatttggagtcactcatatcccgggtgtgtagggctacagactacctgacagatcatgaaattgcccacaacctgtttgtcactcgaggggccccgcccggaaaaaccagtccttcatctgccttgacgggagtgcgagtgattttgtgggcccggaaatcctcattcggaatcaaggatggagaggccttcaacgtcgcactgtgtgaactggccggacacttacccgtgaaaactagccaggacttctcaagcctgaccgaagccgccgcagtcgctctcatccaggattgtcgcctcccccccagtcaggccgaagacgtgcaggccgccctggttgccctgatgagccaggaagagcaatag

SEQ ID NO: 14562 - DNA, 192 bp, Artificial Sequence
  Description of Artificial Sequence: Synthetic coding sequence
atgttgtgtgataacttccctggcgctgtatttcctggctgctattggggcagctatggctaccccctgggatatagcgttgggtgcggttatggctctacatactcgcctgtcggctatggctttgggtacggctacaatgggtgcggcgctttcggctatcggagatattcaccttttgctctctactag

SEQ ID NO: 14563 - DNA, 1083 bp, Artificial Sequence
  Description of Artificial Sequence: Synthetic coding sequence
atgctgggtagcgggttcaaagccgaaaggttgcgggtgaacctgcgtctggtgatcaacagactcaagcttctggaaaaaaagaaaaccgagctggcccagaaggcccgcaaagagatagccgattacttagccgccggaaaggatgaacgcgcacgcatcagggtcgagcatattatacgtgaggattatctcgtggaagctatggaaattttagagctgtattgcgacctgcttcttgctagatttggattaatccagagcatgaaggagttagacagtggcctcgccgaatcagttagtactttaatctgggctgcaccgcgcctacagtctgaggtggccgagctcaagatagtggccgatcagctttgtgctaagtatagcaaagagtacggtaaactgtgtcgcaccaaccagatcggaacagttaacgaccggctcatgcataaactgtccgtggaagcacccccaaagatcctggtcgaaaggtatctgatagaaatagccaagaattacaatgttccttatgaacccgacagtgtcgtgatggccgaagctccgccgggagtggagactgatctcatagatgttgggtttaccgatgacgttaaaaagggcggccccggtagaggcggctcaggtgggttcaccgctcctgtggggggacccgatggaacagtgcccatgcccatgcctatgcctatgcccatgcccagcgcaaataccccctttagttatccactccccaaaggtcccagcgacttcaacggattgccgatgggcacgtatcaggccttccccaacatccacccaccacagattcctgctactcctccatcatacgaaagcatgactcttatgctaatcagaatttccctgcttcatcggctgctggtccttgacccatcccagaagccattgcagtcctttctcccagacttacagatcacaatgactaccctctcataccagagctgccacctgtgccaaacccactaccagctacacctcttagtgcccgcccctcagcacttgaaaacactcacacttatgatcttccctggtggcctgaagagctag

SEQ ID NO: 14564 - DNA, 528 bp, Artificial Sequence
  Description of Artificial Sequence: Synthetic coding sequence
atgccaaagcggagttgtccctttgctgatgtggctccactccagctgaaagtccgagtctctcagcgggaactgtcccggggagtgtgcgcggagcgatactctcaggaagtatttgagaaaacaaagcgcttattgttcctcggtgcacaggcatatctcgatcacgtatgggatgagggctgtgcggtggtgcacctcccagaatcaccaaaaccagggcccaccggggcgcccagggctgcccggggccagatgctgattggccccgatggaagacttattcgctcactgggccaggcttctgaagctgacccttccggagttgcttccatcgcatgtagctcatgtgtgagagcggtggacggcaaagcagtttgtgggcagtgtgaacgcgccctctgcggtcagtgcgttcgcacctgttggggatgtggtagtgtggcctgtactctctgcgggctcgtcgactgctcagatatgtatgaaaaggttttgtgcacatcatgcgctatgtttgagacatag

SEQ ID NO: 14565 - DNA, 366 bp, Artificial Sequence
  Description of Artificial Sequence: Synthetic coding sequence
atggaggctgaagtcgacaaactcgagcttatgtttcagaaagccgaaagtgatttggattacatccagtaccgtttggagtacgagatcaagacaaaccacccagactcagcctcagaaaaaaatcctgtgaccctcctgaaagagctgtccgttatcaagagccgatatcaaaccttatacgcacgattcaaacctgtcgctgtcgaacaaaaggagagtaagtctcggatttgtgccaccgtcaaaaagacaatgaatatgattcagaagctccagaagcagacggatttggagctgtccccgctcactaaagaagagaaaaccgcagcagagcagttcaagtttcacatgccagacctctag

SEQ ID NO: 14566 - DNA, 1968 bp, Artificial Sequence
  Description of Artificial Sequence: Synthetic coding sequence
atggtgactaccctcgggcccaaaatggctgctgagtggggggggggcgttggctacagcggctctggcccgggtcgctcaaggtggcggtggagcggctccgtgtgggttcggagtgttttactgttgttgggcggattgagagcttccgctacctctactcccgttagcctggggagctcacctccgtgtcgtcaccatgtgccctccgatacagaagtaattaacaaggtccacctaaaagccaatcatgtggtgaagagggacgtggacgaacacctgaggatcaaaactgtgtacgataagtcagtggaggagctgctccctgagaagaaaaatctggtcaaaaataaattattcccccaggcaatttcatacctggaaaaaaccttccaagtgcgtcggcccgctggcacgatcttactcagtagacagtgtgccaccaatcagtatctcagaaaagagaatgacccacatcgctactgtacaggtgagtgtgctgcccacacaaaatgcggtcccgtgatagttcctgaggagcacttacagcagtgccgggtgtaccgcggcggaaagtggccacatggcgccgtgggagtccccgatcaggaaggtatcagtgatgctgatttcgtgctatacgtcggcgctctggctacagaacgttgctcccacgagaatattataagctatgccgcatactgtcagcaggaggctaacatggatcgccctattgcaggatacgcgaacttgtgtcctaatatgatctcaacacagccacaagagttcgtgggaatgctgtctactgtgaagcatgaagtgattcacgcactcggattcagtgccgggttgttcgccttttatcatgataaagatggcaatcccctgacgtcccggtttgctgatggattaccgccgtttaactatagtctcgggctataccagtggagtgataaggtggtgaggaaagtggagcggctgtgggacgtgcgggataacaaaatagtgcgtcacacggtctacctgctcgtgacaccgcgcgtcgtggaggaagctagaaagcatttcgactgcccagtcctggaaggaatggagctggagaaccaaggaggagtcgggacagagctgaatcattgggaaaaacgcctgctggaaaacgaagcaatgaccgggtctcatacccaaaatagagttttgagccggatcacgctggctctgatggaagacactggtcggcagatgctttcaccgtactgtgatacgttaaggtctaaccctttgcagctcacatgccgccaggaccagagagccgttgcggtgtgcaatcttcaaaaatttcctaaacctcttccacaagaatatcagtacttcgacgagctttccggaattcccgctgaagacctcccatactacggcgggtccgttgaaatcgcggactactgcccgttctctcaagagtttagttggcacctgagtggcgaataccagcggagctctgactgccgcatcctggaaaatcaaccggagatcttcaaaaactacggcgctgaaaagtacgggccccactcagtgtgcctgatccagaaatctgccttcgtaatggaaaagtgcgaacgaaaattgtcttaccctgactgggggtccggctgttatcaggtgagttgttccccacagggcctgaaggtgtgggtacaggacacctcctatctttgcagtagagcaggtcaagtgctgcccgtgagcattcagatgaatggctggatccatgatggaaacctgctttgtccttcctgttgggacttttgcgagctctgtcctccagaaactgaccccccagccacaaacttgactcgcgctcttcccttagacctgtgctcttgttcaagctctctggtggtgactctatggctcctgctcggcaacctttttcccttactcgcaggcttcttgttgtgcatttggcattag

SEQ ID NO: 14567 - DNA, 408 bp, Artificial Sequence
  Description of Artificial Sequence: Synthetic coding sequence
atgggtagagtgaggaccaagacagtgaagaaggcagccagggtaattatcgagaaatattacacccgtctgggaaacgactttcatacgaataaacgagtgtgcgaggaaatagccatcattcctagcaagaaacttcgtaataagattgctggatacgtgacacacctgatgaagagaattcaacgtgggcctgtccgcgggattagcataaagttgcaggaggaagaacgggagaggagagataattatgtacctgaggtttcagccttggatcaggagatcatcgaggtggatccagatactaaggaaatgctcaagctactggattttggctctttgtcaaatctccaggttacccaaccaactgtgggaatgaatttcaaaaccccgaggggcccagtttag

SEQ ID NO: 14568 - DNA, 1119 bp, Artificial Sequence
  Description of Artificial Sequence: Synthetic coding sequence
atgaatcactgtcagctgcctgtcgtgatcgataatggatccggtatgattaaagcaggcgtggccggttgccgcgaaccccagttcatctaccctaacatcattggcagagccaaaggccagagcagggccgctcagggcggactggaactgtgcgtgggagaccaggctcaggactggagaagctcactgtttatttcgtatcccgtggaaagaggcttgattactagttgggaggatatggaaatcatgtggaagcacatctacgactataatctcaaacttaagccgtgcgatggccccgtgctgatcacagaacctgccttgaatccattagcaaatcgacagcagattaccgaaatgttctttgagcatttgggtgtacccgctttctacatgtcgatccaagccgtgttggctctgtttgccgccgggtttacaacaggattggtcctgaattctggagctggagttacacagagcgtgccgatcttcgaggggtactgcctcccacatggtgttcaacagctcgacctagccggccttgatttaaccaattacctcatggtactcatgaaaaatcacgggatcatgctgctgagtgcaagcgatcgcaaaatcgttgaggacatcaaggagtctttctgttacgtggcaatgaattacgaggaagagatggccaagaagcccgactgcctcgaaaaggtctaccagctcccagacggaaaagtgattcagctgcatgatcagcttttcagctgccccgaagcactttttagcccatgtcacatgaatttggaagcaccagggattgataagatatgcttttccagtataatgaaatgcgacacgggattacggaatagtttcttcagcaacatcatcctggccggtggatcaacttcatttcccgggctcgataagcgtctggttaaggatatagcgaaggtggcccctgccaacactgcagtgcaggtgattgctccacccgagagaaaaatatcagtctggatggggggatcaattctcgccagcctaagcgccttccaagacatgtggatcacagctgccgagttcaaggaagtggggcccaacatagtgcatcagaggtgcttctag

SEQ ID NO: 14569 - DNA, 3072 bp, Artificial Sequence
  Description of Artificial Sequence: Synthetic coding sequence
atggatgccaattccaaggacaagccacccgagactaaagagagcgcaatgaacaacgcaggcaacgcaagcttcatattgggtacaggaaagatcgtgaccccccaaaaacatgccgaattgcctccaaatccatgcactcctgacacgttcaaaagccctctcaacttcagcacagtgactgtggaacagcttggcattacaccagagtcttttgtgcggaattctgcgggcaaaagctcaagctatctgaagaaatgtcgacggcgcagcgcggtaggtgccagaggtagtccagagaccaaccaccttattagattcattgcccggcaacagaatatcaaaaatgcaaggaaaagtcctttggcacaagacagcccttcacaaggcagcccggctctataccgcaacgtaaacacactccgcgaaaggatatcagcgttccagagcgccttccatagtataaaagagaatgagaaaatgactgggtgcctcgagttcagtgaggcgggaaaggaaagcgagatgacggatttaacccgcaaggagggactctcggcttgccagcagagcgggtttccagctgtcctgtcgagcaaaagacgaaggatttcctaccagcgcgattccgatgagaacttgacagatgcggaggggaaagtgataggtctgcagattttcaacattgatacggacagagcatgcgctgtggagacgtccgtagatcttagtgaaatctcctcgaagctgggaagcacacaaagcgggtttctcgtggaggaaagcctaccactgagcgagttgaccgagacgtctaatgctttgaaggttgccgattgtgtcgttggcaagggctcgtccgatgccgtttcccctgatacgtttaccgcagaggtaagctccgacgctgtgcccgatgttcgcagccccgccacaccagcctgtcgccgagatctgccgacacccaaaacgttcgtcctgaggagtgtcctgaaaaagccatccgtaaaaatgtgccttgagagtctacaggaacattgtaacaacttgtacgacgatgatggtacacacccttccctgatctctaacctgcccaactgttgcaaggaaaaggaggcagaagatgaagagaacttcgaggctcctgctttcctgaacatgcgcaagcggaaacgcgttacctttggggaggacttatctcccgaggtttttgacgagtctttaccagccaatacaccactgcgaaaaggcggcacccctgtgtgtaagaaagacttctctggactcagcagtctgctgttggagcaaagcccagtcccagagccactgccccagccggattttgacgataagggcgaaaatttggaaaacatagaaccactacaggtgagctttgcggtgctatctagcccgaataagagctctatcagtgaaacccttagcggcactgatacatttagcagttccaacaaccatgagaagataagcagtcctaaggtgggacggatcacaagaacgtccaatagacgaaaccagttagtatctgtggtggaggagtcagtgtgtaacctattgaatactgaagtgcaaccttgcaaggaaaagaagattaaccgacgcaagtcacaggaaaccaaatgcacgaagagggcactgcccaaaaagtctcaggtcttaaagtcctgcaggaagaagaaaggtaagggcaaaaagagcgttcagaagtcactctatggggagcgagacattgctagtaaaaagcccctgctctccccaatccctgagctgcccgaggtacccgaaatgacaccatccataccttccatccgacggctcggctcagggtatttcagcagtaatggtaagctggaggaggttaagacgcctaaaaaccccgtgaaaaggaaagatctcctgcgccatgatcccgatcttcatatgcaccagggatatgataaatatgacgtgtctgaattttgcagttatatcaagtcatcttcctccttgggcaacgctacttccgacgaggacccaaatactaacatcatgaatatcaatgagaataagaacatccccaaagctaagaataagtcagagtcagaaaatgagcccaaagcagggaccgactcccccgtctcttgcgcgtcagttaccgaggagagggtggcctcagactccccaaaaccagcgctcaccctgcagcaaggtcaagaattctccgccggaggccaaaatgctgagaatctttgccagttcttcaagatatcccccgatctcaatattaaatgcgagcggaaggatgattttctcggggccgcagaaggaaagcttcagtgcaatcgactgatgccaaactctcaaaaagattgccactgcttgggcgatgttttgattgagaatactaaggagtccaagtctcagagtgaagatctgggcaggaagccaatggaaagttctagtgtggtgtcatgcagggatcggaaagataggcgccgctccatgtgttattcagatgggagaagtctccatctggagaaaaatggaaaccatacccccagttcatcggtgggaagcagcgtggagatttctctggagaacagtgaactttttaaggacctttcagatgccattgagcagaccttccagcggcgcaacagcgagacaaaggtgaggaggtctaccaggctgcaaaaagacctggagaatgagggactggtgtggataagtttaccccttccctctacaagccagaaggcaaagagaagaactatctgtacatttgacagtagcggcttcgagtccatgtcgcctatcaaggagacagtttctagccggcagaaaccccaaatggccccacccgtcagcgaccccgagaatagccagggtccagcagccggttcctcagacgagcccgggaagagacggaagtccttctgtatctctactctggctaacacaaaggcgacaagccaatttaaagggtatcggcgacgctcaagcctgaacggaaagggggagtcgtctctgacagccctcgagcggatagagcacaatggggaaagaaaacagtag

SEQ ID NO: 14570 - DNA, 963 bp, Artificial Sequence
  Description of Artificial Sequence: Synthetic coding sequence
atgagtaaatctgagagccctaaggaacccgaacaactgaggaaattgtttatagggggactctcttttgaaacaaccgacgagtcactgcgatcccacttcgaacaatgggggacactgaccgattgcgtggttatgagggatcccaacactaagcgaagcagaggcttcggttttgtgacttacgcaaccgtggaagaagtggatgccgccatgaatgcgagacctcataaggtcgacggtcgcgttgtcgaacctaagcgggccgtctcaagggaagacagccagcggccaggagcgcatctgactgtgaaaaaaatatttgtgggcgggataaaagaggataccgaggaacaccatttgagggactacttcgagcagtacggcaagattgaggtgatagaaattatgactgatcgtggcagtggaaaaaagcgcggcttcgcatttgttacattcgacgaccacgatagtgtcgacaaaatcgtcatccagaaatatcacaccgtgaacgggcataattgtgaagtgaggaaagccctgagcaaacaagaaatggccagcgctagttcttcccagagaggccgttccggatctgggaacttcgggggaggccgtggaggcgggtttgggggcaatgataactttggcagggggggcaatttctctggcaggggggggtttggcggcagtcgggggggcggcgggtacggtgggtcgggggatggttacaatggatttggcaacgatggtaacaactttggaggcggcgggtcttacaacgacttcggcaactacaacaaccagtcaagtaatttcggtcccatgaaaggcggaaatttcggcgggcgctcttctgggccgtacgggggcggaggacagtacttcgccaaaccgaggaaccagggcgggtacgggggttccagttcctcttcaagttacgggagcgggaggcgattttag

SEQ ID NO: 14571 - DNA, 141 bp, Artificial Sequence
  Description of Artificial Sequence: Synthetic coding sequence
atgtgctctcttgccagtggggccaccggctactctcatctcttaaagaaacactttcacacagtgtctctgtctatctccctcatcctgactgcctggttcattaatatggatttgaatttcatggacacactctcctag

SEQ ID NO: 14572 - DNA, 198 bp, Artificial Sequence
  Description of Artificial Sequence: Synthetic coding sequence
atgtgttactatagcaactattatggcggcttacgatatggatacggggtgttgggcgggggttacggctgtggctgtggttacggtcacggctacggtgggctggggtgcggatacggccggggctatggcggatacggatacggctgctgtaggccctcatgttatggcaggtactggagttgtggtttttactag

SEQ ID NO: 14573 - DNA, 7059 bp, Artificial Sequence
  Description of Artificial Sequence: Synthetic coding sequence
atggagaaggccaccgtacccgtcgctgcggccacagccgctgaaggggaaggatctccgcccgccgttgccgctgtggccgggccccccgccgccgcagaagtgggggggggcgtgggaggatcttcaagggcacggtccgcaagctcacctcgaggcatggtgagagtgtgtgatctgctcctgaaaaaaaagcccccacagcagcagcatcataaggcaaagagaaatcgcacctgtcgcccaccttcatcttcggaaagctcatccgactcggacaattcagggggaggaggtggcggggggggcggcggaggggggggcggtggtacctcttcaaataactccgaagaggaagaggatgatgacgacgaagaagaagaagtgagcgaggttgagtcatttatcttggaccaagacgatctagagaacccaatgctcgaaacagcaagcaagttgctgcttagcggaaccgctgatggggcggacctgcggaccgtggaccctgaaacgcaggcaaggctggaagcgcttctcgaggcagcaggaatcgggaaactctccacggccgatggcaaagctttcgccgatcccgaagttttgcggcgtttgacttcaagcgtaagctgcgctctggatgaagccgccgcagccctcacccgtatgcgagccgagtccacagccaacgccggtcagtcagacaatcgctctctagccgaggcatgcagtgagggcgacgtcaacgctgttcggaagcttcttattgaaggcagaagcgtgaacgagcacaccgaggaaggcgagagcctgttatgcctagcgtgctcagcgggctactacgagttggctcaggtcctattggccatgcacgctaacgtcgaagatcgtggcatcaaaggagacataactcctctcatggctgcggccaacgggggacacgtcaagatcgtgaagctgttgttggcgcataaggccgatgtcaacgctcagtcatccacggggaataccgctttgacttatgcttgtgctggaggctacgttgacgtggtgaaagttttactggagtctggggcatctatcgaggatcataacgagaacggtcacacccctctgatggaggccggcagtgccggtcacgttgaagtagcccggctcttgctggagaatggcgctggaatcaacacacactcaaatgaattcaaggagtctgccctcacgcttgcctgttataaagggcatctagagatggtgagatttcttcttgaggccggtgctgatcaggaacacaaaactgacgagatgcatacagccctgatggaggcatgtatggatggccatgtagaagtggctcggctgttgctggattccggtgcacaggtgaatatgcctgctgactccttcgaatccccgctgactctcgcagcatgcggcggccacgttgagctggctgccctgttgattgaacgcggggcctccctggaagaggtgaatgatgagggctatacccctcttatggaagcagctcgggagggccacgaggagatggtagccctgcttttgggacagggcgctaacatcaatgcacagactgaagagacgcaggagactgcccttaccctggcatgttgcggcggttttctcgaagtagccgactttttgatcaaggccggggctgatatagagttagggtgttccacacccttgatggaggccgcgcaggaagggcacttagagcttgtgaagtatctgttggccgccggggctaacgtgcacgccaccacagcaactggcgatacggctcttacttacgcttgtgagaatggacacaccgacgtagccgacgtcctactgcaggccggcgcagacttagaacatgagtccgaggggggccgcacacccctcatgaaggctgcccgggccggccatgtctgcacagtgcaatttcttatcagcaagggcgccaacgtgaaccggaccaccgcaaataacgatcatactgtactaagtctcgcctgtgctggggggcacctagccgtcgtcgaactgctgctggcacatggcgctgatcctacacatcgactaaaagacggttctaccatgctgattgaggcagccaaaggcggccacacttctgtggtgtgctatctcttagactacccaaataatctactcagcgcacccccccccgatgttactcaactcacacccccctcccacgacctgaatagggctccccgagttcctgttcaggcgctgcctatggtggtccccccacaggaacctgataagccccctgctaacgtagctactacgctgcccatcagaaataaagccgtgtctggccgcgcaagcgcgatgtctaacaccccgacacactcgattgctgccagtatcagccaacctcagacaccaaccccaagtcccataatcagccccagtgccatgctgcccatctatccagccattgatattgatgctcaaactgagtctaaccatgacaccgcattgaccttagcgtgtgctggcggacatgaggagttggtccagactttgctggagaggggagcctcaattgagcatcgggacaagaagggttttacacccctaattctcgcagccactgccggacacgttggcgtagtagaaatactactggacaatggagccgacattgaggcccagtctgagcgcaccaaggatacccctctttcactggcctgttcaggagggcgacaggaggtggtcgagttattactggctaggggggccaacaaggaacaccgtaatgttagtgattacacaccactgtctttggccgcctctggcggttatgtaaacattatcaaaatactgctgaacgccggcgctgaaattaatagtagaactgggagcaagttggggatatcacctttgatgttggcagctatgaacggtcacaccgccgccgtcaagctgctcttggacatgggtagtgacataaatgcacagatcgaaactaatagaaacaccgctctgacactggcttgctttcaggggagaactgaggttgtgtccctgctgcttgatagaaaggctaatgtcgagcacagagctaaaacaggtctaactccgttgatggaagccgcttcaggcggctacgccgaggtcggaagagtgctattggacaagggcgcagatgtgaacgctcctcctgtaccttctagccgggatactgcactgacgatagcggcggacaaaggacactacaaattttgcgagctgctgatcgggcggggggcccatattgacgtgcgcaacaaaaaaggaaacacacccttatggttagccgcgaatggaggccacctggatgtcgtgcagctattggtccaagctggagcagacgtggatgccgctgataaccggaaaatcacaccccttatggccgcattcagaaaggggcacgttaaagtggtgcggtacctggtcaaggaggtgaatcagttcccaagcgattcggagtgcatgcgttacatcgctacaatcaccgacaaggagatgctgaagaaatgccacctgtgtatggaatccatagttcaggccaaagatcggcaggcagccgaagcgaacaagaacgcatccatcctactggaagagcttgatctggaaaagcttcgcgaagaatcccgaaggttggcccttgctgcaaaacgcgaaaagcggaaggagaagagacggaaaaagaaggaagagcagcggcgcaaactggaagaaattgaggccaaaaacaaggaaaatttcgagctgcaggctgcgcaggagaaagagaagttgaaagtggaggacgaacctgaggtgctcactgaaccgccttccgccaccactacaacaacaattggaatctccgcaacatggactaccctggcaggatcacacggcaagaggaataataccattaccaccacaagttctaaaaggaagaatcgcaaaaacaagatcacacccgagaacgtgcaaatcatttttgatgatccactgcccatctcctactctcaaccagagaaagtgaatggcgaatctaaatcctctagcacgtccgaatcaggggactccgataacatgaggatttccagttgcagcgacgagagttcgaatagtaactcgtcgcgcaaatcagacaatcatagccccgcagtagttacgaccaccgtgtccagtaagaagcagccctccgtcttggtgactttccccaaagaggagcgaaagagcgtctccggaaaagcatctattaaactatcggaaactataagtgaaggaacctcgaatagcctctctacttgcacaaagagcgggccctccccactctctagccctaacggcaagcttaccgtggcatcacctaagaggggccagaagcgtgaggaggggtggaaggaggtcgttagaaggagcaagaaagtttcagttcccagtacagtaataagtagagtgatagggcgtggaggttgcaatatcaatgctattcgggagttcacaggagctcacattgacattgacaagcagaaggacaagaccggcgaccggattatcactatccggggaggcacggagtcaactcgacaggccactcaacttattaacgccctcattaaagaccctgataaagaaatcgatgaacttatcccgaaaaatcgactgaaatcttctagtgctaattctaaaataggatcatctgcaccaactactacagctgccaatacgtcactgatgggtataaagatgacaaccgtcgctctctcctcaacctctcagactgctaccgcgcttacggtccccgcaattagctcagcctcaacccataagacaataaagaaccctgtcaataatgtaagacctggcttcccagtgtccctgcctctggcctacccgcctcctcagtttgctcacgccttactcgctgctcaaaccttccagcagatccgaccccctcggctgcctatgactcactttggcggaacctttcccccagctcaaagtacgtgggggccgttcccagttcgacccctctctccagcgcgcgcgacgaatagccctaaaccacacatggtgccacgccacagcaatcagaattctagcggatcacaggtgaactctgccggatccttgacatccagtcccaccactactacatcaagtagcgccagcacggtaccagggaccagcacgaatggttcaccttctagtccttccgttagaaggcagctcttcgtcactgtcgtgaaaacatctaatgctaccacaacgacggtgaccactactgcgtccaacaataacaccgctcccacaaacgccacctatcctatgccaacagctaaggaacactaccctgtgagctcaccttcttctcctagtcccccagcccagcccggaggggtgagccgcaattctccactggattgcgggtctgcctcccccaataaagtggcgagcagctcagagcaggaggccggctcgcccccagtagtagagaccaccaatacccgccccccaaattcaagctcctcctccggctcctcatccgcccattcgaatcagcagcaacccccgggttcagtttctcaagagccacgccctcctctgcagcagagccaggtgccacccccagaggttcgaatgacagtcccaccacttgctaccagcagtgctcccgttgccgtgccaagcacagcaccagtgacgtatccaatgccgcaaacccccatgggctgcccacagcccactccgaagatggagacgcctgctatcaggccccccccccacggcacaacagcgccccacaagaacagtgcctctgtgcaaaactctagtgttgcagtgctatctgtcaatcatattaagcgaccccactctgtgccctcttcagtccaattaccgtcaactctgtccacccagagcgcctgtcagaatagcgttcatcccgcgaacaagccaattgctccaaacttttccgcgccactgccatttggacctttcagcacactgttcgagaatagtcctacgtctgcccacgcattctggggcggtagtgtagtcagcagtcagtcgaccccagaaagtatgctgtctggcaagtctagttatctccccaattcagatccactccatcagtccgacacgtcgaaggctcccgggttccgtccacctctgcagaggccagcaccctcacctagtggaatcgtaaatatggattccccttatggtagtgtcactccctcctcaactcacctcggtaatttcgcatcaaacatttcaggaggacagatgtatgggcctggagctccattgggcggtgcacctgcagcagctaactttaatcgacaacatttttcccctctgtccctcctgacaccctgctctagcgccagcaatgattcctctgcacagtcagtatcctcaggggtgcgggccccatcccccgccccaagctctgttcccctgggttccgaaaagccttctaacgtgtcacaggaccgtaaggtccctgtgcccatcggaacagagaggagtgccagaatccgccaaacagggaccagcgcaccctccgtgatcgggtccaacttatctaccagtgtcgggcactctggcatttggtccttcgaaggaataggggggaatcaggataaagtggattggtgtaacccgggcatggggaaccccatgatacacagacctatgagtgaccccggcgtctttagccaacaccaagcaatggagagggactcaactgggatcgttacacccagtgggacgttccaccaacacgttcccgccggctacatggattttccaaaggtcggagggatgcccttcagcgtctacggtaatgccatgatcccacccgtggcgcccattccagatggcgccggtgggcctatctttaacggccctcatgcagctgacccctcgtggaacagcctgataaagatggtcagcagctctaccgagaacaatggcccacaaaccgtgtggacgggcccttgggcgccacacatgaattctgtccacatgaaccagcttggatag

SEQ ID NO: 14574 - DNA, 1374 bp, Artificial Sequence
  Description of Artificial Sequence: Synthetic coding sequence
atgagcggaactagagccagcaacgacaggccacccggggcaggtggagtgaagcgcggacgtctgcagcaggaggccgctgccacgggctcacgggttacagtggtcctcggagcccagtggggagacgaaggcaaaggcaaagtcgtcgaccttctggcaaccgatgctgatatcatcagccgctgccaagggggaaacaacgccgggcacacggtagttgtcgacggcaaggagtacgatttccacctgttacccagcgggatcatcaatactaaggcagtgagcttcatcggaaatggggtggtcattcacctcccaggccttttcgaagaagcggagaagaacgaaaagaagggcctgaaggactgggagaaaaggcttatcatctcagatagggctcacttggtgtttgactttcatcaggcagttgatggcctgcaggaagttcagaggcaggcccaggagggcaaaaatataggcactacaaagaagggaatcggacccacctattcttccaaagcggccaggaccggcctcaggatttgtgatctgctgtctgactttgacgaattttcatctagatttaaaaacctcgcacatcagcatcagagcatgtttcccaccctggaaatcgacatcgaggggcagctgaagagactgaaggggttcgcagagcgtatccgcccaatggtgcgggacggcgtgtacttcatgtatgaggctctgcatggccctcccaaaaaaatcctggttgaaggcgccaacgctgcattactggatattgatttcggcacctacccattcgttacgtcctccaactgtactgtgggcggagtgtgtaccggcctcggtataccaccccagaacattggcgacgtctatggggttgtaaaagcatatacgaccagggtgggtatcggtgcctttccaactgagcagatcaatgaaataggcggcctgctgcagactcgggggcacgagtggggggttaccactggacgtaaaagacggtgcggctggctagatctgatgattctgcggtacgcacatatggtaaatggttttacagcccttgctctgacgaagctagacatcctggacgttctaggcgaggtgaaggtgggagttagctacaagctgaatggaaagcgaataccatacttcccagcaaatcaggaaatgttgcaaaaggtggaagtcgaatatgaaaccctacctgggtggaaggctgacactacaggagcgcgcaggtgggaagacctgccacctcaggctcagaactacattcgatttgtggagaatcacgtaggggtggccgtcaagtgggtgggagttggaaagtcgcgagaatctatgattcagcttttctag

SEQ ID NO: 14575 - DNA, 1596 bp, Artificial Sequence
  Description of Artificial Sequence: Synthetic coding sequence
atgtgctccctggcctcgggagcaacgggcggtcggggggccgtggaaaacgaggaggaccttccggaattaagcgacagcggtgacgaggcggcctgggaggatgaagatgacgcagatctgcctcacggaaagcaacagacgccttgtcttttctgtaataggttgtttactagtgcggaagagaccttcagccattgtaagagcgagcaccaattcaatatcgacagtatggtgcacaagcatgggttagagttttacggttatataaaactcattaactttattaggctcaaaaacccaactgttgagtatatgaatagtatatacaatccagtgccatgggagaaggaggaatacttaaaacccgtcttagaggatgatctgctgctgcagttcgacgtggaagatctttatgagcccgtcagcgtgcccttctcttacccaaacggcttgtcagaaaatacctctgtggttgaaaagttgaagcacatggaggcaagggcattgagtgctgaggcagccctggcccgcgctagggaagacctgcagaagatgaagcagttcgcccaggatttcgtgatgcacaccgatgttcgcacttgctcaagtagcacctcagttatcgcagacctgcaggaggatgaagatggtgtgtacttttcctcctatgggcactacgggatccacgaggagatgctcaaagacaagattagaacagaaagttaccgagactttatctatcaaaacccacacatctttaaagacaaggtggtgcttgacgtggggtgcggaaccggaatcctctcgatgttcgcagcaaaggccggcgccaagaaggtgttgggagttgatcaatccgaaatcctgtaccaggccatggatatcattagactgaataaactggaagatacgatcacgctgataaagggaaagatcgaagaggtccacctgccagttgagaaggtagacgtgatcatttccgaatggatggggtacttcctgcttttcgagtcaatgctggacagtgttctgtacgcaaaaaacaagtaccttgcgaaggggggaagcgtctatcccgacatttgtactatttccttagtagctgtgagcgatgtgaataaacacgccgacagaattgcattctgggacgacgtttatggcttcaaaatgtcctgcatgaaaaaggccgtgatccctgaggctgttgtcgaagtgctagacccaaaaaccttgatcagcgagccatgcggaatcaagcacatcgactgtcacactacctccattagcgatctggagttctcatccgacttcactctgaaaatcacacgtacttccatgtgcaccgccatagcagggtacttcgacatctattttgaaaaaaactgccacaaccgggttgttttttctactgggcctcaatcaaccaaaacacactggaagcaaactgtatttctcctggagaagcccttctccgtcaaggccggagaagccctcaaaggaaaggtaaccgtgcacaagtcaaaaaaggatccgcgttctcttaccgtgacactgaccctgaataacagtactcagacgtacggactccagtag

SEQ ID NO: 14576 - DNA, 1659 bp, Artificial Sequence
  Description of Artificial Sequence: Synthetic coding sequence
atgtccgtactaagtccgggggatctcaagcctaaacggggttctccacataggggatccctagacagaactgatgcatccacagatctcgccatgcgcagctggccttccgagctcggatcacgcacctgttcaacatctgcgactactaccgctccctctaactcaactcctatcgctagacaccccggccgcaccaagggatataatagcgacgataacctgtgcgagccatccctggagtttgaggtacctaatcacaggcagtacgtctctaggccctcctccctggaaagctcgaggaacacctcctccaattcatcaccactgaacttgaagggcagtagtgagcagctccacggccggagtgaaagctttagctccgaagacctaatcccctcacgcgatctggccacgctgccaagggaggcatctacgccaggccggaatgctctcggacggcacgaataccccctgcctaggaacggcccgctgccccaggaaggggcccagaaacgcgggaccgcaccaccatacgtgggcgtgaggccctgctcagcaagtccgagctcagaaatggtgacgctggaggagttcttggaggagtcaaacagaagctctcctactcatgacacccccagctgccgggacgacctcttgagtgactacttcaggaaggcatcagacccccccgccataggcggccagcctgggcccccagctaaaaaggaaggagctaaaatgcccaccaacttcgttgcccccacagttaaaatggctgccccaaccagcgaaggtcgcccgctcaaacccggtcagtacgtgaagccaaattttaggcttactgaggcagaggctcctccgtccgtcgccccacggcaggcacagcccccgcagagcctatccctgggcaggccacgacaggctcccgtcccaccagcatcccacgctcccgcatctcgctccgctagcctcagtagggccttttctctagcctccgctgatctgcttcgggccagtgggcccgaagcatgtaaacaggagagtccacagaaacttggcgcaccggaggccctgggtggacgggaaactgggtcacatacacttcagtctccagccccgccgagctcccactcgctcgcccgggagcgcaccccgcttgtagggaaggccgggtcaagctgtcaggggccaggaccccgctcacgaccactagacacccgtagattctccctcgcgccacccaaggaagagaggcttgctcccctgcatcagtcggctactgccccggccattgcgaccgctggcgctggggccgccgcggctggttccggatccaattctcaacttctgcatttctccccagctgctgcgccagcagccagaaccaaaccaaaagctccgcccaggtctggtgaagtcgctaccataactccagtccgcgccggactatccctgtcagagggggatggggtccccggtcagggttgttccgagggcctgcccgctaagtcacctggacgttctccagatctagcccctcaccttggccgggcccttgaagattgctctagagggtcagtatccaaatcgagtccagcttcgccagaaccgggaggagacccccagactgtttggtacgaatatggttgcgtgtag

SEQ ID NO: 14577 - DNA, 774 bp, Artificial Sequence
  Description of Artificial Sequence: Synthetic coding sequence
atggccgataagatggacatgagcctcgatgacattatcaagcttaataggtcgcaaaggggaggcagaggaggtggccggggtagaggtagagcaggcagccagggtggccggggcggtggagcacaggccgccgctagggtgaataggggaggaggaccaatacggaacaggccagctattgccaggggagccgcaggtggggggggaaggaacaggcccgccccctacagtaggccaaaacaactgcccgacaagtggcagcatgacctgttcgacagtggcttcggggggggagcaggcgttgagacgggcggaaagcttttggtgagcaatctggattttggagtgtctgacgccgacatccaggaactcttcgccgagtttggcactttgaagaaggctgccgtgcactatgaccggtctggccggagcctgggaactgcggacgtacacttcgaaagaaaggctgacgctttgaaagcaatgaagcagtacaacggtgtgcccctggacgggcggccaatgaacattcagctggtgaccagtcagattgacgcccagagaagacctgcacaatcagtaaatcgaggagggatgactagaaacagaggtgcaggaggctttggcggaggaggcgggaccaggcggggcacacgcggaggcgctcgcggtcggggacggggcgctgggcgcaactcaaagcagcagcttagcgcggaggagctggatgctcaactcgacgcatacaacgcccgaatggacacaagctag

SEQ ID NO: 14578 - DNA, 876 bp, Artificial Sequence
  Description of Artificial Sequence: Synthetic coding sequence
atgggggtggccgcacgtcctccagctctgaggcattggttcagccattccatcccactggccattttcgctctgcttctgctgtacctgtcagtgcggtccttgggtgcacgcagcggctgtggacccagagcacagccgtgtgtccctggtgagaccgccccatttcaggttcgccaggaaagcgggacattggaggccccggaacggaagcagccaccctgtctaggcccccgggggatgttgggacggatgatgcgacgctttcacgcctccttaaaacctgaaggggatgtcggtctctccccatatctggccggatggagggccttagtcgaatttctgactcccctggggtccgtgttcgccttcgccacacgggaggcttttacaaaggtgactgatttggaggcgagggtccacggtcccgacgccgaacattattggtctctggtggcaatggccgcctgggagagacgcgctggactcctagagcaaccaggagccgccccacgcgatcctacaaggagctctggatcacggactctgctgctgctgcaccgcgctctgcggtggtctcagctctgccttcaccgggtagctacaggggccttgggcggacccgacgcaggggtccagtgctccgacgcttacagggcggccctgggcccccaccatccatggctggtgaggcaaaccgcccgactggctttcctggcatttccgggccggcgtagactgctggaactggcttgccctggcgcgacagaagcagaggcccgagctgcgctggtgcgcgccgccggcacactggaggatgtttataaccggactcaatccctgcttgccgagcgcgggctgctacagctggcatag

SEQ ID NO: 14579 - DNA, 3303 bp, Artificial Sequence
  Description of Artificial Sequence: Synthetic coding sequence
atgggcaacgctgcgggcagtgctgaacaacctgccggaccggccgccccaccaccaaagcagccagccccccctaagcaacccatgcccgccgctggagagctggaggagaggttcaatcgtgccttaaactgtatgaatctaccgcctgataaggtgcaactcctgtcacagtatgacaacgagaagaaatgggagctgatttgtgaccaggaacggtttcaggtcaagaatcccccagcggcttatatccagaaacttaaaagttacgtggacacgggaggggtttcgagaaaggtagccgccgattggatgtctaatttaggatttaaaagaagggtccaggagtctacccaggtcctgagagagttggaaacaagtctcaggacaaatcatattggctgggttcaggaattcctgaatgaagaaaacagaggtttagatgtcctactagagtacctagctttcgctcagtgttccgtgacttacgacatggagtctactgacaacggagccagtaacagcgagaagaacaagcctctggaacagtccgtggaggatttgagcaaaggacctccgagcagcgtgcctaagagccgtcacctgaccatcaaacttactcctgcccacagccgcaaggccctaagaaacagccggatcgtgagccagaaagacgacgtgcatgtgtgcataatgtgtttgcgagccatcatgaactaccagtccgggttttcactggtgatgaaccatcccgcatgtgtcaatgagattgcactcagcctgaacaacaagaatccaaggaccaaggccctggtgctcgaacttcttgctgccgtctgtctcgtgagaggaggccacgacattatcctggcagcttttgacaactttaaggaggtttgcggagaacaacatagattcgagaagctcatggagtatttccggaatgaggacagcaacatcgacttcatggttgcatgtatgcagttcatcaacattgtggtgcatagtgtcgagaacatgaacttcagggtgtttcttcagtatgaatttactcacctggggcttgacctttacctggaaagacttagactgactgagagtgataaactgcaggttcagattcaagcttatctggacaacatattcgacgtcggggcgttgctcgaggacacggagacaaaaaatgcggttctggaacacatggaggaacttcaagaacaagtggccctcttgaccgagagactgagggatgctgaaaacgaatccatggccaaaatcgctgagctggagaagcagctgagccaggccaggaaggagctggagaccttaagagagcgttttagcgaatccacggccatgggcccatcacgcagacctccagaacccgaaaaagcgcccccagcagcgccaaccagacctagtgccctcgagctgaaggttgaggaactggaagaaaagggtctcatacgcatactgcgaggccccggtgatgccgtttcaatcgagatcctccctgtcgccgtggccacgccatccggtggtgacgcccctactcctggagtgccaactggttctccatcacctgacctagctcctgcagcagagccggcccctggtgcagcaccccccccacctcctccactccctggccttcctagcccccaggaggccccacctagtgccccccctcaggctccgcctcttcctggtagccccgaacctcctcctgcgccccccctccctggggacctgcctccacctccacctcctcctcctcctcccccaggcaccgacggcccagtgccaccgccccccccgccgccccctcccccaccaggcgggcctccagacgccctcggccggagggactctgaattgggcccaggggttaaggccaagaagccaattcaaacaaaatttcgcatgcccctgttgaactgggtcgcactgaaaccatcacagattaccggaactgtgttcaccgagttaaatgacgagaaagtgctgcaggagctggacatgtccgacttcgaggaacagtttaagaccaagtctcagggtccatcgctggatctcagtgctctcaagagcaaggcagcgcagaaggctccctcaaaagccactctaatcgaggccaatcgcgcgaagaacctcgctatcactctgagaaaagggaatttgggtgccgaaagaatatgccaggcaattgaagcctatgatctacaggcacttggccttgattttctcgagctgttgatgcgttttctgcccacagaatacgagagaagcctgattactaggtttgagcgagaacagcggccaatggaagagctgtctgaggaggatagattcatgctctgtttctcgcgaattccccgtttgcccgaacgaatgacgacgttgactttcctcggcaattttcctgacaccgcccaactattgatgccccagctcaacgcaatcattgctgctagcatgtctattaaaagttctgataagctccggcaaatcctggagattgtgttagccttcggcaattacatgaatagttcaaaacgtggggccgcttatgggtttaggctgcagtcgttggatgctctcctagagatgaaaagcactgaccggaagcagaccctgttgcactacctcgtgaaggtgattgccgaaaagtaccctcagctgaccgggttccactcagatttgcactttctcgataaggctggatcggtttccctggactcagtgttggccgatgttagaagcctccagcgtgggctcgaactcacccagcgggagtttgtacgtcaggacgactgcatggtcttgaaagagtttttacgggccaatagtccaaccatggacaaacttcttgccgattccaagacagctcaggaagcattcgagtccgtggtcgagtacttcggggaaaaccccaaaacaaccagcccagggttgtttttctctcttttcagccgcttcataaaggcctataaaaaggcagaacaggaggtggaacaatggaagaaggaggcagccgcgcaggaagccggagcagatacccccggtaaaggcgaaccacccgcccctaagtccccaccaaaagcaaggagaccccagatggatctgatttctgagctgaagcgacgtcagcagaaagagccccttatctatgagtccgatagggacggcgcaattgaagacataatcacagtcatcaaaacagtgccctttactgcaagaaccgggaagcgaacctcacgtttgctgtgcgaagcctcactaggcgaagaaatgccattgtag

SEQ ID NO: 14580 - DNA, 1839 bp, Artificial Sequence
  Description of Artificial Sequence: Synthetic coding sequence
atggaaaaccagctagccaagagcacagaggaaaggacattccagtaccaagattcactgccatctttgcctgtgcctagcttggaagaatcgctgaagaagtatctagagtccgttaagccctttgccaatcaagaggaatataaaaagaccgaggaaatcgtacagaagtttcagagcggaatcggcgaaaagctccaccagaagctgctcgagcgtgcaaaggggaaacgaaattggctcgaggagtggtggctcaacgtggcatatttggatgttcggattccaagccaactgaacgtcaatttcgccggaccggcagcacattttgagcactattggcctcccaaggaggggacgcaactggaaagaggctccatcaccctgtggcataaccttaactattggcagctactgagaaaggagaaggtgcccgttcataaggtgggaaatacacccctggatatgaaccaatttaggatgctgttttcaacatgcaaagtccccgggatcacaagggactctatcatgaactacttccgtacggagagcgaagggcgttcgcctaatcacatcgtggttctctgtaggggacgagccttcgtattcgacgtgatccatgagggatgccttgtcacccccccagagttgctccggcagctgacttacatccataaaaaatgtcacagtgaacccgatggccctggcatcgcagctctgactagtgaggaacgtacccgatgggctaaggcccgggagtatctgataggactggaccccgagaacctagctctgctggagaaaatccagtcctcacttctggtctactcaatggaggattcttccccccacgttacaccagaggactattccgagataatcgctgctattctgattggcgatcctactgtgcggtggggagataagtcatataatcttatctccttctccaatggagtgtttggctgcaactgcgatcacgcaccctttgatgctatgatcatggtcaatattagttattatgtggacgagaaaatcttccaaaatgaggggagatggaagggctccgagaaggtccgcgatatccctctgcccgaagagctgatttttatcgtcgacgagaaggtcctcaacgacatcaaccaggctaaagcccagtacctgcgggaagcctcggatctgcagatcgccgcatatgctttcactagtttcggcaaaaaactcactaagaataaaatgttacaccctgacacatttatccagctggctctgcagctggcgtactaccgattgcacggccaccctgggtgctgttatgaaacagctatgaccagacacttctaccatgggcggacagagactatgagaagctgcaccgtggaggccgttagatggtgccagtccatgcaagaccccagcgtgaatctgagggagcgccaacagaagatgctgcaagctttcgctaagcataacaagatgatgaaggattgctctgccggcaagggcttcgaccgccatctgttgggactcctactgatcgccaaggaagaggggctcccagtcccagagctctttaccgaccctctgttttcaaagagcggtggaggcggcaacttcgtgctgtcaacctccctagtgggttatcttagagttcagggggtggttgtgcccatggtgcacaacggatatggcttcttttaccatatccgggatgacagattcgtcgttgcttgttccgcgtggaaatcgtgtccggagaccgatgccgagaagcttgtgcagctgactttctgtgcgttccatgatatgattcagttaatgaattccactcacttatag

SEQ ID NO: 14581 - DNA, 1773 bp, Artificial Sequence
  Description of Artificial Sequence: Synthetic coding sequence
atgagtgattcccctgcaggaagtaacccaaggacacctgagagctcaggcagtggcagcggaggaggaggtaagcgccccgccgtgccagcggctgtgtccctgttaccacccgcagaccctctgagacaagcaaaccggttaccgatccgtgtcttgaaaatgctgtctgctcacaccgggcatttattgcacccagaatatcttcagcccttatcgtctactcccgttagccctattgagctggatgccaaaaaatctcccctggctcttctggcccagacttgttctcagatcgggaagcctgacccaccaccatcgagcaagctgaactccgtggccgcagctgcgaacggcctgggcgcagagaaagatcctggtcgctcagctccaggcgccgctagcgctgccgccgctttgaaacaacttggagatagccctgccgaggataagtcctcttttaaaccttacagcaagggctccgggggcggcgactcgcgaaaggactctgggtcatccagtgtgagttctaccagctcctcttcctcgagtagccccggggacaaggcaggtttccgggtaccgagtgccgcctgcccccccttcccgccccacggagcccccgtgagcgccagctctagttcatcctctcccggagggtcacgaggcggctcgccacatcactccgactgcaagaatggcgggggcgtggggggcggcgagctggataagaaggatcaagaacctaaaccatcaccagagccggcggcagtaagcagaggcggcggcggagagccaggggctcatggaggggccgaaagcggcgcaagcgggcggaagtctgaaccgccctccgctctcgtcggcgctggccatgttgccccagttagtccttataagcctggtcactccgtgttccctctcccccctagctcaattgggtatcatggatccatcgttggggcctatgccggctatccatctcaatttgttccaggtctggatccatcgaagtctggacttgtgggtggccagctttcgggcggactcgggctcccacctgggaaaccgccatctagcagtccgctcactggcgcttctccaccatcatttctccaggggctgtgtagagacccctactgcctgggcggatatcacggagcgagccacctgggcggctccagctgtagcacctgcagtgcgcacgaccccgctgggccatccctaaaagctggaggttacccccttgtctatcccggacatccccttcaacccgccgccttgtcaagcagcgctgcacaggcagctctgccaggacaccctctctacacgtatggcttcatgctgcagaatgaacccctgcctcatagctgtaactgggtggctgccagcgggccatgtgataaacggttcgctaccagtgaggagctgctctcccatttgaggacccacaccgctctgcctggagcagagaaactccttgctgcatatcctggagcaagcggtctgggatccgcagcagcggcagctgctgctgcggccagttgccacctacaccttccgccccccgcagctccaggtagcccaggttccctgtctctaaggaaccctcacactctgggcttatctaggtaccatccgtacgggaagtcccatctaagtaccgccggtggattagccgtccccagcttgccgaccgccggaccctattactctccttatgcactgtacggtcagcgcttggcatctgcgtccgccctaggatatcaatag

SEQ ID NO: 14582 - DNA, 1020 bp, Artificial Sequence
  Description of Artificial Sequence: Synthetic coding sequence
atgtggaccgcaaggggaccctttagacgcgatcgctggtcttccgaggatgaagaggccgcaggcccgagccaggcactctccccgctgctcagcgatacccgaaagattgtaagcgaaggagaacttgatcagcttgcccagattcgaccacttatctttaacttccatgaacagaccgccatcaaggattgcttgaagatcctcgaggagaagacagcagcctatgacatcatgcaagagttcatggctttagagttgaagaacctgccgggagaatttaattcagggaatcagccctctaatcgggaaaagaaccggtaccgcgatatacttccatatgattctacccgggtacccctgggtaagtccaaagattacatcaatgcctcgtacattaggattgtgaactgtggagaagagtacttttatatagccacccaggggccactgttgtctactatagacgacttctggcagatggtgcttgagaataattctaacgtgatcgcgatgattaccagggagatagaaggcggcataatcaagtgttatcattattggcctatctccctgaagaaaccccttgaattaaagcatttccgggtgtttcttgaaaactatcagatacttcaatactttattattaggatgtttcaggttgtggagaagtccaccggaacatctcatagcgttaagcagctccaattcacgaaatggccagaccacggtacccccgcctccgctgactcgtttatcaagtatatccgctatgctcggaaatctcatctaactggccccatggttgtgcactgcagcgcaggcatcggccgcacaggagtgttcctctgtgtggatgtcgttttctgcgcgatcgtgaagaattgctcatttaatattatggacatcgttgcccagatgcgcgagcagaggtcaggcatggtgcagactaaggaacagtaccatttctgctatgacatcgtcctcgaggtactgagaaagttgttgaccctggattag

SEQ ID NO: 14583 - DNA, 1917 bp, Artificial Sequence
  Description of Artificial Sequence: Synthetic coding sequence
atgagtgcattggcaggggaggacgtatggagatgtcccggttgtggagatcacatcgcaccaagccagatctggtacaggacggtcaacgagacttggcacggatcctgcttcagatgctccgaatgccaggatagcctgaccaattggtactatgagaaagatgggaaactctactgccccaaggactactggggaaaatttggcgaattttgccacgggtgctcccttctaatgaccgggcccttcatggtagctggagaatttaagtatcaccccgagtgtttcgcctgtatgtcgtgcaaggttattatagaagatggagatgcttacgccttggtgcaacacgcaactctctactgtgggaaatgccataacgaggtggtactagctccaatgttcgagcgcctgagcaccgagtccgtccaagagcagttaccctactccgtgaccctgatctctatgccagcaacaacagaagggcgtcgaggtttctccgtctctgtagagtcagcttgcagtaactacgccaccacggtccaggtcaaagaggttaaccggatgcatatctcccccaataacagaaatgccattcacccaggagatcgtattcttgaaattaatggcacgcctgtacggaccttacgtgtggaagaagtagaggatgccataagccagacttcacagaccctgcagctgctcattgagcatgacccggtcagccaacgcctcgaccaacttagactggaggcacgacttgcccctcacatgcagaatgccggccaccctcacgcactttccaccctcgatactaaggagaacctggagggaaccttgcgtcggcggagtctgagacggagtaactccatttccaagagtcctggccccagcagtcccaaagagccgctcctgttctcccgggatatttccagatcggaaagtctgagatgcagttcatcttatagtcagcagatcttcagaccatgcgatttaatccatggtgaagtactcggaaagggctttttcgggcaggccattaaggtcacccataaagcgaccgggaaggtgatggtaatgaaggaactgattcggtgcgacgaggagactcagaagacgtttctcactgaagtcaaagtgatgaggtccctcgatcatccaaacgttctgaaattcatcggcgtcctttacaaggataaaaagctgaacttgttgactgagtatattgaaggagggactctgaaggactttcttcgtagcatggaccccttcccatggcagcagaaggttagatttgcaaaagggattgcctctggaatggcatacctccattcaatgtgtattattcatcgggatctgaatagccacaactgtttgatcaagctggacaaaactgtagttgtggccgactttggcctatcacgtctgatagtggaggaacgaaaaagggcacctatggaaaaggccaccacaaaaaaacgcacactgcgcaagaatgacaggaagaagagatacactgtcgtggggaatccatattggatggctcctgagatgttgaacggtaaaagttatgatgaaactgtcgacatctttagcttcgggatcgtcttatgcgaaataatcgggcaagtgtatgcagatcccgactgtctgcctaggacactcgatttcggacttaatgttaagcttttctgggagaaatttgtgccaacagactgtccacctgccttctttcccttggccgccatctgctgcaggctggagccagagtcccgccccgctttttccaaactcgaggattcattcgaagcacttagcctgtaccttggcgaactgggaatccctctgcctgccgagctggaggaacttgaccacactgtgtctatgcaatatggtctgactcgggactccccaccctag

SEQ ID NO: 14584 - DNA, 606 bp, Artificial Sequence
  Description of Artificial Sequence: Synthetic coding sequence
atggctgccgccaaagacactcacgaagatcacgacacttcaacagaaaataccgatgaaagtaaccacgacccacaatttgaaccaatcgtgagccttcctgaacaggaaatcaagacattagaagaggacgaggaagagctatttaagatgagagccaagctgttcagattcgcctctgaaaatgatctccccgaatggaaagaacgcggaacaggagatgtgaagctgctcaaacataaagagaaaggcgcaatccgccttctgatgagaagagacaaaacactcaagatctgtgctaaccactatattactcccatgatggaattaaaacctaacgccggcagcgatcgggcttgggtgtggaacacccatgcggatttcgctgacgaatgtcccaagcccgagttgctcgcaattcgctttctaaacgctgagaacgcgcagaaatttaagacaaaattcgaggaatgtcgcaaagaaatcgaagagcgcgagaagaaggctgggagcggaaagaacgaccacgccgagaaagttgccgagaaactagaggcactttcagtgaaagaagaaactaaagaggatgccgaagagaaacagtag

SEQ ID NO: 14585 - DNA, 2154 bp, Artificial Sequence
  Description of Artificial Sequence: Synthetic coding sequence
atggcagctgataagcccgccgaccagggggcagagaaacatgaagggactggacaaagctcgggaatcaccgaccaggagaaagaactctccaccaacgctttccaggcgtttacaagcggcaactacgacgcttgccttcagcacctggcctgcctccaggacattaacaaagacgactataagatcattctgaacacagccgtggcagagttttttaagtcaaatcaaactaccaccgacaatttacgccaaaccctgaatcagctcaaaaaccaggtgcacagcgccgttgaagaaatggacggccttgatgacgtcgagaattccatgctgtactataatcaggcagttattctgtatcaccttaggcaatatacagaagctatctccgtcggcgagaagctttaccagtttatagaacctttcgaggagaaattcgctcaggctgtgtgttttcttctcgtggacctgtatatccttacatatcaggcagagaaggcactccacttactcgcagttttagaaaagatgatttctcaggggaataataataagaacgggaaaaacgagaccggcaacaacaataacaaggacggctcaaatcataaggctgaatcaggcgccttaatcgaagccgcaaaatcgaaaatccatcaatataaagtgcgcgcttacatacagatgaaaagcctcaaggcctgcaagagagagatcaagagcgtgatgaacactgcggggaatagcgccccaagcctgtttttaaagtcgaatttcgagtacttgagaggcaactaccgcaaagcagttaaactgctgaactcttccaatattgccgaacatcctggcttcatgaagactggggagtgcctgagatgtatgttttggaacaatctcggctgtattcatttcgctatgtcaaagcacaaccttgggatcttttacttcaagaaggcgctgcaggagaatgataatgtttgcgcacaacttagtgcgggctccaccgacccggggaagaagtttagtggaaggcctatgtgcaccctattgaccaataaaaggtacgaacttctgtacaactgcggaatccagctgctccacatcggtagaccccttgcagcatttgaatgcctgatcgaggctgtgcaggtgtatcacgccaaccctcgcctgtggctccgcctcgcagaatgctgtatcgctgccaataagggaacgagcgaacaggagaccaagggcttgccttccaagaagggaatcgtgcagtcgatcgtgggtcagggataccatagaaagattgtactagcctctcaaagtattcaaaatacagtctataacgacggtcagtcttccgccatccccgtggctagtatggagttcgcagccatctgtctccgcaacgcactactcctgctccccgaagaacagcaggatccaaagcaggagaacggcgcgaagaacagcaaccagttggggggcaatacggagtcaagcgagagtagtgaaacctgccggtgttccattctggcatgctccgcctatgtggcactcgccttgggcgataacctgatggctcttaaccatgccgacaagctgctccaacagccaaagttatcaggcagcctgaagttcctggggcacctttacgcagctgaggccctgatcagcctggatcgaatttcagacgccatcacccacttgaatcccgaaaacgtgacggatgtgtccctcgggatctcatccaacgagcaggaccaggggagcgacaaaggggagaatgaggcaatggagagcagcgggaagcgagcaccccagtgctacccatcttcggtgaactcagctaggacagttatgctgttcaaccttgggtcagcatattgcctgagatccgaatatgataaggcgcggaaatgcctgcaccaggctgcctccatgatccaccccaaggaggtgccccccgaggctatcctcctggcagtctacctagaactccagaatggtaatactcagctggccctccagattatcaagaggaatcaactactgcccgcagtcaagacccactctgaagtacgcaagaaacctgtgttccagcctgtccaccccatccagcctatacagatgcctgcttttacgaccgtgcagcggaagtag

SEQ ID NO: 14586 - DNA, 1488 bp, Artificial Sequence
  Description of Artificial Sequence: Synthetic coding sequence
atggaggcccttttggagggtatccaaaaccggggacacggcggaggttttcttacatcctgcgaggctgaattgcaggagcttatgaagcagattgacatcatggttgctcacaaaaaaagtgaatgggaaggccggacacacgctcttgagacctgtctgaagattcgggagcaggagctgaaatctctcaggagtcagctcgatgtgacccataaagaggtggggatgctccaccagcaggtggaggaacacgaaaagatcaaacaggagatgaccatggaatataagcaagagctcaaaaaactacacgaggaactttgcatcttaaagcgttcctacgagaagcttcagaaaaagcagatgcgtgagtttagaggcaatacaaagaaccacagagaagatcggtccgagattgaaagactgacggctaaaatcgaggaatttagacagaagtcactggactgggagaagcaaaggctcatctaccagcagcaggtctccagtctcgaagcccagcggaaagcactagcagagcagtccgagatcattcaggcacagctggtcaacagaaagcaaaagctcgagagcgtcgagttgagcagtcaaagcgagattcaacacttgagctccaagcttgaaagggccaacgatacgatctgtgccaacgaactcgagatcgaaagacttactatgagagtcaacgacctggtgggtacctctatgaccgtgctccaggagcagcaacagaaggaggagaaattgcgcgaatcagagaagctcctagaggccctacaggaggagaagcgcgagctcaaggctgctctacagagccaggaaaatctgatccacgaggcacgaattcagaaggaaaaactgcaggaaaaggtgaaagctaccaatactcagcatgccgtagaggcaatcagcctggagtcagtctctgccacgtgcaaacagctgtcccaagagttgatggaaaagtatgaagagctgaaacgaatggaggcccacaataacgaatacaaagccgagatcaagaaacttaaggaacagattctccaaggcgagcagtcttactcttccgcgctagaggggatgaagatggagatatcacaccttacccaggaactgcatcagcgcgacatcaccatcgcgagcactaagggtagctctagtgacatggagaagcgcctccgggccgagatgcagaaggcggaggacaaagcagtcgaacataaggaaatacttgaccaattagagagcctgaagttggaaaaccgccatctttctgaaatggtcatgaagcttgaacttggcctccacgagtgtagcttgccagtctcacccctaggcagcatcgctacacgatttcttgaagaggaggaattacgaagtcaccatattttagagcgtttagacgcacacatcgaagaactcaaacgagaatccgaaaaaaccgttcgccagttcaccgccctcaaatag

SEQ ID NO: 14587 - DNA, 1962 bp, Artificial Sequence
  Description of Artificial Sequence: Synthetic coding sequence
atgattccacctcaggaggcaagtgcccggaggagagaaattgaagataaattgaagcaggaagaggaaacactgtcttttattagagattctttggagaaatccgaccagctgaccaagaacatggtgtctatcctgtcgagcttcgaaagccgccttatgaagttggaaaactctatcatcccagtccacaaacagacagaaaacctgcaaaggttgcaggagaacgtggagaaaaccctgtcttgtctggaccacgtaatctcatactaccacgtggcctctgatacagagaaaataatcagggagggacccaccgggcgcctcgaggaatacctgggcagtatggcaaagatacagaaggccgtagagtattttcaggataattccccggactccccagagctcaacaaagtcaaactcttgtttgaacgggggaaagaagcgctagagtccgagttcagaagcctgatgacgagacattccaaagttgtatcaccagtgttgatactggacctaatctctggagatgacgatctcgaggcacaggaggacgtgaccttggaacacctccctgagtcagtcctgcaagacgtgattagaatcagccgatggctcgtcgagtatggacgcaatcaagacttcatgaatgtctattatcaaattcgcagctcacagctagataggtcgatcaagggcctaaaagaacactttcacaagtcgagctcctctagcggcgtaccctactctccagctattccaaataaacggaaagacacccctactaagaaaccggtaaaacggccaggaagggatgacatgctggatgttgagacggatgcatacattcattgcgtcagcgcctttgtgaagttagctcagtcagaataccagctcttggccgacatcatccccgagcaccaccagaaaaagacttttgattctctcattcaagacgctttagatggtttgatgctggagggcgagaatatagtctcagcggcacgcaaagcaattgtccggcatgacttcagcaccgtgttgaccgtttttcctatcctacgtcacttgaaacagactaagccagaatttgatcaagtgttgcagggaacagccgcatctaccaagaataaactgcctgggttaatcactagcatggagacaataggtgcaaaagccttagaggactttgcagataacattaagaatgatcccgataaggagtataatatgccaaaagatggcacagttcacgagctgacttccaatgctatcctctttctgcagcaactcttggactttcaggagacagcaggtgcaatgctagcctctcaggagacgtctagctccgccacctcatattcttctgaattctccaaacgactcctctcaacgtacatttgtaaagtcctgggcaaccttcaactgaacctactatcgaagagtaaggtgtacgaggacccggccttatctgcaattttccttcataataactacaattatatcttgaagtcgcttgaaaaatctgaacttattcagttggtcgccgtcacccagaaaacagccgagcgcagttatcgagagcatatagagcaacagatccagacgtaccagcgcagctggttaaaagtcacagattatatcgcagaaaaaaatctgccggtgttccaacccggagtgaaattgagagataaagagaggcaaatcatcaaggagagatttaagggtttcaacgacggactcgaggaactatgtaaaatccagaaagcttgggccatcccagacaccgagcagcgggaccgcatccggcaagctcagaagaccatcgtcaaggagacatatggagccttcctccagaaattcgggagcgttccgtttacgaagaatcctgagaagtatattaaatatggggttgaacaggtgggcgacatgatcgatcggctgtttgacacaagcgcctag

SEQ ID NO: 14588 - DNA, 735 bp, Artificial Sequence
  Description of Artificial Sequence: Synthetic coding sequence
atggaacttactatcttcatcctcagattggctatttacattctgacattccctttatacctgctgaatttccttgggttgtggtcatggatatgcaagaagtggtttccgtactttctggtgcggttcaccgttatttacaacgagcaaatggcatcaaaaaagagagaactgttttctaacctccaggagtttgccgggccctccggtaaactttcactcctggaggtggggtgtggaacgggtgctaattttaagttttaccccccagggtgccgggtgacttgtatcgacccaaacccaaatttcgaaaagttcctgattaagtcgatagctgagaacaggcatttgcagtttgagcgatttgtggtggccgctggagagaatatgcatcaggttgctgacggttccgttgatgtcgtggtgtgcaccttggtactttgttctgttaaaaaccaggaacggatcctgcgggaagtgtgcagagtgctccgcccaggtggggcgttctacttcatggaacatgtagctgcagaatgctctacatggaactatttctggcagcaggttctcgatccagcatggcacctgctttttgacgggtgcaacttgacaagggaatcctggaaagccctggaaagagcatctttcagcaaactgaagctgcagcatatacaggcacctctctcttgggaattggtacgcccccacatatacggctacgctgttaagtag

SEQ ID NO: 14589 - DNA, 3522 bp, Artificial Sequence
  Description of Artificial Sequence: Synthetic coding sequence
atggcggtggagactctcagcccagactgggaatttgacagggttgacgatgggagccaaaaaatccacgcggaggtacagctgaaaaattacggaaaatttttggaggaatatacctctcagctcagacgcatcgaagatgctcttgacgactctattggagatgtttgggattttaatcttgaccccatcgctctgaagcttctgccatatgagcaatcgagtctcttggagctaattaagacagagaacaaggtgttgaataaggtcataacagtgtacgcggcgctctgctgtgaaatcaaaaaactcaagtacgaggccgagactaaattctacaatggtctgctgttttacggcgaaggagctacggacgcttccatggttgagggagattgccagattcagatgggcagattcattagcttcctacaggaactttcatgcttcgtcacacggtgctacgaagtcgtgatgaacgtcgtccaccagctggctgccctttatatttcaaataaaatagccccaaaaatcatcgagactacaggcgtccacttccagacaatgtacgaacacctgggagaactgctcacagtgttactgactctagacgagatcatcgataatcatataactctcaaagatcattggactatgtataagcggctcctcaaatcagtgcatcacaatccatctaagtttggaatacaggaagagaaactcaagccctttgagaagtttcttctcaagttggaagggcagctgcttgacggtatgattttccaagcttgtatcgagcagcagttcgatagcctaaacggaggagtgagcgtcagcaaaaattctacattcgccgaagaatttgctcactccatccggagcatatttgcaaatgtggaagccaagttaggcgaaccttctgagattgaccaacgagacaagtacgtcggcatttgcggactctttgtcctgcacttccagatttttaggactatcgacaaaaagttctataagtcactcctggacatctgtaaaaaagtcccggcaattactcttactgcaaatatcatctggttcccagataactttctgattcagaagatcccagcagctgccaagctgctagatcgtaagagtctgcaggccatcaaaatccaccgggacacatttctgcagcagaaagcccagagtctcaccaaggatgtccaaagctattacgtctttgtgtcctcctggatgatgaaaatggagagtatcctatcaaaggaacagcggatggataaatttgcagaggacctcacgaatcggtgtaacgtgtttattcagggattcctatatgcttacagtatcagcacaatcatcaagacaacaatgaacctgtatatgtctatgcagaagcctatgaccaaaacaagcgtaaaggctctctgcaggctggtggagctcctgaaggccattgaacacatgttctatagaagaagtatggtcgtggccgacagcgtgtcacacatcacacagcacctgcagcatcaggccctgcattcgatctccgtagcaaaaaagagggtgatctccgataaaaaatattctgaacaaaggctggacgttctgagcgcgctggttctggcagagaataccctgaacgggccatccactaaacagagacgcctgattgtgtcacttgctctatcagtgggtacccagatgaagacgttcaaggacgaggaattattcccacttcaggtagtcatgaaaaagctcgatctgatttctgaactgcgcgaacgagttcaaacacaatgtgactgctgctttctgtattggcacagagccgtgttccccatctatctcgatgacgtttacgagaacgccgttgacgccgcgcggttgcattacatgtttagcgccctccgcgactgtgtacctgcgatgatgcatgctcggcacctagagtcctacgaaatcttgttagactgctatgataaagaaattatggaaatcctgaacgaacatctgcttgacaagctctgcaaagagatcgaaaaggacttgcgtttgtccgttcatacacatcttaagctggatgatcggaacccctttaaggttggcatgaaagacttggctttattcttctcactgaatcctatccgattcttcaacagattcatcgatatccgcgcgtatgtgacccattacctcgataaaaccttctataacttgactactgtcgcactgcacgattgggccacttactcagagatgagaaatttggcgacccagaggtacggattggtcatgactgaagctcacttgccgtcccaaactctcgagcaagggctggacgtgctggaaataatgcgcaatattcacatcttcgtgtccaggtatctctacaacctcaataatcagatttttattgagcggacttcgaacaacaaacatttgaatacaatcaacattcggcacattgccaacagcattcggacccacggcactgggatcatgaataccaccgtaaattttacataccagttcctgaaaaagaaattttatatctttagtcagttcatgtatgacgaacatatcaaatctaggctcatcaaggacattagattctttagagagatcaaagatcagaacgaccataagtacccattcgacagagccgagaagttcaatcgggggataagaaagctcggcgtgaccccggaaggtcagagctatctagatcaatttagacagcttattagccagatcggcaacgcaatgggatacgtgaggatgatccgttcaggagggctgcattgttcctctaatgctattagattcgttccagacctcgaagacattgtgaactttgaagaactggtgaaagaagagggtctagccgaagaaacgctgaaagctgcccgtcacctcgacagtgtcctgagcgatcacaccagaaatagcgctgaagggaccgagtactttaagatgctagtggacgtgtttgcccccgagtttcgtcggccaaaaaatatccacctgaggaacttctatattatagtcccgcctcttacactgaactttgtggagcacagtattagttgtaaggagaaactgaataagaagaacaagattggcgctgcttttacagacgatggcttcgccatgggggtggcctacatcctaaaactccttgaccagtatcgggaattcgatagcttacactggttccagtccgtgcgtgagaagtacttgaaggaaatacgtgccgtggcaaagcaacagaacgtgcaatcagcgtcgcaagatgaaaagttgctgcaaacgatgaatctgacccagaaacgcctcgacgtctacctgcaggaattcgaactgctatattttagcctttctagcgctaggatcttttttcgcgccgacaaaacggccgcggaggaaaaccaggagaaaaaggaaaaagaggaggaaacgaaaaccagtaacggtgacctgtcagactctacagtgagcgctgatccagtcgtcaaatag

SEQ ID NO: 14590 - DNA, 972 bp, Artificial Sequence
  Description of Artificial Sequence: Synthetic coding sequence
atgttgcggtggacggtccatctcgaagggggtcctagacgagtaaatcatgctgccgttgcagtgggccaccgggtttacagcttcggaggttactgcagcggggaagactatgagaccctacgccaaatcgatgtgcacatcttcaacgctgacacacacaaatggttcaccccccgggttagtgggaccgtacccggtgccagagacggccactcagcctgtgtcctcggaaagatcatgtacatctttgggggatatgaacagcaggcggattgcttttctaatgacatacataagttggataccagcacgatgacctggaccttgatctgcactaagggatctcccgcccggtggcgtgatttccacagcgccacaatgctgggctcccacatgtatgttttcggaggtcgcgcggatcgttttggcccatttcactctaacaacgaaatatactgtaatcgaatccgggtctttgacacgcgcacagaggcatggctcgactgtccgccgacccctgtcctgccggaagggaggcggagccactccgcttttggatacaacggtgaactatacattttcggcggatataacgctagactcaacaggcacttccatgacctatggaagttcaatccggtatctttcacctggaaaaaaatcgagccaaagggcaagggcccatgccctcgaaggcgccaatgttgttgtatcgttggcgacaagatcgttctgtttggaggaacaagtcctagtcctgaggaagggctcggagacgagtttgacctgattgaccactccgacctgcatattcttgacttctccccatcgctcaaaaccctctgcaaactggccgtcatccaatataatctcgatcaaagttgcttgccccatgatatcagatgggaattgaacgcaatgacaacaaattccaacatctctagacccattgtgtccagtcatggctag

SEQ ID NO: 14591 - DNA, 2517 bp, Artificial Sequence
  Description of Artificial Sequence: Synthetic coding sequence
atgaccggcgccgaaatagagccttcagcccaggccaaacccgagaagaaagcaggtgaggaagtcatcgccggtcctgaaagagagaacgacgtccccctggtcgtgaggccgaaggtccggacgcaggcgaccactggcgcacggcctaagacagagactaagtcagtaccagctgcccgccctaaaaccgaggcccaggctatgtctggggctcgccctaagaccgaggtgcaggtgatgggcggagcacggccaaagactgaggcccaaggtatcaccggagcgcgacccaaaacggacgcccgtgcggtcggcggggcacgcagcaagactgacgccaaggcgatccctggagctaggcccaaggacgaggcccaagcttgggctcagagcgaatttggcaccgaggcggtctcacaggcagaaggggtaagccagacgaacgcggtggcctggccactcgcaactgctgagtcaggctcagttaccaagtcaaaggggctctccatggaccgcgaactcgtgaatgtcgacgcagaaacttttccagggacccaggggcagaaaggcatacagccctggttcgggccgggtgaagaaactaatatggggtcatggtgttacagcagacctcgagccagggaagaggcttccaacgagagcggattttggagcgccgacgaaacttctacagcttccagtttctggaccggggaggaaacgtcggtgcgcagttggccgagagaggagtctaatacccgcagtcgccaccgagccaaacatcagacaaatcctagaagcagacccaggtcaaagcaggaagcatacgtggacagctggtcaggctctgaggacgaagcgtcaaatcctttttctttctgggtcggagagaataccaacaacctgttccgccctagggtaagggaagaagccaatatccggtcaaagctgcggaccaatagagaagactgcttcgagtcggaatccgaggatgagttctataaacaatcgtgggtgctgcccggggaggaagccaattccagattccggcatagagataaagaggatcctaacaccgccctgaagctgcgcgcccagaaggatgttgactccgatagagtgaagcaggaaccacggtttgaggaggaagtgattatcgggtcctggttttgggcagaaaaagaagcctctctcgaggggggggcctcggcaatttgtgaatccgaacctggcaccgaggaaggggctattggcggctctgcctattgggcagaagaaaaatcttccctgggggctgtggctcgggaggaagctaagcctgagtccgaagaggaggccatcttcggatcctggttctgggatcgcgacgaggcctgttttgacctcaacccttgcccagtgtacaaagtctccgaccgtttccgggacgctgctgaggagctcaatgcttcatcacgcccgcagacttgggatgaggttacggtggagtttaaacctggcctctttcacggtgtgggcttccgctcgacctcaccatttggaatccctgaagaggcttcggagatgctggaggcgaagcccaaaaatctcgagctgagccctgaaggtgaagagcaggagtccctgctccagccggatcagccaagtcctgagttcacattccagtacgaccccagctatagatcggttcgtgaaatcagggagcacctcagagctcgagagagcgccgaaagtgaatcctggtcttgcagttgcattcagtgcgagttaaaaattggatcagaagagttcgaagaatttctgctcctgatggacaagattagagatcccttcattcacgagatctcaaaaatcgcaatgggtatgagatcagcctcgcagtttacacgcgattttattagagatagcggcgtggtgtccttaatcgagactctattgaattaccctagctcacgcgtgagaacgagttttcttgagaacatgatccacatggcacccccctatcccaatctgaacatgatagagacctttatctgccaggtgtgcgaggagactctggctcactcggtggactcactagagcagctgacggggatccgtatgttgcgacacctgacaatgacaatagattatcacacgctgatagcaaattacatgagtgggtttctctctctgctgacaaccgctaatgctagaaccaaattccatgtcttaaagatgctgctgaacctgtccgaaaaccctgctgtggcaaaaaagcttttcagtgccaaggccctctctatattcgtaggacttttcaacatcgaggaaaccaacgacaacattcagattgtaatcaagatgtttcagaacatctctaacatcatcaagagcggtaagatgagcctgatcgatgatgatttttctttggagcctctcatctctgccttcagggaattcgaggagttagctaagcaattgcaagctcagatcgacaaccagaacgatcctgaggtgggtcaacagtcttag

SEQ ID NO: 14592 - DNA, 2649 bp, Artificial Sequence
  Description of Artificial Sequence: Synthetic coding sequence
atgccaggacgggctcgcactcgcgcaagaggtcgagctcggcggcgggaaagctatcagcaggaagcaccagggggccctcgcgcacctggcagtgcgaccacccaggagcctccacagcttcagtctacaccaagacctctccaggaagaagtccccgtggttcgccctctgcagccacgagctgctagggggggggctggcggtggagcccaatcccagggagtgaaggagccaggtcccgaggccgggctgcacacagcacccctgcaggagcgacgcatcggtggggtgttccaagacctggtggtgaatacacggcaggacatgaagcacgtcaaggacagcaagactgggagcgagggtacagtggtacagcttcttgcgaaccacttccgggtaatcagtagacctcagtgggtggcatataagtacaatgtcgattataaacccgatatcgaggacggtaatctccgcaccatcctgctggatcaacaccgtcgaaaattcggagagagacacatatttgacggaaattcacttctgctgtctcgccctctgaaggagcgcagggtcgaatggctcagcacaacaaaggataaaaacatcgtgaagataacggttgagttctcaaaggagctcacccccacttctcctgactgcttaagatactataacattttgtttaggcgcacatttaagctgctagatttcgagcaggtgggcaggaactactacacaaagaaaaaggccattcagctgtaccgacacgggacatccttggaaatttggctgggctacgtgactagtgtgctgcaatatgagaattctattacactgtgcgctgatgtcagtcataaactcctaaggatagaaacggcctatgactttattaaacgcacaagcgcacaggcccagaccgggaacatacgcgaagaggttaccaataagctgatcggcagcatcgtgctgacaaaatacaacaacaaaacttaccgggtagatgacatcgattggaaacagaaccccgaggatactttcaacaagtcggacggatcaaagatcacgtatatcgactactaccgccagcaacataaggagatagtaacagttaaaaaacagcccctcctggttagtcaggggcggtggaagaaaggcctcacagggacacagagagagccaatcctgctaattccccagctatgccacatgactggactcactgacgaaatctgcaaggactattctattgtaaaggaacttgccaagcacacaaggctgtctccgcgcaggcgccatcatacgcttaaggagttcatcaatacccttcaagataataagaaggttcgggagttgcttcagctgtgggacttgaaatttgataccaacttcctgagcgtgcctgggagagtgcttaagaatgccaatatcgtgcagggtaggcgcatggtgaaggccaactcccagggagactggtctagagagattagggaattgccattactcaatgctatgcccctccattcctggcttattctgtactcccggtccagccatcgcgaagcaatgtccctcaagggacacttgcagtcggtgacagcccccatgggtatcacaatgaagcccgctgagatgattgaagttgacggcgatgcgaactcatacatagacacactgagaaagtataccaggccaactctccaaatgggcatgtcttgcttgttagtgtttaaagtgatctgcatcctcccaaacgacgacaaaagacgttatgactccatcaagcggtacctttgtactaaatgccccattccctcccagtgtgtagtcaaaaaaactttggaaaaagtccaagctaggacgatcgtgaccaaaatcgcccagcaaatgaattgtaagatggggggagccctatggaaggtagagacagatgtgcagcggacgatgttcgttggaatcgattgcttccacgacattgtgaatcgccaaaagtccattgccgggtttgtggcgtctactaatgcggaactcactaaatggtacagtcaatgcgtcatacagaagaccggcgaggaattggtaaaggaactcgaaatctgcttaaaggcggctttggacgtgtggtgcaaaaatgaaagttctatgccccactcagttattgtatatagagacggcgtgggggatggacagcttcaggctctgctggatcatgaagcaaaaaaaatgtctacctacttaaagaccatttctcctaacaacttcacactggcttttattgtggtcaagaagcggattaacactcgtttttttcttaagcatggctccaattttcagaacccccccccaggcactgtgattgatgtcgagctgacccgaaacgagtggtacgattttttcatcgtgtcccagtccgtacaggacggaaccgtgactccgacacactacaacgtcatttacgatacaattggcctctctccagacaccgtacagaggcttacatactgcctctgtcatatgtactataacctgccaggaattatccgagtgccggccccttgccactatgcacacaaattggcctatctggtgggccagtccatacaccaagagcctaaccgcagcctctcaacgagacttttttatctgtag

SEQ ID NO: 14593 - DNA, 1917 bp, Artificial Sequence
  Description of Artificial Sequence: Synthetic coding sequence
atgaatcggcaagtctgtaaaaagtcctttagcggcagatcccagggcttttccgggcgaagcgctgtcgtttccgggtccagcaggatgtcctgcgtggccagatccggtggcgcaggaggaggagcatgcggcttcagaagtggcgcgggaagctttggctcgcgatctctgtataatctgggctctaataagtcgatcagtatttccgtggccgctggcagcagtagagccggaggatttggaggaggtcggagttcctgcggcttcgctggcgggtatggcggcggcttcggcgggagttacgggggaggattcggcggtggtagaggtgtggggtctggctttgggggcgctgggggtttcgggggcgccggcgggtttggaggacccggggttttcggtggacctggctcttttggtgggccgggagggtttggtccaggtggctttcccgggggaatccaggaagtgattgtcaatcaaagcctgctccagcccctgaacgttgagattgacccacaaatcggccaagtgaaggctcaggagagagagcagataaaaacactgaataacaagttcgcttccttcatagacaaggttcgtttcctcgaacaacagaataaggtgcttgagactaagtgggaactcctgcaacaacagactactggctctggaccatccagtctggagccgtgcttcgaatcatatattagctttttatgtaaacagcttgattccctgctaggcgaacgcggcaatctggagggcgagctgaagtcgatgcaagatttggtggaagattttaaaaagaaatatgaggacgagatcaacaagagaaccgccgcggagaacgagtttgtcgggttgaagaaagatgtggatgccgctttcatgaacaaggtggaattgcaggccaaagttgattctctcacagacgaagtctcctttctaagaacgttatatgagatggagctgtcgcagatgcagagccatgcctctgacaccagtgtggtattaagcatggataataaccgatgcctggacttggggtcaataatcgctgaggttcgagctcaatatgaagagattgcgcagcggagtaaaagcgaagctgaggccctataccagacaaagttgggcgagctccagacaactgcgggaaggcatggggatgatttaagaaacactaagagcgaaattatggaactgaatcgaatgattcaacgactccgagcagaaatcgaaaacgtaaagaaacagaacgctaacctccagaccgcgattgctgaagccgagcagaggggtgagatggccctaaaagatgcgaacgcaaagctgcaggaccttcaaaccgccctgcagaaagcaaaggacgacctggcgagactgttgcgagactaccaggagttgatgaacgtgaagctggctctcgatgtggaaatcgcaacgtaccgcaagctgttggaaggcgaggagtgcaggatgagcggcgaatgtcagagtgcagtgtgtatatccgtggtgtcaaatgttacttcaacctctggatcgagcggtagctcgaggggcgtgttcggtggagtgagcggcagcggaagcggaggatataaggggggcagctcttcttcatcctcaagcgggtatggggtatcaggtggcagcggaagtgggtacggtggagtgtcttcaggcagcacgggaggacgggggtcctcaggctcttatcaatcctccagttctgggtcccgcctgggcggggccggttcaatttcggtctctcactctggcatgggcagttctagcggcagcatccaaactagtggcgggtcaggctacaagtccggcggcggcggttccacatcaataagattctctcagacgacttccagcagccagcactcctccacaaaatag

SEQ ID NO: 14594 - DNA, 1080 bp, Artificial Sequence
  Description of Artificial Sequence: Synthetic coding sequence
atggctgaacctttcctgtcagagtatcaacatcaacctcagacatccaattgcaccggggccgccgctgtgcaggaagagcttaaccctgagcgtccgcccggcgcagaagaaagagtccctgaagaagactcaaggtggcagtcccgcgcgttcccgcagcttgggggcagacccggccccgagggcgagggctctctggagagtcaacccccgccactgcagacccaggcctgtccagagagtagctgtctgagggagggcgaaaaggggcagaacggcgacgactcatcagccgggggcgacttccctccccctgctgaggtcgagcctactccagaagcagagctgttagcccaaccttgccatgattctgaagcaagcaaacttggggcgcccgccgccggaggggaggaggagtgggggcagcaacagagacagctcggaaaaaagaagcacagacgcaggccgagtaagaagaagcggcattggaagccttactacaaattgacatgggaggagaaaaagaagttcgatgagaaacaaagtctgagggcctcaagaattcgggctgagatgttcgcgaaaggacaacccgtagctccatacaataccacgcagttcctgatggatgaccacgaccaggaagagcccgacctgaaaacagggctgtattccaaacgggccgccgccaagtccgacgacacatcagacgacgacttcatggaagaagggggcgaagaagacgggggctctgatggaatgggaggagatgggagcgagttcctgcaacgtgacttctccgaaacctatgagagataccataccgaatccctgcaaaacatgtccaagcaggagcttattaaggaatacctcgaacttgaaaagtgcctgagtcgtatggaagatgagaataacaggctacgtcttgagtctaaacgactggggggcgatgatgcccgcgttcgagagcttgaactcgaactcgacaggctccgtgccgagaacctgcaactcttaaccgagaacgaactccaccggcagcaagaaagggcacccctgtctaagttcggcgattag

SEQ ID NO: 14595 - DNA, 2889 bp, Artificial Sequence
  Description of Artificial Sequence: Synthetic coding sequence
atggatgaacaggcattgttaggacttaatcccaatgcggacagcgacttccgtcagagggctctggcttacttcgagcagctgaagatatctcctgacgcttggcaagtctgtgccgaggctctggcccagagaacctacagtgatgaccacgtcaagttcttttgctttcaggttcttgagcaccaggtgaagtacaaatattctgaattaactacagtgcagcaacaactgattagagagacactgatctcatggcttcaggctcagatgttaaatccacagcctgaaaagacttttatcagaaacaaagccgcacaagtatttgcactgctttttgtgaccgaatatctgacaaaatggcccaaattcttctttgacattttgagtgtagtcgatctgaacccgcgcggagtggatctgtatctgaggatcttgatggcgatcgattccgagctggtggatcgggacgtggtgcatactagcgaggaagccagacgcaacacattaatcaaggatactatgagagaacagtgtatccctaatcttgtggagtcatggtatcagatcttgcagaattaccagttcaccaattcagaagtaacgtgtcagtgtttggaagtggtgggcgcatacgtttcgtggattgatctctctctgatcgcaaatgatcggtttattaatatgctattgggccatatgagcatcgaagtcctgcgagaagaagcttgcgattgtttgttcgaagtggtgaataagggaatggatccagtggacaagatgaagctggtggaatccctttgtcaagtccttcagagcgctggattcttcagcatcgatcaggaagaggatgttgattttctcgcccggttctcgaagctagttaacggcatgggtcaatcactcattgtgagctggtctaagctgatcaaaaacggcgatattaaaaatgcacaggaagccctgcaagctatagagacaaaagtagccctgatgctccaactgctgatccatgaagatgatgacatttcatccaacatcatcggattctgctacgattatctgcacatactaaaacagctcactgtcctgtccgaccagcagaaggccaacgtagaggctataatgcttgctgtcatgaagaagttgacctacgacgaggagtataactttgaaaacgagggcgaggatgaggccatgtttgtggagtacaggaagcagcttaagctgctgctggacagactagcacaggtgtcgcctgaactgcttctggcatccgttcgacgggtgttctccagtaccctacaaaactggcaaaccacaagattcatggaggtcgaggtcgcgatccgcctactttacatgctggctgaagccctgcccgttagccacggggcccatttctcaggcgacgtgagtaaagcttctgcgctgcaggatatgatgagaaccctcgtaacttctggtgtgtcgtcataccagcacacgagtgtaacgctggagtttttcgagacagttgtccggtatgaaaagttcttcacagtggagccccagcacattccttgcgtgctgatggccttcctggatcaccgtggactgcggcacagctctgccaaagtccgtagtcgcacagcgtatctcttttcccgctttgtgaagtccttgaacaaacagatgaatccgtttatcgaagacatcctgaatagaatacaggatctcctggagttgtcaccccccgagaatggccaccagtctctgctctcatccgacgaccagctgttcatttacgaaacagctggagtgcttattgttaattcggagtatcccgcagaaagaaaacaggcccttatgaggaatctgctgacccccctgatggagaagttcaaaatactcctggaaaagttgatgcttgcgcaggacgaggagcggcaggcctccctggctgattgcctgaaccacgcggtgggctttgccagtaggacctctaaagctttctccaacaagcagactgtgaaacagtgcggttgcagcgaggtgtatttagactgtcttcagacttttctccccgctctttcctgtccactgcagaaagatatactaaggagcggggttcggacattcctccaccgcatgattatatgtctcgaggaagaggttctaccattcatcccttccgctagcgagcatatgctgaaggactgcgaagcaaaagacctgcaagaattcattcctttgatcaaccagatcacagccaagtttaagattcaggtcagtccattcctgcagcagatgtttatgcctctcctgcatgcaattttcgaggtccttctgcggccagccgaggagaacgatcaatccgcagccctcgagaaacagatgctcagacgctcctattttgccttcctgcagacagttacaggttcagggatgtccgaagtgattgcaaatcagggagcagagaacgttgagcgagttttggtcacagttattcagggggctgtcgaataccctgatcctattgcccagaaaacttgttttataatcctatccaagctggttgaactgtggggtggcaaagatggtcccgtgggctttgccgacttcgtgtataagcacattgtaccagcatgcttccttgcccccctgaagcagacattcgatttggccgatgcccagactgtgctggctcttagcgagtgtgcagtcactctgaagacaatacaccttaagagaggcccggaatgcgtccagtatctccagcaggagtacttgccctcactgcaggtggcccccgaaattatccaggagttttgtcaagcattgcagcagccagatgccaaggtctttaagaactatttaaaagtattttttcagagagccaagccctag

SEQ ID NO: 14596 - DNA, 2976 bp, Artificial Sequence
  Description of Artificial Sequence: Synthetic coding sequence
atggccgagtctttcttctcagatttcggcttgctttggtacctgaaggagttacggaaagaagagttctggaagtttaaagagttattaaaacaacccctcgagaagttcgaactgaagcctatcccatgggcagagttgaagaaggcctctaaggaagatgtagcgaaattactcgacaagcactaccctgggaagcaggcttgggaggtgaccctgaatctcttcctgcaaatcaaccgaaaggatctgtggaccaaagctcaggaagagatgaggaataagctgaatccttaccgaaagcatatgaaggaaacatttcagctcatctgggaaaaagagacctgcctccacgtgccggagcatttttacaaggagacgatgaaaaacgagtacaaggaactgaatgatgcctacaccgctgccgcgagacgacacacagttgttttagagggacctgatgggatcgggaagacaactctccttcgcaaggtcatgctggactgggctgagggcaatttgtggaaagataggttcacattcgtcttcttcctcaatgtgtgcgaaatgaacggcatcgccgagacctcccttctcgagctgctttccagggattggccagaatcaagtgaaaagatcgaggatatcttctcccaaccagagcggatcctgtttatcatggacgggttcgaacagctgaaatttaatctgcagctgaaggccgatctgtctgatgactggcgccagagacaaccaatgcctatcattctctcctcccttctgcagaagaagatgctgcctgagtcctccctgctgatcgcactaggtaaactcgcaatgcagaagcactactttatgcttagacatccgaagttgattaagctgttgggattttctgaatccgaaaagaagtcctacttttcttatttcttcggggagaagtccaaagcattaaaagtgttcaattttgtgagggataatggcccgctgtttatcctgtgtcataacccttttacgtgttggctggtatgtacatgcgtgaagcaacgattagagaggggcgaggacctggaaatcaacagtcaaaatacaacctatttgtacgcgagctttctcactacggtatttaaggcaggatcacagagctttccaccaaaggtgaacagagctcggttaaaatcactctgtgctctggctgctgaaggtatctggacctataccttcgtattcagtcatggtgatcttcgacgcaacggcctgtccgagtccgaaggagtgatgtgggttggaatgcggctgttgcagcgccgtggcgactgctttgcttttatgcacctttgtattcaggagttttgtgcagccatgttttatctattgaaaagacctaaagacgatcctaaccccgcaatcggttctatcactcaacttgtgagagcttctgttgtgcagccccagaccctcctcacacaggtagggatatttatgttcgggatctccacagaggaaattgtatccatgctggagacctccttcggcttccctctgtcaaaagacctcaagcaggaaattacgcagtgtctcgaaagtttatctcagtgtgaggccgatcgcgaagcaatcgccttccaggagctgtttatcggcctgtttgaaacccaagaaaaagaattcgttacgaaggtcatgaatttcttcgaggaggtatttatttacatcggcaacatcgagcatcttgtgattgcctcattctgcctgaaacactgccagcatctgaccactctccgtatgtgtgtggaaaatatcttccccgacgacagtgggtgcattagtgattacaacgaaaagttagtgtactggagagagctgtgctccatgttcataaccaataaaaatttccagatcttggacatggagaacactagtttagacgatccctccctggccattctgtgcaaggcactggctcagcctgtctgcaagctgaggaagcttatcttcacctccgtgtattttggccacgattctgagctctttaaggctgtgctgcataaccctcacttaaagttgttgagtctctacggcactagccttagtcaaagtgacatccgccacttgtgcgaaactttgaaacacccaatgtgtaagatcgaagagctgattctgggcaaatgcgatataagcagcgaagtgtgtgaagacatcgcgagcgtgttggcttgtaattcaaaacttaaacatttatctcttgtcgaaaacccccttagagacgagggtatgacactgttgtgtgaggccctcaaacattctcattgtgcactggaacggttaatgctgatgtattgttgcctaacatccgtctcctgcgacagtatttcagaggtcctgctgtgcagtaagtccctctccctgctggatttaggcagcaacgctctggaagacaacggcgttgcctcactgtgcgcggctctgaaacacccgggctgttctattcgcgagctttggctcatgggatgcttcctcacttccgattcttgtaaagatatcgcggccgtgctgatctgtaacgggaaacttaaaacactcaagctgggtcacaatgaaattggtgacaccggggtgagacagctttgtgcagcactgcagcatccgcactgcaaactcgaatgtcttggcctccagacttgtccaatcacacgggcgtgttgtgacgatatagccgccgcgctcattgcctgtaagaccctgcgttcactgaatcttgactggatagcgctagatgccgacgcggttgtggtactgtgtgaggccctgtctcaccctgattgtgcgctacagatgctcgggcttcacaagagcggcttcgatgaagagacacagaaaatccttatgtcagtcgaggagaaaattccccaccttaccatatctcacgggccatggatcgatgaggaatataagatacggggagtgctgctttag

SEQ ID NO: 14597 - DNA, 534 bp, Artificial Sequence
  Description of Artificial Sequence: Synthetic coding sequence
atggcagcggtgaaggcctctacctctaaggccactaggccttggtacagccacccggtatatgcgaggtactggcagcactatcatcaggctatggcctggatgcagagccaccataacgcctaccgcaaagccgtagagtcctgcttcaaccttccttggtatttgcctagtgccctgttgccacaatctagttacgacaatgaggctgcctacccacagtccttttatgaccaccatgtagcctggcaagattacccatgctctagttctcacttccgaagaagcggacaacacccacgctatagctcacggatccaggcttcaacaaaagaagaccaggctctgtccaaagaagaggaaatggagaccgagtctgacgcagaggtggagtgcgaccttagcaacatggaaattacagaggagctgcgacagtactttgccgaaacagagaggcacagagaagagcgaagaaggcagcagcagttagatgctgagagacttgacagttatgtgaacgcagatcacgactag

SEQ ID NO: 14598 - DNA, 1503 bp, Artificial Sequence
  Description of Artificial Sequence: Synthetic coding sequence
atggtgggtcggtcatgcggggtggccactcagcggcaggggggcggacagaggcccactaacctggcgctgactctgagcagcagtccggcacatagcacagccttgccttggctgcccccccgcagcttgcagctcctaagtggccactctgtgccagcccaacccacacctcaccttccctctgcatgcggcggcccaactagggtgacgctgggagaagagagagcatggcgctctcatggctcgaacgctggcggtcatacttgccttccacgcagaacagctggagccggatctcttacacccggtggggagcgtggaggtaacaatgccggccacactgtcgtggttgacggcaaggagtacgactttcacttactcccgtccggaatcattaacaccaaggccgtcagtttcatcggcaatggtgttgtgatccacctgccagggctgtttgaggaggctgagaagaacgagaagaaaggccttaaggactgggagaaaagacttatcatcagcgaccgcgctcacctagtcttcgactttcatcaggcggtagatggtttgcaggaggtccagagacaggctcaggaagggaaaaacattggtaccaccaaaaagggcataggccctacttactcttccaaggccgcccgcactggtttgagaatatgcgatctgctttctgattttgacgagttctccagtaggttcaagaacctcgctcatcagcaccagtccatgttcccgactctcgagatcgacattgaggggcagctgaagcggctaaaaggattcgccgagagaatcagacctatggttagggatggcgtgtatttcatgtatgaagcgctccatggcccaccaaaaaagattctggtggagggtgcgaatgcggccttgttagatatcgacttcggcacctaccctttcgtgacctcttctaactgtaccgttggtggagtatgtacaggcttgggaatccctcctcagaacatcggagacgtgtatggagtcgtcaaagcttatacaacaagggtcggcatcggggcattcccaacagaacagatcaacgagattggcggcctcctgcagacgcgaggccatgagtggggtgtaacaaccgggcgaaagcggaggtgcggctggctggatcttatgatcttacgctacgcgcacatggtcaatggcttcacggccctcgcacttacgaagctagatatccttgatgtgttaggtgaggtgaaggtcggagtttcttacaaactcaacgggaaacggatcccttatttcccagcgaatcaggaaatgctgcaaaaagtcgaagtggagtatgagacactgccgggctggaaagcggacaccacgggtgctcggaggtgggaggatttacctccccaagcacagaactatatcagatttgtcgaaaaccatgtcggtgttgccgtcaagtgggtaggagtcggaaagtcaagggagtccatgatacagctcttttag

SEQ ID NO: 14599 - DNA, 468 bp, Artificial Sequence
  Description of Artificial Sequence: Synthetic coding sequence
atggtcaatagttgctgcggttccgtatgcagtgaccagggctgcggacaggacctgtgccaggaaacttgctgttgtccatcatgctgccagacaacctgctgccgaacaacgtgttatcgaccaagctactcagtgtcatgctgttgccgaccccagtgctgccagagtgtttgctgtcagccgacctgctgccgtccgagctgctgcgttcccacttgctgccatccatcttgctgtattagtagctgctgccgtccctcctgctgcgtgtccagttgttgtaagcctcagtgctgccagtccgtgtgttgccagcctaactgctgccgcccttcctgttgccggccctgctgctgcctgcgcccagtttgtggaagggttagctgccataccacatgctaccgcccggcttgtgtaatttcaacctgcccacgaccagtgtgttgtgccagcagctgctgttag

SEQ ID NO: 14600 - DNA, 2124 bp, Artificial Sequence
  Description of Artificial Sequence: Synthetic coding sequence
atggctgccgaagccctcgcagccgaggctgtggcctcaagactggaacggcaggaagaggatatcaggtggctgtggagtgaggtggagcgtctaagggacgaacagcttaacgccccgtattcctgtcaggctgaaggtccctgcttgacacgggaagtggcgcagctcagagcggaaaattgcgacctccgccaccggctgtgtagtttgcggttatgcctggccgaggaacggtccagacaagctacgctcgagtcagccgaactggaggccgcccaggaggcaggagcccagccccctccatctcaatcacaggataaggatatgaagaagaagaagatgaaagagagcgaggctgatagcgaggttaaacatcaacccatatttattaaggaacgcctcaaactcttcgaaatcctgaagaaagatcatcagctgctccttgcaatctatggcaaaaagggagatacctcaaatattattactgtgagggtggccgacggacaaactgtacagggtgaagtgtggaaaaccaccccttaccaggtggcggcggagatctcacaagagctagccgaaagcacagtcatcgcaaaggtgaacggcgaactctgggatttggacagacctctggagggggacagttccctggagctgttgacctttgataacgagaaggtcaacacagccaccactactgtgtacagatgcggaccactcatagatctttgcaagggccctcatgtcaggcatacaggtaaaatcaaaactatcaaaatattcaagaattcctcaacttattgggaggggaacccagaaatggaaactcttcagcggatctatggtatttcattcccggataacaaaatgatgcgtgactgggagaagttccaagaggaagctaaaaatcgagaccacagaaaaatcggtaaagagcaggagctattcttttttcatgaccttagcccaggttcctgcttcttcctccctagaggcgctttcatctacaacaccctaacagatttcatcagagaggaatatcacaagcgcgacttcacagaagtgctgagcccgaatatgtataattctaagctgtgggaggccagtggacactggcagcactatagtgagaacatgttcacctttgaaatcgagaaggataccttcgccctcaagcctatgaattgccctggccattgcctaatgttcgcacacaggcccagaagctggagagaaatgcccatccgcttcgctgattttggagttctccatcggaacgagctgtccggcactttgtccggactgacgagagtgcggcgcttccagcaggacgacgcacacattttttgcactgtcgagcagatcgaggaggagattaaaggctgtttgcagtttctgcaatctgtgtattccacgtttggattcagttttcaattgaacctctccacccgcccagagaattttctgggagagattgaaatgtggaacgaggcagaaaagcagcttcaaaatagcctgatggatttcggcgaaccatggaaaatgaatccaggtgatggcgcattttatggtccgaaaatcgatataaaaatcaaagacgccatcggtaggtatcaccagtgtgccaccattcagcttgacttccaactgcccatccggttcaacctcacttacgtgagtaaggatggcgacgataagaaacggcccgttattatacatcgagctatcctcggctcagtggagcgcatgatagctatcctgagcgagaactacggagggaaatggcctttttggctgagcccccgccaggtgatggtgatccctgtgggccctacatgcgaaaagtacgccctgcaagtgagtagcgagttctttgaagaggggttcatggccgacgttgacttagaccactcgtgcaccctaaacaagaaaatcaggaacgcccagctggctcagtataacttcattctcgtggtgggcgaaaaggaaaagattgacaatgccgtgaacgtgaggacgagagacaacaagatacacggggagatcctcgttacctccgcaattgacaagctgaagaatctgagaaaaaccaggacattaaacgctgaggaggccttttag

SEQ ID NO: 14601 - DNA, 816 bp, Artificial Sequence
  Description of Artificial Sequence: Synthetic coding sequence
atggcaggcctggaggtgctgtttgcctcagctgcacccgccatcacatgcaggcaggacgccctggtgtgttttttacattgggaggttgttacccacgggtattttggactcggagtgggggaccagccaggtcccaatgacaagaagtcggagctactgccggccggttggaataataacaaagacctgtacgtcctcaggtacgagtacaaggatggaagtagaaagctgctggttaaagccataacggtggagagttcgatgattctaaacgtcctggaatacggcagccagcaggtagctgaccttacccttaatctggacgactacatcgacgccgagcacctgggtgattttcaccgcacttacaagaattccgaggagttaaggtcacggattgtgtcaggaattatcacacctatccacgagcagtgggagaaggccaatgtgtcatccccccatagggagtttccacccgcaacggcacgggaggttgatcccctgcgaataccgccgcatcatccccatactagccgacaacccccatggtgtgatccccttggaccgttcgtagtgggaggagaagacctcgacccatttggaccccgacggggaggcatgatcgtcgatcccctccggtcaggctttccaagggccctgattgacccaagttctgggctgcccaacaggttgccacccggggcagtcccgccgggtgcccgttttgacccgtttggccccatcggaacttcccctccgggccccaacccagaccacctaccgcccccgggatacgatgatatgtacctctag

SEQ ID NO: 14602 - DNA, 474 bp, Artificial Sequence
  Description of Artificial Sequence: Synthetic coding sequence
atggccaccccacccaaacggcgcgcggtggaggcgacgggcgagaaggtccttaggtacgaaaccttcattagcgacgtcctccaaagagatctccggaaagtgctcgaccatcgtgacaaagtctacgagcagttggcaaagtacttgcagttgagaaatgtcatcgagaggctgcaggaagccaagcatagtgagctctacatgcaggtggatctcggatgcaacttttttgtggacaccgtagtaccagatacgtctagaatttacgtggctctaggctacggattcttcttggagctcaccctcgccgaggcactgaagtttattgaccggaaaagcagcctgctgacagagctcagtaactcactcacaaaagactcaatgaacattaaggcccacatccacatgcttctggagggcctgagagagctgcagggactccagaacttccccgagaagccgcaccattag

SEQ ID NO: 14603 - DNA, 543 bp, Artificial Sequence
  Description of Artificial Sequence: Synthetic coding sequence
atgcaggcagaggggagaggcacaggaggatctactggcgacgccgacggcccgggtggccccggcatccctgatggaccaggcgggaatgctggaggccccggagaagctggagctacgggcggcagagggccgcgcggcgctggagccgcgcgggcctccggacccggaggcggtgctccaaggggaccccatggcggggccgcgagcggcctgaacggttgttgtcggtgcggcgcaaggggtcccgaaagccggctgctcgagttctatctggcaatgccttttgccacacccatggaagctgagctcgcgagaagatccctggctcaggacgcacctcctctcccagttccaggtgttctgctcaaagaatttactgttagtgggaacattcttactatccgcctgactgccgccgaccacagacagctgcagttgtctatatcgagttgtctccagcagctgtccctcttaatgtggattacacagtgctttttacctgtatttttggcccagccaccttctggtcagcgacgctag

SEQ ID NO: 14604 - DNA, 621 bp, Artificial Sequence
  Description of Artificial Sequence: Synthetic coding sequence
atgactgctagcgtactgcgatccatatctctggcactgcggccgacaagcggcctgcttgggacctggcaaacccagctccgggaaacacaccagcgggcctcactgttgtcgttttgggagctaattccaatgcgctcagaacccttgcgaaaaaagaaaaaagtcgatcctaagaaagaccaggaggcgaaagagagactgaaacgaaaaatccggaagctggagaaggcaacccaagaattaatacccatcgaagactttatcaccccattgaagtttctggataaagctagggagaggccccaggtggagttgacgtttgaggagaccgagagacgcgcgttgctactgaagaaatggtcactctacaagcagcaggagaggaagatggaaagggacaccatccgcgcaatgctcgaggcacagcaggaagctctggaggagctacagcttgagtcccctaaactacatgctgaggcaattaagagagatcccaatctttttccatttgaaaaggagggaccccactatacgccccccatcccaaactaccagcctcccgagggtagatacaatgatatcacaaaggtgtacacccaggtcgagttcaagaggtag

SEQ ID NO: 14605 - DNA, 6963 bp, Artificial Sequence
  Description of Artificial Sequence: Synthetic coding sequence
atggcagagccatcaagtgccaggcgacccgtgccactaatcgagtcagaactttatttcctcatcgcacgctatctcagcgcaggcccatgcaggagagccgctcaggtactggtgcaggaattagagcagtatcagctgctgccaaagaggctcgactgggaaggcaacgagcataaccgcagttatgaggaactcgtcctcagtaacaaacacgtcgcaccggatcatctgctccagatatgtcagcgcatcggccctatgttagacaaggagattcctccaagcataagcagggtcacatcactcctgggcgcggggcggcagtcccttttacggacagccaaagattgccgccataccgtctggaagggcagcgctttcgctgccctgcacagagggcgaccacccgaaatgcctgtgaactatgggagcccaccaaatctggtcgaaatccatcggggaaagcagctaaccggctgttcaacattcagcacggctttccccggcacaatgtaccagcatatcaaaatgcaccgaaggatccttggccacctttccgctgtgtactgcgtcgcctttgatcggactggacacaggatcttcacagggtccgatgactgtctcgttaagatctggtccacacacaacggacgcctgttaagtacccttaggggccactctgccgagatttccgatatggccgtgaattacgagaataccatgatcgccgccggatcctgtgataagattatcagagtctggtgcctaagaacttgcgcccccgtggctgttctgcagggccatactggaagtattacgagcctacagttcagtccaatggccaaaggaagccagagatacatggtgtccacaggggcggatggaacagtctgtttctggcagtgggatctggagagcctgaaattttcccctagaccactaaagttcacagaaaaaccacgccctggtgtgcagatgctgtgtagctccttcagcgtgggagggatgtttttggcgactggttcaaccgaccatgtgatccggatgtatttcttgggatttgaggctccagagaagatcgccgaactagaatctcataccgacaaggttgacagcatccagttctgtaacaacggggatcggtttctgagtggttcccgcgacggcaccgccagaatctggcggtttgagcaactcgaatggcggagcatccttcttgacatggccacccggatctctggggatctctccagcgaggaagagcgcttcatgaagcccaaggtgaccatgattgcgtggaatcaaaatgattccatcgtcgtcactgccgtaaacgaccacgttctcaaggtatggaactcttataccggtcagctccttcacaatctgatgggccacgctgatgaagtgttcgtcttggagacacaccctttcgactccagaattatgctgtccgcgggacacgatggttctatttttatctgggacatcaccaaaggtacaaaaatgaagcactacttcaatatgatagaaggacagggtcatggggccgtttttgattgtaaatttagtcaggatgggcagcatttcgcctgcactgattctcacggccatttgcttatattcggtttcgggtgttcaaagccatacgaaaaaatacccgatcagatgtttttccacactgattaccggcccctgattagggattcaaacaactacgttctggacgagcaaacacagcaagcccctcacctcatgccgcccccctttttagtggatgttgacggaaaccctcatcctacaaagtaccaaagactcgtgcccggtcgcgagaatagcgccgacgaacacttgattccccagctcggatacgttgccactagcgacggagaggttatcgagcagattatttcccttcagacaaacgataacgatgagagaagtcccgaatcgtccatacttgatgggatgatcaggcaactgcagcaacaacaggaccagcgtatgggagccgaccaggatactatacctcggggtttaagcaatggtgaagaaacccctcgtcgcggattccgtaggctgtctctggacattcagagtccgcctaacatagggctgagaaggtctggtcaggtcgaaggagtgagacagatgcaccagaacgcccccagatcccagatcgccactgaaagggatctacaggcctggaaacggcgtgtggtggttcctgaggtccccctcggcattttcagaaaactggaggattttaggctcgaaaaaggggaagaggagcggaacctctacattataggccgtaaaaggaaaaccctgcagctgtctcacaagagtgactccgtcgttctggtgtctcagtccagacagaggacctgcagaagaaaataccctaattacggccgcagaaatcgtagctggagagaactgtcctcagggaatgaatcttctagctccgtccgacatgaaacttcttgcgatcagtctgaagggagtggctcatccgaagaagacgaatggaggagcgatagaaaatccgaatcttatagcgaaagttcctccgactcttcatcgcgttacagcgactggaccgctgacgccggtataaatctgcagccgccactgagaacaagttgccgtagacggataacccggttttgctcttctagcgaggatgagattagcacagagaacttgtcaccacctaagagacgcaggaagcgcaagaaagagaacaaacctaaaaaagagaatctgagacgaatgacacctgccgagctggcaaatatggagcatctgtatgagtttcaccctccagtgtggattacagatactacactgaggaagagccctttcgtaccacagatgggggatgaagtcatttattttagacagggccacgaagcttacatcgaagctgtacggcgcaacaatatttatgagctcaaccccaataaggagccctggaggaagatggacctgagggatcaggaattagtcaagattgtgggaatccgttatgaggtgggaccccccactctgtgctgcctgaagctggccttcatcgatcccgccacaggaaaactgatggacaagagcttctccatacgctatcatgacatgcctgatgtaattgatttccttgtcttgcgccagttttatgacgaggcccggcaaagaaactggcagtcgtgcgatcggttcaggtccatcattgacgatgcttggtggttcggaaccgttctctcacaggagccataccaaccccagtaccctgacagccatttccagtgctacattgtcaggtgggataatacagaaatagaaaaattgtctccatgggatatggaacctatccccgataacgtcgaccccccggaggagctgggcgcctcaataagcgtgacaactgatgagctcgaaaagctactctataagccccaggccggcgagtggggccagaagtcccgggatgaagagtgtgatcgcattatatctgggatagatcaactgctgaacctcgacattgcagcagcatttgcaggtccagtggacctgtgtacatatcctaaatattgtacagtggtggcctatcctactgacttgtacacgattcgcatgcggctcgtgaaccgtttctataggcgcttgtctgccctggtgtgggaagtgaggtacattgagcataatgcacgcacatttaatgagccagagagcgtgatcgcccggtcagctaagaaaattaccgatcagctgttaaaatttatcaagaaccaacactgtaccaatatcagtgagctgagcaatacaagtgaaaatgatgaacagaacgccgaggacctggacgatagtgatcttcccaaaacgtccagtggccgaagacgggttcacgacggcaagaaatcaattagagcaacaaactacgttgaaagtaactggaaaaaacaatgcaaggagctggttaacctgatttttcagtgcgaagacagcgagccatttcgtcagcccgtcgatctggtcgagtacccagattatcgtgatataattgatactcccatggactttgggaccgttcgcgaaactttggacgccggcaattatgacagtcccctagaattctgcaaggatataaggcttatcttcagtaacgccaaagcttacactccaaacaagcggtctaaaatctatagcatgacgttgcgtctgtctgccctgtttgaagaaaagatgaaaaaaatcagctccgattttaaaattgggcagaagttcaatgagaagctccgcagatcgcagcggtttaaacagcgccagaattgcaagggtgacagccaacccaataagtcgatccgtaatctgaaaccaaaacgacttaagagccagacaaaaatcatacccgaactcgttggcagccccacccagtcgacttctagtcggactgcctacttagggacacataaaaccagcgcaggcatatcgtctggtgtgaccagcggcgactcatccgatagtgcagaatcatctgaacgaaggaagcgcaaccggccaatcacaaatggcagcaccttgagcgagtccgaggtggaggactcacttgcgacctcattaagttcctccgcatcctccagttcggaagagtcaaaggagtcctccagagcccgggaaagttccagccggtctggtctgtctcggtccagtaatcttagggtaacccggacccgagccgcccagcgaaaaaccggtcctgtttcactggcaaatggctgcggccggaaggctaccagaaagagagtctacctgtcggactccgacaataactcactggagaccggtgaaatcctgaaggcccgggctggcaacaatcggaaggtgttgcggaagtgcgctgccgtggcagccaacaaaattaagcttatgagcgatgtagaggaaaactcgagttcagagagcgtgtgcagtggccgaaagctgcctcatcggaacgctagcgcagtggcgaggaagaagcttttgcataattctgaggatgagcagtccctgaagtcagagatcgaggaagaggaactgaaagatgagaaccagctgctgccggtgagttcttctcacacagctcaatccaatgtcgatgagtccgaaaatagagattcagaatctgagtccgatctgagggttgctcgtaaaaactggcacgccaatggctataaatcacacacccctgccccaagcaaaacgaagtttctaaagatcgagagtagtgaagaggactcaaagtcgcatgacagtgatcatgcttgtaaccggacagcaggcccctcaacaagcgtccagaaattaaaagctgagtctatctcagaggaggccgatagcgagccagggcgatccgggggaagaaagtacaacactttccacaaaaacgccagttttttcaaaaagactaaaatccttagcgattcagaggacagtgaatctgaagagcaggatcgcgaggacggaaagtgtcacaagatggagatgaatcccatttcaggaaacctgaactgtgacccaattgccatgtctcaatgcagctcagaccatggctgtgagaccgacctcgactccgacgacgataaaatcgagaagccaaacaacttcatgaaagattctgcgtctcaggataacgggctgtcgaggaagattagtcgaaagagagtatgtagcagtgacagtgattcttccttgcaggtcgtgaagaagtcctcgaaggctaggactggactgctgaggatcactcgccgatgtgcagctaccgccgctaacaagatcaagctcatgagtgacgtggaagacgtcagccttgaaaatgtacacacccgttccaagaatgggcgaaaaaaacccctgcacctcgcctgtacaacagccaagaaaaagctatctgactgcgagggctccgttcattgtgaagtcccatctgagcaatatgcttgcgaaggtaaacccccagaccccgattccgaggggtcgacaaaagttctgtcccaagccctgaacggggactccgacagcgaggacatgctcaatagtgaacacaaacatagacacacaaacatccacaagatagacgctccttcaaagcggaagtccagctcagtcacgtccagcggagaagacagtaaaagccatataccagggtctgaaaccgatcgcacattctcctcagaatctaccctcgctcagaaggcgacagcggaaaacaacttcgaagttgagctgaattatggccttaggcgttggaacgggcgaaggcttcggacttatggtaaggccccctttagcaaaacgaaggtgatccatgactcacaggagacagctgagaaggaggttaaaagaaaacggtcacatccagagctcgagaacgttaaaatctctgagactacaggaaattccaagttcagacctgacacgtcctctaagtcgtccgacctcggaagtgtaaccgaatcagatattgactgtactgataacacaaagaccaagcgcagaaaaacaaagggaaaggccaaggtggtccgtaaggagtttgtcccccgtgaccgcgaaccaaataccaaggtccgcacctgtatgcacaatcaaaaagatgcggtgcaaatgccaagtgagaccctgaaggccaaaatggtccccgaaaaagttccccggaggtgtgcgaccgtcgcggctaataagattaaaatcatgagcaacctcaaagagaccatctccggccccgaaaacgtatggattaggaaatcaagtaggaagctcccccaccgcaacgcatccgcagccgccaagaaaaagctactaaacgtttacaaagaggatgataccactataaattccgagagcgaaaaagagctggaagacattaacaggaaaatgttgttcctcagaggcttcaggtcatggaaagaaaacgcacagtag

SEQ ID NO: 14606 - DNA, 2961 bp, Artificial Sequence
  Description of Artificial Sequence: Synthetic coding sequence
atggctgaatcctttttttccgacttcggccttctgtggtacctcaaagaactgcgcaaggaggagttctggaagttcaaggagctgctgaaacagccactagagaagttcgagttgaagccaatcccctgggccgagctgaaaaaagcctcaaaagaggatgtggccaagctgttggacaagcactatcccgggaaacaggcctgggaagtcacccttaacctatttctgcagataaaccggaaggacctgtggacaaaagcacaggaagaaatgcggaacaagctaaacccttacagaaaacacatgaaggagacattccagctgatctgggagaaggagacatgcttacatgttcccgagcatttttacaaagagaccatgaagaacgagtataaagaactgaacgacgcttacacagcggcagcaagaagacacacagtcgtattggaagggcccgatggaataggaaagactaccctgctgaggaaggtcatgctggactgggcagagggcaacttgtggaaagatagattcaccttcgtgttctttcttaacgtctgtgaaatgaatggtattgccgagactagccttttggaactgttgtcccgagattggccagaaagcagcgaaaagatcgaagatattttcagccagcccgaaagaatcctgttcatcatggatggtttcgagcagttaaaattcaaccttcagctgaaggccgacctttcggatgactggcgacaacgccagccaatgccaattattctgagtagtctcctgcaaaaaaaaatgcttcctgagtctagtctgctgatcgctctcggtaagctggccatgcagaagcactactttatgctgcgccacccaaagctaataaagctactgggctttagcgagagcgagaaaaagtcctatttctcatacttttttggggagaagagtaaggctctgaaggttttcaattttgtccgcgataatggtcccctgttcatactgtgccataacccctttacatgttggctcgtttgtacttgcgtcaagcagcgcttggagagaggcgaggatctggaaataaactctcagaacactacatatctttacgccagctttttaaccacggtgttcaaggccggttcacagagcttcccacccaaggtgaatcgcgctcggctcaagtccctgtgcgctctcgctgcagagggtatctggacgtacacctttgtcttctcacacggcgatcttagacgaaatgggctcagcgaaagcgaaggagtcatgtgggtggggatgagacttctacagcggcgcggcgactgtttcgcattcatgcatctctgtatacaggagttctgtgctgccatgttttatcttctgaaacggccgaaggatgatcctaatccagctatcggcagcataactcagctggttcgtgcatccgtagtacagccccagacactgctcactcaagtcggtatcttcatgttcggaatctcaacagaggagattgtgagcatgctggagacaagcttcgggtttcccttgtctaaggatctcaagcaagagataacacagtgtctggaatccctgtctcagtgcgaggcagacagggaggctatcgccttccaggagctttttattgggctgtttgaaacccaggaaaaggagtttgtcactaaagtgatgaactttttcgaggaagttttcatttacatcggtaatatcgaacaccttgttattgcctctttctgcctgaaacattgtcaacatctcaccactctccggatgtgcgtagaaaatatcttcccagacgacagcgggtgcatatccgactataacgagaaactggtgtactggcgcgagctttgctccatgtttatcactaacaagaacttccagatattggacatggaaaacacaagtctggatgacccgtctttggctatcctgtgcaaagccctcgctcagcctgtgtgcaagctgcggaaattgatattcacttcagtgtattttggccacgactcagaactgtttaaagcggtgctgcacaaccctcacctgaaactgttaagtctgtacggcacaagcctgagccagagcgacatcagacacctctgtgagaccttaaagcatcccatgtgcaagatcgaagagctaatcttggggaagtgtgacataagttcagaggtgtgcgaagatatcgcctctgtattggcctgtaactcgaagctgaagcacctgtctctagttgaaaatcctctacgtgacgaggggatgaccctgctctgtgaggctctcaagcatagccattgcgccctagagcgcttgatgctgatgtattgctgtctgacgtcagtttcctgcgattccatttccgaagtactgctgtgctctaagagcctgagcctcttggacttgggttctaacgccctcgaagataacggcgtggcctccctatgtgccgccctgaagcatcccggctgctctatacgcgaattgtggctgatgggttgtttccttacaagcgatagctgtaaagacatcgccgcggtgttgatatgcaacggtaaactgaaaactctgaagttgggtcacaatgaaatcggtgatactggcgtcagacagctttgcgctgcgcttcaacacccacactgcaagctggagtgcctgggcctgcagacttgccctataactcgggcctgttgtgacgatatcgcagcggcgttaattgcctgtaagacactaagatctctcaacttggattggattgctctcgatgccgatgccgtggtagtactatgtgaggctttgagtcaccccgattgcgcattgcagatgttgggtaattgccagaaatctctgggcgataccgtcgccccaggtgagaatcattgctcaataaagcatctgcttcttaccctccctatcaacatgcagcggcaactccggctgcaaaagtag

SEQ ID NO: 14607 - DNA, 3039 bp, Artificial Sequence
  Description of Artificial Sequence: Synthetic coding sequence
atggatgcactcgatgctagcaaactgctcgacgaagaactttacagtaggcaattatacgtcctcggctcaccagcaatgcagaggatccaaggcgcgagggtcctggtgtctggcctacagggtctcggtgctgaagtagctaaaaacctggttctcatgggcgtcggtagtctgacgctgcacgatccacatcccacctgttggtctgatttggcagctcagtttctactgtccgagcaggacctggaacggtcaagggcagaagctagtcaagagcttttggcacagcttaacagagccgtgcaagttgttgtccataccggggacataactgaggatctgctgcttgactttcaggtggttgtcctgaccgccgcgaaactcgaagaacagctcaaggtgggaaccctgtgccacaagcatggtgtatgttttcttgcggccgacacacgtggcttggtgggccaactattttgtgactttggagaggactttactgtgcaggaccctacagaagcagagccgttaacagccgcaattcagcacatctcgcagggctctcctggtatcctcaccctcagaaaaggagcgaacacccattatttccgcgacggggacttggtgacgttcagcggcattgaagggatggtcgaactgaacgactgcgaccctaggagtatccacgtcagagaagacggctcgctggagattggggacacaacaacattcagccgctaccttcgcgggggcgccattacagaggtcaaaagacccaagacagtgcgacacaagtcactggacacggctcttctgcagcctcatgtggtggcgcagtcgagccaggaggttcatcatgctcattgtctccaccaggctttttgcgctcttcacaaattccaacacttacacggccgcccacctcagccttgggaccctgtagatgctgaaaccgtggtgggactagctcgggacttggagccactgaaacgcaccgaagaggaacccttagaagagcctctcgatgaggctttagtgagaacggtggcattgagttcagctggagtgttatcccctatggttgccatgctgggagcggtcgccgcccaggaggtgttgaaagcaattagtaggaagtttatgcctcttgaccagtggctgtacttcgacgctctcgactgtctgccggaagacggagagttactaccatcccctgaggattgtgcactgcggggaagtaggtatgatggccagatagccgtattcggggccggatttcaggaaaagttaaggcggcagcactatttgctcgtcggtgctggcgccatcgggtgtgagctactcaaggtcttcgcccttgtgggcctaggtgcaggaaattccggaggattgacagtcgtggatatggaccatatcgaacgtagcaacctttcacgacaattcttattcaggagccaggacgtcggtcgtcccaaagctgaggtcgccgctgcagccgcccggggcttaaatcctgacttgcaggtcatccctttgacttaccctctagaccccaccaccgagcatatctacggcgataactttttttccagagtcgatggcgtggcggcagcactcgatagctttcaggcacggagatacgtcgcagcccggtgtactcattatctgaaacccctattagaagctgggacttccggaacatgggggtccgccaccgtctttatgccgcatgtgacggaggcgtacagagccccagctagcgcagccgctagcgaggacgcaccctacccagtctgtacagtgaggtacttccccagcaccgcggagcataccttacagtgggcccgtcacgagttcgaagaactgtttcggttgtcagcagagaccattaatcatcaccagcaggctcacaccagccttgcggacatggacgaacctcaaaccttgactctgctcaaacctgttctgggcgtactgcgcgtcagaccccagaactggcaggattgcgtcgcctgggccctcgggcactggaaactgtgtttccattatggtatcaagcagctgctgcgccactttccgcctaataaggtgcttgaagacgggacacctttttggtccggccccaaacagtgcccccagcccttggagttcgacaccaaccaagatacccatcttctgtacgttcttgccgcagccaatctctacgctcaaatgcatggactaccaggtagtcaagattggacagcactgcgtgagttactgaaacttctgccccagcccgatcctcagcaaatggctccaatttttgccagcaacctggagctggctagtgcaagtgcagagttcggcccagaacaacagaaggagctgaacaaggcgctcgaggtgtggtctgttggaccacccctgaaacctctaatgttcgagaaggatgacgactctaacttccacgtagacttcgtggtggcggctgcgagccttagatgtcagaattatggcatccctcctgtgaacagagcccaatctaaacggattgtgggccagatcattcctgccatcgcaacaacaacagctgcagttgccggacttctgggtctggaactgtacaaagtcgtgtccggtcccagaccccgttccgcgttcaggcactcatacttgcatctggcagaaaactacctgatcaggtacatgcccttcgcaccggccattcaaacatttcaccacctgaagtggacttcgtgggaccgattgaaggtaccggcagggcagcctgagcggactctcgagagccttctggctcacttacaggagcaacacggcctgagggtgaggatactcctccacggatctgccctgttgtatgcagcaggatggtcccccgaaaaacaggctcagcatttacccctccgggtgacagaattagtccagcagctgaccggccaggctcccgcccctggacagagggtactcgtgctggaactgagctgcgagggcgacgacgaggatacagcctttccacccctacattacgagctttag

SEQ ID NO: 14608 - DNA, 360 bp, Artificial Sequence
  Description of Artificial Sequence: Synthetic coding sequence
atggtaaggaccaagacttggacgctgaagaagcactttgttggttaccctaccaattcagattttgagttgaagaccgctgagctcccaccccttaagaatggcgaagtgttattggaggcactattcttgacagtcgatccttacatgagagtggttgagtccaagaacgtcgctctgcccaaaggcaccatagtcctggcttctccaggctggactacccactctatcagtgatggtaaagatctcgagaaactgctcactgaatggcccgacacaatcccactcagcttggcacttggcacagttgggatgccagggttgacagcatacttcgggctgttggaaatctgcggctag

SEQ ID NO: 14609 - DNA, 1797 bp, Artificial Sequence
  Description of Artificial Sequence: Synthetic coding sequence
atgggaggttgcttctccaagcctaaaccggtcgaactgaagatcgaagtggtgctccccgaaaaggagcgagggaaagaagagttgtctgccagcgggaaggggtctccccgcgcgtaccaaggtaatggcacagctcgccatttccataccgaggagagattatctactccgcatccttatcctagtccacaagattgcgtggaagcagctgtgtgtcatgtcaaagacctggaaaatggccagatgcgggaagttgagctggggtggggaaaagttctgctagttaaggacaacggtgaattccatgctctcggccacaagtgtcctcattatggggctcccttggtcaaaggcgtgttgagtaggggccgggtgcgatgtccttggcacggagcctgtttcaatatttcaacaggagatcttgaagacttcccaggcctggattcgctacacaagttccaggttaagatcgaaaaggagaaggtgtacgttagggcctctaaacaagccctgcagctgcagcgaagaaccaaagtaatggccaagtgtatctcgccctccgccggatatagctctagcaccaacgtgcttatcgtgggtgccggggcggctggcctcgtgtgtgccgagacattgcgccaagagggtttctccgaccggatcgtgctatgcacactggaccgccatctgccatatgaccgtcctaagctgagcaaaagtttagacacccaacctgagcaattagctctcagaccaaaggagttttttcgggcctacggcatcgaggtgctcaccgaggcccaggtggtgacagtggacgtgcggacaaagaaggttgtttttaaagacggcttcaaactggagtacagtaagctgcttttggctcccggctcatcccctaagaccctttcgtgtaaaggcaaagaagtggaaaatgttttcaccattcgcacacctgaggacgctaaccgcgtggtgagactggccagaggtcgcaacgtagtggttgtgggcgccggattcctcggaatggaggtggcagcatacctgaccgagaaagctcacagtgtgtccgtagttgaactggaagaaacccctttcaggagatttctcggtgagagagtgggcagagcgcttatgaaaatgttcgagaacaacagggtgaaattctacatgcagacggaggtgagcgaactgcgagggcaggaaggcaaactaaaggaagtcgttcttaaatcctctaaggttgtgcgggcagacgtgtgtgtggtgggaatcggagccgtgcccgccacgggcttcctacggcagagtgggattggtctcgacagtcgcggttttatccccgtcaataaaatgatgcaaacaaatgtgccgggcgtgttcgctgctggcgatgccgtgacctttccactggcctggcgcaataaccgcaaggttaatataccccattggcagatggctcatgcgcaggggagagttgctgcccagaatatgctggcacaggaagccgaaatgagcaccgtgccatatctgtggaccgcaatgtttggaaagtcactgagatacgccggatacggagaaggattcgacgatgtgattatccaaggcgatctcgaggagcttaagttcgtggctttttacaccaaaggagatgaagtgattgccgtggcttccatgaactatgaccctattgtgtctaaggttgccgaagtccttgcatcagggagggccattcggaagagagaggttgaaactggtgacatgtcttggctcaccggtaagggtagctag

SEQ ID NO: 14610 - DNA, 1854 bp, Artificial Sequence
  Description of Artificial Sequence: Synthetic coding sequence
atgggcagttacctgtcagtgccagcctactttacatctcgcgatttgttccgatgctcggagtgccaagattctctaactaactggtattacgagaaggatggtaaactgtactgcccaaaagactactggggcaagttcggggagttctgccatgggtgctcactcctgatgacagggccttttatggtagctggcgaattcaaataccatcccgaatgctttgcgtgcatgtcttgtaaagtgattatcgaagacggggatgcctatgcgctcgtgcaacatgctaccctgtattgtgggaagtgccacaacgaggtggtcctggccccaatgtttgagagactttcaactgagtccgtacaggaacagcttccctactctgtgacacttatatctatgccagccaccacagaagggcgtcgtggtttctcagtgtctgtggagtccgcctgtagcaactacgcaaccaccgtgcaggtaaaagaagtgaatagaatgcacatttccccaaacaacagaaacgctatacaccccggggacagaatacttgagatcaacggaactcctgtcaggacgctgagagtggaggaggtggaggatgccatttctcagaccagtcaaactttacagttgctgatcgagcatgatccagtatcacagaggctggatcagctacgtctggaggcaaggctggctccacatatgcagaatgccggtcacccccatgcactctccacccttgacacaaaagaaaacctggagggcacactgcggcgacgatcactgagaagatccaactccatttcaaagagcccaggcccgtcaagccctaaggaaccattactattctcccgggacatctcccgatccgagagtcttagatgcagctcctcctatagtcagcagattttccgcccctgtgatctcattcacggcgaggtgttggggaaggggtttttcgggcaggctatcaaggtgactcataaagctactggcaaagtgatggtgatgaaagagttgatcaggtgcgacgaagagactcaaaaaacgttcttgaccgaagtcaaggtcatgcggtccctcgaccatcccaacgtgctgaagtttataggtgtgctgtataaagacaagaagctgaacctcctgaccgaatatatcgaaggcggcacccttaaagacttcttacgatccatggacccttttccttggcagcagaaggtgcgtttcgctaaagggatcgcatccggtatggcctatctccacagcatgtgtatcatacaccgggatttgaattctcacaactgcctgattaaattggataagactgtggtggttgcagattttgggctatccaggctcatcgtcgaggagagaaagagggcacctatggaaaaagccaccactaaaaagagaaccttaaggaagaacgatagaaagaagcgatatactgtcgtcgggaacccctactggatggcccccgagatgttaaatggcaagtcctacgatgaaacagtggatatcttttctttcgggatcgtgctatgcgagatcatcgggcaggtttatgccgatcccgattgtttaccaagaacactggattttggccttaacgttaagctgttctgggagaagttcgttcctaccgattgtcctccagcctttttccccctggcagccatttgttgtcgcctggaacccgaatcgcgaccagcattttctaagcttgaggactcgttcgaagcgctcagcctctaccttggtgaactgggcattcctctgcccgcagaactggaagagcttgaccatacagtgagcatgcagtatggcctgaccagagactcacccccctag

SEQ ID NO: 14611 - DNA, 1338 bp, Artificial Sequence
  Description of Artificial Sequence: Synthetic coding sequence
atgagggaaatcgtacatattcaggccggacaatgcggaaatcagatcggcgctaaattttgggaagttatctccgatgagcacggcatcgatcccaccggctcttatcatggcgattctgaccttcagctcgaacggattaacgtatattataatgaggcagctggcaataagtatgtgccaagggcaattctggtggatttggaaccgggcacaatggatagtgttagatccggcccatttgggcagatcttcaggcccgataatttcgtcttcggccaatccggcgcaggcaacaactgggcaaaaggccattacacagagggggctgaacttgtagattctgttctcgatgtggtgcgtaaggaatcagagagctgcgattgtctgcaaggatttcagctgacccactctctggggggcggaacaggatccggtatggggacactgcttatctccaagatcagagaggaatatcctgatcggatcatgaacacttttagcgtgatgccgtcacccaaggtttccgacacggtggtcgagccctataacgcaacattatcggttcatcagctcgtggaaaacaccgacgaaacctacagcatcgataacgaagcgctgtacgatatttgtttccggacactgaaattgacaactcctacgtatggagatctgaaccatctggtgtcagctacaatgtcaggcgtgaccacatgtctgcggttccccggacagctcaatgcggacctgcggaagttggccgtcaatatggtgcccttcccccgtcttcactttttcatgccaggctttgctcctctgaccagccgcggcagccagcagtatcgcgccctcaccgttcctgagctgactcagcagatgttcgattcaaagaacatgatggccgcgtgtgacccgagacacggcaggtatctgacagtggcagctattttcaggggccggatgtccatgaaagaagtggacgaacagatgcttaatgtacaaaacaaaaatagctcctatttcgtggaatggattcccaataacgtgaaaactgctgtgtgcgatattcccccacgtgggttgaagatgagcgctactttcattggcaacagcactgccattcaggagctattcaaacgcatctcagagcagttcactgcaatgttccggaggaaagcattccttcactggtataccggagagggaatggacgagatggagtttactgaagctgaatctaacatgaatgatctggtttccgagtaccaacagtatcaggatgccaccgcagacgagcagggagagttcgaagaagaggagggtgaggatgaagcctag

SEQ ID NO: 14612 - DNA, 2028 bp, Artificial Sequence
  Description of Artificial Sequence: Synthetic coding sequence
atggccaaacacggggccgacgagccttcctctcgaagtggatccccagaccgagaaggaagggcatctgaagaccgaagtctgctgcaccagcgcctcgctgtgagggagctcatcgacaccgaagtatcttatttgcatatgctgcaattgtgcgccagcgacatccgctctagactgcagcagcttcctcaaggggacctggatgtgctgttctcaaatattgacgacattataaaggtgaacagccgcttcctgcatgacctgcaggagacagcatcaaaggaggaggaacaagtgcagctggtcggaaatatcttcctcgagttccaggaagaactggagcaggtgtacaaagtttactgcgcctcatatgatcaggccctcctgttggtcgacacctacaggaaggagcctgagttgcagagacacatacagggaattgtggaagcggttgtgccgcaggccggaagctccggtttatctttcttgctggtgattccactgcagcggattactcgctaccctttgttgctgcaaaaaatactggaaaacacagtccctgacgccagtgcataccctgtattgcagcgggccgtgtctgcccttcaggatgtcaacaccaacataaatgaatataaaatgcgcaaagaagtcgcctccaaatataccaaggtcgaacaactgactcttagagaacgtcttgcgcgcataaacacccatacattgagtaaaaagaccactaggttgtctcagttgctcaagcaggaagccggcctcattccgcgaacagaagacaaagagttcgacgatctggaggagaggtttcaatgggtatccctttgcgtcactgagctgaagaacaacgtggctgcttatctcgacaacttgcaagctttcttgtattttagacctcatgaatataatctcgacatacctgaaggccccgccgttcagtattgcaatctggctcgggacttacatctggaggccttcctgaaattcaagcagcgactcgaagggctcgtgtggcagcccctgtgtagcctggcaaaagcccttttgggcccacaaaacctgataaagaaaaggctcgacaagttattggattttgagcgtgtcgaggagaaactccttgaggttggaagcgtcacgtaccaggaggaggccgctaggcatacttatcaggcgttgaatagtctcctcgtggccgagcttccacagtttaatcaattagtgatgcagtggctcggccagatcatgtgcactttcgttactctgcagagagatctggctaaacaggtgctgcagcgtgccgagggctcaatggcccagttacctcatcatcatgttccggaaccagcttttaggaagcttgtagaagatgctctgggccgtacgagtaaccagctgcgcagctttcaggagacattcgaaaaagtccaacccccccctaccactcagccactgctccccggaagtgaacgacaggtgcaagctttgctaagcaggtatggcccaggcaagctctaccaagtcacttcaaatatctcaggaacaggcaccctcgacctcactttgccaagaggtcagatcgtggccattctgcagaacaaggatacgaagggaaactcgggccgctggctcgttgatacaggcggccataggggctacgtccccgcaggcaagttgcagctctaccacgtggtcccatccgccgaggaattaaggaggcaagccggcctgaataaagaccctagatgccttacacccgagccatcccccgctctagtgccctctataccgaccatgaaccaggtgatagcggcatacccttttgtggcccgctcatctcacgaggtaagcctgcaggcaggccagccagtcactatcttggaggcccaggataagaagggaaaccccgagtggtcactggtcgaggtgaacggccagcggggctatgttccaagcggttttttagcacgggcacgcagccccgtattgtgggggtggtccctacctagttag

SEQ ID NO: 14613 - DNA, 3399 bp, Artificial Sequence
  Description of Artificial Sequence: Synthetic coding sequence
atggcttctgatggcgcctccgccctcccgggtcccgatatgagtatgaaaccctccgcagctccgtcccccagtccagcattgcccttcttacccccaacaagcgatcccccagatcacccaccccgggaaccaccgcctcaacctattatgccgagtgtttttagccctgacaaccctctcatgctttccgcctttcccagtagtctcctggtcaccggcgatgggggaccatgtcttagtggagccggcgctggcaaggtgatcgtgaaggttaaaacagaaggggggtccgcagagcccagccaaacgcagaatttcatcttgacgcagaccgcactaaatagcaccgcccctggaaccccctgcggcggtttggaaggcccggcccctcccttcgtgaccgccagtaatgtgaaaaccatcttgcccagcaaagcagtcggtgtgtcccaagagggcccccctggtcttccacctcagccaccgccgcccgtcgctcaactggtcccaattgtgcccctcgaaaaggcatggcccggaccacatggcaccacgggcgagggcggacctgtggccaccctgtccaaaccttcactgggcgatcgctcgaagatttctaaagatgtgtatgaaaacttccgacaatggcagagatataaggccctggcccggcggcatttgtcgcaatccccagatacagaggctctgtcatgcttcctgattcccgttctgaggagtttggcgcgactgaagcctacaatgaccctggaggaggggttacccctcgcagtgcaggaatgggagcacacttcaaacttcgacagaatgatcttctacgagatggccgagcgttttatggaattcgaggcagaagagatgcagatacagaacacacagttgatgaacggatcacaggggctgagcccagccactcctctgaagcttgacccattaggccctctcgcttccgaggtgtgccaacagccagtgtatatcccgaagaaggcagcatccaaaacccgcgctcccaggaggaggcagcgaaaagctcagagaccgcccgcgcctgaggcgccaaaagaaatccctcccgaggccgtcaaagagtacgtagatattatggaatggctggtgggcactcacctcgctactggagaaagcgacggaaagcaggaggaggaaggccagcagcaggaggaggagggaatgtaccccgaccctgggctgctgtcgtatatcaatgaactatgttcccaaaaagtcttcgtgagcaaagtagaggccgttattcaccctcaattcctggccgatcttctgtcacctgagaaacaaagagatcctctggcgctcatcgaagagctagaacaggaagaaggcctgaccctcgctcagcttgtccagaaaaggctgatggcactggaggaggaggaggacgccgaagctccacctagcttttctggagctcagctggactcttccccaagtgggagcgttgaggatgaagacggtgatgggcggctcaggcccagtcccgggctgcagggagctggcggcgcagcatgcctgggcaaggtgagttctagtggcaaacgggcgcgcgaagtgcatgggggtcaggagcaagctctggattccccacgcggtatgcaccgtgacggaaacacccttccgagcccctcttcctgggacctccagcccgagctcgctgccccacagggcacacctggtccgcttggggtggaaagaagaggctctgggaaagtgataaatcaggtaagcctgcaccaggacgggcatctggggggagctggccctccaggtcactgtctggtcgctgatcggacatccgaggcactgccgctgtgttggcagggaggcttccagcctgagtccacgccgtctcttgatgctggactggctgagttggctcccctacagggccaaggactggagaagcaggtactggggctacagaaagggcagcaaactggcggaagaggagtgttgccccagggcaaggagccactcgctgtaccttgggagggaagttctggggccatgtggggggatgatcgcggcacccctatggcacagagttatgatcagaaccctagcccgcgagcagcaggcgagcgggacgatgtctgcctctccccaggtgtgtggctctcgagtgaaatggacgccgttggcctggaactaccggtccaaatcgaggaagtgattgagtctttccaagtggaaaagtgtgttacggagtaccaagaaggttgccagggactgggcagtcgaggaaacatctctttagggccaggcgagaccctggtgcctggggacacagaatctagtgttatcccctgcgggggcactgtggctgctgccgcattggagaagcgcaactactgttccttaccaggccctttgcgcgctaattctcctccactccgtagcaaggaaaatcaggaacagagttgtgaaaccgtgggtcatccttcagatctctgggccgagggatgctttccgctgctggagtccggcgacagtacccttggcagttcaaaggagaccctccctccaacttgtcagggcaatctcttgatcatgggtactgaggacgcaagctctctgcctgaagcatcccaagaagccggtagccgaggtaacagtttcagccctctccttgagacgattgaaccagtgaacatcctcgacgtgaaagacgactgcggcctgcagttgcgcgtgtccgaggacacatgtcccctcaatgtgcatagttacgaccctcagggggaaggccgggtggaccctgatctgagtaagccaaagaatctggccccactacaagagagccaggaatcttacacaactggtacgcccaaagctacaagcagccatcagggcctcggaagtaccctgccgcgccgcgggactaggaacgccatcgtgcctcgcgagacatctgtttcaaagactcaccgatccgctgatagagcaaaagggaaggaaaagaagaaaaaagaggcagaagaggaggatgaagagctgtcaaattttgcttatcttttagcttctaagttaagcctgtctccaagggagcatcctctgtccccacaccatgcatcagggggacagggcagccaaagagccagccacctcctgcccgcaggagctaagggcccatcaaagctaccataccctgttgccaagagcggaaaacgcgcacttgctggtggccccgccccaaccgagaaaaccccccactccggggctcagctgggagtgccacgggagaaacctctggccttaggggtcgtgcggccatctcagccaaggaagcgcaggtgcgactcatttgtaaccgggagacgcaaaaagcgtcgccggtcccagtag

SEQ ID NO: 14614 - DNA, 522 bp, Artificial Sequence
  Description of Artificial Sequence: Synthetic coding sequence
atggctgtggctgtgggcgttagagctgccccagtcttgggcttggctcgtgctttagtactgggtctgagaggaagccaggccgcacggtggcgcggctggggtacagccgccccgggttcactgtgggccctgtgcgagtgtcccgctggttgtagggaactatggttccggggacgcgcagcatgggctgcccggtctgagcgattacttcacccagcccaggattccgatggcgagagggaggacagtgcagcagagagagcaagacagcagctggaggcccttctgaacaaaactatgcgaatccgaatgacggatgggcgaaccctagtgggctgctttctatgtactgatagggactgcaacgtgatcctggggtcagcacaggaatttttgaagccatccgactcttttagcgcgggcgaaccacgcgtgctggggttggccatggtgcctggtcaccacatcgtctccattgaggtccagagagaatctttaaccgggccaccctatctctag

SEQ ID NO: 14615 - DNA, 558 bp, Artificial Sequence
  Description of Artificial Sequence: Synthetic coding sequence
atggtgaactcctgttgcgggtctgtgtgcagcgaccaggggtgcgggcaggatctatgccaggagacatgttgttgtcctagttgctgtcaaaccacttgttgcaggacaacctgctataggccgtcctactcagtctcttgctgttgcagaccccagtgttgtcagtctgtgtgctgccagccaacctgctgccgccccagctgctgcgtgagcagctgctgtaaaccccagtgttgtcagtctgtatgttgccaacccacgtgctgccatccttcttgctgtattagctcctgttgcagaccaagttgttgcgtgagctcttgttgtaagccccaatgttgccagagcgtttgttgccaaccaaactgctgcaggccaagctgttccattagttcatgctgcaggccatcctgctgtgagtcctcctgttgcaggccctgttgctgcctccggcccgtctgtggcagggtctcttgccatacgacatgttacaggcctgcatgcgtgatcagtacctgccctaggcctgtctgttgcgcaagctcctgctgctag

SEQ ID NO: 14616 - DNA, 252 bp, Artificial Sequence
  Description of Artificial Sequence: Synthetic coding sequence
atgtgctgtaactattatcgcaactgttgcggtggctgtggctacggctcaggctggtcatccggatgcggatatgggtgtggatatggctgcggctatggatccggatgtcggtacgggtctggctacggcacaggatgcggttatgggtgcgggtatggaagtggctgtgggtatggttgtggatactctagtagctgttgtgggtatcggccgctgtgttaccggcggtgttacagctcatgctactag

SEQ ID NO: 14617 - DNA, 993 bp, Artificial Sequence
  Description of Artificial Sequence: Synthetic coding sequence
atggggagccgtaaaaaagaaatagcactccaagtcaacatctctacccaggagctctgggaagagatgctgtccagcaaggggctaacagtagtcgacgtgtatcaaggctggtgcgggccatgcaaaccggtcgtgtccttatttcaaaagatgcggattgaagtcgggctcgatctcctgcacttcgccttagctgaagctgaccggctggatgtgctcgaaaaataccgaggaaagtgtgagcccaccttcttattctatgcagggggcgaactggtagctgtcgtaagaggagctaatgcccctctgctgcagaaaactatactggaccaactggaagctgagaagaaggtcctcgctgagggcagagaacggaaggtgatcaaggatgaggcactgtctgatgaggacgaatgtgtctcacacggcaagaataacggtgaggatgaagacatggtctcgagcgagaggacatgcactctggccatcataaagcctgatgccgtcgcacatggcaaaacagatgagataattatgaaaattcaagaggccggtttcgagatcttaaccaacgaggaacgcacgatgacagaagcagaggtccgacttttctatcagcataaagcgggagaagaagccttcgaaaagctcgtccatcatatgtgttcgggaccttctcacttgcttatcctgacccgtaccgaaggtttcgaggacgtggtgacaacatggcgcactgtgatggggcctagagacccaaacgtcgctagacgcgagcaacctgaatctctgcgggcgcagtacggaacagagatgccatttaatgccgttcacggtagcagagacagagaagatgccgacagagagctggcgcttctatttccttcactgaaattcagcgataaggacacggaagctcctcaggggggcgaagccgaggctaccgcgggacctacggaagcattgtgtttccctgaagatgtagactag

SEQ ID NO: 14618 - DNA, 606 bp, Artificial Sequence
  Description of Artificial Sequence: Synthetic coding sequence
atggttagctcctgctgtggcagtgtttgctctgaccagggctgtggccaggacctctgccaggaaacatgctgtcggcctagttgttgtgaaactacttgctgtaggacaacttgctgcagaccaagctgctgcgtgagtagctgctgtaggccgcagtgctgtcagtcagtgtgttgccaacccacttgctctcgtccatcctgttgtcaaacaacgtgctgtagaacaacctgctatcggccatcttgttgtgtgagctcctgctgccggcctcagtgttgccagccagcctgttgccagccgacgtgttgcagacccccccgctgctgtatcagcagctgctgtcgacccagctgttgtgtgtcgtcatgttgtaaaccccagtgctgtcaaagcgtgtgctgtcagcccaattgttgtaggccgtcatgctcgatcagctcctgttgcaggccgtcctgttgcgaatctagctgctgcaggccttgctgctgtgtgcggccggtgtgtggtagagtgtcctgtcacaccacttgctaccgaccaacatgtgtaatctccagttgccctaggccattgtgctgtgccagctcatgttgttag

SEQ ID NO: 14619 - DNA, 792 bp, Artificial Sequence
  Description of Artificial Sequence: Synthetic coding sequence
atgggggacattcctgccgttgggctgagctcctggaaggcgtctcccgggaaagtgacagaagccgtgaaagaggccattgatgcgggttaccggcattttgactgtgcctatttttatcataatgaaagagaagtgggggctggcatccgatgcaagataaaagagggagcagtgagaagggaagacctttttatcgcgacaaagctgtggtgcacctgccacaagaagtcactggtcgagactgcctgtcgcaagtccttgaaggccttgaaactcaattatttggacctctatctgattcattggcccatggggttcaagcccccacaccctgagtggataatgtcttgctccgagctctccttttgtctgtctcatccaagagtgcaggatctgcccctggatgaaagcaacatggtgatacccagcgatacagattttctggacacttgggaggctatggaggatcttgtcatcacgggactggtgaagaatattggtgtcagtaatttcaaccatgagcagctggagagactattgaataagcccggcctccgatttaaaccgctgactaatcagattttaatcagattccagatccaaaggaatgtgatagtgatccccggctctattacgcctagccacattaaagaaaatatccaggtgtttgattttgaactaacccaacatgacatggacaacatcctatccttgaatcgcaacctgcgcctggcaatgtttcctatcaccaagaaccacaaagattacccatttcatatcgaatactag

SEQ ID NO: 14620 - DNA, 177 bp, Artificial Sequence
  Description of Artificial Sequence: Synthetic coding sequence
atgcgctattatggtagctattatcgggggcttggctacgggtgcggagggtttggtggcctaggctacgggtgtggttgtggtggttacaggtatggttctggatacggaggctacaggtacggatgttgtaggccctcttgcagagagggatatggttttagtggcttttattag

SEQ ID NO: 14621 - DNA, 159 bp, Artificial Sequence
  Description of Artificial Sequence: Synthetic coding sequence
atgtgctatggctacgggtgcggatgtggaagcttctgccggttaggatacgggtgcgggtacgagggctgtcggtatgggtgtgggcatagggggtgtggtgatggatgctgctgcccatcatgttaccgacgatatcggtttacaggcttctactag

SEQ ID NO: 14622 - DNA, 255 bp, Artificial Sequence
  Description of Artificial Sequence: Synthetic coding sequence
atgtcatactatggctcgtactaccgaggattagggtatggatgtggcggattcggcgggctcggatatggctatggttgcgggtgcggatccttcagacgactaggctacggatgtggcttcgggggcaatggatacgggtactgccggccctcttgctacggcggatacggtttttccatcctgcttaaatcttatcccgaagatactatatctgaagtcattcgaagatccttcaatctgaccaaatactag

SEQ ID NO: 14623 - DNA, 246 bp, Artificial Sequence
  Description of Artificial Sequence: Synthetic coding sequence
atgagctactacggcagctactatgggggtctcgggtatggatgtggcggcttcggcgggctgggatatggttacgggtgcggatgcggatcttttcgtcgcttaggtagtgggtgcggttatggggggtacgggtatggttcgggcttcggtgggtatggctacggatccggtttcggcgggtacggctacgggtgttatcgcccaagctattatggaggatatggatttagcgggttctactag

SEQ ID NO: 14624 - DNA, 414 bp, Artificial Sequence
  Description of Artificial Sequence: Synthetic coding sequence
atgagctacaactgtagctctggcaatttctctagctgctgctttgggagctatctccggtaccccgtgtcaacttataacctcttttacccctccaatgcgatttatagtcctaacacctgccagctgggatcttcactctataatggttgtcaggagacctattgtgagcctacctcctgccagactagctgcaccctagcgaggtcatatcaaaccagctgttattgcccaaagaacagtattttttgcagcccaagacagaccaattatattaggagtctgggttgcggaaacacaggacttggaagtctggggtgcggtagcacaggcttccaatccctggattgcggcagtagtttctatcaccccacaacgttttcaagcagaaactttcaggcgacatgctactag

SEQ ID NO: 14625 - DNA, 483 bp, Artificial Sequence
  Description of Artificial Sequence: Synthetic coding sequence
atgtcatacaactgttgctcgcggaatttctcctcacggagtttcgggggatacctatactaccccggcagctacccaagctcactcgtctatagcaccgccctctgctcgccaagcacctgtcagctaaggagttcgctgtaccgcgattgccagaaaacatgctgggaacccgcctcctgccagaaaagctgttaccgtcccaggactagcatcttatgttgtccctgtcagacaacatgttcagggtccctgggctttcgcagctcctcctgcaggtctcagggatatggatctaggtgttgctacagcctcgggaacggtagtagcgggttccgttttttaaaatatggtgggtgcggatttcccagcctgtcctatggttcccggttctgctatccaaattacctggcttctggagcctggcagtccagctgctacaggcctatttgtgggtcccgattttatcagtttacatgttag

SEQ ID NO: 14626 - DNA, 684 bp, Artificial Sequence
  Description of Artificial Sequence: Synthetic coding sequence
atgttgaatcctgatggcgtataccttggcaactatagatgttcactcatgggcttcgacctgaatcgtcattggctggaccctagtccgtgggtacacccaaccctgcacggcgtgaagcagctgatcgtgcagatgtacaatgaccctaagacgtcactggagttttatattgacatccatgcccactctacaatgatgaatggctttatgtatgggaatatctttgaagatgaagaaagatttcagcgccaagccatcttccctaaactgctttgccagaacgccgaagatttttcctacagtagcacgtctttcaaccgcgacgccgtcaaagccgggaccgggagaaggttccttggcgggctcctggaccatacaagctattgctacacactagaggtgtcattttattcatatattatcagtggcactaccgctgccgtcccttacactgaggaagcctatatgaaacttggcaggaacgtcgctagaacattcttagattattatcgccttaaccccgtggttgaaaaagtcgctattcccatgcctaggctgcggaaagagaagagccccccttacaagcaccccctcctaagaggcccggcttccaactaccctaatagcaaaggcgacaaaaagtcatccgtcaatcataaggacccttctacaccgttttag

SEQ ID NO: 14627 - DNA, 465 bp, Artificial Sequence
  Description of Artificial Sequence: Synthetic coding sequence
atgacccattgctgttccccctgctgtcagccaacttgttgtcggactacttgttgtagaactacatgttggaagcccacgactgtgacaacttgctccagcactccgtgttgccagcctagctgttgcgtctccagctgctgccaaccgtgctgcaggcctacatgttgtcagaatacctgttgtcagcccacctgcgtcacgagctgctgccaaccatcgtgttgctcgaccccctgctgtcagcccacgtgctgtggctcgagttgtgatcagagctcatcttgcgcccctgtctactgccggcgcacttgttactaccctacaactgtttgccttcccggctgtctgaatcagagctgcggcagcaattgttgtcaaccctgctgtagacctgcctgctgcgaaacaacctgtttccaacctacctgcgtctccagttgctgtcaaccattttgttgttag

SEQ ID NO: 14628 - DNA, 7062 bp, Artificial Sequence
  Description of Artificial Sequence: Synthetic coding sequence
atgaaacagagaaaaggacagggtagcggcggttcacgcggtagaaagaagagagggttatcagatatttcgccaagcacatctttacctcccctggtggaaggccaattaaggtgttttctcaaactcaccgtcaacagggtgatctggaaaatcgctaaacctccgacctgcgtccttgtccgcgtgagatggtggggagagaccagcgacggcactttgttttgcccgcgcgatgctctgcagaccgagcccaaagcagtaagaaccaccacacggtacgccatccgctgtggcccaaaacaattcacttcttacttgaccgacatggcggtactggtgctcgaggttatcacaaaactggatggcctccccatcggtagagtgcagatcaacggattagcgcagctgtctccaactcaccagataaacggtttcttcaccattgtatcttccacaagtaaaaagctgggcgaactgcaggtatctctggcacttgagcccctgagcgaaacctacgactcttaccacccgttgccaaccactgacatgaccgagaatgtactgttgtctaagcagggttttcgcgagaatacagagcccagtagcacccagtttcaagtaccctccagacctagggacattcacactatcaagatcgatgggaaggagttagccgctaactcttctaggtccaccacgccccgtggaaaagatcacgtgtgtttcgccgagaaccctgacaccattaaagactccagctttgggcttcagcattccctcaactccggacagagcttggaatctgtaactctcaaaggaagggcgccccgcaaacaaatgtcactcctaaatagttctgaattccaaccgcagatacgcaccgtggccaaatcacactcagacagttgcatattgagctcaaataacctaccaactaaggacctactgagcgccttgctggagcagggaaacaaactaaggaacgcaatggtgatctcagccatgaagtctagccccgagacctccatgctgctggaccaggtgcacccacccattaacgaggactcactacgcgcgtccacccaaatcagagccttcagtcggaaccgcttcaaagatcacatcgaagaccatctgctaccctcaaccgaaaacactttttggcggcacgacactaaggcggatacccgcgcaatccagctactgctggggagtgctgagctctctcagggtaacttttgggacggccttggttcacctccagactctccgtctcctggatccgatgtatactgcatctcagagctgaacgatccacagtacgatcagtcattattggagaacttgttttatactgcaccaaagagtgacaccagcatctctgacttcttgtccgaggaagatgatatcgtccccagtaaaaaaatttcacagtctaccgccctagctaggagctccaaagttctcgagagctccgatcacaagcttaagaaacggtcggccggaaagagaaatagaaatttggtcgaacagcagatgctgtcggagacacctgaagacgcacaaaccatgacactgagtgtggaccgcctggcactcctgggaagaactcatagtgttcgcatcatcatcgagacaatgggcgtgcctcccgattctcctcagatgacgccagggaagaagtcctatgcggggcccccacctaaggtcacaactgcaaaaaaaaggacattctttgttgagtatcatttcccggtgggatttagcgaatctgggctcgggaagacagcgctcataacggaggtggttcggctggcctcctcaaagattactgatggaaaagtaaaatttcagcagcgattcgtgtttcctgtgcaatttggtgggccgatgatcgagcactggtggaacagtaacctgaccttccaaatctatgtgaagaaaacaccgcaaaagaaacccgaggtgattggctctgtgagtctctctttgcgtgcagttattcaaagcgaactgctttctttcagtgatcagctacctgtccagcaggagaatggacagtccccttttggcccactaaaagtcacaatggaattgatcacggataataaagactttacaggcattaacaccaagctcagcggaaatacacactatacccctctctgcgccccaacatctcctaataaagctctgccagagttgaatcaggacatgacttgcactaagaatccccaaaaccttaatcaaatccacgaggagaccgcaaagaaggcccagaatctggttttacctaatagaaaaagcccaagccccgtcgctccacacccatccacattcgtggctactccggcaagccataatctggtcaatcaaaccaacggaaccacaaaggaatcggctttactgttgcacgtacttctcatggtcccagatggtaaagactttattagcggcgagagcgaaaagcaatctccatgcaatgtatatttgaactgtaaactgttttctaccgaggaagtaaccagaagcgttattgcctggggaaccacacaaccagtgttcaacttctcgcaagtgatccctgtttctttatctagcaaatacctggagcggctcaaaaacaacgtaatggtcattgaaacttggaacaaggtacgatctcccggacaggacaagctgttaggccttgtcaaactgcctttgcaccagttttacatgagcttcaaagacgcaaagatctctcgcctgctgctggatgctcagtatcccgtggtggccgtcgactcatacatgccagttattgacgtcttcagtggccatcagaacggcagcttaagggttttcctggcaatgggcagttccaatcagattatggcactgcaaagactaaaaaatgaagaagggaccctgccaccttttagcccaagaccagctcatttcctcgatcagccaaccgctgcaagcgtggccatggctgaagatagaggcaacgggttaatggagcactgcttcgagattcacattgagatggtgaagggtctggcgcctctccaggctaccgtgtggggagaggccgattgttacgtgcagtactattttcccgtgcagcacagccagtcctcggtgctgaaaggccctgagttcctcgagaatggaatcacattgaaacctttccgcacggcaacaacattatgcgtgccagatccaatatttaattctgagcatcaccactccttgctgttgcccgcagaagtgcctgttcagagacttctactgtcagcgtttagcgctcagggactggtgcctggcggtggtgtccagttcgagatctggtgcaggtactattatcctaatgtcagggatcagaaagtggcaaaaggcacactccccctctcccgcatttgtgcgatggtcacaactcaacatagggaggatgtgggtattcagacctttaacctacctctaaccccaaggattgagaatagaaaagagcttagaaaccaatcaagcggcctgttggatgtgggactgcgatacaggcggagcccgcgcacagctgagggagttctcgccgcccggaccgttagcatcagtgtccaaattattcgcgcatgcggactgcaggccgccgctaaggcattagccgagagggaacctgcccttcagttctctgccacagtgggggtcaacgcatcggtgacaacacacctgtcttttttgcctcaaggggaacagcggcggacccatccagtggcatgctctttctgcccagagttttcacaccatgttgagttcacctgtaatctcgttacgcagcattgctccggggaagcctgctttctggctgagctgttggaatttgcggaggtaatcttcgcagtttatcatgaaaatacgaagagtgcctccgacatcattagtatcgagtcctgtaaggaatatctgctgggggtcgttaaagtgccaacgaaggagttgctcatcaagaggagtggcataaccggctggtacccgattattctgcccgaagacggcggcctgcctcatggactggagttgatgcagaaaatcgtgggggggttagagctgagcatctccttcacacacaggggtgatcgggaacgggtattggaagctgccgaacacctcggatggagctttgagaacagtctcaaagactttgttcgaatggatgagggcgagcctgcaaccgtgaccatctctacaccccgtttgtggttacccatccattgtgtcctgcttgccgggcataatcacattcacaagaatacttattgttatctgcggtataagttctatgaccacgaggccttttggacaccactgaagaagcccaaagagagcgtcaacaaaaagcagattatggtgacattcaaagcatcaaaaagggcggaagtgactagaggcccgtcacttctttggtactttcgggaggagcgactcgagatccaagtgtggcgggcgtacggtaacgattccgtggagaggcctcatcagacagatagttggatcggcagtgcttatgtagatttggcccggctgggagagcgatctgctcggactcttactgtgtctggtgtgtaccctctgtttggaaggaatgctagcaacttatcaggcgctgcactgagagtacatgtagtacttagctccctgtcctcacatcttgagccaacgcacgagctagactccatggattgcagtagccactccgaatcagagcaactccccagaagaaacgacgaggtgcagttatctccgcctgaagtgatcagttgtcaccagaagtctcctgcctctactcaagtcccctgtagcagcaccaccgctgaagtgaggcttacccaggaaggccccgccgatctggatggaactttcgcggtaagcattctcgtggaaagagctatgcacctgtcccttaagggtagtcccctcaccgagagaaaggtctccataccatcctgctgtgtctcattcgcaacggctgacgagagctccccagtttacacacaggtggtagaaaacactgactccccaatttggaactttcagcagcagtccaggctgagtaaagaattactgctggatccccagcagaccttggtcttcaaagtctggcacaagggggatgaggagagggtcatcgggttcgcatccgtggacctctccccactgctcagtggatttcagtttgtatgtgggtggtataatatcactgatttctcaggcgagtgccagggccaaattaaagttgccgtcagcccgctggaatctctcatccactttaaggaggaacgccaggccagacgcggcgttgagacttcaaaatctctgattcctatctactccccattctccttcccagctagcgatacctatgccgcgttttcaagtcacatggcccgccagaccctcgatcagctggctcacgcgtcttcaaaggaactcgatttctcctcaccaggaaggtctgacactactcgttcacaggcctctcgacatgaggagcatgttcagaatatcaggaggtttcacgagtccttacatctacagggcgaagctcccctcccttgtgacgacaagttaacgacttctcccctcagttcccagaccagcatcctgacctccttgagaaagaatttgagcgaacttgaccaaattcagcggtatttcagacaaaagttgacaaaaccattcctgcccctctccccacagactcaaactgcaatctcacaacaccaggaatcatgcagggatcatctgggtcctggtgcgtctagtctggacccgggaagccagtgtatcctagaaaaaagctccaatctcgtgcttcaggtttccagtctgatcacggatctgcagaccatcactcgcgacagtcaggctgcactaagtagtcacagagccagatctcggagcaacaaagcaaccaccctgcctgacgctcaggataccgaagcactccaggagcgttgcactatgcccgacgagcctcttgtgcgggctcctgataagggcacagactccccctctccgccaccactggaggagacttcgaatgggggaagaatgttgcacgagagtctgcgacacgcagtcccaattacgcggatgcagagcagcgaggacacagaagcgggccccgcatattctgatgaggactatgaggaggatatcattgaaccccggaccctgaacgagatcaccaccgtcaccgataaaactagcccatggtcctccgttatttcagacacctccgaagtcattagccctcaacctgatgaggttcagagggagggaccctcatgcccctcccccggacctttttgccgagaggagctcatggtgaagtcctcattccttagtagcccagagagagcagttaatccacacctgcctaggcagggcagcccctcccagtccctggtagcatgcgagtgcgaagcttccaaggcacgggtaggaggcgagtccgcctctgcgaatcctcagccgattccttgtcctactctcagcggggcccaacaatcaagcacatttgtcgggtggagctcgcctcagacagaccaaaacaaggaacccaaatcagaagcacccgcggaaaacgaggccgcaaccagcgagctgggcgactcggctgacagctttaagaagctgccactgaatctggcaagccagtcaagacgggaaaatcacaaaggtcctcctattgatagctcagatatccgacagcggcaagtgacaactggctccgagacttctacaaagcagtcccttctgttaccaggccccatcgtggtgccaaacttctttctcccccctcagcagctggaagcctcactgaggatgctcagtctcagtgccaccctgccaccagctgcaacaactgaccaagacaaatcagaagccactaggggcgcactgagccagagaccgtgtagacctcgccctaacagcctgcctctgaacctgcccgaggaggagacactgcgaattgctcgtattttttcatctcagtacagtcagaaagactag

SEQ ID NO: 14629 - DNA, 219 bp, Artificial Sequence
  Description of Artificial Sequence: Synthetic coding sequence
atgaattattatgggaattattacggcggcttgggttatggatacggaggttttgacgacctaggctacggatacgggtgcgggtgtggttccttcaggcgcctaggttatggcgggggatatggcggctacggttatggaagcgggttcgggggatacggttatcgttcctgtagacctagctgctacggaggctacggattttccggtttttactag

SEQ ID NO: 14630 - DNA, 198 bp, Artificial Sequence
  Description of Artificial Sequence: Synthetic coding sequence
atgagttacaactgttgttgtggcaatttcagtagtcattcctgcgagggatatctgtgctactcaggctattctcggggaggcagctcttatccttccaatttagtgtacagtacagaaccactcatcagccagcatcttccagctgggtttcttagcctgcaaggcttgagtggagacctgctcgggaatccctag

SEQ ID NO: 14631 - DNA, 384 bp, Artificial Sequence
  Description of Artificial Sequence: Synthetic coding sequence
atggtgaatagctgctgtggatcagtatgttccgatcagggctgcgatcagggactctgccaagagacatgctgtcggccatcatgctgccagaccacttgctgctgtccaagttgcgtggtttcgtcatgttgccggccctcgtgctctcaaactacatgttgtcagaccacatgctgtcgtccatcctgttgtcacccggtatgttgccagacaacttgtcgaccttcttgcggggtgtccagttgctgccgcccgctatgctgtcagaccacctgccgcccatcgtgtggggtgtcctcatgctgcagaccactgtgttgccaaaccacatgttgtcgagctacgtgctgcagaccctcttgctgcgggagctcctgttag

SEQ ID NO: 14632 - DNA, 318 bp, Artificial Sequence
  Description of Artificial Sequence: Synthetic coding sequence
atgggctgctgccccggagattgctttacatgttgcactcaggagcagaactgctgcgaggagtgttgctgtcagcctggatgctgtgggtgctgcgggagttgttgcggatgtggaggatctgggtgtggcggctccgggtgcggcggatcgtgctgcggatcctcctgctgcggatcagggtgcggagggtgtgggggctgcggagggtgtggcggcggatgttgcggcagtagctgttgcgggtcctcctgttgtggctctgggtgttgtgggcccgtgtgttgccagccgacgcctatctgtgataccaagtag

SEQ ID NO: 14633 - DNA, 3915 bp, Artificial Sequence
  Description of Artificial Sequence: Synthetic coding sequence
atggaggagatacctgttaaggtagcagtgcgcatcagacccctgctgtgcaaggaagcccttcacaaccatcaggtctgcgtgcgcgtgatccccaactcccagcaggtcattattggccgcgacagggtgtttacgtttgactttgtattcgggaagaattctacacaggacgaggtttacaacacttgcattaaacctctagtgctgtcactgattgaaggctataatgcaactgtttttgcatatggccaaactggcagtggcaagacttatacaattggtggcggtcatattgctagtgtggtggaggggcagaaaggcattatccctcgggccatccaggaaattttccagtctatttctgaacacccaagtatcgactttaatgttaaagtgagttacatcgaggtatacaaggaggaccttcgtgatcttctggaactagaaacatccatgaaagatctgcatatcagggaggacgaaaagggcaatactgtgatagtaggtgctaaggaatgtcatgttgagtctgctggggaagtgatgtccttactagaaatgggtaatgctgctaggcacacagggaccacacagatgaacgagcatagttctcggagtcacgcaatctttactattagcatttgtcaagtgcacaaaaatatggaggctgccgaagatggcagctggtacagcccgcggcacattgtctcgaagttccattttgtcgatctcgctggatcagagcgggtgacgaagactggaaacaccggggaaaggtttaaagagtccatacaaatcaattcaggcctcctggcactcggaaacgttatatccgccctcggggacccccgacgcaaaagttctcacattccctacagagacgccaagataacccgtctgctcaaagacagcctgggtggcagcgctaagactgttatgattacctgcgtgagcccctcctccagtaactttgacgagtcactcaattcactgaaatacgccaatcgtgctagaaacatcagaaacaaaccgacggtgaacttcagcccagaatcagatagaatagatgaaatggagtttgagatcaagctgttacgggaagccctgcagtcacaacaagccggcgtatcccagacaactcagataaacagagaggggagccccgacaccaatcgcatccatagccttgaagaacaggtagctcagttacagggtgaatgtctaggctaccaatgctgcgtggaggaggccttcacatttctggtcgacttaaaggacactgtccgcctgaatgagaagcagcagcacaagctccaggagtggttcaatatgattcaggaagtgagaaaagcagtgctaaccagctttaggggcattggcggtacggcttcgctggaggaaggtccgcaacacgtgaccgtgttgcagcttaagcgggagctgaagaaatgccagtgcgtgctggctgctgacgaggtggtgtttaaccagaaggaactcgaggtcaaagaactgaaaaatcaagtgcagatgatggtacaggaaaacaaggggcacgccgtgtcacttaaggaggcacagaaggtcaacaggttgcagaacgagaagatcattgagcaacagcttctcgtagaccagctgagtgaagagctcaccaaactcaacctgtcagtgaccagttcagccaaagagaactgcggcgatggtccagatgctaggattccggagagaagaccatataccgtcccttttgatacccacctggggcactacatctatattccatccaggcaggatagccggaaggtgcatacttctccacccatgtatagtctagaccgcatttttgcaggctttaggacaaggtcacagatgctcttgggacacatcgaggagcaggataaggttcttcactgccagttctccgataattctgacgatgaagaatctgaggggcaggagaaatctggtacgcggtgccggtccaggtcttggattcaaaagcctgacagcgtctgtagcctggtggaactgtcggacacacaggacgaaacgcaaaaatctgatctggaaaatgaagatctaaagattgattgtctccaggaatctcaggagcttaacctgcagaaattgaagaattcggaacgtatcttgactgaagcgaagcagaaaatgagagagctgacaattaatatcaagatgaaggaagatctcatcaaggaactgatcaagactggtaatgacgcaaagtccgtctccaaacagtacagcttgaaggtgaccaaactggagcacgatgccgaacaggccaaagtggagctgatagaaacgcagaagcaattgcaggagttggagaacaaggacttgtccgacgtagcgatgaaagtgaaactccagaaggaatttcgaaaaaagatggatgccgccaaactgcgtgtgcaggttttgcagaagaaacagcaggattccaagaaattggcaagcctgtcaatccagaatgagaaacgagcgaacgaactggagcagtccgtcgaccacatgaagtaccaaaaaatccaactgcaacgcaagctgcgcgaggaaaatgagaagcggaaacagctggatgccgtgataaagcgggaccagcagaagattaaggctctgaacacagatagtctaaagatcagcacgagacttaatctgctagagcaagaattgagcgagaaaaacgtccaactgcaaacctcgactgcagaggagaaaactaaaatctccgagcaggtggaagtgctacagaaggagaaggaccaattgcagaagcggcgacacaatgtggacgagaaattgaaaaacggcagagtcctgtccccggaagaagaacacgtgttattccaattggaggagggaattgaggccttggaagctgcgatcgagtataggaatgagtctatccaaaaccgccaaaaaagcttgcgagcctcattccataacctcagtaggggcgaggctaacgttctggaaaagctagcctgcctgagtccagttgagatccggaccattctctttcggtacttcaacaaggttgtgaacctccgtgaagcggagagaaaacagcagttatataatgaggagatgaagatgaaggtcctggagagggacaacatggtgagagaattggaaagtgctctggatcatctaaaactgcagtgcgatagacgactgaccctgcagcagaaagaacacgaacaaaaaatgcagctgctgctacaccacttcaaagaacaagatggggaaggtataatggaaacctttaaaacctatgaggataaaattcaacagctcgagaaggatctctatttctataagaagacatctcgagaccacaagaaaaagttgaaggaactggttggcgaggccatcaggaggcaactggcaccttccgaataccaggaggccggggacggggttctgaagcccgaaggggggggaatgctttcagaggaattgaagtgggccagccggccagaatctatgaagctctcggggagagagcgggagatggatagtagtgcctcctccctgcgaacgcagcccaacccccaaaagctgtgggaagatattccagaactgcctccaattcacagttcgttggcccccccctctgggcacatgctcggcaacgagaataagacagaaaccgatgataaccagtttacaaagtctcactcccggcttagctctcagatccaagtggtgggcaacgttggtcgccttcacggagtgacacctgttaagctctgcagaaaggagctgcgccagattagcgcattggagctgtctctgaggcgatcatcgctgggtgtcggtattggatccatggctgcagactctatcgaggtgtctagaaagccgcgggacctgaaaacgtag

SEQ ID NO: 14634 - DNA, 903 bp, Artificial Sequence
  Description of Artificial Sequence: Synthetic coding sequence
atggaagaggaagctagctcaccagggttgggctgtagtaagccccaccttgagaagctgacgctagggatcacccgcatcctcgagagttcgccgggggtcaccgaggtgactatcattgagaagccacctgccgagcggcatatgatcagttcatgggaacaaaaaaacaattgtgtgatgccggaggatgtgaaaaacttttacctcatgaccaatggctttcacatgacctggtctgttaagttagacgaacacatcattcccctcggctctatggctatcaatagtatatctaagcttacgcagctgactcagagctcaatgtactccctccctaatgcaccaaccctcgccgacctcgaagacgacacccacgaggcgtctgatgaccagcccgagaaaccgcatttcgatagccggagcgtcattttcgaacttgattcttgcaacggcagcggtaaggtatgccttgtgtacaagtcaggtaagcccgcattggcagaggatacggagatttggttcttagatcgggcgctctactggcatttcctgacagatacgttcacagcctactataggctgcttatcactcacctgggtctgccccagtggcagtatgcctttaccagctatggcatatcccctcaggctaagcagtggttttcaatgtacaagccaataacatataataccaacctcctaaccgaggaaaccgacagcttcgtgaacaagttagatccatctaaggtcttcaaaagtaaaaataaaattgtgattcccaagaaaaagggcccagtccagcctgccggtggacaaaaagggcctagtgggccatcaggccccagtacatcctccactagcaagtcatccagtgggtcagggaaccccacccggaagtag

SEQ ID NO: 14635 - DNA, 390 bp, Artificial Sequence
  Description of Artificial Sequence: Synthetic coding sequence
atgatgactgatctgaagcagtcccattccgtgcgtctgaacgatggaccattcatgcccgtattgggttttggtacatacgcacccgaccatactcctaagtctcaggccgccgaggccactaaggttgcgatcgatgtgggattccgccacatagactctgcgtacctttatcagaatgaagaagaagtcggtcaggctatttgggagaaaattgccgacggcaccgtcaagcgggaggaaattttctacacaataaaactctgggcaaccttttttagagctgagcttgtacatccagcactagaacgaagcctgaaaaaattgggaccagactatgtcgatctgttcatcatccacgtaccctttgcaatgaaaggaagctcctag

SEQ ID NO: 14636 - DNA, 1257 bp, Artificial Sequence
  Description of Artificial Sequence: Synthetic coding sequence
atgcatcctgaacctagcgagccagcaactggtggtgccgccgagcttgattgcgcccaagagcctggcgtggaggaaagtgccggtgaccacggttcagcaggacgcggagggtgtaaagaggaaatcaatgaccccaaggagatatgcgtcggaagctcagatacaagttaccacagccagcagaaacagtctggcgataatggaagtggagggcatttcgcccatccgagagaggatagggaagatcgcggccccaggatgactaagtcctcactacagaagctctgcaaacagcataaactatacattacacctgccttgaacgacacactgtacttacactttaaaggcttcgacaggatcgagaatttggaggagtataccggactgcgctgtctctggctgcagtctaatggcatccagaagatcgagaatctcgaagcacaaactgaactgagatgcctgttcctccagatgaaccttctacgcaaaatagagaacctggaacctctgcagaaacttgatgctttgaatctgtctaataattatattaagactatcgagaacttatcctgtttgcccgttcttaatactttgcaaatggcacataaccacctggaaacggtggaagacatccagcacctccaagaatgtctgcggctctgcgtgctcgatctttctcataacaagctcagcgaccccgagatccttagcattctggaatcaatgccagacctccgcgtccttaacctgatgggaaatcccgtgattcggcagatccccaactataggcgtacagtgacagtgaggctgaagcacctgacctatcttgacgatcgccccgtgttcccgaaggaccgggcatgcgccgaagcatgggccagaggaggatacgctgctgagaaagaggagagacagcagtgggaatctcgtgaaagaaaaaaaataacagattcgattgaggcactggcgatgatcaaacagagggctgaggagcggaaaagacaacgcgaatcccaagaacgcggtgaaatgacctcaagcgatgatggcgagaatgtgccagctagcgccgagggtaaagaagagcccccaggtgacagagagactagacagaagatggagctgttcgttaaagaatcatttgaggctaaagacgagctttgccccgagaaaccttccggtgaggagcctccagtagaggccaagcgcgaggatggagatcccgctactgtgactgcctgcgagggctag

SEQ ID NO: 14637 - DNA, 2472 bp, Artificial Sequence
  Description of Artificial Sequence: Synthetic coding sequence
atgggcaagaaacgaactaaaggcaaaacagttcctattgatgattcatctgaaactcttgaacccgtctgcaggcatattaggaaggggcttgagcaagggaatctaaagaaagcgctggtcaacgtggaatggaacatttgtcaggactgtaaaaccgacaacaaggttaaagacaaggccgaggaggagacagaagaaaaaccatccgtttggctttgcttgaaatgtggccaccagggatgcggccgcaatagtcaggagcagcatgctctgaaacactatcttactccacgatcagagccgcattgtctggtgttgtcgctagataactggtcagtgtggtgttatgtatgtgacaacgaggtgcagtattgctcttctaatcaactgggccaagtggtggactatgttaggaagcaggcctctatcactacacccaaaccagctgagaaggataacggaaacattgagctcgaaaacaagaaactggagaaggagagcaaaaacgagcaagagcgcgaaaagaaggaaaacatggcgaaggaaaaccccccgatgaattccccttgtcagataacagtgaaggggctcagtaatcttgggaacacctgcttcttcaacgcagtgatgcagaacctttcccagacaccagttctgagagaactgttgaaggaggtgaaaatgagcggaactatcgtcaagatcgaacctcccgacctggcccttactgaacccctcgagattaacttggaaccaccgggtcctcttaccctagccatgagccagttcctgaacgaaatgcaagagacaaagaagggcgtcgtcacacctaaggagttgttttcgcaggtatgtaaaaaagcagttcgctttaagggctatcagcagcaggactcccaagaactactgcgttacctactggatggtatgcgtgctgaagaacaccaacgggtgagcaagggaatcctgaaagcatttggcaatagtactgagaagctcgatgaggaactcaagaataaagtcaaagactacgagaaaaagaagtcaatgccctcatttgtggaccgtatattcggaggggaacttactagtatgattatgtgtgatcaatgtcgcaccgtgagtcttgttcatgaaagcttcctggatctctcccttcccgtcttggatgaccagtccgggaagaaatccgttaatgataagaaccttaagaagactgttgaggatgaggatcaggacagtgaggaagagaaggataacgatagttacatcaaagaaagatcggacatcccatccggcacttccaaacacttgcagaagaaggccaagaagcaggcgaagaaacaggcaaaaaaccagcggcggcagcagaagattcaggggaaggtgttacatctcaatgatatctgcactattgaccaccccgaggactctgagtatgaagccgaaatgtccctgcagggagaagtgaatatcaagtctaatcatatctcacaggaaggcgtcatgcacaaagagtactgcgtcaatcagaaggacctgaatgggcaggccaagatgatcgaatcggtgacagataaccaaaaaagcacggaagaggtggacatgaaaaacataaatatggacaacgatttggaggtactgacctcatctcccactcgaaatttgaatggagcctacctgaccgaaggcagcaatggcgaggtggatatttctaacggcttcaaaaatctgaatcttaatgccgctctccaccctgacgaaatcaacattgagatcctcaacgattcccacacacctggaactaaggtatacgaggtcgtgaatgaggacccagaaactgccttctgtaccctggccaatcgtgaagtatttaataccgatgaatgttcgattcagcattgcctctaccaatttacaagaaacgaaaaactgcgggacgccaacaagttgttgtgtgaagtgtgcacaagacggcagtgcaatggcccaaaagccaatataaaaggcgagcggaagcacgtgtacaccaacgccaaaaagcaaatgcttatttccctggccccccctgtcctgactctacatcttaaaaggtttcagcaagctgggtttaacctgcgtaaagttaacaaacacattaagtttccagagatcttagatctcgccccgttctgcacgcttaagtgcaagaacgtggcagaagagaacacacgcgtcctgtattccctgtacggggtggtcgagcactctggcactatgaggagcggacactatacggcctatgccaaagctagaaccgcgaattcccacttaagcaatttggttcttcatggcgacatccctcaggacttcgaaatggagtccaagggccagtggtttcacatttcagacacccatgttcaagccgtccctacgaccaaagtactcaactctcaagcttatttgcttttttacgagcgaattctgtag

SEQ ID NO: 14638 - DNA, 3204 bp, Artificial Sequence
  Description of Artificial Sequence: Synthetic coding sequence
atgaatagtatggacagacacatccagcagacaaacgacaggctccagtgtataaaacagcacttacagaaccccgcgaattttcacaatgcagctaccgagctattggattggtgcggggaccccagggcattccaacgccccttcgagcagtctctgatggggtgccttacagtggtcagcagggtggcggcccagcagggttttgatctggaccttgggtatcggttactggcggtatgtgctgccaacagagataagtttaccccgaagtccgcagcactgctcagttcctggtgtgaggaacttgggcgattgctcctgttgcgccatcaaaagagtcggcagagcgatccacccggaaagcttcctatgcagcctccactgtcttccatgtctagcatgaaaccaaccctgtctcactccgacgggtctttcccttatgactccgtaccatggcagcagaatactaaccagcctccggggtccctgagtgtggtgacaacggtgtggggggtcactaatacatcccaaagccaggtacttggcaaccccatggccaacgcgaataaccccatgaacccaggggggaaccccatggcctccgggatgaccactagtaatcctgggctgaatagtccacagttcgcaggtcagcagcagcagttctccgccaaagctggacccgcccaaccatatatccagcagtctatgtacggcagacccaattaccccggttccggcggttttggagctagttatcccggcggaccgaacgcccccgccggcatgggaattccacctcacacaagacctccggctgattttacacagcccgctgctgccgctgccgcagccgctgtggccgctgctgctgcaacggcaaccgcaactgccacggccacagtggccgccctacaggagactcagaacaaggatataaatcagtatgggcccatgggtcccacccaggcctataactctcagttcatgaatcagccaggacctagaggtccagcctccatgggtggctccatgaaccccgcgtctatggccgctgggatgacgcctagcggaatgagtgggcctccaatgggaatgaatcagccccgcccacccggcatatccccgtttggaacgcacgggcagcgtatgccacagcagacctaccctgggcctaggccacagtctctccctatccaaaatattaagcggccctatccaggggagcctaattacggcaaccaacagtacggcccgaacagtcagtttcctactcaaccaggtcagtacccagctcctaatcccccgcgaccacttactagccctaactatccaggccagcgcatgccaagtcagccctctagcggccagtatcctccccctaccgtgaacatgggacagtactacaaacccgagcaattcaatggccaaaataataccttctccggctcctcatatagtaactattctcaaggcaatgtcaatagaccaccaagacctgtgccggttgccaattatcctcactctccagtcccaggcaatccaactcctcctatgacgcccggaagctcaatcccgccgtacctttctccatctcaagacgtgaaaccccctttcccacccgatattaaaccgaatatgagtgcgcttcctccaccccctgccaatcacaacgacgagctgcggctcactttccctgtgcgtgatggcgtagtgcttgaacccttcaggttggaacacaatctggcagtgtctaaccacgtattccatcttaggcctactgttcaccagacccttatgtggcgctcggatctcgaactccaatttaagtgctaccatcacgaggaccgacagatgaacacaaactggcctgccagcgtgcaagtgtctgtcaatgccacccccttaaccatcgagaggggagacaacaaaacttcccataaaccactgcatttaaagcacgtttgccaacctgggagaaacaccattcagatcaccgttactgcatgctgctgttcccacctattcgtactacagctggttcacagaccttccgtgcggtccgttcttcagggcctgctgaagaaaagactccttcctgccgagcactgtatcaccaagatcaagcgaaacttttcatcagtggctgcttcatccggaaacacgacactgaatggcgaagatggcgtggagcagacggctataaaagtctctctgaaatgccccattaccttccgtcggatacagctgcccgcaaggggccacgactgtaagcatgtccagtgttttgacctagaatcatatctccaacttaattgcgagcgtggaacttggagatgcccagtttgcaataaaacagccctcttagaaggtctagaagtggaccaatacatgtggggtatcctcaatgctattcagcacagtgagttcgaagaggttacaattgacccgacctgcagttggaggccagtgcccatcaaaagcgaccttcatatcaaagatgatcccgacggtattccgtcaaagaggttcaagaccatgtccccatctcagatgataatgcctaacgtgatggagatgatcgctgctcttggccccggtccaagcccttaccctctgccccccccaccgggaggaactaacagtaacgattattcttcacaagggaacaactaccaggggcatggaaatttcgatttcccccacggcaaccccgggggtaccagcatgaatgacttcatgcacggaccaccacaactgtctcacccccctgatatgcccaacaatatggctgccttagagaagcctctttcacaccctatgcaggaaacaatgccgcacgcaggatccagtgatcagccacaccccagcattcagcaaggtctgcatgtaccccacccctcttcacaatccggaccaccccttcatcactcaggagctccgccaccacccccctcccaacctccacgccagccccctcaggctgctccttcgtcgcatccacacagtgacctgacatttaacccaagctcagccttagagggtcaagctggagcacagggagcatccgacatgccagagccttccttggatcttctgccagaattaacaaaccccgacgagctgttgtcttatctggacccgcctgacctgccatccaacagcaacgacgacctgctgagcttattcgagaataactag

SEQ ID NO: 14639 - DNA, 1038 bp, Artificial Sequence
  Description of Artificial Sequence: Synthetic coding sequence
atggatggtgaagatatacccgatttttcgagcctgaaggaggaaacagcctattggaaagaactgtctctgaagtacaaacaatcctttcaggaggccagagacgagctcgttgaattccaggagggatctcgggaactagaagcagagctggaagcccaactagttcaggccgaacagcggaacagagacctgcaggctgataaccagagactcaaatatgaagtggaggccctgaaggagaaactggagcatcagtacgcccaatcttataagcaggtctccgtgctcgaggatgacctgtcccagaccagggctataaaggagcaactccataagtacgttcgagagctggagcaagcgaatgatgacctcgagagagccaagcgcgccacgattgtaagcctggaagactttgagcagcggctcaatcaagccatagagcgtaacgcttttctggagtccgagctggacgagaaagaatccctcctggtctccgtgcagcggttaaaggatgaagcccgtgatctgagacaggagcttgcagtccgggagcgacaacaggaggtaacccgcaaaagtgccccctcaagccccaccctggattgcgagaagatggacagcgctgtgcaggctagtcttagcttgcctgctacccccgtcggcaagggcactgagaacacatttccctctccgaaggcaatccctaatggatttggcacaagtccccttaccccctcagctaggatttccgccctgaatatcgtgggagacctcctgagaaaagttggggctcttgaatctaagctggcggcttgccgtaacttcgctaaggatcaagcgtcgcggaaatcatacatttccgggaatgttaattgtggcgttttgaatggcaatggaacaaagttctctcggagcggtcataccagcttttttgacaaaggagctgtcaatggctttgacccggcccccccgcctccaggattggggtcgtctagaccctcctctgcaccagggatgctgccactcagtgtgtag

SEQ ID NO: 14640 - DNA, 588 bp, Artificial Sequence
  Description of Artificial Sequence: Synthetic coding sequence
atgggctctagggcgagtaccttgctgagagatgaggagctcgaggaaataaaaaaagagactgggttctctcattcacagatcaccagactgtactctagatttacgtccctagataagggggagaacgggaccttgtctcgggaggattttcagcggatccccgaattggccattaaccccctgggggatcgtatcattaacgctttcttcccagaaggggaggatcaggtgaatttcagaggcttcatgcgtacactggcccatttccggcctatcgaagacaatgaaaagagcaaggacgttaacgggccagaacctctgaattcaagaagtaataaattacatttcgccttccgcctgtatgacctggacaaggatgaaaagatctctagggatgaactcctgcaggtcctgagaatgatggttggggtcaatatctcggatgagcagcttgggtctatcgccgatagaaccattcaggaagcagaccaggacggagactccgcgatttcgttcactgagtttgtgaaggtgttggaaaaggtggacgtagagcagaagatgagtatccgcttcctgcactag

SEQ ID NO: 14641 - DNA, 780 bp, Artificial Sequence
  Description of Artificial Sequence: Synthetic coding sequence
atggcagacgcctgctgtactcgaacatatgtgatcgcggcctccactatgtcagtctgttctagcgatgtgggccacgtgagtagggttagctcaccgtctacctgcacgggctcatcatggcaggtggataactgtcaggagtcatgttgtgagcccaggagctgtgcatcatcttgttgtaccccatcctgctgcgctccagcaccttgcctggctctcgtttgcgccccggtgagttgcgagccttctccatgtcagtccggatgcaccgatagctgcaccccctcctgctgccaacagtctagctgtcagccagcatgctgtacctcctcaccttgccaacaagcgtgctgcgtcccggtgtgttgtaagagcaactgttgcaagccagtgtgctgcgtgtctatctgctccggggcgagtagtccctgctgtcagcaatctagctgtcaatctgcctgttgtaccttttccccctgccagcaggcttgctgcgtcccaatttgctgtaaacccatctgctgcgttcccgtttgcagcggcgcctcgagtctgtgttgtcaaaaaagctcgtgtcagccggcctgttgcaccaccagttgctgtaggccttcttcctcagtatcacttctgtgcagacctgtatgccgccccgcctgctgcgttccggtgccctcttgttgtgttccagcgtctagctgccagcccagctgctgccaccctgcatcatgcctctctttcttatgccgacctgcttgtagcagacttgcatgttag

SEQ ID NO: 14642 - DNA, 171 bp, Artificial Sequence
  Description of Artificial Sequence: Synthetic coding sequence
atgatatactatagcaactattatggaggttatggctacggaggcctaggatgcggttacgggtgcggatacagagggtatggatgtggttacggcggctatggaggatacggtaacgggtattactgtccttcctgttacgggcggtactggagttatggtttttattag

SEQ ID NO: 14643 - DNA, 897 bp, Artificial Sequence
  Description of Artificial Sequence: Synthetic coding sequence
atggccgcctcgaccatgagtgtgtgcagttctgcatactctgacagctggcaagtcgatgattgccctgagtcgtgctgcgaacctccttgttctgccccttcttgttgcgcgcccgcccccagcctgagcttagtgtgtacccctgtcagttgcgtgagtagtccgtgctgccaagccgcttgtgaaccttccgcttgccaatccggctgtacatcttcatgtacgccttcatgctgtcagcagagttcgtgtcagcccgcctgctgtacaagcagcccatgtcaacaggcctgctgtgttcccgtgtgctgcaagacagtttgctgcaaacccgtgtgctgtgtgcctgtgtgctgtggcgccgcatcatcgtgctgccggcagtcttcgtgtcagccggcttgctgtgccagctcctcttgccagccggcgtgctgcgtgcctgtgtgctgcaaacccgtgtgctgtgtgtcaacatgttcggaagattccagtagctgctgccaacaatcctcctgccagcctgcctgttgcacaagctcctcttatcagcaggcatgttgcgtgcccgtttgttgtaaaaccgtttattgcaaaccaatttgctgtgtgcccgtgtgttcgcgtgcctccagcagccggtgccagcaacctagctgccagcccgcctgctgcacgacatcatgttgccgaccaagttcttccgtgagcttgctgtgtcatcccgtgtgtaggagcacttgctgtgtgccagttagctcatgttgcgccccgacctcaagttgccagtctagctgttgtcgcccggcctcgtgtgtgagcttattatgccggccagcgagctccaggctggcatgttactccctctgttccggcaagaagtccagttgttag

SEQ ID NO: 14644 - DNA, 567 bp, Artificial Sequence
  Description of Artificial Sequence: Synthetic coding sequence
atgactgccccctcgtgtgcattccctgtccagtttaggcagccgtccgtatccgggttgtcgcaaatcacgaaatcactgtacatcagtaacggcgtagcagctaacaacaagctgatgctgagttctaaccaaataactatggtcattaatgtatcagtagaggtcgtgaacactttgtacgaggatatccagtatatgcaggtcccagtcgcagacagccctaactctagactttgtgatttttttgatcctattgccgatcacattcactccgtggagatgaaacaggggcgcactcttctgcactgtgcagcgggggtctctaggtcggccgcgctgtgtctggcatatctgatgaaataccacgctatgtccttattggacgcacatacgtggacgaagtcttgcaggcccattattcgccccaattcaggcttttgggagcaactgattcactacgagtttcaactttttggtaagaatacagtccacatggtctcctcaccggtgggaatgatccccgatatttacgaaaaagaagtccggcttatgatcccgctgtag

SEQ ID NO: 14645 - DNA, 147 bp, Artificial Sequence
  Description of Artificial Sequence: Synthetic coding sequence
atgtctttcgacaacaactatcacgggggtcagggctacgcgaagggggggctcgggtgttcttacgggtgtggcctgtcaggctacgggtacgcctgctactgcccatggtgctatgagcggtcctggttctcaggctgtttttag

SEQ ID NO: 14646 - DNA, 192 bp, Artificial Sequence
  Description of Artificial Sequence: Synthetic coding sequence
atgagttacagcggtagttattacggtgggctgggatatggctgtggtggtttcggcggactgggttatggctacagttgcggatgcggctcatttagacgcctgggatacggctgcggatatggaggataccgatacagctgttgtcacccatcttgctacgggggttattggtcatccgggttttactag

SEQ ID NO: 14647 - DNA, 189 bp, Artificial Sequence
  Description of Artificial Sequence: Synthetic coding sequence
atgtgtggcagttattacgggaactactatggtgatcatggctatggttgctgcggatatgagggtttgggctacggttacggcagccttcggtgtggatatagttcctgttgcggctacgggcacggatacgggtcacggttcttttgcggttgtggctacggctgtggaagtgggtactactactag

SEQ ID NO: 14648 - DNA, 4227 bp, Artificial Sequence
  Description of Artificial Sequence: Synthetic coding sequence
atgtggtcactgactgcctctgagggcgaaagcactaccgctcattttttcctcggggccggggatgagggactcgggacccggggcatcgggatgaggcctgaggagagcgattccgagctgcttgaagacgaggaggatgaggtgccccccgagcctcagataattgtgggcatttgtgctatgacaaaaaagagcaagtcaaaacctatgacccagattctggagcgcctctgcagattcgattacctgaccgtggttatactaggagaggatgtcattctgaatgagcccgtggagaattggccaagttgtcactgcctgatttcttttcactcaaagggcttccctctggataaggctgtggcttattctaaactcagaaacccgtttttgattaacgatctcgcaatgcaatactacatacaagaccggagggaagtgtatagaatcctgcaggaggaggggatcgaccttccacggtacgccgtgctcaaccgagatccagcccgccctgaagagtgcaacctgattgagggcgaggatcaggttgaggttaatggcgccgttttcccaaaacctttcgtcgagaaaccagtttctgctgaagaccataacgtgtacatctactatcccagcagtgccggcggcggttcacagagactgttccggaagatcggttcgcggtctagcgtgtacagtccagaaagttccgttcgcaagacgggtagctatatttacgaggagtttatgcccaccgacggcacggacgttaaggtctataccgtggggcccgattatgcccatgctgaagccaggaagtctccagctcttgacggcaaagtggagagggactccgagggtaaggagatcaggtatccagtaatgttgacagctatggaaaagctggttgcccgaaaggtgtgtgttgccttcaaacaaacagtttgcggtttcgacctcttgcgggcgaatggccactctttcgtgtgcgacgtgaatggctttagttttgtcaaaaacagtatgaagtattacgacgactgcgccaaaattctggggaacaccatcatgcgagagctagccccccagttccagattccgtggtccatccccaccgaggcagaggacatccctattgtcccaacgacttccggcaccatgatggagctccgatgcgtgattgccatcatccggcatggggacaggacgccaaagcagaaaatgaagatggaggtgaagcatccacggtttttcgccctcttcgagaagcacggcgggtacaagacgggaaaactgaaactgaagcgccctgaacagttgcaggaagttctcgacattacaaggctacttctggccgaacttgaaaaagaaccagggggtgagattgaagagaagaccggcaaactggaacagcttaagtcggttcttgagatgtatgggcacttcagcggaatcaatagaaaggttcaactgacttactaccctcatggagtcaaagctagcaatgaggggcaagaccctcagcgcgagacactcgctcctagtctgctccttgtacttaagtggggcggagagttgacgcccgctggccgcgtgcaggcagaagaattgggcagagcatttcgttgtatgtatcccggaggacaaggagattatgctggcttccctggatgcggactgctccgcctgcattcaactttccgacatgatcttaagatttacgcctctgatgaaggaagagtccagatgactgccgccgcattcgcaaaaggtttgttagctctggagggcgaactgaccccgatactcgtgcagatggtcaaaagcgcaaacatgaatggcttacttgactctgatggtgattctctgtcatcatgccagcatagggtaaaggccaggctccatcacatcctgcagcaggacgccccctttgggcctgaagattacgatcaattggcgcccacccgttcaacctctctgctcaattctatgactattatccaaaaccccgtaaaagtgtgtgaccaggtctttgcccttatagaaaatctgacccaccaaattcgtgagcgcatgcaggacccgcgtagcgtcgacttacaattgtaccactccgagaccctcgagttgatgctccagaggtggtctaagctcgaacgggacttcagacagaaatcagggcggtatgacatttcaaagatcccagacatatatgactgcgtcaaatacgatgtgcagcacaatggttccttggggctgcaaggtaccgcagaattacttcgcctctctaaggccctggccgacgtggttatccctcaggagtatggaatatcccgggaagagaaactggagatagccgtaggcttctgtcttcccctgctgcggaaaatactactagatttgcagaggactcacgaggacgagagtgtcaacaaactccatcccctttactctcggggcgtactgtctcccggtagacacgtgagaacacgtctgtactttacgagtgaatctcacgttcactctctgctctcagttttcagatatgggggtctgctcgacgagacgcaggacgctcagtggcagagggcgctggactatttgtctgccatatccgaactaaattatatgacccagatcgtgattatgctctacgaggacaacacccaagacccattgtcagaggaacggttccatgtggaactccacttctcgcctggcgtcaaaggcgtcgaggaggaaggcagtgcaccagcggggtgcgggttccgcccggcctcaagcgaaaatgaagagatgaaaactaatcaggggtccatggagaatttgtgtccaggtaaggcctccgatgagcctgatcgcgccctccaaacttccccacaacctcctgaaggccccgggctgcctaggagatcaccacttattcgcaaccgaaaggccggctctatggaggtcctttctgaaacatcttctagtagacccggcggctacagattgttttcatcttctcggccgcccaccgagatgaagcagagtggcctaggctcacagtgtacaggactgtttagcaccaccgtgctcggaggaagctcctccgccccgaatctgcaggactacgcccgaagccacggcaaaaagctccctcccgccagtctaaaacacagggatggatttgaagggtgctcaatggtccccaccatctatccacttgagaccttacacaacgcgctttccttacgacaggtctctgagtttctgtcaagagtatgtcagcgacacaccgacgcccaggcccaagccagtgccgccttattcgattcgatgcactcttcacaggcgagtgacaaccctttctcaccacctcgtactctccatagcccacccctacagttgcagcagaggtccgaaaagcccccctggtattctagtggcccaagctccacagttagctctgccggtccgagctcaccaaccaccgtggatgggaattcccaattcggattctctgatcaaccgtcattaaactcacatgtcgctgaggagcatcaaggcctaggtctgttgcaggaaaccccaggatctggtgcccaggagctctctatagagggcgagcaggagctgtttgaacctaatcagagccctcaggtaccgccgatggaaacgagccaaccctatgaagaggtgtcccagccgtgccaggaggtccccgacatctcccagccttgtcaggatatctctgaggctctgtctcaaccttgtcagaaggttcctgacattagccagcagtgccaagagaaccacgacaacggaaaccacacatgccaggaggttccccacatctcacagccatgccagaagagctcgcagctttgccagaaagtcagcgaagaggtctgccaactgtgcctagagaactcagaggaagtgtctcagccgtgtcagggggttagcgtcgaggtcggcaaactggtgcataagttccacgtgggagtagggtcactggtgcaagaaactctagttgaagtcggctcccccgccgaagagatccccgaggaggtgatacagccctatcaagaattttctgtggaggttggccgtttggcacaggagacctctgccattaacctactgtctcaaggcattcccgaaatcgacaagccctcgcaggagtttcccgaagagatcgatctgcaggcccaggaggtaccggaggaaataaactag

SEQ ID NO: 14649 - DNA, 705 bp, Artificial Sequence
  Description of Artificial Sequence: Synthetic coding sequence
atggaaggcgcctctagaaatttggcttccactccgcgggtccacgccaaagttatgatgtacagaaaggaacagtacctggacgtcctgcatgctctcaaggtagttcgcttcgtgagcgacgctacgccacaggcagaggtgtatctgcggatgtatcagttagagagcggtaaactgcctagaagcccatctttcccactggagcccgacgatgaggtgtttctggccatcgctaaagcaatggaggagatggtggaagattctgtcgattgctactggatcacaagacgctttgtcaatcaactgaacactaaataccgtgatagcttgccacagctgccgaaggcgttcgaacagtacctgaatctcgaggacggtcgcctcctgacgcatctgaggatgtgcagcgcagctcctaagttgccctacgacctttggttcaagagatgtttcgcaggttgtcttccggagtcatcactgcagcgcgtgtgggataaggtcgtctcgggtagctgcaagatcctggtgtttgtcgcggtcgagatattgctcaccttcaaaataaaggtaatggctcttaactctgctgagaagatcacaaagttccttgaaaacatcccccaagattcatcagacgccattgtatcaaaggcaattgacctgtggcacaaacactgcgggacgccagtgcacagcagctag

SEQ ID NO: 14650 - DNA, 537 bp, Artificial Sequence
  Description of Artificial Sequence: Synthetic coding sequence
atgaccacgctcagggcattcacatgtgacgatttgtttcgattcaacaatattaatctggatccactgactgagacctacggcatccccttctacctgcagtacttagcccattggccggagtactttatcgtggctgaggcccctggcggcgaattgatggggtatatcatggggaaggctgaaggatctgtggcaagggaggagtggcacggacatgtgactgcattgagtgtagcaccggaattcagacgtctcggcctggccgctaaactgatggagctcctggaggagatctccgagcgcaagggtggctttttcgtggaccttttcgtgcgggtatccaaccaagttgccgtcaatatgtacaagcaactgggctacagtgtgtatcgtacagtgatagagtactattccgcatccaacggcgaaccagacgaagacgcttacgacatgcggaaggcactctccagggacacagaaaagaaatccattatcccactgcctcaccccgtgcggcccgaagacatcgaatag

SEQ ID NO: 14651 - DNA, 2373 bp, Artificial Sequence
  Description of Artificial Sequence: Synthetic coding sequence
atgggtaccagaaagaaggtgcacgcttttgtgcgcgtcaaacccacagacgattttgcacacgaaatgatccgctatggagacgataagagatcgatcgacattcatcttaaaaaagacattagaaggggcgtagtcaataatcagcagaccgattggagcttcaagctagatggagtccttcatgacgctagccaggacctggtctacgaaacagttgcaaaggatgtggtctctcaggcgcttgacggctacaatggcacaatcatgtgctatgggcagactggcgctggtaagacgtatacgatgatgggcgcaaccgagaattacaaacatcgaggaatactacccagggcactccagcaggttttcaggatgatcgaggaacgtcccacccacgcgattacagtgcgcgtgagctatctggaaatttacaacgaatccttgttcgatctactgagcaccctgccctatgtagggcctagcgtgacgccgatgaccatcgtggaaaatccccagggcgttttcatcaaaggtttaagtgtgcatctcacttcacaggaagaggacgcattcagcttacttttcgagggcgaaaccaatcggattattgctagccacactatgaataagaatagttcaaggagtcattgtatttttactatttacttagaagctcatagccggaccctgtccgaagagaagtacattacctcaaagatcaacctggtcgatctggccggcagcgaaaggcttgggaaatctgggtcagaaggacaggtgctgaaggaagccacctacataaataaaagtctatcctttttggaacaggctatcatcgcactgggtgaccagaagcgtgaccacataccgtttagacagtgtaagctcacccacgctctgaaagattccctagggggtaactgcaatatggtgctggtgaccaatatttacggggaagcagcccagctcgaggaaacactgtcatccttgaggttcgcgagtcggatgaagctagtcacaacagagccagccattaacgagaagtatgacgctgaacgcatggtaaaaaatttagagaaggagttggctcttctgaaacaggagttagcgattcacgacagcctgacaaacaggacatttgtgacctatgatcctatggacgagatccaaatcgcagagattaattctcaggtgaggaggtatctggaaggcacacttgatgagattgacatcatcagcctccggcagatcaaggaagtgttcaaccagtttcgtgtggtactctcgcagcaggaacaggaagtcgagtccacccttagaagaaagtataccctcatcgacaggaatgatttcgctgccattagtgccatccagaaggccgggttggttgacgtcgacgggcatcttgtgggggaaccggagggacaaaactttggcctgggcgtcgccccattctccactaaaccaggtaagaaggcaaaaagtaagaagacgtttaaggaaccccttagcagtttggcccggaaggagggtgcaagctcaccagtcaacgggaaggatttggattacgtgtctacttccaaaactcagctggtgcccagcagcaaagatggagatgtgaaagatatgctgtcaagagacagggagacttcatcaattgaacctctgccgagtgatagccccaaagaggaattgcggcctatcaggcccgatacccccccatcaaagcctgtagcctttgaggagttcaagaatgaacagggaagtgaaatcaataggatctttaaggagaataaatctatactcaatgagcgtcgtaagcgcgcttcagaaacaacacaacatattaatgcgatcaagcgggaaatcgacgtgaccaaggaggccctgaacttccagaaaagccttcgagaaaagcaaggcaagtacgagaacaaaggtctgatgattatcgacgaagaggagttcctgcttatcctcaagctgaaagatctgaagaagcagtaccgcagcgagtaccaggacctccgcgacctgcgcgccgagattcagtactgccaacatctcgttgaccagtgccgtcaccggctgctgatggaattcgatatatggtataatgagagtttcgtgattcccgaagacatgcaaatggcactcaaacccgggggatcaattaggcctgggatggtccccgtgaaccgcatcgtgtcactgggagaggacgatcaagacaagttttcacaattacaacagcgggtgctacctgaagggccagatagtatttcgttttacaacgccaaggtcaaaatcgaacaaaaacataactacctcaagacaatgatgggcttgcagcaagctcacagaaagtag

SEQ ID NO: 14652 - DNA, 3588 bp, Artificial Sequence
  Description of Artificial Sequence: Synthetic coding sequence
atgtggagcctgaccgcctccgagggagagtcaacaaccgcacatttctttctcggcgcaggcgacgaggggcttggtactcgaggcatcggtatgcgccccgaggagagtgacagcgaactcctcgaggacgaagaagatgaagtgccccccgaaccgcagattatcgtgggaatttgtgctatgacgaaaaaaagtaagtcaaagccgatgacccagattctcgaaagactgtgtcggttcgactacttaacagtcgtcattttaggagaagacgtgatcctcaatgagcccgtggagaactggcccagctgccactgcctcatttcctttcatagcaagggcttcccacttgataaggctgtggcctattcaaagctccgaaacccctttttgatcaatgatctggccatgcaatactatatccagggagaccgacgggaggtctacagaatcttacaggaagagggcattgacctcccaaggtacgccgttctgaatcgagaccctgcacggcctgaagagtgcaacctgattgaaggggaggatcaggtagaggtaaatggggcagtatttcctaaacctttcgtggaaaagcctgtctctgccgaagatcataatgtctacatctactacccctcatctgcaggcgggggaagccagaggctgtttcgaaaaatcggtagcaggagttctgtttattcaccggaaagttctgttcgcaagactggctcctatatttatgaggagtttatgcctacagacggtacagatgtcaaggtgtatactgtagggccggattacgcccacgccgaggcccggaagagccctgcactggatgggaaggtggagcgcgactccgagggtaaagagatccggtaccccgttatgctcactgcaatggagaagctggttgcaaggaaggtttgcgtggcgttcaagcagacagtgtgtggttttgacctgcttcgcgcaaatggccactcctttgtttgcgatgtgaatggattctcgttcgtcaagaacagtatgaaatactatgacgattgtgcaaagatcctgggtaatactataatgcgggagctggctcctcaattccagattccgtggtcgatcccgacggaagctgaggacattcctatcgttccgaccactagcggaacaatgatggagctgagatgtgtgatagctattatacggcacggcgaccgcactccaaaacagaagatgaagatggaggtcaagcacccacggttctttgccttattcgagaagcacggtggatacaagactggtaagcttaagctaaagcgccccgaacagctacaggaagtcttagacatcacacgcttgcttctggctgaactggaaaaagaacctggcggcgaaattgaggaaaagacaggaaagctggagcaactgaagagcgtcctggagatgtatggccactttagcggcattaatcgcaaggtccaactcacttactatccgcacggagtgaaggcatctaacgaaggtcaggatcctcagcgtgagaccctcgctccatcgttgcttctggtgcttaaatggggtggggaattgacccctgcggggcgagtgcaggcagaggaactgggccgcgcttttcgctgcatgtatccagggggacagggcgattatgctgggttccccggttgtggtctgctgcgcttgcattctaccttccgacatgacttgaagatctatgcctcggacgagggtcgcgtccaaatgaccgctgccgcattcgccaaaggactgttggctctggaaggggagttgactcccattcttgtccagatggttaagtccgctaacatgaacgggctgctggattcagatggtgactccctgagctcttgtcagcaccgcgtgaaagctagacttcaccacattttacagcaggacgctccgttcggcccagaagactatgatcagcttgctcctacgcggtctacgagtctgctcaactccatgaccatcatacagaacccggtaaaagtgtgcgaccaggtgttcgcactaattgagaacctgacccaccagatacgtgagcgcatgcaggaccctcgctcggtcgatttgcagctgtaccattcagagactctggagctgatgctccaacggtggagcaagctcgagagggattttcggcagaagagcggtcgatacgacatttcaaaaatcccggatatttacgactgtgtgaagtacgatgtgcagcataacggctctctgggcttacagggaacggcggagctgttaaggctgtctaaagctctagcagacgtagtgattccccaagagtatggaataagcagggaggagaagctggagattgccgtgggtttttgtctccccttactcaggaaaatcttgctcgatctgcagcggacccatgaggacgaatacagcaggggtgtgctgtcaccaggcaggcatgtcagaacaagattgtacttcactagcgagagtcacgtgcattcactgctcagtgtgtttaggtatgggggccttctggatgagactcaggatgccgacagagcactgcagacatcccctcagccccctgagggcccgggtctgcccaggagatccccccttatcaggaatagaaaagccgggtccatggaagtcctctctgaaactagctccagtcgtccagggggctatcgtctcttttcgagtagccggccacccacggagatgaaacagtctggcttagggtctcaatgtaccgggctattctctacgaccgtcttaggagggtcgtcctctgcgcctaatttgcaggactacgccagaagtcacggcaaaaaactgccccccgcgtcccttaaacatagagatgagttgttatttgtccctgcggtgaaacggttttctgttagcttcgcgaagcaccccactaacggattcgaggggtgttctatggtgccaaccatctatcccttggagactctccacaatgcgctctccctgcgccaggtaccccctatggagacttcacagccttacgaggaggtaagccaaccctgtcaggaggtcccagacatcagccagccgtgccaggatatttcggaggctctgtcccaaccgtgtcagaaggtgccggacatctcccagcagtgtcaggagaatcacgataatggtaaccacacctgccaagaggttccgcatatttcccagccctgtcagaagtcctcgcagctctgtcagaaggtctccgaggaggtttgtcaactctgcctggaaaattccgaggaagtgtcacagccttgtcagggagtgagtgtcgaggtaggtaaactggtgcataaattccacgtgggagtcgggagtttggttcaggaaaccctcgtggaagtcggcagccccgctgaagaaattcctgaggaagtgatccaaccttatcaagaattctctgttgaggtcggcagattggcccaagagacctctgcgattaacttgttgtctcaaggcattcccgaaatcgataaaccgtctcaggaattcccagaagagatagacctgcaggctcaggaggttcccgaagagatcaactag

SEQ ID NO: 14653 - DNA, 240 bp, Artificial Sequence
  Description of Artificial Sequence: Synthetic coding sequence
atgtgctgtaactactatggaaatagctgtggttacggatccggctgtggctgtggctatggatccggcagtggctgtggttgtggatatggaaccggttacggatgcggctatgggtgcggatttggctcccattacggatgtggctacggcacagggtacggttgcgggtatggatccggttccggatactgcggatatcgccctttctgttttcgacggtgttactcttcctgctag

SEQ ID NO: 14654 - DNA, 1767 bp, Artificial Sequence
  Description of Artificial Sequence: Synthetic coding sequence
atgaagctggagttcacagaaaaaaattacaattctttcgtgctgcagaacctgaacagacaacgtaaacggaaagaatactgggacatggcattaagcgtggacaaccacgttttcttcgctcataggaatgtcttagccgcggtgtctccactggtacgcagtctgatttctagcaacgacatgaaaacagctgatgagttgttcatcactattgatacttcttacctttcacctgtcacagtggaccaactgctggactacttctatagcgggaaagtggttatcagtgagcagaatgtggaggaactgctgcggggagctcagtatttcaatacaccacgcctgagagtgcattgtaatgattttctgatcaaaagcatatgtcgggctaattgtcttcgatacctgtttctggctgagctgttcgagctgaaagaggtgagcgatgttgcctattcaggaatcagggataacttccactattgggcctctccggaaggatcgatgcatttcatgaggtgtccacccgtgatctttggacgcctgttacgggacgaaaaccttcatgtgttgaacgaagaccaagccctctcagctctgattaactgggtatacttcagaaaagaggatagagagaagtacttcaagaaattcttcaactacatcaacttgaatgcagtctccaataaaacactagtttttgctagcaacaaactggtgggcatggagaacacctcttcacatactacgctcatcgagtccgtcctaatggatcgcaagcaggagaggccctgctcactcctggtgtatcagcggaaaggagctcttcttgattccgtggtgatcctcggtggccaaaaggcccatgggcaattcaacgacggagttttcgcctatattatccaggagaatctatggatgaaactttcagacatgccataccgggcagccgccctgtctgctacctccgcaggcaggtatatctacatttcaggagggaccacagagcagatcagtggcctgaaaactgcctggcggtatgatatggacgacaatagctggaccaaactgccggacctgcctattggactcgtgtttcatactatggttacctgtgggggcaccgtgtactctgttggcggctccatcgcaccaagaagatatgtgtcaaatatctatagatacgacgaacggaaggaagtatggtgtctggcaggcaaaatgagtattccgatggatgggacggcagtcatcaccaagggagatagacacctgtatattgtgacaggacgttgcctggtgaaagggtatatctctagggtgggggtcgtggattgcttcgacacaagcactggcgatgtggtgcagtgcattacatttcctattgagttcaatcatcgccctcttttgagcttccaacaggacaatattctgtgcgtgcattcccacagacaaagcgtggagatcaacttgcagaaagtgaaggcctcaaagaccaccactagtgtgcccgtgctgcctaattcctgtccgctcgacgtctcgcatgccatatgtagcataggggactctaaggtgtttgtatgtggcggggtcacgactgcatccgatgtgcagaccaaggattacactatcaatcccaatgcatttctgctggaccagaaaacggggaaatggaagacactcgcacccccccccgaggccttagattgccccgcttgttgcctggccaagctcccatgtaagatcctgcagcggatatag

SEQ ID NO: 14655 - DNA, 2208 bp, Artificial Sequence
  Description of Artificial Sequence: Synthetic coding sequence
atgatccccccacaggaggcgagcgctagaagaagggagatcgaagacaaacttaagcaggaggaggagacactgtccttcatccgcgactcactggagaagagtgaccagctgaccaagaatatggtatctattctttcgagtttcgaaagcagacttatgaaacttgagaactcgattatcccagtgcacaagcagactgagaacttgcagaggttgcaagagaacgtcgagaaaacgttgtcctgtttggaccatgttatctcttactatcacgtagcttccgacaccgagaaaatcattcgggaaggaccaacgggacgtctggaggaatatctgggttcaatggctaaaatacagaaggccgtagagtatttccaggataattcccctgacagccccgagttgaataaggtgaaacttctgttcgaaaggggtaaagaggctctcgaaagtgagttccgatcattgatgacacgccatagtaaagtggtgtcacctgtccttatccttgatctcattagtggcgacgacgacttagaagctcaggaagatgtgaccctggaacatctgccggagtctgtcctccaagatgtgatccgcataagcagatggttggtcgaatacggacggaaccaggatttcatgaatgtgtattaccagataaggtcttctcagctggaccgatcaatcaaggggctgaaagaacactttcataagagctcatcgagttccggtgttccctattcgccggccataccaaataagcgcaaggacaccccaacaaagaagcctgtgaagcgccccgggactattcgcaaggctcagaatctgctgaaacaatactcccagcacggacttgacgggaaaaaaggcggctcaaacctgatacctctggagggactgctgccctgtacaccacggggggggttgcccggaccgtggataaacgcagcgtgtgtgtgtgctgccgatatttccccgggccatgaacatgacttccgggttaagcatttgtctgaggccttgaacgacaagcacggccccctggcaggtagagacgacatgctcgacgtggagaccgatgcatatatccattgtgtgtccgctttcgtcaaactggcacaaagtgagtatcagctgcttgctgacatcattcctgagcaccatcagaagaaaacattcgacagtctgatccaggacgctctcgatgggctgatgcttgagggagaaaatatagtgagtgccgcgcgaaaagccatcgtcaggcatgatttttccacagtgctcaccgttttccctatactgaggcatttgaagcagaccaagccggaattcgaccaagtgctgcagggcacagccgctagcaccaagaataagttgccaggccttatcacttcaatggaaacaatcggcgccaaagcgctagaggacttcgccgacaacatcaagaacgacccggataaagagtataacatgcctaaggacgggactgtgcacgaactgacttccaatgccattcttttcctgcagcagctgctagattttcaggagactgcgggtgcgatgctggctagccaggaaacgtcctcctctgcaacctcctattcttcggagttcagcaagcggctgctgagcacctacatttgtaaggtgttaggcaatcttcagctcaacttgctttccaaatccaaagtgtatgaggatcccgccctttccgcaatttttctgcacaataattataactacatactgaagtcgcttgagaagtctgaactaatccaactcgtagcagtgacacagaagactgccgaacgcagctatcgggagcacatagaacaacagatacagacctatcagcgttcatggttgaaagtaaccgactatattgccgaaaaaaacctccctgtgttccagccaggcgtgaagctgcgtgataaggaaagacagatcattaaggaacgatttaagggcttcaacgatgggctggaagaactgtgcaaaatccagaaggcgtgggctattcccgacactgaacaaagagaccgtataagacaggcacagaagaccatagtgaaagagacctacggtgctttcctgcagaagttcggatccgtgcctttcacgaagaacccagaaaagtatatcaagtacggtgtggagcaggtaggtgacatgatagaccggctatttgacacttccgcctag

SEQ ID NO: 14656 - DNA, 378 bp, Artificial Sequence
  Description of Artificial Sequence: Synthetic coding sequence
atggcgggggccggccctacgatgcttctccgagaagagaacggttgttgcagtcggagacaaagtagtagcagtgccggggacagcgatggagagcgtgaggatagtgccgctgagagggcacgccagcaactggaagcactgctcaacaaaacgatgcgaattagaatgacagacggacgtactcttgttggatgctttctgtgcacggaccgagattgcaatgtcattctcggatctgctcaagagttccttaagccttctgatagctttagcgccggtgagccgagggtgttgggtcttgctatggtgcccggtcaccatatcgtatccatcgaggttcaacgagaatctctcaccggtcctccttacttgtag

SEQ ID NO: 14657 - DNA, 477 bp, Artificial Sequence
  Description of Artificial Sequence: Synthetic coding sequence
atgctcttgctggactgcaacccagaagtagacggcttgaagcatttattagaaacgggggcctcggtgaatgcaccgccggatccatgtaaacagtctcccgtccatctagcggccggctcaggcctggcatgcttcctgctatggcagttacagaccggagccgacttgaaccaacaagatgtattgggggaggcaccgctgcacaaagccgctaaagtcggtagcctggaatgcttaagtctgctagtggcaagcgatgctcaaatagatctatgcaacaaaaatggacagacagccgaggacttggcgtggagctgtggctttcccgattgcgcaaagttcctgacaaccatcaaatgtatgcagaccatcaaggctagtgagcatccagaccggaatgattgtgtggcagttctgaggcaaaagaggagcctcggctctgtagaaaacactagtgggaagcgcaagtgttag

SEQ ID NO: 14658 - DNA, 8712 bp, Artificial Sequence
  Description of Artificial Sequence: Synthetic coding sequence
atgcggggacgcaggggccgtccccccaagcagcctgccgccccagccgccgaaaggtgcgcgcccgccccccctcctcctcctccacctcctacatcgggccctattggtggactgcggagcagacatagagggtcttcacgcggaagatgggccgcggctcaggcagaagtggcccctaagacccggttgtccagcccaagaggtgggtcctcgtccagaagaaagcctcccccaccacctcctgctcctccttccacctcggctccggggcgtggcgggcgaggcggaggcggtggaaggacgggaggaggcggaggtggggggcacctcgctcgaacgacggctgctcgtcgcgccgtgaataaagtcgtgtatgacgatcacgagtctgaggaggaggaggaagaggaggacatggtctccgaggaagaagaagaggaggatggtgatgctgaggagacacaggatagtgaagatgacgaggaagacgagatggaggaagatgacgacgattctgattaccctgaggaaatggaagacgatgatgacgatgcctcctattgcaccgagtcaagctttcgctcacattcgacttattcttccactccaggcaggaggaagccacgagtgcacagacccaggtctccgattctggaagaaaaggacattccccctcttgagttcccaaagagcagcgaagacctgatggtgcctaacgagcatattatgaatgtaatagccatctacgaggtgttacgaaattttggcactgtgttgaggctgtcaccattccgttttgaggatttttgcgcggccctggtctcccaagaacagtgcactctgatggcagaaatgcacgtggtgctgttaaaggcggtccttagggaagaggacactagcaatactacctttggccccgcagatctgaaggattccgtgaatagcacactctacttcatcgatggcatgacctggcctgaggtgctcagagtatattgtgagagcgataaggaataccatcacgtgctcccgtaccaggaagcagaagattacccgtatgggcctgtcgagaataagataaaggtgttgcaattccttgttgaccagttcctgacgaccaacattgcaagagaagagctgatgtcagagggcgtcattcagtatgacgatcattgtagagtctgccataagctcggagacctgctgtgttgcgagacctgttcagcggtgtaccatttggagtgcgttaaacccccgctcgaggaagtgcctgaggacgagtggcagtgcgaagtctgtgtcgctcacaaagtgcccggagtcacagattgcgtcgctgagatccagaaaaacaagccatatatcagacatgagccaatcggttatgaccgcagtagacgcaagtattggtttctgaaccggaggctgatcatcgaggaggatacagagaatgagaacgaaaagaagatatggtactactcgacaaaggttcagctggccgagctcatcgattgtctagataaggactattgggaggctgagttgtgtaaaatacttgaagagatgcgtgaggagatccatcgccatatggatataacagaggacctcactaataaggccaggggctcaaataagagctttcttgccgccgcgaatgaggaaatcctggaatccatacgcgcaaagaagggagatattgataacgtgaagtcacctgaggaaaccgagaaggacaagaatgagacagaaaatgacagcaaggacgctgagaagaacagggaagagttcgaggatcagagtctagagaaagactctgatgataagacccctgatgacgacccagaacaagggaaaagcgaggagcccacagaagtgggggacaaaggaaattctgtcagtgccaacctgggagacaacactactaacgcaacaagcgaggagacgtcgccgtcagaggggagaagtcccgtcggttgtctgtctgagacgccagacagcagcaacatggctgagaagaaggttgcttccgagctgccacaagatgtgcccgaggaacccaacaagacctgcgagagctccaacacatcagctactaccacgagcattcaacctaacttggaaaatagcaatagttcctctgaattaaactcaagccagagtgaaagcgcaaaggccgccgatgaccccgaaaatggcgaaagggaatcgcacactccagtaagtattcaggaggagatcgtgggagacttcaagtctgagaaatcaaacggagaacttagtgaatctccgggagcgggtaaaggggccagcgggagcacacggatcatcacaagattgcgcaaccctgactcgaaactttctcagttgaagtcccagcaggttgcagcagcggctcatgaggctaataaattattcaaagaaggcaaggaggtgctggtagttaattcccagggcgagataagcaggctttctacgaaaaaagaagtcatcatgaaggggaacatcaataactacttcaaactcgggcaggaggggaagtaccgcgtgtatcacaatcagtattccaccaatagtttcgctctgaataaacatcaacatagggaagaccacgacaagcggcggcacctggctcacaagttttgcctgactcccgccggagagtttaagtggaacggttctgtccacggcagcaaagttcttacaattagtacacttcgtttgacaatcacgcagctcgaaaacaatatacctagctcttttctgcatccgaattgggcttctcatagagctaactggattaaggcggtacaaatgtgtagcaaaccgcgtgaatttgccctggcactcgccatactcgaatgcgctgtcaaacccgttgtgatgcttcccatctggagggaaagcctcggacacacacgactccaccggatgacaagtatcgagagagaggagaaggagaaggtgaagaagaaggagaaaaagcaagaggaggaggagactatgcaacaagccacctgggtaaagtacacatttcctgtaaagcatcaagtgtggaagcagaagggcgaagaatatagggtcaccggctatggcggctggtcctggattagcaaaacacacgtctatcggtttgttccaaagctcccgggtaacactaatgtcaattaccggaaaagcctggaaggcaccaagaacaatatggacgagaatatggatgagtccgataaacgcaagtgcagtcgtagtcccaaaaagatcaagatagagccagatagtgaaaaggacgaagttaagggaagtgacgctgccaagggagcagatcagaacgaaatggatatctccaaaatcacagagaagaaagaccaagacgtgaaagagctgcttgactcagactcggacaaaccttgcaaggaggaaccaatggaagttgacgacgacatgaagactgaatcccatgttaactgtcaggagtccagccaggtcgacgtggttaatgtctctgaagggttccatttgcgaaccagttataagaaaaagacgaaaagttccaaactggatggactccttgaaagacgaattaaacaatttaccctcgaggaaaaacagagactcgagaagataaagcttgagggtggcattaaaggcataggaaagacgagtacgaattccagcaagaatttaagcgaatccccagttattacgaaagctaaagaaggttgtcagtcggacagcatgcgccaggaacagtcgccgaatgccaacaacgatcagccggaagatctgatccagggatgtagcgaatctgactccagcgtcctgcgcatgagcgacccgtcccacaccactaataaactctaccccaaggatcgagtcctcgatgatgtgtctattaggagtcccgagaccaagtgccccaagcagaactccatcgaaaatgatatcgaggagaaggtctcagatctagcaagcaggggccaggagccctcaaaaagcaagactaagggaaacgacttttttatcgacgatagcaagttagcctcggctgatgatatcggcactcttatctgcaaaaataagaaaccgctgatccaggaggagagcgataccattgtctcctcctctaagtctgctctgcatagtagtgtgccaaagtctaccaacgacagagacgctactcctctgtcccgcgccatggactttgaagggaaactggggtgtgacagcgagagcaactccacactggaaaactcttcggacacagtgagtatccaagactcctcggaggaagacatgattgttcaaaattcgaatgagtctatttcggaacagttccgcacccgagagcaggatgtggaggtcctcgagccattgaaatgcgagttggtgtcaggggagtccactggtaattgcgaggaccggctgcctgtcaagggaactgaggccaacggaaaaaagcccagccagcagaagaagctggaggagcgtcctgtcaataaatgttcggatcagattaaactcaagaacacaacagataagaagaataatgaaaaccgggagagtgagaaaaagggccagcggacatctaccttccagattaatggcaaagacaataaacccaaaatctatctgaagggggagtgtctcaaagagatttccgagtcaagggtggtgtcggggaacgtggagcctaaagttaacaacattaataaaattatcccagaaaacgatatcaaatccctgactgtcaaggagtctgcaattcgccccttcatcaatggcgacgttattatggaagacttcaacgaacggaacagcagtgagacaaaatctcatctgctcagctcaagtgatgccgaaggaaactatcgagactctttggagacactgcctagtactaaagagagtgattccacccaaaccacaactccgagcgctagctgccctgaaagcaacagcgttaaccaggtggaagacatggagatcgagacgagtgaggttaagaaagtgactagctctcccataacatcagaagaggagtcaaacttgtcaaacgactttatcgacgagaatggattgcccataaataagaatgagaacgtcaatggtgaatccaagcggaagacagtcattactgaggtgacaacaatgacctcaactgtcgctactgagtcgaagacagttattaaggtggaaaaaggagacaagcaaacagttgtgtcctcaacagagaattgcgccaagtctactgtgactaccacgaccacaactgttacaaaactcagtactccaagcactgggggatccgtcgacatcatatcggttaaagaacagtcaaaaaccgtagtgacaactaccgtgacagactcgctcaccaccacaggaggcaccttagtaacaagtatgactgtaagtaaggagtacagcacccgggacaaagtgaagcttatgaagttctccagacccaagaaaactcggagcggcacagcactgccttcatatagaaaattcgtaacgaagagttctaaaaaatcgattttcgttctgcccaatgatgatctgaagaagttggcccggaagggcggaattcgagaggtaccctatttcaactataacgcgaagcccgcacttgatatatggccatacccaagtcctaggcctacattcggaattacgtggaggtatcgcttacagaccgtaaagagcttggcaggggtttccctgatgttacgtctgttgtgggcgagcctgagatgggacgatatggcagcgaaagctcctcccggaggcggcactacccggacagaaaccagcgagactgaaattaccactaccgaaatcatcaagagacgggacgtcggtccatacggaattagatccgaatactgcatacgcaagatcatctgccccatcggcgtccccgaaaccccaaaagagacacccacgcctcagagaaagggacttcgcagctctgccctgcggcctaagaggcccgagacacccaaacaaaccgggcccgtgatcattgagacttgggtcgcagaagaagaactggaattgtgggagatacgcgcatttgccgagagggtggagaaggagaaagctcaggccgtcgaacagcaggccaagaagagattagagcaacagaagccgaccgtcatcgctacatctaccacatctcctacatccagcaccacatctacgatatccccagcgcagaaagtgatggttgcaccgatctccgggtcagtcactaccggcaccaaaatggttctgacaacgaaggtgggatctccggccaccgtgacctttcagcaaaacaaaaactttcatcagacctttgctacttgggtgaagcaggggcaaagtaattccggcgtagtccaggtgcagcagaaagtgctgggcatcatacccagcagtactgggacttcccagcagacatttacatcatttcaaccgcgtaccgctactgttaccatacggcctaatactagcggctccggcggcacgaccagcaactcacaagttatcactggtccgcagattagacctgggatgaccgtgatccggacacctctccagcagagcaccctgggtaaggcaatcataagaactcccgtgatggtgcagcctggggccccccagcaagtgatgactcaaataattcggggccagccagtttccacggccgtgtccgcccctaataccgtttcctccacacccggtcaaaagtccctgaccagcgcgactagtacctctaatatccagtcctcagcatcgcagccaccaagaccgcaacagggtcaagtaaagttgacaatggcccagctgacccaactgacgcagggacatgggggaaatcagggtctgacggtggtgatacaaggccaggggcagactaccggccaactacagctgatcccacagggagtcacggtgctcccaggccccggtcaacagctgatgcaggccgcaatgccaaacgggaccgtgcagcgattcttgttcacccccctcgcaacgaccgcaaccaccgcgagcaccacgaccacaaccgtcagtactaccgctgctggaaccggagagcagcgccagtcaaaattgagcccacagatgcaggtccaccaggacaagaccttaccacccgcccagagtagcagcgtcgggccagcagaggcccaaccacaaacagcccagccaagcgctcagccgcagccccaaacacagcctcaatcccccgctcagcctgaggtgcaaactcaaccggaagttcagactcaaaccactgtctctagccatgtgccgtctgaggcccagccaacacatgcgcagtcatccaagcctcaggttgccgcccagtcgcagccccaatccaacgttcaaggccagtcgcccgttcgcgtccagagcccatctcaaacgcgcatacggcccagcactccaagtcagctttctcctgggcagcagtcacaggtacagaccacaacttcccagcccatccctattcagccccacactagcctacagatcccgtcgcaggggcagccccagtctcagccgcaggtcgtaatgaagcataatgctgtgattgaacatctgaaacagaaaaagtccatgactcctgcggagcgcgaagagaaccagcgtatgattgtttgtaaccaagtcatgaagtacattctcgataagattgataaagaggagaaacaggctgccaagaagcggaagagggaggagtcagtcgagcagaaaagatccaaacaaaacgccacaaaactgagtgcattgctgtttaagcacaaagagcagctcagagccgagatattaaagaaaagggccctcctggataaggacctgcagatagaagtacaggaggaactgaagcgcgacttaaaaattaagaaagaaaaagacctaatgcagcttgctcaggctaccgcagtcgcagcaccatgtccacccgtcacgcctgcaccccccgccccaccagcaccacccccatctcctccaccacctccggccgtgcagcacacaggcctgttgtcaacacctacactgccagcagcctcccagaaaaggaaacgggaagaggagaaggattcctcatctaagagtaaaaagaagaaaatgatttcaacaacttctaaggagactaaaaaagatacaaaattgtattgcatctgcaaaaccccctatgacgagtctaagttctacattggctgtgatagatgtcagaattggtatcatgggaggtgcgttggcatcttgcaaagcgaagccgagttgattgacgagtatgtgtgcccacagtgtcagtccaccgaggacgccatgaccgttctgactccactcactgaaaaggactacgaggggctgaagcgggtgctgcggtctttacaggcccataagatggcatggccatttctcgagcccgtggaccctaatgacgcacccgactattatggcgtaataaaagaaccaatggacctcgctaccatggaggagcgggtgcagagaaggtactacgaaaagctgaccgaattcgttgcggacatgactaagatcttcgataactgtcgctactacaatccatctgattccccattctatcaatgcgctgaggtgttggaatcttttttcgtgcagaagcttaaaggatttaaggcgtctcggtcccataataataagctacagtcgactgcttcctag

SEQ ID NO: 14659 - DNA, 2628 bp, Artificial Sequence
  Description of Artificial Sequence: Synthetic coding sequence
atgaacttccaggccgggggaggacagtctccacagcagcaacagcagcttgcggggggccccccgcaacagtttgcgttgagtaactccgccgcaatcagagcagaaattcagcggttcgaatcagtgcaccctaatatttacgcaatttacgatctaattgagcgaattgaggaccttgcactgcagaatcagatcagagaacacgtgatcagcatcgaggacagctttgtgaacagccaagagtggaccttgtcacgctcagtgcctgagctgaaggtgggaatcgttggaaacttgagttctggaaagtcagccctagtgcatcgctatttgacagggacctatgtgcaggaggaaagccccgagggtgggcgattcaaaaaggagatcgtggtggacggtcagtcctacctgcttctcattcgtgatgagggtggcccaccagagctgcagtttgcagcatgggtagatgccgtggtctttgtgtttagtcttgaggacgagatctccttccaaactgtctacaattactttttaagattgtgctcattcagaaatgcctctgaagtgccaatggttctagtggggacccaagatgccatttcagcagctaacccccgggtaatcgacgacagtagggctcgaaagctaagtacagatctcaaacgctgcacttactacgaaacctgcgccacctacggactgaacgtggaacgtgtcttccaggacgttgcgcaaaaggtggtcgccctaagaaaaaagcagcagctcgcaattggcccctgcaaaagcctgcctaactctccttctcactccgctgtatccgcagcctcgatccccgcagtgcatatcaaccaggcaaccaacggtggcggctcagcattttccgattacagctcatccgttcccagtaccccatcaatctcacagcgagaactccgcatcgagacgatcgcagcctctagcactcccacccccatcaggaagcaaagtaaacggcggagcaacatcttcacatctagaaagggggctgacttggatcgagaaaaaaaagccgccgagtgcaaagtcgattctattgggtccggccgcgctattcccatcaagcagggaatcctcctgaagaggtccggcaagtccctaaacaaagaatggaagaagaaatacgtgaccctgtgtgacaacggactgctgacctaccaccccagcctccatgattacatgcagaatattcacggaaaagaaatcgacctacttagaacaaccgttaaggtgccaggaaaaaggcttccacgcgcaacgccagcaacagcgcctggcacgtccccacgcgcaaacggactttctgtggaacgatccaatacccagttggggggcgggacaggcgcgcctcacagtgctagttccgcctccctgcacagcgaaaggcccctttccagtagcgcttgggctggcccaaggcctgaggggttacaccaaagaagctgttccgtgtcaagcgcagatcagtggagcgaagccactacgagcctgcctccggggatgcaacatccggcaagcggcccagcagaggtcctgtcttccagtcctaagctggaccccccaccatcaccccatagtaacaggaagaaacatagaagaaaaaagagcacaggcacccccagacccgatggcccgagctccgcaacagaggaagccgaagaaagctttgaattcgtggtggtaagcctgactggacaaacctggcacttcgaggctagcaccgctgaggagcgggagctttgggttcagagtgttcaggctcagatcttggccagcctgcagggctgtcgctcagctaaggacaaaacccgcctgggcaatcagaatgccgctctggcagttcaagctgtgcgtacagttagaggaaactctttttgcatcgactgcgatgcgcctaacccagattgggcttccctcaatttaggcgcgttgatgtgcatcgagtgcagcggtattcaccgtcatctgggtgcacacctctcccgggtccgcagtttagacctggatgactggcctcctgagctcctggcagtaatgaccgccatggggaacgccctcgccaactcagtctgggaaggagcgctgggggggtatagtaagccaggcccagacgcatgtagggaggagaaggagcgctggattcgtgcaaagtacgagcagaagctattccttgcccccctcccatcatctgatgtgcctctgggacagcagctgttgagagctgtcgtcgaggacgatcttaggctgcttgttatgctgcttgcacacggaagcaaggaggaagttaatgaaacgtacggggatggagacggacgcactgccttgcacctgtcttctgccatggctaacgtggtctttacccagctgttgatttggtacggcgtggatgtccgtagtcgcgatgcacgcggcctaactccactggcctacgcccggcgggcaggctctcaggagtgtgctgacatcctcattcagcacggctgtcctggtgagggctgcggactcgcacccacgcccaacagggaacccgctaatggcacaaatcccagtgctgagttgcatcgcagtccctccctcctgtag

SEQ ID NO: 14660 - DNA, 1761 bp, Artificial Sequence
  Description of Artificial Sequence: Synthetic coding sequence
atgggtggcgcactcggcctccggcagttacctatctgtgctccagcatgtcgtccaagctcagggcacagtccctgggcggcggcatcaccgaacccaaaccaatggtctagcagaagtcggtggtgttgtctgcggagaagcgaggcaaggagatcttgtcgtcccgttggccgagcagctccaggtccaactagagcaatggcaagacccgccacgtccacacgcagaagcgcctgccccccactgacacctactcctgctctccgcatcgcttggagactgctatcagccaccagcagaacctcacgcatggcctcagtgctctcacgtggtagggttcgatgcccttggcacggtgcatgcttcaacatctccactggcgaccttgaggacttcccaggcttggattccttacataagttccaggtaaagattgaaaaagagaaggtgtacgtgcgtgctagcaagcaggctctgcagctgcagcggaggacgaaagtgatggcaaaatgtatctccccgtcagcgggatatagcagcagcacaaacgtgctgattgtcggggcaggcgcagctggactagtctgcgccgaaactctgcggcaggaagggttctcggaccgaattgtcctgtgcactcttgaccgtcacctgccttatgatcggccaaaactgtctaagtccctggacacccagcccgagcagttggccctcaggcccaaagaatttttcagggcatacggtatcgaagtcctgaccgaggcccaggtggtcacagtcgacgttcggactaagaaggtagtctttaaggatggcttcaagttggagtattccaagctcttgcttgcaccaggctctagccctaagacactcagctgcaagggtaaggaggtggaaaatgtatttacaatccggacaccagaagatgcgaatagggtagtaaggctggctcgcgggcggaatgtggttgtggttggcgccggcttcctcggcatggaggtcgcagcttatctgactgaaaaggctcatagtgtgagtgtcgtggagctggaagagacaccattccgcaggttcttgggggagcgcgtaggcagagccctcatgaagatgttcgaaaacaatagagtgaaattctatatgcaaaccgaagtctctgagcttcggggccaagagggcaaactgaaagaggtagtactcaagagcagtaaggtagtccgggcagacgtttgcgtggtaggaatcggggccgtccccgcaacaggcttcctgagacagagtgggatcggccttgattctcgcggtttcattccagtgaataagatgatgcaaaccaacgtgcccggtgtgtttgccgcaggtgatgctgtcacattcccacttgcttggcgcaacaatagaaaggtgaacattcctcactggcagatggctcacgcacaggggcgagtggcagcccaaaatatgcttgcccaggaagccgagatgagcaccgtaccatacctgtggaccgccatgttcggaaagtcacttcggtacgccggttacggtgaagggtttgacgacgtgataattcagggtgacctggaagagctgaaatttgtggccttttacactaagggagatgaggttatcgccgtcgcctctatgaactatgatcctattgtctctaaagtagccgaggttttggcctcaggacgagcgatccgcaagcgggaagtcgaaactggggatatgagctggctaactggtaaaggaagttag

SEQ ID NO: 14661 - DNA, 1521 bp, Artificial Sequence
  Description of Artificial Sequence: Synthetic coding sequence
atgcctgtacaggcagctcagtggaccgagtttctgtcatgtcctatctgttataacgaattcgatgagaatgttcacaagcctataagtcttggctgtagtcacaccgtttgcaaaacatgtctcaataaattacaccgcaaggcttgtccgtttgatcagactgccatcaacaccgacattgacgtgttgcccgtgaactttgcactgttgcaactggttggggcgcaagtcccagaccatcagtcaattaagctgtccaacctcggcgagaacaaacactacgaggtggccaaaaagtgtgtggaagacctggctctctatttgaagcctctaagtggcggcaaaggtgtggcgagcctgaaccagagcgcgctgagtagacccatgcagcgcaagctagtcacactcgttaattgccagctagtagaggaggagggccgggtgagggccatgagagccgcccgctcattgggtgagagaaccgtcaccgagctcatcctgcagcaccaaaatccacaacaactttctgccaacttgtgggcagcggttagagctcgtggctgccagttcctgggccctgccatgcaggaagaagccttgaaacttgttctgctagcactggaggatggatccgctttatcccggaaagtattagtcctgtttgtcgtacagcgtctcgagccacgattcccgcaggcctcaaagacctctatcggccacgtggtccagttgttgtatcgggcctcctgcttcaaggtaacaaaaagagacgaagactcctcgctcatgcagctcaaggaagagttcagatcctatgaagcgctgcgcagagaacacgacgctcagatcgtacatattgctatggaagccgggctgcgcattagcccggagcagtggagttctctactctacggggacctcgcccataagtctcacatgcagagtattattgacaaactgcagtctcccgaaagcttcgccaagagcgtccaagagctgactatagtcttacagaggaccggggatccagcaaaccttaatcgcttgaggccacatctggaactacttgccaatattgatccaaatccagatgcggtatctccaacctgggagcagctcgagaacgccatggtggctgtcaaaacagtggtccacggactggtcgactttatccagaattactcgcgcaaaggacacgaaacgcctcagccccagcctaactcaaagtacaagacatcaatgtgccgagatttaaggcagcagggtggatgtcccaggggcactaattgtactttcgctcattcacaggaagaactggagaagtgtaatccaaggggcctgtacctgcactgctgcctgctcagttcagtggccagtctggggaccgttcataatgagctatacaagcagcagcactgcgaccgcgagaaaattagcgtgtgcgcggtgaagagagcagagacctgcttctctagccaattcttctctccgctcgaagtcccccgagaggaagactag

SEQ ID NO: 14662 - DNA, 783 bp, Artificial Sequence
  Description of Artificial Sequence: Synthetic coding sequence
atgccacgcgcccggtcaggtcgtaggtcccggggggccgggggaagggaagaaacattcctgagagttcgcgcgaaccggcagaccaggctgaatgctaggatcggcaagatgaagagacgcaaacaagacgagggacaagtgtgccccctctgtaaccgccccttagctggctccgaacaagaaatgtccagacatgtggagcattgcttgtctaaacgggagggctcgtgcatggcagaggatgatgcggttgatatcgaacatgaaaacaataaccgcttcgaagagtatgaatggtgtggccagaagaggattagagcgactactttgcttgaaggagggttccggggcagtggctttataatgtgtagtggtaaagaaaatccagattctgacgctgacctcgatgttgacggcgatgacacgcttgagtacggaaagcctcagtacactgaggccgacgtgattccttgcaccggggaagaacccggggaagcaaaggaaagagaagcccttcggggtgcagtgttgaatggcggcccaccatcgacaagaatcacccccgagttctccaagtgggcaagcgacgagatgccgtcaacaagtaatggagagagttctaagcaggaagcaatgcaaaagacctgcaaaaatagtgatattgaaaaaatcaccgaggattcggcagtcacgaccttcgaggcgctaaaagcaagagtgagggagctggaacgacagttgagtcgcggcgacaggtataaatgtctcatctgcatgtag

SEQ ID NO: 14663 - DNA, 1461 bp, Artificial Sequence
  Description of Artificial Sequence: Synthetic coding sequence
atggctgccgtgaaaaccctgaacccgaaagccgaggtcgctcgcgcccaagcagcgctggcagtcaacataagcgcagcgagaggcttacaggatgtcctccgcacgaacctcggcccaaagggcaccatgaaaatgttggtgagtggggcaggggacattaagttgaccaaagatggcaacgtgttgcttcatgaaatgggactccatccccgcattattaccgagggcttcgaggcagccaaagagaaagccctgcaatttctcgaagaagtgaaagtgtcaagagaaatggatcgggaaacgctgatcgacgtggcgcggacatctcttagaactaaagtgcatgccgagctcgccgacgtccttacagaggccgtggtagacagcatcctggccatcaagaagcaggatgaaccaatcgatctcttcatgatcgagatcatggagatgaagcataaaagcgagactgacaccagtctcataaggggtctagtgctggaccatggagccagacatcctgatatgaagaaacgcgtcgaggatgcctacatactgacatgtaatgtatctctggagtatgagaaaaccgaggttaacagtggctttttctataagtctgccgaggaaagggagaaattagtgaaggcggagagaaagttcatcgaggaccgcgtgaagaaaatcatcgaactgaaacgtaaggtatgcggggacagcgataaaggcttcgttgtgatcaatcaaaagggcatcgatccgttttcattggacgcattgtccaaggaaggcattgtggcccttagaagggcaaagcggagaaatatggaaagactcacactcgcctgtgggggtgtcgcgctgaattcatttgatgatctgtcgcccgactgcttagggcacgctggattggtatatgagtacactctcggcgaggagaagttcacgtttatagagaaatgtaacaacccgagatccgttactctgctgattaagggacccaataaacatactctaacacagatcaaggacgctgtgcgagatggacttagagccgtgaagaatgctattgatgacggatgcgtggtgccaggagccggagctgtcgaagtggctatggctgaggcactcatcaaacataagcctagcgtgaagggacgcgcccagttgggagtgcaggcctttgcggacgcgcttctcatcatccccaaagttcttgcgcaaaactctggcttcgacctgcaggagacactcgtgaagatccaggcagagcattctgaaagcggtcagctcgtgggggtagatctaaacaccggcgaaccaatggtagccgcggaagtgggcgtctgggacaattattgtgtgaagaagcagctgctgcactcttgtaccgtgatcgcgactaacatactgctggttgatgaaattatgcgggcaggtatgagcagcctcaagggttag

SEQ ID NO: 14664 - DNA, 1407 bp, Artificial Sequence
  Description of Artificial Sequence: Synthetic coding sequence
atgagcttcaggctgagtggcgggagtagaagaatctgtagtaggacaggatctggtagactgtccggaggtggcacaggattcgtagctggcaatgtatgtgtaggatccggggctcgatcctccttcagctgcaccctcgaaggcatctcttcagggggaagcttttgtaactccggaggagggctgggcagtggagcttgcgcaggattcctcgggaacgagcatagcctcttatcaggtaacgaaaaggtcaccatgcagaaccttaacgaccggctggcctcctacctggatcatgtccacgccctcgaagaggcgaacgccgacctagagcaaaaaattaagggctggtacgagaagtgtgagcccgggtcttccagagaacatgaccatgattactccaggtacttttccgtcattgaggatctgaaacgacagataattagcgccacaatttgcaatgcaagcatcgtgctacagaacgacaacgccaggctcaccgccgacgactttcggttgaagtatgaaaacgaacttgccttacaccactctgtggaagcagatacctccgggttgcgccgagtgctggacgagctgaccctttgtacaacagacctggagattcagtgcgagacacttagcgaggagctgacttacctcaaaaaaagccacgaggaagagatggaggtgctgcagtacactgcaggtgggaacgtgaacgttgagatgaatgcaacacccggcgtggacctcactgtgttactcaacaatatgcgtgctgagtatgaagacctggcagagcagaaccgaaaggatgccgaggcgtggttcaatgaaaggtccgccactctacaacaacagatctcagatcacgaaggcgctgccactgctgcacgcaacgagctgaccgaacttaaacgcaatctgcagaccttggaaattgagcttcaatccctgatggccgtgaaacactcatacgagtgttccctcgcagaaactgagggcaattattgcaatcagctgcagcagatacaagatcagatcggagtgatggaggagcaattgcaacagattagaactgaaactgagggacagaagcttgagtacgagcagctgttagatgtgaagatctttttggagaaggaaatcgatatttactgcaacttactggacggagaggaaaggaaaagcaaatcaacttgctataaaagcaaggggtaccgacccgtgaattctggcaatcaggctaaggacagtactgaggagactattgtcaagactgtggtggaggaactagaccagatcgggaacctgctttccttgcgagttcattcagtcgaggagaagtcttcaaagatcagtaacatcactgtggaacagcgggtgcctagtaaggcaccatag

SEQ ID NO: 14665 - DNA, 816 bp, Artificial Sequence
  Description of Artificial Sequence: Synthetic coding sequence
atggcgggactggaggttctctttgcttcggctgccccagcgatcacatgcaggcaggacgccttagtgtgtttcctgcactgggaggtggtcacgcacggctatttcggcctgggggtcggcgaccagcccggtccaaacgataaaaaaagcgaactcctccctgcaggctggaataataataaagatctgtatgtacttaggtacgagtacaaggacggcagccggaagctactggttaaagctattaccgtggaatctagcatgattctgaacgtacttgagtacgggagtcagcaggtggccgacctgaccctaaaccttgacgattacatagatgctgagcatcttggggactttcaccggacgtacaagaatagcgaggagcttagatctagaatcgttagtggcatcatcacccccatccatgagcagtgggagaaagcgaatgtgagctctccacacagggaattcccccctgccaccgcgcgtgaggtggatcctctcagaatccctccacaccatcctcacacctctcgacaacccccatggtgcgatcccttgggacccttcgtggtagggggtgaggatctggacccttttgggcctcgtcgaggggggatgattgtggacccactccgcagtgggtttccaagagccctgatcgatccctcttccggtctcccgaataggctgccccctggggctgtgccacctggcgcgagattcgatccttttggtcctataggtacttcccctcccgggccgaatcccgaccaccttccccctcctggttacgacgatatgtatctgtag

SEQ ID NO: 14666 - DNA, 753 bp, Artificial Sequence
  Description of Artificial Sequence: Synthetic coding sequence
atgtccgagaacgctgcacccgatttctactatgtcgccatggattttgggggccatgggctctcttctcactacagtcccggggtgccttattacctccagacgttcgtctccgagattagaagggtggtcgccggcggggtggtgggcggaatgtttttttgcacatttccagagatggtcgacaaactaatcctgttagacactcctttgttcctcctggagtcagacgagatggaaaatctcctgacctataaaaggcgcgccattgagcatgtccttcaagtcgaggcctcacaggaacctagtcacgtcttttctttaaagcagctgctacagcggcttctcaaatctaatagccaccttagtgaagagtgtggagagcttcttcttcaacgtgggacgaccaaggttgctacaggactggtgctgaatcgcgaccagagactggcctgggcagagaatagcattgactttattagtcgggagttgtgtgcccactcaattcgcaagcttcaggcccatgtgctcctgatcaaagccgtgcacggttattttgactcacgacagaattactcggagaaggaatcactctcctttatgattgatactatgaagtctacactgaaggagcagttccaattcgtggaggtacccggcaaccattgtgtacatatgtctgaaccccagcacgtagcttccattatatccagctttttgcaatgcacccacatgctcccagcccaattgtag

SEQ ID NO: 14667 - DNA, 510 bp, Artificial Sequence
  Description of Artificial Sequence: Synthetic coding sequence
atggtgttccccctgcctacacctcaggaacccattatggctaccccaccaaagaggagggccgtggaagccaccggagagaaggtgttgaggtatgaaacattcatctcggatgtgctgcaacgagatctccgtaaagtcctggaccaccgggataaagtttacgagcaactcgccaaatacctgcagttgaggaatgtgattgagagactgcaggaggccaaacatagtgaattatacatgcaggtggatctggggtgtaacttctttgtcgatactgtagtgcctgacacttctcggatctatgtcgccctaggatatggcttcttcctcgaactgactttagcagaagcgttaaagttcatagaccgtaaaagtagtctcctcacagaacttagtaacagtcttaccaaggattccatgaacatcaaagctcacatccacatgttgctcgagggtctgagagaactgcaggggctgcaaaacttccctgaaaagcctcatcactag

SEQ ID NO: 14668 - DNA, 3177 bp, Artificial Sequence
  Description of Artificial Sequence: Synthetic coding sequence
atgactactgtggtcgtgcacgtcgactcaaaggccgagttgactacactgctggaacaatgggagaaggagcacgggagtgggcaggacatggtgcccatcctcacacgtatgagtcaactgatagagaaggaaaccgaagagtaccgtaagggagacccagatccatttgacgaccggcacccgggtagggccgaccctgaatgtatgctgggacacctacttcgcatcctttttaagaacgacgacttcatgaatgcactcgtgaacgcctacgtgatgacctcccgcgagcctccattaaacacagccgcctgtcgtctgctgttagatattatgcctggtttggagactgccgttgtattccaggagaaagaagggatagtggaaaatctgttcaagtgggcaagagaagccgatcagccgcttaggacttatagtaccggcctccttgggggggcgatggagaatcaggacatcgccgcaaactaccgagatgaaaactcccaattggtagccattgtgctgcgccgattaagagagttgcaactccaggaagttgccctccgacaagagaataagcgcccctctccgcgcaagctaagtagtgagccacttttgcctctggacgaagaggctgtggatatggactacggcgacatggccgtggacgacgccgaaattcagaaaagtgccctgcagattatcattaattgcgtgtgcggacccgataatcggatatcaagcataggaaaattcatttccggaacaccgagaagaaaactcccacagaatccaaagtcaagcgaacacacattagcaaaaatgtggaacgtagtacagtccaacaacgggatcaaagtattgcttagtctgctttctataaaaatgcccattactgatgcggaccaaatacgagccctggcgtgcaaggccctggtcgggctgagtcgttcctccaccgtgcgtcagattatttcaaagctccctctctttagctcttgtcagattcagcaactgatgaaagaacctgttttgcaggacaaacggtccgaccacgtgaagttctgcaagtatgcagcagagttgattgagcgtgtgtctggtaagccccttttgatcggaactgatgtgagcctggcccggctccagaaggcagacgtcgtggctcagagccgtattagttttcccgagaaggagcttctgctactgattcgcaaccacctcatttctaagggcctaggggaaaccgcaaccgtcctgacaaaggaggcagatctcccaatgaccgccgcctcccacagtagcgccttcacacccgtgaccgctgcagcctcacccgtcagcctgcccaggacccctcgcattgccaatgggatcgccacgcgtctcggatcacacgcagccgtgggcgcatcagctccctccgcaccaactgcccaccctcagccgagacccccacaggggcccctggcccttccaggacccagctacgcggggaactcaccattgatcggtagaattagttttattcgggagagaccgtccccctgcaacggccgtaagattcgagtgctgcgacagaaatccgaccacggggcttatagccagagccccgccatcaagaagcagctggatcgccatttgccatccccaccaaccctggatagtataatcactgaatatcttcgagagcaacatgctagatgtaaaaacccggttgccacctgcccacccttctcgctctttactccacaccagtgccctgaacccaagcagcggagacaggcgccaattaatttcactagtcgcctaaatagaagagcgagctttccaaagtacgggggggtggacggcggctgcttcgaccgtcacttaatcttttctcggttccgccctattagtgtgttcagggaggccaatgaagatgagtcagggtttacatgctgtgcattctcagctagggaaagatttctgatgctaggcacttgtaccggccagctgaagctatataacgtattcagcggccaggaggaggcttcttataattgccataatagcgctattacccacttggagccaagtagagacggatcattgctgctgaccagcgccacgtggtcacagccccttagcgccctgtggggcatgaaatctgtgttcgacatgaaacactcatttactgaagaccactatgtggaattctcaaagcactcacaggaccgggtgatcgggaccaagggcgacattgcccatatctacgatattcagacaggtaataaactgctcaccttgttcaacccagatttagcaaacaactacaagaggaactgcgctacctttaatcccactgatgacctggtacttaacgacggggttttgtgggacgtgaggagcgctcaggctatccataagttcgacaaatttaacatgaatatctctggcgtttttcaccccaacggcctggaggtaataattaataccgaaatttgggatctgcgcacctttcacctacttcatactgtccccgcgctggatcagtgtcgagtggtgtttaaccatactggaaccgttatgtatggagccatgctacaggcggatgatgaagatgatcttatggaggagaggatgaaaagccctttcggatccagcttccggacctttaatgccacggactacaaaccaatcgctacaattgatgtgaagagaaatatctttgatctctgtactgacacaaaggattgctacctcgccgtcatcgagaaccaggggtcaatggatgctctcaacatggacacagtgtgcaggctctatgaagtgggtcggcagcgtctggcagaggacgaagatgaggaggaagaccaggaagaagaagaacaggaagaagaagatgacgatgaagacgatgacgataccgacgacctggatgagctggataccgatcagctcctggaagctgagcttgaagaggacgacaataatgaaaacgccggtgaggacggagacaatgacttctccccttcggacgaggaattggctaacctgttggaggaaggagaagatggggaagacgaggactcagacgctgatgaggaagttgaactgatactgggggatacagattcgagcgacaatagcgacctggaagacgacataattttaagcctgaatgaatag

SEQ ID NO: 14669 - DNA, 2409 bp, Artificial Sequence
  Description of Artificial Sequence: Synthetic coding sequence
atggcggcggaggccttagcggcggaggcagtagctagccgtctggagcggcaggaggaagacattcgttggctgtggagcgaggtggagagattgcgggatgaacagttgaacgcaccctatagctgtcaggcggaaggtccctgcctcacccgggaggtggctcaactgagagccgagaattgcgatctgcgacacaggctttgtagtctgaggctgtgcctagctgaggaaaggtccaggcaggcaacccttgagagcgcagagctggaagccgcccaggaggctggcgcacagccaccaccatcccagagccaggataaggacatgaagaaaaaaaagatgaaagagtccgaagccgactccgaagtcaagcaccagccaatttttataaaggagcgactgaagttgtttgagattctgaaaaaagatcatcagctccttctggccatctatggtaagaagggggacacatcaaatattatcaccgtaagggtggcagacggtcagacggtgcagggtgaggtgtggaagacaaccccgtatcaggtggccgcggagatttctcaggagctagcggagagtaccgtcattgcaaaggtcaacggagaattgtgggacctggacaggccgctggaaggcgatagtagtctggagttgcttacctttgataacgaagaggcacaggccgtgtactggcactcctcggctcacatcttaggagaggctatggagctctattacggcgggcacctgtgttatggtccgcctattgaaaacggattttattacgacatgtttattgaagatcgagcggtgtcatcgactgaactgagcgcgctggagaacatctgcaaggcaatcatcaaggagaagcagcccttcgaacgcctggaggtgagcaaggagattctgttggaaatgtttaagtataataagttcaaatgcaggatcctgaacgagaaggttaacaccgcaacgactactgtgtaccgctgcggtccccttattgacctctgcaaaggcccacacgttcggcacaccgggaagataaaaaccatcaagatattcaagaatagctccacctactgggaaggaaatcccgaaatggaaactctgcagcggatatacggtatcagttttcctgataacaaaatgatgagggactgggaaaagttccaagaggaggcaaagaatagggatcatcgtaagattgggaaagaacaggagctcttttttttccacgacctctcacctggaagctgcttctttctcccgcggggagccttcatttataacactttgaccgatttcatcagggaggaatatcacaagagggactttaccgaggttcttagcccaaacatgtataattcaaagctgtgggaagcctctggtcactggcagcattatagtgagaacatgtttacgttcgaaatcgagaaggacacctttgcattgaaaccaatgaactgcccgggccactgtctgatgtttgcccatcgcccacgctcgtggcgcgagatgcccatcagatttgccgactttggagtccttcatagaaatgaactgtctgggaccttgtcgggattaaccagagtccggaggtttcagcaggatgacgcccatatattctgcacggtggaacaaattgaagaagaaattaaaggatgcttgcagtttctccagagcgtgtactccacattcggattctcctttcagctgaatctgagcacccgtccagaaaatttcctcggagaaattgaaatgtggaacgaggcggaaaaacagctgcagaactccctgatggactttggagaaccctggaaaatgaatccaggggatggtgctttctacgggccgaaaattgacatcaagataaaggatgccatcgggagataccatcagtgtgctacaatccagctcgatttccagctgcccattcgattcaatcttacatacgtgagtaaggatggggacgataagaagcggcccgtgatcattcatcgagcaatcctgggtagcgttgagaggatgattgccattctgagcgaaaactatggaggaaaatggcccttctggctctcaccccgacaggttatggttattcccgtcggtcctacgtgtgagaagtatgcactgcaggtaagctctgaattcttcgaggagggatttatggccgatgtcgacctggaccattcctgcacactgaacaagaaaatcagaaacgcccagctggcccagtataacttcattcttgtcgtgggggaaaaagaaaagatcgataacgccgttaatgtgcgaaccagagacaataagatccacggagagatcctggtaactagcgcaattgataagttaaaaaacctgcggaagactcggactttgaacgctgaggaggcgttctag

SEQ ID NO: 14670 - DNA, 1149 bp, Artificial Sequence
  Description of Artificial Sequence: Synthetic coding sequence
atgtttaagatccaacttgagcctcttaagctgagagcatggaccctgaacggatttgtgaagttccgcaacaaagagacttctgctgggccggttgctgttatgggcaaagattactacaagattttgggaatcccatctggggccaatgaggacgaaatcaaaaaagcataccgcaagatggccctcaagtaccatccagataaaaacaaggagcctaatgcagaggaaaagtttaaggaaatagccgaagcctacgacgtcctttcggatcctaagaaacggggcctttacgatcagtatggagaggagggtctgaagacagggggcggcacgagtggagggagctccgggtcattccattacacttttcacggggacccgcacgctaccttcgcgagcttcttcggtggcagcaacccctttgacattttttttgcaagttcacgtagcacccggccgttttcgggttttgaccccgacgatatggatgtcgatgaggacgaagaccccttcggcgcgttcggtaggtttggttttaacgggctttccaggggaccgcgacgagcccctgagccactctacccgagacgtaaggtgcaggatccccctgtggtacacgaacttcgcgtatcattagaggaaatctatcatgggtcaacaaagagaatgaagattacccgtagacgtcttaaccccgacggtaggaccgtgcgcacagaagataagatactgcacattgtaataaagcgcggatggaaggaggggactaagatcacctttccgaaagaaggagacgccacaccagataatattcccgctgacatcgtctttgttctgaaggataagccccacgctcatttccgacgagatgggactaacgtgctgtactctgcgctgatatccctcaaagaagctctgtgtggttgcaccgtgaacatacctaccatcgacggacgcgtgattcctctgccatgtaacgacgtcattaagcccggtactgtgaagcggctgcgcggggaagggctgccctttcccaaggtgccaacccagcggggcgacctgatcgtggaattcaaggtcaggtttccggatcggctcaccccacagaccagacaaattctgaaacagcatctgccgtgcagctag

SEQ ID NO: 14671 - DNA, 1356 bp, Artificial Sequence
  Description of Artificial Sequence: Synthetic coding sequence
atgcgcgaatgtataagcatccacgtcgggcaggctggtgtgcaaattggaaacgcctgctgggagctttattgtcttgagcatgggatacagcctgatggccagatgccttccgacaaaaccattgggggaggagatgatagtttcaacaccttctttagcgaaaccggagcaggcaagcacgtgccacgggccgtctttgtggacctagaaccgacagtcatcgatgaggtgagaacgggcacctaccggcagttatttcaccccgagcagctgattacgggaaaggaggacgcagcaaacaattacgcccgcggacactacactatcgggaaggaaattattgatcttgtgttagatcggatccggaaactggctgaccaatgcaccggcctgcagggctttctagttttccattcgttcgggggtggcacagggtcagggttcactagcttactcatggagcggcttagcgtagattacggcaaaaagagcaaacttgagttcagcatttatcccgctcctcaagtaagcacagcagtggtggaaccttataattctatcttaaccacccacacgacacttgagcacagcgattgcgcatttatggttgacaatgaagctatctatgacatctgtcgcagaaacttggatattgagaggcctacttacaccaatctaaacaggctgatctctcagatcgtgagctccattactgctagcctgaggtttgatggcgcccttaatgtcgacttgaccgaattccaaacaaacctggttccttacccaaggatccatttcccccttgccacatacgcccctgtcatctcggcggaaaaggcctatcatgaacaactgtccgtcgccgagatcacaaatgcctgttttgagcctgccaatcagatggtcaagtgcgatcccaggcatggaaaatatatggcctgttgtttactgtataggggtgacgtggttcctaaagatgtgaacgccgctattgctactattaaaacgaagcgctccatccagtttgtcgactggtgtcccactggtttcaaagtgggcatcaattaccagcctccaactgtcgtcccgggcggcgacttggccaaggtgcaaagagctgtgtgtatgttgagcaacaccacagcgatcgcagaggcctgggcccgcctcgatcacaaatttgacttgatgtacgctaagagggcttttgttcattggtacgtcggcgaaggaatggaggaaggagaatttagtgaagctcgcgaagacatggctgccctcgagaaagattacgaagaagtaggggtggactctgtggagggcgagggtgaagaggagggagaagaatactag

SEQ ID NO: 14672 - DNA, 444 bp, Artificial Sequence
  Description of Artificial Sequence: Synthetic coding sequence
tagaccgccagaggaccagagcccgaacagatggggctcgcgccatgctgcactcaggccctgtgtggtctcgcactgaggcatcactctcatctccagcagatcaggctggagtttcatagactgtctgaggagaacacccttttgaaaaacgatctgggacgtgtcaggcaggagttggaggctgcggaatccactcatgacgcacaacgtaaggagatcgaagtcttaaagaaggataaagaaaaagcctgttcagagatggaggtgctcaatcggcagaatcaaaattacaaagatcagctaagtcagctcaacgttcgggtgctgcaactcggccaggaggcatctacacaccaagctcaaaacgaggagcaccgcgtaacaattcagatgctcacgcagtcattggaagaggtggtgcgaagtggacaacaacagtag

SEQ ID NO: 14673 - DNA, 771 bp, Artificial Sequence
  Description of Artificial Sequence: Synthetic coding sequence
atggcaacccagcggaaacacctcgtgaaagacttcaacccatatatcacatgctatatatgcaagggctatcttatcaagccaacaaccgtgaccgagtgcctacacacgttctgtaaaacatgtattgttcagcacttcgaagacagcaacgactgcccgcgttgtggtaaccaagtgcacgagacgaacccgctcgaaatgctccggctggacaacacattggaggagatcatctttaaactagtaccaggcctgagagagcaagaactggaacgcgagtccgagttttggaaaaaaaacaaaccacaggaaaacggtcaggacgacacaagtaaagccgacaaacccaaggtagacgaagagggtgacgagaacgaagacgacaaagactaccatagatccgatccccagattgccatctgtctcgactgcctcaggaacaacggccagagcggggataatgttgtgaaggggttgatgaagaagtttatcagatgttcaactcgagttactgtgggtaccatcaagaaattcctctctttgaagctgaagctgccctcctcctacgaattggatgtgctctgtaacggagaaatcatggggaaggaccacacaatggaattcatttacatgacaaggtggaggctgcggggggaaaacttccggtgcttgaactgctccgcatctcaagtttgtagccaggacgggcctctgtaccagtcctacccaatggttttacaatacagacccaggatcgatttcggttag

SEQ ID NO: 14674 - DNA, 6672 bp, Artificial Sequence
  Description of Artificial Sequence: Synthetic coding sequence
atggctccgaaaaaggagaaaggcggcacagtgaacacaagttcgaaaatttgggaaccaagcctcatcgctgctcaatttaatcagaacgactggcaggcgagcatcgcctttgttgtggggaaccagatagaggatgacctgctgatccaggctctcactgtggccgtgcaggtccctcagcggaaacttttttcaatggtgtcctggcaggacatcctccagcagataaatgagattaacaccctggtggggagtgccagctcaaaaaaggctaaaaagccagtaggcgggaacgctcctctttactatgaggtgctaaccgctgctaaggctattatggactccggcgaaaagctgacactccctctgatcggaaagctgttgaaatttcagctcttacagatcaagttcaaggaccagcaacggagagagaacgaaaagaaagtcattgaagataaacctaagttagagaaagataagggcaaagctaagagcccaaaggaaaaaaaagccccttcggcaaaaccagcaaaggggaagggaaaggaccagcctgaagccaatgcacccgtcaaaaagaccacacagcttaaacgtaggggggaggacgaccatacaaaccgatatatcgatgacgaacctgatgacggggcacagcactacatcatcgtggtgggttttaacaatccacagctgctcgcgataatggccgagctgggaatcccaatcacttccgtgatcaagatttcttcagagaattacgaacctcttcagacccatttggccgccgtgaaccaacagcaggaagtattactgcagagcgaagacctagaggctgaaaaacttaaaaaagagaatgcaattaaggagctgaaaactttctggaagtatttggagcccgtcctgaacaacgagaaacccgagaccaatctcttcgatgtggcacgattggagtacatggttaaagcggccgactttcccagcgactggtctgatggcgagatgatgctcaaactgggcacggacatcttcgaaaacatcgcatgcctgatgtacgacattctagattggaagagacagcatcagcattatttggagagtatgcagctgatcaacgtgccccaggtagtcaacgagaaacctgtgttggaggctatgcccacctcagaggccccacagccagccgtgccggcccccgggaaaaaaaaggcacaatatgaggagccccaggcccccccgccagtgacctccgtgataactacggaggtggacatgagatactataactacctattgaaccctatccgggaggagttcatctctgtgcccctcatcctccactgtatgctggagcaagtggtggccaccgaagaggacctcgtgccacccagcttgcgcgaaccatcgcctagagccgatggcctggaccatcgaattgcggcccatattgtgagcttgctgccatccttgtgtctcagtgagcgggaaaaaaagaatctccacgacatattcctgtcagaagaggaaaacgaatcgaaggcggtccccaaaggaccccttctgttaaattatcatgatgcacatgcgcataaaaaatacgcacttcaagatcagaagaatttcgatcccgtacagatcgagcaggaaatgcagtcaaaactgcccttgtgggagttcctgcagtttcctctcccccccccatggaacaacactaaaaggctggctacaatccatgagctcatgcacttctgtacctcagatgtgctgtcctggaatgaagtggagagggcctttaaagtgttcacatttgagtccctcaagctgtctgaggtggatgagaaggggaagcttaaaccgtccgggatgatgtgcggttctgactcagagatgtttaacattccatgggacaaccccgcccgcttcgctaaacagataaggcagcaatatgtcatgaagatgaacactcaggaagctaagcaaaaggcggacattaagatcaaagaccgaaccttgtttgttgatcagaatctgtctatgagcgtgcaggacaacgagtcgaatagagaaccttctgacccctcacagtgtgacgcaaataatatgaaacacagtgacctgaacaatttgaaacttagcgtccccgacaatcgccagcttttggaacaggaaagcatcatgaaggcccagcctcagcatgagtctctcgagcagactactaacaacgagatcaaggacgatgccgtcacaaaagccgatagtcatgagaagaagcccaagaagatgatggtagaggccgatctggaggatatcaaaaaaacccaacagagatctttgatggattggagctttaccgaacacttcaagcccaaagtgttgctgcaggtcctgcaggaggcccataagcagtacagatgcgtggatagttattaccacacacaggataattcgctattattggtatttcataaccccatgaacaggcagcggttacattgtgaatactggaacattgccctacactccaatgtggggtttcgcaattacctggagctggttgccaagagcatccaggattggatcaccaaagaagaggcaatctaccaagaaagtaagatgaacgagaaaatcatcagaaccagagcagaactggagctgaagagctcggcaaacgcgaagttgactagcgcatctaaaatcttcagcataaaggagagtaagtctaacaaggggatctctaagaccgagataagcgaccaggagaaggagaaagagaaggaaaaaatcccgttcatcctggagggcagcctgaaggcctggaaagaggagcagcatagactagcagaagaagagaggcttcgcgaagaaaaaaaggctgaaaaaaaaggtaaggaagctggtaaaaagaagggcaaagacaacgcagaaaaagaagatagccgttcgctcaagaagaagtcaccctacaaggagaagtctaaggaagagcaggtcaaaattcaggaagtgactgaagagtcacctcaccagcccgaacccaaaataacctatccgtttcacgggtataacatggggaacattcctacccaaatctccgggtccaactattacctctatccatctgacggaggacaaatcgaggtggaaaagacaatgtttgaaaaaggaccgaccttcataaaagtccgcgtcgtgaaagacaaccataacttcatgatccatctaaacgatcccaaggaaattgtcaaaaaagaggaaaagggcgattactacctggaagaggaagaggagggcgacgaggagcagtcactcgaaaccgaggtgtccgatgcgaagaacaaggccttttcaaagtttggtagcttttccgccactctggagaatggtatttgcttgtccatctcctactatgggtcaaacggaatggctcctgaagataaggatcctgatctggaaacgatccttaatatcccttcagcgctgaccccaacagtcgtgcctgtcattgtgacggtccctcaaagcaaagccaagggtaagatcaaggggaaggaaaagccgaaagagtctcttaaggaggaagaacaccctaaggaggaggagaagaaagaggaggaggtcgagcctgaacccgtcctgcaggagaccctggatgtcccaaccttccagtccctaaacgtatcctgtcccagcggactgcttctcacatttatagggcaggaaagcaccggacagtacgttatagacgaagagcctacttgggacatcatggttaggcagtcatacccacaaagggttaagcactacgagttttacaaaactgtcatgcctccagccgagcaggaggcatccagggtcatcacgtcacaagggactgtcgtgaagtacatgctcgacggcagcacgcagatcttgttcgctgacggggctgtctctcggtcacctaatagtggcctgatctgtcctcccagtgaaatgcctgcgacccctcatagcggcgatttaatggacagcataagtcagcagaagagcgaaactatcccatccgagataaccaacacaaaaaagggcaagtctcacaagtcccagtccagcatggcacataaaggggaaattcacgaccctcctcccgaggctgtgcagactgtgacccccgttgaagtccatattgggacttggtttacaaccacacctgagggaaataggattgggacgaaaggcttggaaagaattgccgacctgactccgcttctgtcgttccaagccacagaccctgtgaacggtaccgtcatgacaacccgtgaagacaaagtcgtaattgtagagcgcaaggacggaacgagaatagtggaccatgccgatgggacaaggatcactacattctatcaggtgtacgaggatcaaatcattctcccagatgaccaagagactacggagggccccaggactgtcacccgccaggtgaagtgcatgcgggtcgaatcctctcgatacgccacagttatcgcgaattgcgaggattcatcgtgctgcgctaccttcggagacgggacaacgattattgccaaaccccagggcacataccaggtgctgcctcccaatacaggctccttgtacatcgacaaggattgctctgctgtttattgccacgagagctcaagcaacatttactatccgttccaaaagagagagcagcttcgggcggggcggtacattatgcggcatacctccgaggtaatttgcgaggtgttggaccccgagggcaatacgtttcaggttatggcagacggttcaatctctacaattcttccggagaaaaagctggaggatgacctgaatgaaaaaaccgaagggtacgattccctctcgagcatgcatctggaaaagaaccatcagcagatctacggggagcacgtgccacgctttttcgtgatgtatgctgacggcagtgggatggaactgctcagggattcagatatcgaggaatacctgtccctcgcctacaaagaatcgaacaccgtggttcttcaagaacccgtgcaggagcagccgggcacactcaccatcaccgtgctgaggccttttcacgaagcaagcccttggcaggtgaaaaaggaagacacgattgtcccaccaaacctaagatctcggtcctgggagacctttccttccgtcgagaagaagactcccgggcctcctttcggaacacaaatctggaaagggctgtgtatcgaatctaaacagcttgtttcagcgccaggtgccattctcaagtccccttctgtactccaaatgagacaattcatccagcacgaggtgatcaagaacgaagtcaaactgagattgcaagtttcactgaaagactacatcaattacatcctgaagaaggaagacgaactgcaggaaatgatggtgaaggattcacgaactgaagaagagaggggaaatgcagctgacctccttaaactcgtcatgagctttccaaaaatggaagaaactaccaaatcccacgtcactgaggtcgcggcccacttaaccgacctgttcaaacagtctctggccacaccaccaaagtgtccaccggacacattcggcaaagacttttttgagaagacctggcgtcacactgcatctagtaagagatggaaggaaaagattgacaagacccgcaaggaaatagaaacaacacaaaactatctaatggacataaaaaatcgcattattcccccgttttttaaatccgaactcaatcagctgtaccagtctcaatacaaccatctcgattcgctttccaagaaactgccatcttttacaaaaaagaacgaggatgccaacgagactgccgtccaggacacctcggacttgaatctggacttcaagccccataaggtctcagagcagaagtcctccagcgtgcctagtctaccaaaaccagaaattagcgcagataaaaaggattttactgcacaaaaccagaccgagaatttgactaaatctcccgaagaggccgagtcgtatgaacctgtcaaaatcccaactcagagtctgctccaggacgtggctgggcagacccggaaggaaaaagtgaaacttccacactacctgctctcttctaagcccaaatctcaaccactggccaaggtgcaggactcggtgggcgggaaagtgaacactagcagcgtggcaagcgctgctatcaacaatgccaagagtagcctatttgggttccatctcctgccttccagcgtcaaattcggagtgctaaaagagggacatacctatgctactgtggtcaagctcaagaacgtcggcgttgatttctgccgctttaaggtgaaacagcctcctccaagtacaggcctcaaggtgacttacaaacctggacccgtggccgcggggatgcaaaccgagctaaacatcgagctgttcgccaccgccgttggcgaggatggcgccaagggttcggcgcatatttcacacaacatcgagataatgaccgagcatgaggtgttgttcctccccgtggaggcaaccgtgttaaccagctctaactacgataaacggccaaaagattttcctcaagggaaggaaaacccgatggtgcagagaactagtaccatatattcttcaaccttgggggttttcatgtcacgtaaggttagcccccactag

SEQ ID NO: 14675 - DNA, 2337 bp, Artificial Sequence
  Description of Artificial Sequence: Synthetic coding sequence
atgcctgcctttctggggctgaaatgcctcggaaagctatgtagctcagaaaaatcaaaggtgacgtcgagcgagagaacgagcgccaggggcagcaatcggaaacgcttgatcgtcgaggaccgccgggtttccggtacatcattcaccgctcacagaagagcgactatcacacacctgctctacctctgtccaaaagattactgccctcgggggcgggtgtgcaacagcgtggacccatttgttgcacatccccaggacccccatcatccatctgaaaaaccagtgatacattgtcacaaatgcggggagccatgtaagggggaggtccttcgcgtgcagaccaagcactttcacattaaatgtttcacgtgcaaagtctgcggctgtgacctagcccaaggcggattttttataaagaatggcgaatatctgtgtacattggactatcagagaatgtatggaacacgctgccatggctgtggagagtttgttgaaggcgaggttgtgacagccctgggaaaaacctatcatcctaactgttttgcttgtaccatatgcaagaggcctttccctccgggggacagagtaacattcaacggccgcgattgtctgtgtcaactctgcgctcaacctatgtcttctagtccgaaggagaccactttctctagtaactgcgctggttgcggtcgtgatattaagaatgggcaggcacttctcgccctagataaacagtggcatttaggctgttttaaatgcaagtcttgtggcaaagtactcactggagaatatatttctaaggacggcgcaccgtattgcgaaaaggactaccaaggcttgttcggggtaaagtgcgaagcttgtcatcaattcataactgggaaggtgttagaggccggcgataaacactatcacccttcttgtgccagatgttctagatgcaatcagatgtttaccgagggcgaagagatgtaccttcagggatcaacagtatggcacccagattgcaagcagtcaaccaagactgaagaaaaattgcgccctactaggacaagctcagagtctatctacagtaggccgggcagctcgatccccggttcccctggccatactatatatgctaaggtggataacgaaattttggactacaaggacctcgctgccatcccaaaagtgaaggctatttacgatattgaaagaccagacctaatcacctacgagcccttttacacttcaggatacgacgataagcaggagcggcagtcgttgggggagtcaccccgcactttatcacccacaccctcagcagaaggctatcaagacgtgagagatcgcatgatccatagatctacatcgcaaggctccatcaacagtcccgtgtattcacgacacagctatactccaacaacatccagaagtccgcaacacttccatcgccctggcaacgagccatcttcagggcggaactcccccctgccttaccggccagactcgcgaccgctaacgccaacctacgcccaggcacccaaacatttccacgtgcccgaccaggggattaatatctaccggaagcctccgatctacaagcagcatgccgcactcgcagcacagtcaaagtcctccgaagatattatcaaattcagcaaatttcctgccgcccaggcccccgacccctcggagacaccaaaaatcgagacggaccattggcctgggccaccaagttttgccgtggtcggcccagacatgaaacgtaggtcaagcgggcgcgaggaagatgacgaggaactgcttcgtagaagacaactgcaggaagagcagctgatgaagctgaatagcggattggggcagctcattctcaaggaagaaatggagaaagaatctagggagagatccagccttctcgcctcacgctacgactctccaattaattcggcgtctcatatcccatcatccaaaacagcgagccttcccggttatggccgcaatggtcttcacagacccgtctccaccgacttcgctcagtacaatagttatggggacgtctctggaggcgtgcgagactaccagactctgccggacgggcacatgcctgcgatgcgcatggatagaggggtaagcatgccaaatatgttagaaccaaagatatttccctatgaaatgctcatggttactaatcgcgggaggaacaagattctccgcgaggtcgataggactcgactcgagcggcacctggcgccagaggtcttcagggagatttttggaatgtctatccaggaattcgataggcttccactctggcgacgcaatgacatgaagaaaaaagcaaaactcttttag

SEQ ID NO: 14676 - DNA, 1689 bp, Artificial Sequence
  Description of Artificial Sequence: Synthetic coding sequence
atgaaccctctgttcggtccaaacctgtttttgctccagcaagaacagcagggattggccggtcctcttggcgattccctgggtggagatcacttcgctggcgggggcgacctgccacccgcacctctgtctccagccggtccggccgcgtacagccctcccggccctgggcccgccccaccggccgcaatggcacttcggaacgaccttggaagcaacataaacgtcctcaagacattgaatttgaggtttcgatgtttcctcgccaaggttcacgaacttgaaagacggaaccgacttttagagaagcaactgcaacaagcattagaggaggggaaacagggtaggagaggactcggccggcgagatcaggctgtgcaaacaggttttgtaagccccatacgtccgctcgggctgcaactgggagcccgacccgccgccgtgtgcagcccttccgcacgagtcctgggcagccctgctagatccccagctggtcctctggcaccttctgccgcatccttgagctctagttcaacgtccacatctactacgtattcgtcgagcgcgagattcatgcctggcacgatttggagtttttcccatgctcgacggctggggcccggcctcgagcccacgctagtgcaaggcccaggactttcttgggtccacccagatggagttggtgtccagattgacactataacacccgagatacgagctctgtacaatgtgctggccaaagtgaagagggagagggacgagtacaagcggcgatgggaagaggaatacaccgtgcgaatccaactacaagacagggttaacgaactgcaggaggaggctcaggaggccgacgcttgccaggaggaactggccctgaaagtggagcagcttaaagccgaactggtagtgttcaaaggactcatgagcaataatctctctgagttggatactaagattcaggaaaaagccatgaaggtcgacatggacatctgcagacgaatagacattacggccaaactgtgcgacgtggcgcaacagcgcaactgtgaggacatgattcagatgttccaaaagaagctggtgcccagcatgggcggtcggaaacgtgagagaaaagctgctgtagaagaggatacatctctgagcgagagcgagggacccagacagccggacggggatgaggaagaatctactgctctctccatcaatgaggagatgcagcggatgctcaatcagctgagagagtacgattttgaagatgattgcgacagcctaacttgggaggaaacagaggagaccctgctgctgtgggaggacttctcaggatacgctatggcagccgctgaggcgcagggagagcaggaggattctttggaaaaggtaataaaggacactgagtctctgttcaaaaccagagaaaaggagtaccaggagacaatcgatcaaatagaactggaactcgccaccgccaagaatgatatgaacagacatctgcacgaatatatggaaatgtgctccatgaaaagaggccttgatgtgcagatggagacgtgtcggcgtttgatcactcagagtggagacaggaaaagtccagcattcactgccgttccccttagcgatccccctcctccccccagcgaggctgaggattccgatagggacgtctcttcggatagttcgatgcggtag

SEQ ID NO: 14677 - DNA, 2415 bp, Artificial Sequence
  Description of Artificial Sequence: Synthetic coding sequence
atgaactaccagcagcaactcgccaactcagcagcgattagggccgagatacaacgttttgagagtgttcaccctaatatctatagcatttatgagctcctggagagagttgaagagcctgtgctgcagaatcagattcgggagcacgtgatcgccattgaagacgccttcgtgaatagccaggagtggaccctgtcccgttccgttcctgaactgaaggtcggcatagtgggcaacctagcttctgggaagtccgccctagtgcatcgctatctgacgggtacttacgtacaggaggaaagtcccgaaggaggccggtttaagaaagagatcgtggtcgacgggcagtcctacctgctcctaatacgggatgaaggaggccccccagaggctcagtttgcgatgtgggtagacgcagtcatcttcgtgttctcgcttgaggacgaaatctcatttcaaaccgtatatcattattatagtcgcatggccaattatcggaataccagtgagatcccactcgtgcttgtcggcacccaggatgcaatctcaagtgcaaatccaagagtgatcgacgatgccagagccagaaaacttagcaacgacctcaaaaggtgtacatactatgagacttgtgctacatatggactgaatgtggagcgtgtgtttcaggacgtcgcacagaaaatagtcgctacacgtaagaaacagcagctgagcattgggccatgtaagtccctgcccaattctccctcgcatagctccgtctgttcagcacaggtctcagccgtacacatctcccagacatccaatggaggtggcagtctcagcgattatagttcatctgttccctctacaccttccacctcccaaaaggagttacgtatcgatgtgccgcctacagcaaatacccctactccagtgcggaaacagtctaagcgcaggagcaatctgttcacatccaggaaaggctctgaccccgataaggaaaagaagggcctcgagtccagagccgattccatcggctctgggcgtgccatccctatcaaacaggggatgctactgaagagatcaggcaagagtctgaataaagagtggaaaaagaagtacgtcactctctgcgacaatggtgtgctgacataccatccctccttgcatgactacatgcagaatgtgcacggtaaggagatagacctgctccgcacgactgtgaaggtgcccggaaagagaccccccagagccaccagcgcctgtgctcctatcagcagtccgaaaaccaatgggctctctaaggacatgtcctccctacatatcagccctaatagtgatacgggattgggggatagtgtctgctcttctccttcaatctctagcaccacctccccaaagctagacccaccaccatctccgcacgcgaataggaaaaagcatcgccggaagaagtcgacatccaacttcaaagctgacggactgtctggcaccgccgaggagcaggaggagaacttcgagttcattatagtgtctttaaccggccagacgtggcacttcgaggctactacctacgaagaacgggatgcatgggtgcaggctatcgagagtcaaattctggcttcactccagagttgcgagtccagcaaaaataagtcccggctgaccagtcagagtgaggcaatggctcttcaatcaattcgcaacatgagagggaatagtcactgcgtggactgtgagacgcagaatcccaactgggcaagcctcaatctcggggctctcatgtgtatcgagtgctcgggcatccaccggaatctggggactcacctttctcgcgtgcggagtctggacctcgacgattggccagtggaattgattaaggtgatgagttccatcggcaatgagttagccaattctgtctgggaagagagttcacaaggacgaactaagcccagcgtggattcaacgcgagaggagaaggagcgctggatacgagccaagtacgagcaaaagctgttccttgcccctctcccttgtactgagctaagtttgggtcagcacctgcttcgcgctaccgcggacgaagacctccgcaccgcaatcctgctgctcgcccacggcagtcgcgacgaagtgaatgaaacatgtggggagggtgatggacggacagcactgcacctggcttgtcgaaaaggaaacgttgtgctggctcagttgttgatttggtacggggttgacgtcacagcccgcgacgctcacgggaacacggctctggcatatgccaggcaagcaagctctcaggaatgcatagacgtgctcctccaatacgggtgtccagatgagcgctttgtgttaatggccactcctaacctgtcccggaggaataacaatcgtaataactcctcgggccgtgttcctacgataatttag

SEQ ID NO: 14678 - DNA, 2712 bp, Artificial Sequence
  Description of Artificial Sequence: Synthetic coding sequence
atgcccgaacagtttagcgtggccgaatttctcgcggtgaccgccgaggacctttccagccccgccggggccgccgcctttgcagccaagatgcctcggtacaggggggccgctctagccagagaggagatcctggagggggatcaggccattctgcagaggatcaagaaagctgtgagagccatacacagctcaggccttggacacgttgagaatgaggagcaataccgcgaggccgtagaatccttagggaattcgcatctcagtcagaactcccacgaactgtctacaggcttcctgaatctcgctgtgttcacaagagaagtcgcggccctgttcaagaaccttattcagaacctgaataacattgtctcatttccactggacagcctgatgaaaggccagctccgcgacggccggcaggactctaagaaacagcttgaaaaggcatggaaggactacgaggcgaagatggcaaagttggagaaggagcgcgatcgcgcgcgggttacagggggcatccccggggaggttgctcaggacatgcagagagagcggaggatctttcagctgcatatgtgcgagtatctgcttaaggccggtgagagccagatgaaacaaggacccgattttctgcagagcctcataaagttttttcacgcccagcataactttttccaggacgggtggaaggccgctcagagtttgttcccctttatcgaaaagctggcggcaagcgttcacgctctacaccaggcacaggaggacgagctacagaaactaacacagttaagggacagcctccggggaacgctgcagctggaaagcagggaggaacatctttccaggaagaattctggttgcggatattcgatacaccagcaccaggggaataaacagttcgggactgaaaaagttggtttcttgtacaagaaaagtgatgggatcaggcgcgtgtggcagaagcggaagtgtggcgtcaaatacggctgtctgacaatctcgcattcaactattaatcgaccgcccgttaagcttaccctactgacctgccaggtgcgaccaaacccagaggaaaaaaaatgtttcgatttagtcactcacaacaggacctatcactttcaggcagaagacgaacacgagtgtgaggcctgggtctccgtgctgcagaacagcaaagatgaggctctgtctagcgccttcttgggtgagcctagcgctggtcctggatcgtggggttcagctgggcacgatggagagccccacgatctcacaaaactcctgattgcagaagtgaagtcccggccaggaaacagccaatgttgcgattgtggcgccgcagaccctacatggctcagcacaaaccttggcgtgctgacatgcattcagtgctctggagtgcatcgcgaactcggagtgcgcttcagtagaatgcaatcgctgaccctggatctgctcggcccaagcgagttgctcctggcattgaatatgggtaacacaagcttcaatgaagtgatggaggctcaactgccaagccacggcgggccaaaaccttccgccgaatccgacatgggcaccagaagagactacattatggccaagtacgtcgagcacagattcgccagaagatgtactcctgagccacagcgcctctggaccgccatttgcaaccgggatctgctctcagttctcgaggccttcgcgaatggccaggattttggacagcccctccccggcccagatgcgcaggccccggaggagctcgtccttcaccttgccgtaaaggtggcgaatcaggctagcctgcccctcgtggattttattatccagaacggaggacacctcgacgcgaaggccgccgacggcaacacggccctgcactacgccgctctgtataatcagcccgactgcctgaaactgttgctcaaaggccgcgccctcgtgggtactgtgaacgaggccggagaaacggcccttgacattgctagaaagaagcaccacaaggaatgcgaggagctcctggagcaggctcaggctggcacatttgctttccccctgcacgtggattacagctgggttatttctacagagccgggatctgattcagaggaggatgaggaagaaaagagatgcctgctgaaactccctgctcaagcccattgggcctccggtcgcttagatatcagcaataagacctacgaaacagtcgcttctctgggcgctgctacccctcagggcgaatctgaggattgccctccacccttgcctgtgaagaactcctcgcgaacgcttgtacagggctgcgcccggcatgcatcaggagatcggtctgaagtcagcagcttgtcttccgaagccccggagacccccgagtcactgggcagccccgctagcagtagctcgctgatgagccccctcgaaccaggagacccatcgcaagctccaccgaacagcgaagaaggactgcgagaaccgcctggaacttcacgaccatctttgactagcggcaccacacctagcgaaatgtatctgcctgtcaggttttcctcagagtccacccggtcctatcgccgaggtgcccgaagcccagaagacggcccctccgcccgtcagcctctccccaggcgcaatgtgcccgttggaattaccgagggtgatggcagtaggacagggtctctccctgcctccagtgttcagttgctgcaggactag

SEQ ID NO: 14679 - DNA, 1359 bp, Artificial Sequence
  Description of Artificial Sequence: Synthetic coding sequence
atgatgaaaaggcaactacaccggatgagacagctcgctcagacaggatccctgggacggacccctgagactgcggaattcctgggggaggatctgctacaagtggaacaacggctggagcctgcgaagcgggccgctcataatatccacaagagactgcaggcttgcctacagggacaatctggtgcggatatggacaaacgagtaaagaagttgcctttgatggccctgtcaacgacaatggccgagtctttcaaggagcttgacccagacagttctatgggcaaggctctcgaaatgtcctgcgctatccagaaccagctagcacgcatcttagcagaattcgagatgactctggagagggatgtgttgcaaccattgtcaagactgtctgaggaggaattgcctgccattcttaaacataagaagtctttacaaaagctggtctccgactggaatacactcaaatcgaggctctctcaggctacaaagaacagcggttcatctcaggggctcggtgggagccctggctcacacagccacactactatggctaacaaagtcgagaccctcaaggaggaggaggaagaattgaaacgaaaagttgaacagtgccgcgacgagtacttggccgatttgtatcacttcgttaccaaagaggattcatacgcaaattacttcattcgcctgctcgagatacaggcagattaccatagacggagcctttctagcctagatactgcccttgcagaacttcgggagaaccacggtcaggcggaccattctcctagcatgactgcaactcacttcccacgtgtgtatggagtttccctcgccacccatctgcaggagctgggcagagaaattgccctccccatcgaggcctgcgtcatgatgctattatccgaagggatgaaagaggaaggtttgttcaggttagcagcaggcgcgtctgttttaaaacgcctcaagcagaccatggcttccgatccccactcccttgaggaattctgctccgacccacatgcagtagctggcgctttgaagtcctacttacgcgaactacccgaacccttgatgacctttgacctgtacgacgactggatgagagcggcctccctgaaagaacctggcgcaagacttcaggctctgcaagaggtctgcagtagactgccccccgagaacctgtccaacttgcggtatctgatgaaatttttagcgcggctggctgaggaacaagaggtgaataagatgactccttctaacatagctatagtactgggcccaaatttactttggcccccagagaaggaaggtactgagccagcaagggaacttggaagccagaccctgtgttag

SEQ ID NO: 14680 - DNA, 1137 bp, Artificial Sequence
  Description of Artificial Sequence: Synthetic coding sequence
atgaataacagcggtgcggacgagataggcaaactctttgtgggtggactggattggagtaccactcaggagacactgagatcttacttttcccagtacggggaggtggtggactgcgtcattatgaaagacaagaccacaaaccagtctagaggcttcggattcgtgaaattcaaagaccccaattgcgttggtaccgtcctcgcatcccgcccccacaccttggacggcagaaatatcgaccccaaaccgtgcacccctcgcgggatgcagcccgaacgcacacgacctaaagaaggatggcagaaaggaccacggagcgataatagtaaatcgaataagatcttcgtaggaggaatcccacataactgcggtgaaaccgaacttcgggagtatttcaagaagttcggtgtggtgacggaagtagtcatgatttatgacgcagagaagcagcgaccccgtggtttcgggttcataacctttgaagatgaacaaagcgtggatcaggcggtcaatatgcattttcacgatattatgggcaaaaaggtggaggtgaaacgtgcagagcccagagattccaagtcgcaggcgcctggccaacccggtgcatctcagtggggctcacgggtagtgccgaacgccgccaatggatgggccggccagccgccacctacttggcagcagggctatgggccacagggaatgtgggtccccgccggacaggcaataggcggatacggacccccccccgccggccggggcgcccccccccctccccccccattcacaagctacatagtttccacccctcctggaggatttccgcctcctcagggcttcccacagggttacggtgcgccgcctcaatttagtttcggatatgggccacccccacctcctccagaccaatttgctccgcccggcgtaccacccccacctgcaacgccaggtgctgcacccttggcattccccccaccccctagtcaggccgccccagacatgtctaaaccacctactgcccaacccgacttcccctacggtcagtacgggctggggtcttactcaccagctccccctggatgcggaccccatttcgtctactccctcatggtgcggctgtcctccgatgtcgcatag

SEQ ID NO: 14681 - DNA, 2430 bp, Artificial Sequence
  Description of Artificial Sequence: Synthetic coding sequence
atggaggtcttgagggagaaagtcgaggaagaagaagaagccgaacgggaggaggctgccgaatgggcagaatgggctcgaatggaaaaaatgatgcgccctgtggaagtacgcaaagaggagattactctcaagcaagaaactctgagagatctggaaaaaaaattatccgaaattcagattacggtgtccgccgagctgcccgcattcaccaaggatactatcgacatttctaaattacctatcagctacaagaccaatactcctaaggaagagcatctactccaggtggcagacaacttttctcgccagtatagccacctgtgcccggaccgggtgccactttttctgcatccactgaacgagtgtgaagtgccaaaatttgtgtccactaccctccgccctactctgatgccgtacccagaactgtataactgggactcatgcgcacagtttgtgagcgacttcctgaccatggtccccctgcccgatccactgaaacctacaattaaaaaggaagaaaaagtcttgcctaagaagtatactatcaagccacccagagacctgtgctcgcgctttgaacaggagcaggaggtcaaaaaacagcaggagattcgagcccaagagaagaaaagactccgcgaagaagaggaaagattaatggaagccgagaaagcaaagccagacgcactgcacgggttaagggttcattcctgggtgttggtactgtctgggaaacgggaggtgcctgaaaatttttttatcgacccattcacaggccactcctatagcacccaggacgagcatttcttgggcattgagtccctttggaaccacaagaattactggatcaacatgcaagactgttggaactgctgcaaagatctgattttcgacctgggcgacccagtgaggtgggaatacatgctcttgggcaccgataagagccagctttctctcactgaggaagacgacagtgggattaatgatgaagacgacgtggaaaatttgggcaaggaagacgaagataaatcttttgacatgccccatagttgggtcgagcagattgagatctccccagaagcatttgagactcgatgccctaacggcaaaaaagtgatccagtacaaaagggctaagctcgagaaatgggcaccctatctgaacagtaatggcttagtgagcagactgacaacgtacgaggacctccagtgtaccaatatcctggagatcaaagagtggtatcaaaaccgcgaggatatgctggagctgaagcacatcaacaagacgaccgatctgaagactgactattttaagccagggcacccccaggcgctgcgagttcacagttacaagagcatgcaacctgaaatggatagggtcatcgagttctacgaaacagccagagtagacggcttgatgaaaagagaggaaacaccacggaccatgactgaatactaccaggggcgacctgattttctgtcatacaggcatgcgtcatttggccccagagtcaagaaactgacattaagtagtgctgaatccaatcctcgtccaatcgtcaaaataaccgaacgtttcttccgaaatcctgccaaacctgctgaggaggatgtggccgagcgcgtgtttctggtcgctgaggagcgtattcagttgcggtaccactgtagagaagaccatattacggcgtcaaagcgtgaattcctccggcgcaccgaggtcgacagcaagggtaataagatcattatgacaccggatatgtgtatttcattcgaggtggaacctatggagcacactaagaaactcctgtaccagtatgaagcaatgatgcacctgaagcgggaggaaaaactttcacgacatcaagtctgggaaagcgagcttgaagtcttggagattctgaaactgagagaagaggaggaagcagcccatacattgactatttccatctacgatacaaaacgcaacgagaagtctaaagaataccgggaagcaatggagcgaatgatgcacgaggaacatctgcggcaagtcgaaacacagctggattacctggcgccttttctcgctcagctgcctccgggggaaaaattgacctgctggcaagcagtacgcttgaaggacgagtgtttaagcgactttaagcagcggctgattaataaggccaacttgatccaagctcggttcgaaaaagaaacacaggaacttcagaagaagcagcagtggtaccaggaaaaccaggtgacgctcactcccgaggacgaggatctgtatttatcctactgctcccaggcgatgtttaggattagaatcttggaacagcgtctcaaccgtcataaggagctggccccactgaagtatttagctctcgaagaaaagttatataaagaccccaggttgggggaactgcagaagatctttgcttag

SEQ ID NO: 14682 - DNA, 828 bp, Artificial Sequence
  Description of Artificial Sequence: Synthetic coding sequence
atgtggccattaaccgctctcctgttgctggtacctagctccggacaggcagccacactggagaagccaatactgagcctccaccccccttggactactatctttaaaggtgagagggtgaccttgaaatgcgatggctatcatccgctgcttttagagcttcagcctatcagcacactttggtatttaggccacctgctcctgccaagccataaaaagtcgatcgaggttcagactccaggagtttaccgctgtcagacccgcggagcgcccgtgtctgatcctatccaccttagcgtgtccaatgattggcttatcctacaagtgccctacgccccagtcttcgaaggagaaccactggttctacggtgccggggatggtatgataaagtcgtttacaagctgcactattatcacgatggacaggcagttaggtattttcactcatccgcaaattacacagtactccaggctagagcctccgattcagggaggtaccagtgttctggcacaatgcgcattcctgtagaatccgcgcctatgtttagcgcgaaggttgcagtaacagttcaggaggccagacacgcagccgccgtgcgagtccttcaagtccaacctagaggggcacctctccggctggggcggcgcgttcacagccccggtgcaagaggtcgtggggctcgtatcgtactggtgcgcggcggctaccggcacccgcagtgccccgagacgcaatccgtggccgccgcccccggcgccggattttctcctggaccagggcttcaccaccggccttcatcaatgggaaggtccttgggaagttggtag

SEQ ID NO: 14683 - DNA, 657 bp, Artificial Sequence
  Description of Artificial Sequence: Synthetic coding sequence
atgaactgtcgaagtgaagtgctagaagttagcgttgaaggccggcaggtagaagaggctatgctggcagttttacacaccgttctcctgcaccgctctaccggcaagtttcattataagaaagaggggacatattccataggcactgtgggcactcaagatgttgattgcgacttcatagatttcacgtatgtgcgggtgtcatccgaggagctggatagggccttgcgaaaggtcgtcggggaattcaaggacgctctaaggaattcgggtggagatggcttggggcaaatgtcgctcgaattttaccagaaaaagaagtcacgctggcccttctctgacgaatgtattccttgggaagtttggactgtaaaggttcacgtggttgccttggcgactgagcaggagcgccaaatctgtcgagagaaggtcggagagaaactctgcgaaaaaattataaacatcgtcgaggtgatgaataggcatgagtatcttccaaaaatgcccacccagtctgaggttgataacgtctttgataccggactgcgggacgttcagccctacctgtacaaaatctcattccagatcacagatgcccttgggacctctgtcacaacaacaatgcgtcggctcattaaagacaccttagcattatag

SEQ ID NO: 14684 - DNA, 552 bp, Artificial Sequence
  Description of Artificial Sequence: Synthetic coding sequence
atgatgcaaatctgtgacacatacaatcagaaacactcactgttcaatgccatgaaccggtttattggggccgtaaataacatggaccagaccgtcatggttccatcattactccgcgatgttcctctcgccgacccagggctcgacaacgatgtcggagtcgaggtgggtggaagcggcggctgtctcgaggaaagaacgcccccggtcccagacagtggctccgctaatggatcgttcttcgcacctagccgagatatgtatagtcactacgttctcctgaagtctatccggaatgacatcgagtggggggttctccatcagcctccgcctcccgctggttcggaagaaggctcggcctggaagtcgaaagacatcctggtggacctcggccacctcgagggcgccgatgcaggtgaggaagatctggagcagcagttccattaccacctaaggggccttcatacggtgctatcaaaactgacccgaaaagcaaatatattgacgaataggtataagcaggagatcgggttcggaaattgggggcattag

SEQ ID NO: 14685 - DNA, 369 bp, Artificial Sequence
  Description of Artificial Sequence: Synthetic coding sequence
atgcttttcgcgccttgctgtcaccaatgcggtgagtttatcatcggacgcgttatcaaagccatgaacaactcctggcacccggaatgctttcgttgcgacctgtgccaggaggtgctggctgacattggtttcgtcaagaacgccggcagacacctttgtcggccctgtcacaaccgggagaaagctagaggcctgggtaaatatatttgtcagaaatgtcatgctatcatcgacgagcaacccttaatctttaagaatgacccatatcaccctgatcactttaactgcgccaactgcggacaagagggctccgactgtcgatgcaccggagccgaacgcggggccattctccctgccatgccgtag

SEQ ID NO: 14686 - DNA, 1083 bp, Artificial Sequence
  Description of Artificial Sequence: Synthetic coding sequence
atggacagcgagttgatgcactctatcgtgggtagttatcataagccccctgagcgggtttttgtgcccagctttactcagaacgagccaagccagaattgccatcccgccaatctggaggtgaccagcccgaaaatcctgcactctcccaactcacaggagaaacagctggaatatacaaaacgcatggtgcttaatgtcgagcgtgagaagaacatgattctggagcagcaagcccagctccagagggaaaaagagcaggatcagatgaagttatatgctaagctggagaagctggacgtgctagaaaaggaatgttttagattaactaccacccaaaagactgctgaggataagatcaagcatctggaagaaaaacttaaagaggaagaacatcagcgcaagcttttccaggacaaggccagcgagctgcagaccggcctggaaattagcaagattattatgagctctgtgtccaatctaaaacacagcaaagagaagaaaaaatccagcaagaagactaagtgcatcaaacgcagacctccatggcagatctgcagtaaatttggcgcattaccgttcgtggcagaaaagccctcgcggacaacctcctggtgcaaagccataccacctgactctgagaagagcatttccatttgcgacaacctgtctgagttgctaatggccatgcaggatgagcttgaccaaatgagcatggaacatcaggagcttttgaagcagatgaaggaaacagaatcacactcagtttgtgacgatattgagtgtgaactcgagtgcctgctgaagaagatggagatcaagggagagcagatatccaagctcaagaaacaccaggattccgtgtgcaaactgcagcagaaggtgcagaattctaagatgtccgaagctagcggcatacagcaagaagatagttacccaaagggtagcaaaaatattaaaaatagcccccggaaatgtttgaccgacactaatcttttccagaaaaacagcagctttcatcctattagggtgcataacttgcaaatgaagctcaggagagacgatattatgtgggagcaatag

SEQ ID NO: 14687 - DNA, 1758 bp, Artificial Sequence
  Description of Artificial Sequence: Synthetic coding sequence
atgtcagggtccactccattccagatgcgcttggtgcacttagacctgaagggcgcacctccgaaggtctcctacttgagtgagatctttcctctgtttcgggctcttggcgcgaacgggcttttgattgaatacgaagatatgtttccttacgagggtccgctgagacttttgcgggctaagtacgcctacagtccttctgagattaaagaaattctacatctcgcaggcctgaatgaactggaagtcatacctctcgtgcaaaccttcggacacatggaattcgtgctgaagcatacagctttcgcgcatcttcgggaagttggatcctttccgtgcacgcttaacccgcatgaggcagagtcccttgcattagtgggcgctatgatcgaccaggtgctggaactgcatccaggggcccagcggctccatattgggtgtgacgaggtctactatctgggagagggggaggcctcacgacggtggctgcaacaggagcagaattctacaggaaagttatgcctatcccatatgcgggcagtagctagtggagtgaaggcccgtcgcccatctgtgacaccgttagtgtgggacgacatgctccgggacctgccggaagatcagctggccgcctccggggtgcctcagctcgtggaacccgtactttgggactacaccgcggacctggatgtgcatgggaaagtgctcctcatgcagaaatacaggaggtgtgggtttccccagctgtgggccgctagtgccttcaaaggagccacagggcctagtcaggcagtgccgccagttgagcatcacctgaggaatcatgtgcagtggcttcaggtggctgggagtggaccgactgactcgctacagggaataatcctgaccggctggcagcgatacgatcattatagcgtgttgtgcgaattacttcctgccggggtacctagcctcgctgcctgtttacaactgctactaagaggtgggtttgacgaagacgtgaaagctaaagttgagaacctgctcgggatctctagcttagagaagaccgatcccgtgaggcaagccccctgttcaccaccatgtcccctgctgcctctgccattccccaggccttggcgacagcttttcagcgccggcctatccgcaggacgcggtcccgcacctagccttgcagctaccagccttccgctttcccacaaaagcgcatcgatatgcgccgccctgtggatgcgttgctggcgcgctaccggcatgagcctggccgggagcgcgcccactaccgcttctgggtcgtccagcactcgatcctggttttccacatcatcgccacaacgcagtgcctcctggcacagtggagccccgagttgcagatcctggcggctgccatgttcatggctgtccacccgcatgccatggcgctcaggttggaggaaaacctgtactccagcctgcagcggctgcaaactgtgttgtagaacgtctgcccggtgcctgcccccaaggtgccaccctcctgcgctggcagggacattactgagaacaccagagggccgagcccacgccaggggcctacttctagaggcaggtggagctctgcattgtcagatggcctgggccattcgagcccacgttggagtggtgcccagcggacctgccgtcagctgtccccacagcgtgccagaagggcccggacagccactcggggaacgtctggagaatacagagggtagttctacgggccgccctgcactgtag

SEQ ID NO: 14688 - DNA, 2112 bp, Artificial Sequence
  Description of Artificial Sequence: Synthetic coding sequence
atggaggcactgctggagggcatccagaacagaggccacggggggggcttcctcacctcctgtgaagccgaactgcaggaacttatgaagcagattgacatcatggttgcccacaagaaatccgaatgggaaggcagaactcacgctctcgagacctgcctcaaaatcagagaacaggagctcaaatccctccgaagccagctggatgtcacgcacaaagaggtgggtatgttgcatcagcaagtggaagagcatgaaaaaatcaagcaagagatgaccatggaatataagcaggagctcaaaaagctccatgaagaactgtgtattctcaagaggtcctatgagaaattacagaagaagcagatgagggagtttcgcggcaataccaagaaccatcgtgaagacaggtcagaaatcgagcggctaacagccaaaattgaagaattccggcagaaatcactggattgggaaaagcagaggctcatctatcagcagcaggttagcagtctggaggcacagagaaaagcactcgcagaacaatcagagattattcaggcccaattggtgaatcgcaaacagaagctagaaagtgtggagttatcatcccagtccgaaattcagcacctttctagcaaactcgaaagagccaacgataccatatgcgccaatgaactggagatcgaacgccttacaatgagggtcaacgatttggtgggtacatctatgactgtgctccaggaacagcagcagaaagaggaaaagctgagggagtccgaaaagcttctggaagccttacaggaggagaaacgcgaactgaaggcggccctccaatcacaggagaacctgatccacgaggccagaatccaaaaggagaagctgcaggagaaagttaaagctaccaacacacagcacgccgtcgaagcgattagaccacgcgaagaatccttagcagagaagaagtacacgagccagggtcagggggatttagatagtgtcctctcccaactcaatttcacgcacacctcagaagacctgttacaagcagaggtgacatgtctcgaaggaagtctggaatctgtttccgccacatgtaaacagctcagccaagaactcatggaaaaatacgaggagttaaaaagaatggaagctcacaacaacgagtataaggcagagataaagaagctaaaggagcagatactgcagggtgagcagtcttatagcagtgccctggaagggatgaagatggagatatcccacctgactcaagagttgcaccagagggatattacaattgcttccacaaaaggctcctcatccgacatggagaaacgattgcgcgcagaaatgcaaaaagcggaggacaaagccgttgagcacaaagagatcctggaccaattggagtctttgaagttggagaacaggcacttgtccgagatggttatgaagctggaattgggtctgcatgaggccaaagaaataagcctagcggatctgcaggagaactacatcgaggctcttaacaaacttgtcagtgagaaccagcagcttcagaaagacctaatgaacacaaaatcacagctggagattagcacccagatgtgcaaaaaacagaatgataggatctttaaacctacacattctcgcactactgagttcaaaaatactgaatttaaacctactcacggccaacatcgccatgacggtatcaaaaccgaacactataaaacagatctgcactctccacgggggcaagccagcgactctatcaaccccatgagtcgggtcctttccccactctctcctcagatttccccctgttcctcaacaagatccctgacctcctactcactttgcaagacacacagtctgccctcagccttggatactaacgaggcgaacttctctgacaccatgagcgaaagcatgaacgatcaggaagagttcatttctagctgttctctgcctgtctctccccttggctcgatcgccaccaggtttctggaggaggaagagctcaggagtcatcacatcctggaacggctggacgcccacatcgaggaactgaagagagagagcgaaaaaaccgtgcgccagtttaccgcactaaaatag

SEQ ID NO: 14689 - DNA, 1626 bp, Artificial Sequence
  Description of Artificial Sequence: Synthetic coding sequence
atgagctcttgcgttagttcgcagcccagctctaatcgggcggcccctcaggacgagctgggcggtagagggtcctcatcaagtgaaagtcagaagccatgcgaggcgctgagaggcctgtctagccttagcatccacctgggcatggagtcatttattgtagttaccgaatgtgagcctggatgtgcagttgacctgggcttggctagagacaggccactcgaggcggatgggcaggaggtgcccctcgacacgtccggatcccaggctagacctcacctcagtgggcgcaaactctcgctgcaggagagatcgcagggcggcctcgccgccggtggcagcctagacatgaatgggcgatgcatctgcccttctcttccttacagccccgtttcatcaccccagagctcacccaggctccccagaagacccacagttgagtcacaccatgtcagcattactggcatgcaggactgtgtgcaattgaatcaatatacgctgaaggatgaaattggaaagggatcttatggcgttgttaagctggcctacaatgagaacgacaatacttactacgctatgaaagtcctgagtaagaaaaagttgatcaggcaggctggatttccacgacgcccgcccccaagaggcacacgaccagccccaggcggctgcatacagccaaggggtcctattgagcaagtgtaccaggagatagccatcttgaaaaagctggaccacccgaacgttgtcaagctcgtggaagtgctggatgacccaaatgaggatcacctctacatggtgttcgagcttgtcaaccagggacccgtaatggaggtgcccacactcaagcccttgagtgaagaccaggctagattctactttcaggatctcattaaaggcattgaataccttcactatcaaaaaattattcatcgggacatcaagccctccaaccttctggtgggcgaagatggccatattaagatcgctgacttcggcgtgagcaatgaattcaaaggctcagacgcccttttgagtaatacagtgggcactccagctttcatggcacctgaaagcttatctgagaccagaaagattttctcgggtaaagccctagatgtttgggcaatgggtgtgactttatactgttttgtatttggccagtgtccttttatggacgaacggatcatgtgcctacattcaaaaatcaagagccaagctttggaatttccagatcaacctgacattgctgaggacctgaaggatctcatcacccgaatgctcgacaaaaaccctgagagtcgcatcgttgtccctgagatcaagctgcatccatgggtgaccagacacggagccgagccccttccctccgaggatgaaaactgcaccttggtcgaggtcaccgaggaagaggttgaaaactcagtcaagcacataccttccttggccacggttatcctggtcaagacaatgatcagaaagagaagcttcggaaacccatttgagggttccagacgggaggaaaggtcactctccgccccaggcaatctcctgactaagcaggggagcgaggacaatctccaaggtactgatcccccacctgtgggcgaagaggaagtgctcttgtag

SEQ ID NO: 14690 - DNA, 2463 bp, Artificial Sequence
  Description of Artificial Sequence: Synthetic coding sequence
atgaccgataccagacgcagagtgaaggtctataccctgaacgaggacagacaatgggacgatcgcgggactggccacgtgtcttctgggtatgtcgagcggcttaagggtatgtcactgttggtgcgggctgaatcggacggcagcctcctactagaatctaagataaatccgaacactgcctaccaaaagcaacaggatactctgattgtatggtctgaggctgagaactatgatcttgctttgagttttcaggaaaaagccggctgtgatgagatctgggagaaaatttgtcaagtccagggaaaggatccatcggtagacataactcaagaccttgtggatgagagcgaggaggagcgtttcgacgacatgagcagccctggtctggaactaccctcttgtgagctgtcccgactggaagaaattgcggagttggtcgcaagttctttaccatctcctctgcgccgggagaagctcgccctggcactcgagaatgaaggctacataaaaaagctcctggagctgttccacgtgtgtgaggatctagagaacattgagggcctccatcacctctacgaaattattaaggggatctttctcctcaaccgtactgctctattcgaagtgatgtttagtgaggaatgtatcatggatgtgatcggttgtctggagtacgatcctgctctgagccagcccaggaagcatagggaatttctgaccaaaaccgcaaagtttaaagaagtgatccctataagcgaccctgaactgaagcaaaagattcaccagacctaccgcgtccagtacattcaggacatggtcctgcctaccccatctgttttcgaagagaatatgctcagtacccttcatagcttcatcttttttaacaaggtggagatcgtcggaatgctccaggaggacgaaaagtttctcactgacctcttcgctcagctcactgacgaggcaacagacgaggaaaaacgacaggaactggtcaatttccttaaagagttctgcgctttttcacagaccctgcagccccagaaccgcgacgcattcttcaagaccttaagcaatatggggatccttcccgctcttgaggtcattctgggaatggacgacacgcaggtccgcagcgccgcaaccgacatcttttcctatctagtggagtataatccttcaatggtacgggaattcgtgatgcaggaggcgcaacagaatgacgacgatattctcctcatcaacttgattattgagcacatgatctgcgataccgatcctgaattgggtggagctgtgcagctaatgggacttctaaggaccctcgtagacccagaaaatatgctggcaactgcgaacaagactgagaagacagagttcctcgggtttttttataagcactgcatgcacgtgctcacagctcctctgctggccaacacaacggaagataagccctctaaggatgactttcaaacagcccaactgctggcacttgttctagaactactgacattttgtgtggagcaccacacatatcatataaaaaactacattatcaataaagatattttgaggcgggtattggtgcttatggcctcaaagcacgcctttttggccctgtgcgcactgaggttcaaaagaaagataataggactaaaagatgagttttataaccggtacattatgaaaagcttcttgttcgagccagtggtgaaggcatttcttaacaatggctctcgttacaacctgatgaactctgctatcatcgaaatgttcgagttcatccgcgtagaggatatcaaatcacttactgcacatgtgatcgaaaactattggaaggccttggaagatgtcgactatgttcagaccttcaaaggccttaaacttcgattcgaacagcagcgcgagcgccaggacaatcccaaactggactctatgcggtctatcttacggaaccacaggtacagaagggatgctagaactctcgaagatgaagaggagatgtggtttaacactgatgaagatgatatggaggacggagaggccgtggtttccccttctgacaaaaccaagaatgacgacgacattatggaccccattagcaaatttatggagagaaagaaactaaaagaatccgaagagaaagaggttctgctgaaaacaaatctcagcgggagacagagcccatccttcaagttaagcctttctagtggtaccaagaccaatctcacaagccagtcctcaacaacaaaccttcccggaagtcccggttctcccgggagccctgggagccccggatcgccagggtctgtgcctaaaaatacgagtcagaccgctgccatcaccacaaaaggcggacttgtggggctcgtagactatccagacgacgacgaggacgatgacgaagatgaggacaaggaggatacgctgcccctgtctaaaaaggcgaaatttgatagctag

SEQ ID NO: 14691 - DNA, 2382 bp, Artificial Sequence
  Description of Artificial Sequence: Synthetic coding sequence
atgagtgagcagggggacctcaatcaggctatcgctgaggagggcggcaccgaacaagagacagcaacccccgaaaacggtatcgtcaagtccgagtccttggacgaagaagagaaactcgagctgcaacgtcggctcgaggcccagaaccaggaacggagaaagtcaaagtccggtgccgggaaggggaagttaaccagatcactggctgtgtgtgaggagagcagcgcaagaccggggggagaaagcctgcaggaccaggagagcatacacctgcagctcagctccttctcaagtcttcaggaagaagacaaaagcagaaaagatgactccgagcgtgagaaagagaaggacaagaataaagacaagacaagcgagaagcccaagattcgtatgctatcaaaggactgcagccaggaatataccgactccactggaatcgaccttcatgaattccttatcaacacactcaaaaacaactcaagagatcgtatgattctactcaaaatggaacaggagatcatagatttcattgctgacaataacaaccactataagaaatttccacagatgtcaagttaccagagaatgctggtgcaccgcgttgccgcctactttgggctcgaccacaatgttgaccaaacgggaaagtccgttatcattaacaaaacatcgagtaccagaatccccgagcaacgcttctgcgagcacctgaaagatgagaagggcgaggagagccagaagaggtttattcttaagagggataacagctccatagataaggaggacaaccagtctgtctgttctcaagaatccctttttgtcgagaaccgaggtaaccgtgacggcagcggaagaacatccgggtcaaggcagtcttcatctgagaacgagctgaaatggtcggatcaccaacgtgcttggtcatctaccgattctgacagtagtaatcgtaatctgaaaccagccatgacgaagacagcttcttttggggggatcactgttctgacccgtggagactcaacctcttccactcggtctaccggaaaactcagcaaagcaggtagtgagtctagcagttctgccggtagtagcggaagcctctcccggacacatcccccactccagagcactcctctggtttcaggcgtggccgctggctcccctgggtgtgtgccttaccctgagaatggaattgggggtcaggtcgccccttcctccacaagctatattctgctgcccctggaagccgcaaccggaatccctccgggaagcatactcctaaatcctcacaccggtcagcccttcgtaaaccccgacggaactcccgcaatctacaatcctcctacctcccagcaacccctcagatcagcgatggtgggacagtcgcagcagcaacctccacagcaacagccttcacctcagccccaacagcaagtgcagcccccgcagccacagatggctgggccactagttacccagagtgtccagggcctccaggctagctctcagtccgtgcaatatcctgccgtaagctttcccccacagcatcttttgcctgtctcccctacgcagcatttccccatgcgcgatgacgtggcgacccagtttggccaaatgaccctgagccgccagtctagcggtgagaccccagagcctccctccggacccgtttacccatcatccctgatgccacagccagcccagcagccctcctacgttatcgcgtccactggtcagcaattgcctacgggcggattcagcgggtcgggcccccccatttcccaacaagtcctccaaccaccaccttcccctcagggtttcgttcaacagcctcctcctgcacaaatgccagtctactactatccatccgggcagtacccaactagcacgactcagcagtacagacctatggcacctgtgcagtataacgcccagcggagccagcagatgccacaggccgctcagcaggcaggataccagccagttctgtccggacaacagggctttcagggactgataggtgtgcagcagcccccccagtcgcagaacgtgattaataatcagcaaggcacccccgtccagagtgtgatggtgagttaccctactatgtctagttatcaggtgccaatgacccaagggtcacagggattaccccagcaatcttatcagcagcccatcatgctgcccaatcaggctggccagggatccctccccgccacaggcatgcctgtctactgcaatgtgaccccacccactcctcagaacaatctgcgccttattggccctcattgtccctcctctactgtgcctgttatgtctgcttcctgccggactaattgcgcaagtatgagcaacgcagggtggcaagtcaagttctag

SEQ ID NO: 14692 - DNA, 1467 bp, Artificial Sequence
  Description of Artificial Sequence: Synthetic coding sequence
atgagatttcattggctgccaactttgtctgaacctttcgacagaaaccaagagttagagacctgtattcgccctctttggaccccctcggggtctgcctgtgagactgagcataataagtccatggacatgggcaaccagcatccttctatcagtcggttgcaggagatccagaaggaagtgaaaagcgtcgagcagcaggtgataggcttttctggtctttccgacgataaaaactataaaaagctggagaggatccttacaaagcagctgtttgaaatcgattcagtagatacagaaggcaaaggcgatatccagcaggctaggaagagagccgcacaggagacggagagactcctgaaggaactcgagcagaacgcaaaccatcctcatagaattgaaattcagaacatctttgaagaagcacagtccttagtaagggagaaaatagtccctttctataacgggggcaattgtgtgaccgatgaatttgaggagggaatacaggacatcatcctaagattaactcacgtcaaaaccggtggaaaaatctcactgaggaaggcacgctatcacactctaacaaaaatttgcgcagtgcaggaaattatcgaggattgcatgaaaaagcagccttccctccccttgagcgaggatgctcacccgtctgttgccaaaatcaatttcgtgatgtgtgaggtcaataaagcgcggggcgtcctcattgctctgctgatgggggtgaataataacgagacgtgtcggcatctgtcctgcgttctctccggattaattgccgacctggatgccctagatgtctgtgggcggacagagatcagaaattatagacgggaggtggtcgaagatataaacaagctcttgaagtacctcgatctcgaggaggaagcagacacgaccaaggccttcgatctgaggcaaaatcacagcatcctgaaaatagaaaaagttctcaagcggatgcgggagattaagaatgaactcctgcaggcccagaacccctctgaattatacctctcctcaaaaactgagctccaagggctaatcggccagctcgatgaggtatccttagagaaaaatccctgcattagagaagcccggaggagagcagttatcgaggtgcagaccctaattacatacatcgatctaaaagaggctctcgaaaaacggaaattgttcgcttgtgaagagcaccctagccacaaagcagtgtggaatgttctgggcaacctgtccgaaattcagggtgaagttctgagctttgatgggaacagaacggacaagaactatattagactcgaggagctgctgacaaaacaacttcttgctttggacgcagtagacccgcagggagaagagaaatgcaaagctgccagaaagcaggcggtgcgactcgctcaaaacatattgagctacctggatctgaaatccgatgagtgggaatactag

SEQ ID NO: 14693 - DNA, 978 bp, Artificial Sequence
  Description of Artificial Sequence: Synthetic coding sequence
atggggaagatggtgtccgtgatcaacactgtggataccagtcatgaggacatgattcacgatgcccaaatggattattacggtacacggttagccacctgttccagcgaccggagcgttaaaatttttgatgtaagaaacgggggacaaatcctgatcgctgatttacgcggtcacgagggtcccgtgtggcaggtggcctgggcccacccaatgtacggaaacatcctcgcctcctgctcatacgatcggaaagtgattatctggcgcgaagagaacgggacatgggagaagagccacgagcatgctgggcatgacagttctgtaaacagcgtctgctgggcaccccacgattatggtttgattctcgcctgtggcagctctgatggggccatcagcctactaacttatactggtgaagggcagtgggaagtgaagaaaatcaacaacgcccacaccattggttgcaacgccgttagttgggccccggcggtcgtgccagggtctctcatcgaccatcccagtggtcaaaaacccaattacattaagcggtttgcttctgggggttgtgacaacttgatcaagctatggaaagaagaggaggacggtcaatggaaggaagaacagaagctggaggcccactccgattgggtgcgcgacgtggcttgggcgccaagcattggtctgccgaccagcacaattgcaagctgctcacaggacggccgcgtgttcatttggacctgtgacgatgcctctagtaacacctggtctccgaagctgctccataaatttaacgacgtcgtgtggcacgtatcatggagcatcaccgcaaacatactcgccgtgagcggaggtgacaacaaagtcacgctgtggaaggagtccgtggacggccagtgggtatgcatatccgacgttaacaaggggcagggtagcgtatccgctagcgtcacagagggacaacagaatgagcagtag

SEQ ID NO: 14694 - DNA, 846 bp, Artificial Sequence
  Description of Artificial Sequence: Synthetic coding sequence
atgctgtttatctttccccttagcctgccatggcgcccatcatgctggaaggagtcttgctctacagggcagcgtcaggctggtaggtcacgagaggactcagtgaccccacctccaagctccccatggcccacccccccagccggtgcaatgagcacaaaacaggaggcacgcagagatgaaggtgaggcccggaccagaggacaggaagcccaattacgggacagagcgcacctgtcgcagcagcgccggttgaagcaagccacacagtttctgcacaaagatagcgccgacctgcttcccctggacagcctgaaacgtctggggacctccaaggatctgcagccccgatcggttatccaacggcgacttgtggagggcaacccaaattggctgcagggagagccaccaaggatgcaggacctcatccacggacaggagtccagaagaaaaacctctagaaccgagataccagcgctcctggtcaattgcaagtgtcaagaccagttgctgagggtagccgtggataccgggactcagtacaaccgtatctctgccggctgcctctctaggctgggcctcgaaaagagagtcttgaaggcgtccgcaggggatctggctcctgggcccccgacacaggtggaacagttggaacttcagctgggccaggaaacagtggtttgctctgcccaggttgttgacgctgagtcccctgagttctgcctggggcttcagacgctcctgtccttaaaatgctgcatcgacttggagcatggagtgctcagactcaaagccccattctccgaactgccctttttgcccctgtaccaggaacctggccagtag

SEQ ID NO: 14695 - DNA, 1533 bp, Artificial Sequence
  Description of Artificial Sequence: Synthetic coding sequence
acaggcgggggagtcgcccccgcggggcaagtgcgcacagctacctgggcaagacgagcccgaccctataggaagatggctgcacgaactggcacagaacttgcctctgctgcttccacaacagctcccgggtcttccaagcgaaggaaaaggcacccgtggcacactgtgtcgcggagacccggtcggactcccaaatggcgtttgcctaggatctccgccagagccccttatcggctgcggcgcctgcgccgccacacgtactggcccccgcggcgaccagtggccgcctccaggtgctggcctgttggagcgactcctctaggtagcgtggggggccggaccggaaaaatggacgcagctactttgacatatgatactctgagattcgcagagttcgaggatttccctgagacgtccgagcctgtgtggatcctcgggcggaagtactccattttcactgagaaagatgagattttaagtgatgtggcttcgcgactgtggttcacataccggaagaacttccccgctattgggggaacaggcccaacaagcgatacagggtggggctgcatgctccggtgcggccagatgatcttcgctcaggctctggtctgccgccacctcgggagagactggagatggacccaacgcaagagacagcccgattcatatttctcagtcttgaatgctttcattgaccgtaaggactcatactattctatccatcagattgcgcagatgggagtcggggaagggaaaagcattggccagtggtacggacctaacactgtggcacaagttttgaagaagctcgcagtgttcgatacatggagctctctcgctgttcacatcgccatggataacacagtggtgatggaggagatcaggaggctttgcaggacaagtgtgccgtgcgctggcgcgaccgctttccctgctgattcagatcggcactgcaacgggttccctgctggagcagaggtcacgaaccgccctagtccttggaggccactcgtgctactgatccctttacggttaggactcacagatatcaatgaagcctatgtggagactttaaagcactgcttcatgatgcctcagagcttgggggtgatcggaggcaaacccaacagcgcccattacttcatcgggtatgttggtgaggaattgatctatctggaccctcacaccacgcagcccgctgtggagcccacagacgggtgtttcattcctgacgaaagtttccactgccaacaccccccgtgccggatgagtatcgccgagctcgacccatcaattgcagtaggctttttttgcaagactgaggacgactttaatgattggtgtcaacaggtaaaaaagctctctctgctggggggcgcgttgcccatgttcgagttggtagagctacagcctagtcacctggcatgtcccgatgtgctcaatcttagtctggattcctccgacgtggagcggcttgagcgctttttcgattctgaggacgaagatttcgagatcctgtccttatag

SEQ ID NO: 14696 - DNA, 552 bp, Artificial Sequence
  Description of Artificial Sequence: Synthetic coding sequence
atggcaagcaataaaaccacgctgcagaagatgggcaaaaagcagaacggcaaatccaagaaggtagaggaggcagagcccgaggaatttgtggtggaaaaggtactggatcgccgggtcgtgaatgggaaggttgagtattttttgaagtggaaaggttttacagatgccgacaacacatgggagccagaggagaatctggactgcccagagctcattgaagcatttttaaactctcagaaggctgggaaggaaaaagacggaactaaacgaaagagcttgtccgatagtgaaagcgatgattcaaaatctaaaaagaaacgagacgccgccgacaagccccgcggatttgcgagagggctcgatccggagagaatcatcggggcaaccgactcctccggcgagctcatgttcctgatgaaatggaaggatagtgatgaagccgacctggttctggccaaagaggctaacatgaagtgcccacagatcgtgatcgctttctatgaagagcgtctgacctggcattcctgtccggaagatgaggcccagtag

SEQ ID NO: 14697 - DNA, 1464 bp, Artificial Sequence
  Description of Artificial Sequence: Synthetic coding sequence
atggagagaagtgggcagcgcgtgactacctgggactgcgaccaagggaaacacagcgacagtgattaccgtgaagacggcatggatctaggctctgatgccggcagctcctcatcttcaagtagagcctctagccagagcaactctactaaagtcaccccatgctccgagtgcaagtcgagctcctcacctggggggagcctggacctggtgtctgcgctggaagattacgaagaaccgtttcctgtgtaccagaagaaggtcatcgatgaatgggcccctgaggaagatggcgaggaggaagaagaggaggacgagagagaccaaaggggctatcgggacgaccggagccctgcccgcgagcccggcgacgtgagcgccagaacacggtcaggtggaggaggaggccggagcgccacaaccgcaatgcctcccccagtgccaaacggcaatctgcatcagcacgatccacaggacctccggcataacggcaatgtcgtcgtggccggacggcccagctgctccagaggcccccgccgcgcaatccagaagccccagcctgccgggggtcggcggagcggaaggggccctgccgccgggggattgtgtctgcagccaccggacgggggtacttgtgtgcccgaagagccccctgtgcctccaatggactgggaagccttggagaagcacctggcggggctacagttcagggagcaggaggtgagaaatcagggccaggctcggacaaatagtacaagcgcgcaaaaaaatgaaagggagtctatccggcaaaagttggcacttgggagttttttcgatgatggaccggggatttatacaagttgttccaagagtggaaaaccatcactcagcagtaggctccagagcgggatgaatctccagatttgtttcgtcaatgactccggatcagataaggatagcgacgcggacgactctaaaacagagacctccctggacacccccctctcccccatgtcaaagcagtcatcaagctactcagaccgggacaccacagaggaggaatccgagtccctggatgacatggatttcctgactagacaaaagaaactccaggccgaagccaaaatggcccttgctatggctaaaccaatggctaaaatgcaggtggaagtcgagaagcagaatcggaagaaatctcctgtggctgatctgctgcctcacatgcctcatatctccgagtgtctgatgaaaagatctctgaagccgacagacctccgggatatgactatcgggcagctccaggtgattgtgaatgatctccattctcagattgagtcactcaatgaggaactggttcagctgctcctgataagggacgaattacatactgagcaggacgccatgctggtggatattgaggacctgacaaggcacgcagagagccagcagaagcacatggctgaaaaaatgcccgccaagtag

SEQ ID NO: 14698 - DNA, 927 bp, Artificial Sequence
  Description of Artificial Sequence: Synthetic coding sequence
atgaagagagcccatccggaatattcctcttctgactccgaactagacgagactatcgaggtggagaaggaaagcgccgacgagaatgggaatctcagcagcgctctcggaagcatgtcacccaccactagtagtcagatcctcgcacggaaaagaaggagaggtattatcgaaaagagacgtagagacagaatcaataacagcttgagcgagttaaggagactggttccctcagcgtttgaaaaacaggtgatggagcagggctcagctaaactcgaaaaagcagagatcctgcaaatgactgtggaccacctaaagatgctgcacaccgcaggcgggaaaggctattttgatgctcacgccctggctatggattatcgctctttggggttcagggaatgcctggcagaggtcgcacgatatctgtcaattatcgagggcttggacgcctctgatcctctccgcgtccggctggtgagccacttgaataactatgcaagccagcgcgaagcagcttccggcgcacatgcaggcctcggacacataccctggggaaccgtcttcggtcaccacccccacatcgcccatcccctgctgttaccacagaatggccatgggaatgcagggacaaccgcttctcccacagaaccccaccatcagggcaggctggggtcagcacatccggaagcacccgccttgagagcccctccaagcggctccttggggccggtgctgcctgtggtcaccagcgcttctaagctgtctccacccctcttatcaagtgtggcctccctgtctgcattccctttttcttttggctcatttcacctgctgagcccaaatgccctctctcctagtgctcctacccaggcagccaatctgggaaagccctatcgcccatggggaacagaaatcggcgccttctag

SEQ ID NO: 14699 - DNA, 1338 bp, Artificial Sequence
  Description of Artificial Sequence: Synthetic coding sequence
atgtccgtgacatatgatgattccgtgggggtggaggtcagctcagacagtttttgggaggttgggaactacaagaggaccgtcaaacgcatagatgacggccatcggctgtgcagtgatttgatgaattgtctccacgaacgcgcacgtatagaaaaggcgtacgctcagcagctgaccgagtgggcccgccggtggcggcagctggtggaaaagggcccccaatacggaaccgtggagaaagcctggatggcctttatgtccgaagccgagagggtgagcgagctgcacctggaggtgaaagcaagcctgatgaacgatgattttgaaaaaattaaaaactggcagaaagaagctttccacaaacaaatgatgggtggcttcaaggagaccaaagaagccgaggacggattccggaaggcacagaagccttgggcaaaaaagttgaaggaagtggaggctgccaaaaaggcccaccatgcagcttgcaaagaggaaaagctcgccatatccagagaagctaactccaaggccgacccctctctgaaccccgagcagttgaagaagttgcaggacaagatcgaaaaatgcaagcaggatgtgctgaagaccaaagaaaagtatgaaaaatctcttaaggagctggatcagggaaccccccagtatatggagaacatggagcaagtctttgaacagtgccagcagtttgaagagaaacggctcaggttttttcgtgaagtcctgctggaggtacagaagcatctcgacctgtcaaacgtggcaggatacaaagctatttaccatgacctagagcagagtattcgtgccgctgacgccgtggaggatttgcgttggttcagggccaatcatggccccggaatggccatgaactggcctcagttcgaggaatggtccgcggacttgaatagaaccctgagccgccgggaaaaaaagaaggctaccgacggtgttaccctaactggcatcaatcagactggcgatcagagcctgccttctaaaccttcaagtgttagcagctatgaaaaaacccagagttatcctacagattggagcgatgatgaaagcaataacccattctcatcaactgacgccaatggcgattcaaatccgttcgatgatgatgctacgtccgggaccgaggtccgggttcgagctctttacgattacgagggtcaggagcatgacgaattgagtttcaaagctggggatgaactgacaaagatggaagatgaagacgagcagggctggtgtaaaggaagactggacaatggccaggtgggcctttaccccgccaattatgtcgaagcaatccaatag

SEQ ID NO: 14700 - DNA, 1248 bp, Artificial Sequence
  Description of Artificial Sequence: Synthetic coding sequence
atgatgttgggaccagaaggcggtgagggattcgttgtcaagctcagaggcttgccctggtcttgcagcgttgaagatgttcagaactttctgtcggactgcactatccatgacggcgcagctggagtacactttatttatacacgcgagggccgtcagtccggagaggcatttgtggagctggggtccgaggacgatgtgaaaatggcgttgaaaaaagatcgcgagtccatggggcataggtacattgaggttttcaaatctcatcgtactgagatggactgggtcttgaagcacagtgggccaaatagcgctgacagcgctaacgatgggtttgtgaggctgcgtggactccctttcggatgcaccaaggaagagattgtccaattcttcagtggactagaaatagtgccaaacggtattaccttacctgtggaccctgagggcaagatcactggagaggctttcgttcagtttgcctctcaggagctcgctgagaaagccctcggcaaacataaggagcgcattgggcatcggtacattgaggtcttcaaaagcagccaagaggaggtgcgctcatactccgaccctccacttaagttcatgtcagtgcaacgcccaggaccttacgaccgtcctggcactgcccgccggtacatagggatcgtgaaacaggccggtctagagaggatgcggccgggcgcctactctaccgggtatggggggtacgaagagtatagtggccttagcgatggttatggtttcactactgacctattcggccgtgatctttcttactgcttatctgggatgtacgaccacaggtatggagacagcgaattcacagtgcagagtactacagggcattgcgtacatatgagaggcttgccatataaagctaccgagaatgacatctacaattttttttcaccattgaatcccgtccgcgtgcatatagaaatcggtccagatgggagagtgacaggggaggcagacgtggaattcgccacacacgaggaagccgtggccgccatgtcgaaggatagagccaacatgcagcaccgatatatcgaactattcctcaatagcaccactggtgcaagtaacggagcatattcatcgcaggtcatgcagggtatgggagtgagtgctgcacaggcgacatactcaggattagaatctcagtccgtgagcggttgctatggtgctgggtatagcgggcagaacagtatgggcgggtacgactag

SEQ ID NO: 14701 - DNA, 1770 bp, Artificial Sequence
  Description of Artificial Sequence: Synthetic coding sequence
atgtcagtgtctgttcatgaaaccagaaagtcaaggtcgtctacaggctcaatgaatgttaccttgtttcataaggcttcccaccccgactgcgtgctcgcccatctgaatacactgaggaaacactgcatgtttactgatgtgaccctttgggcaggcgaccgggctttcccctgccacagggctgtgctggcagcttcctcccggtactttgaggccatgtttagccacggactgagggagtccagagatgacacggtgaactttcaggacaacctgcaccccgaggttctggagctcttgctggacttcgcatacagctccaggatcgccatcaatgaggagaacgccgagtccctgctggaagcaggggatatgctgcagttccacgacgtgcgtgacgccgctgctgaattcctagagaaaaacctcttcccctccaactgtctgggtatgatgctcttgtctgacgcccatcagtgccgcagactctatgagttctcctggcgaatgtgtctggttcacttcgagaccgttcgacagtccgaggattttaactccctcagtaaagacactcttctcgatctcatctcaagtgacgagttagagactgaagatgagcgtgttgttttcgaagccatcttacagtgggtcaagcacgacctcgagccgagaaaggtgcatcttcccgagctgctcaggtccgtgaggttagccctgctgccttccgactgcttacaagaagcggtgtcatctgaggcactcctaatggctgacgagagaacaaagttgatcatggacgaggccctgcgatgtaaaacaaggatcctgcagaatgacggagtggttacctccccttgcgcccggcctcgcaaggctggacatacactcctgattttgggcggacagacttttatgtgtgacaagatttatcaggtcgaccataaagctaaggagattattcctaaggccgatctgccctccccccgaaaggaattctccgcaagcgctattggatgtaaagtgtacgttacaggtggacgcggatccgaaaatggggtgagcaaggatgtttgggtctacgataccgttcatgaggaatggtccaaagctgcacctatgctcattgccagatttgggcatggatctgctgaacttgagaactgcctgtacgtggttggcggacatacatctctggctggtgtgtttcctgcatccccctccgtgtctctcaagcaggtggaaaagtacgatcccggagctaataagtggatgatggttgccccgctgcgcgacggggtgtcaaatgccgcagtggtgtcagctaagctgaagttgttcgtatttggggggacaagcatacacagagatatggtgagcaaagtgcagtgctatgatccttctgagaatcgctggactatcaaggcggaatgcccacaaccctggagatatacagccgccgctgttctgggatctcaaatcttcattatggggggtgatacggaattcaccgctgcgtcggcatacaggtttgattgtgaaaccaatcagtggactcgcataggcgatatgaccgctaagcgcatgagttgtcatgccctggcgtcagggaataagttgtatgtggttggaggatactttggcacacagcgctgtaaaacacttgattgttatgaccctacatcagacacatggaattgtattactactgtgccctattctctcatccccacggctttcgtgtccacttggaaacatctgcctgcttag

SEQ ID NO: 14702 - DNA, 1311 bp, Artificial Sequence
  Description of Artificial Sequence: Synthetic coding sequence
atgatgggcgaggcagctgtggctgccgggccttgccctcttcgggaagattccttcacacgtttttcaagccagagcaacgtttacgggctggccggcggggcagggggccgtggagaactgttggccgcaacactcaagggcaaagtgctggggtttcgataccaagacctcaggcaaaagattaggccggtggcgaaagagctccagtttaactatatccctgtagatgccgaaattgtcagcatcgacacgtttaacaaaagtcccccaaagcgcggcctggtggtgggaatcacattcattaaggactccggcgacaagggctcaccgttcttgaatatctattgtgattacgagccaggatctgaatataatttggactcgatcgcacagtcctgtctcaacttggagttgcagtttactccttttcagctttgtcacgccgaagtccaggtgggcgaccagctcgagactgtctttttgctctcaggcaacgatccggctattcacctgtacaaagaaaacgaaggcctgcatcaatttgaggaacagccagtggagaatctttttcctgaattgacgaacctgacctcctccgtgttatggctagacgtgcacaactttcctggcacttcacggcgacttagtgctcttggctgccagtcgggatacgtgcgtgtggctcatgtcgatcaaagatcaagggaagttctgcagatgtggtctgttctgcaggacggccccattagccgagttatcgtgttcagcctcagtgccgctaaagaaactaaagatcgcccactccaagacgagtattctgtgttggtagcctccatgctagaacccgctgtggtgtacagagatctgttaaaccggggcctagaagatcagttgctgttaccaggcagtgaccagtttgacagcgtgctgtgtagcctcgtaacagatgttgatctcgacggccgtccagaggtgctggtcgccacttacggccaggaactcctttgttacaaataccggggcccagaatctggactacccgaagcacaacacggtttccacctgctgtggcagaggtccttctcctcccccttgctggccatggcccatgttgatctaaccggagacggtctgcaggagcttgcggtcgtaagccttaagggtgtacatattctgcagcattccctgattcaggcctccgaactcgtcctgacaaggctgcgacaccaggtcgaacagagaaggcgaaggctgcagggactggaggatggagccggcgctgggcccgcagagaacgccgccagctag

SEQ ID NO: 14703 - DNA, 642 bp, Artificial Sequence
  Description of Artificial Sequence: Synthetic coding sequence
atgcttctgcctttcattaggactctgcccctgctctgctataaccatctgcttgtgtcccctgatagcgccaccctgagcccaccctacagtcttgagaagatgacagacctggttgcggtctgggacgttgccctgtcggatggtgtgcataagattgagttcgagcacggcacaacatccggcaaaagagttgtctacgttgacggtaaggaggaaattcgaaaggaatggatgttcaagctcgtaggaaaggaaactttttacgtaggtgctgctaaaacgaaggccaccattaacatcgatgcaatctctggctttgcctacgaatacactctcgagatcaatggcaagagcctaaaaaaatacatggaagacagaagcaagacaaccaacacatgggttcttcatatggacggagagaactttaggattgtacttgagaaagacgctatggatgtgtggtgcaacggcaaaaagctggagactgccggtgagttcgtcgacgacggtactgaaacccacttctcaatcggcaaccacgattgttacatcaaggcagtctcttccggaaagcgcaaggagggcattatccataccctgatcgtcgataaccgtgagatcccagagatcgctagctag

SEQ ID NO: 14704 - DNA, 663 bp, Artificial Sequence
  Description of Artificial Sequence: Synthetic coding sequence
atgacttcaggtgaggttaagacctccctgaaaaacgcctatagttcagccaaacggttgtcacccaagatggaagaggagggcgaagaggaggactattgtacccccggcgcatttgagttagagcgacttttttggaagggcagccctcaatacacacacgtcaacgaggtttggcccaaactctacataggggacgaggctacggcccttgatcgatataggctgcagaaggcggggttcacccacgtgctgaatgcggctcacggccgttggaacgtagacactggacctgattattatcgcgatatggatatccaataccacggcgtggaggcagatgaccttcccaccttcgacctcagtgtgttcttttaccccgctgccgcgttcatagaccgggcacttagcgacgaccatagtaagatcttggtgcactgtgttatggggagaagcagatctgccaccctggttttggcgtatctcatgattcataaagatatgactctagtggacgctattcaacaggtggctaaaaacagatgcgttctgcccaaccgaggctttcttaaacagctacgcgagctggacaaacagctggtacagcagagaagaagaagccagagacaggacggcgaagaggaagacggccgggagttgtag

SEQ ID NO: 14705 - DNA, 1845 bp, Artificial Sequence
  Description of Artificial Sequence: Synthetic coding sequence
atgtcaccagccgacaggtgccgatccgccaacaccatcgaaccagcgaccacgtcctccttggcattgttcctgctcttacagcgtgatcagagcagtcgtacacggggcctgcctgaggagaaggaagaggtcacaatggatacgagcgaaaaccgcccagagaacgacgtgcctgagcctccaatgcctatcgcagaccaggttagcaacgacgaccgccccgaggggtccgttgaggatgaagaaaaaaaagaaagctccctccccaaatcttttaaacgaaagattagcgttgtcagcgctacaaagggagtgccagccggaaactctgacacggaaggcgggcagccaggccgcaagaggaggtggggtgcgtcgactgccacaacccagaagaaaccatcaataagcatcactaccgagtcccttaagagtctgataccagacattaagccactggccggacaggaggcagttgtcgacctgcacgcagacgattctagaattagcgaggatgaaaccgaaaggaacggcgacgacggtacacacgataaggggctgaagatatgtaggaccgttacccaggtggtgcctgcagaaggacaggagaacggccagagagaagaggaggaggaggagaaagaaccagaggcagaaccccctgtgccaccacaggtgtccgtcgaagtggctctgcccccccccgcggagcacgaagttaaaaaagtgaccctgggggacactcttactaggaggtctattagccaacaaaaaagtggcgtgtctatcacgatagacgatcccgttcggactgcccaggttccgtcccctccccggggcaaaatttcaaatatagtacatattagcaacctggtacgcccttttacgttgggacagctgaaggagctgttgggaagaaccggcactctcgtcgaggaagccttctggatcgacaagattaagtcccattgttttgtgacatactccaccgtggaagaagcagttgccacgagaacagccttacacggcgtcaaatggccgcaatctaatccaaagtttctctgcgccgactacgctgaacaggatgagctggattaccatcgcggcttgctcgtagaccggccctcagaaacgaagacagaagagcaaggcatccctcgaccgcttcacccaccccccccacctcccgttcaacctccacagcacccccgtgccgaacaacgggaacaagaaagggcagtgcgtgaacaatgggccgaacgcgagagggagatggaacgccgtgagaggacccggtcagagagggaatgggacagggataaggtgcgcgaagggcctaggtctcgatctcggagcagagacaggcggaggaaggagagggccaagagcaaagagaagaaatccgaaaagaaagaaaaggctcaagaagaacctcctgcgaaattgctcgacgatctgtttcggaagacaaaggccgctccttgcatctattggctgccattgacagattcacagatagtgcagaaggaagctgaacgggcggagagagctaaagagagggaaaaacgcaggaaagagcaggaggaagaagaacagaaggagagggagaaggaggctgagcgggagaggaaccggcagctggagcgagagaagcggcgcgaacactctcgggagagagacagagagcgggagagagagcgggagcgagaccgtggagaccgagaccgagacagggagagagatcgagaacgaggacgggaacgggaccggcgcgacactaagcgacacagtcgttccaggtcacgctcaaccccagtccgcgaccgggggggacgacgttag

SEQ ID NO: 14706 - DNA, 1203 bp, Artificial Sequence
  Description of Artificial Sequence: Synthetic coding sequence
atgaaaaacgagccactaacacccggctaccatgggtttcctgcacgggattctcagggcaaccaggaacctaccaccacccctgatgccatggttcaaccttttactaccatcccttttccccctcccccacagaatggtatccctaccgaatatggtgtcccacacacacaggactatgcgggacagactggcgaacacaacctgacgttatacggctcaacccaggctcacggcgagcaaagttctaactccccaagtacacagaatggatcgttaacgacagagggcggcgcacaaacagatgggcagcaaagtcaaacacagtccagcgagaactcggaatctaagtccactcctaagaggctgcacgtcagcaacatcccctttcgctttcgagacccagacctccgccaaatgttcgggcagtttgggaagattctggacgttgaaatcatcttcaatgaaaggggtagtaagggctttggattcgtcacttttgagaacagtgccgacgctgatcgcgcgcgggaaaagctgcacggcacggtcgtcgaaggccgcaagattgaagtgaataacgctactgcacgcgtcatgacaaataaaaagatggttaccccctatgcaaacggatggaagctgtcaccggtggttggtgccgtgtatggacctgagctgtacgcagcttccagctttcaggctgacgtgagcctggggaacgatgccgccgttcctctgtccgggcgtggtggcattaatacctacatcccccttatcattccaggctttccctatccaacggctgccaccaccgccgccgcgtttcgaggagcacatttgcgcggccgcgggcggaccgtctacggcgcagtgagggcagtacctcctacagccatacctgcttatccaggcgtggtgtatcaggatggattctacggcgccgacctctatatagaaagcgctaattgtttccgttcaaacagggtggacatgcaacctacagatatgcactctctgctgctccagccccagcccccacttttacaacccctgcaacctctgaccgtgacagtaatggctggatgcacacagcctaccccaacaatgccgctccctctgcccctggctatggagctggcactgtggcgggtttacactgaagttgccactgctgatctgccaccgaccgaggtgacctag

SEQ ID NO: 14707 - DNA, 1545 bp, Artificial Sequence
  Description of Artificial Sequence: Synthetic coding sequence
atggacgaaggcatggaaatctcatctgaggggaacagtctgattaaagctgtgcaccagagtcgtctacgcttgacaagactcctgctcgagggtggagcctacatcaacgagtcaaatgataggggcgagactcctcttatgatagcttgcaagacaaagcatgttgaccaccagtcagtctctaaagccaagatggtcaaatacctactggaaaataacgccgatcctaatattcaggataagagtggaaaaacggccctgatgcacgcttgccttgagaaggcagggcctgaagtcgtgagtctactgttgaagtccggcgcagacttgagcctccaggatcacagcagctactctgccttagtctacgcgatcaacagcgaggataccgagactcttaaagtgctattgtcagcttgcaaggctaaggggaaggaagtgatcataattaccacggccaaattgccgtgtggaaaacataccaccaaacagtatttgaatatgcctcctgtggatatcgatggctgccacagccccgcaacttgcacaacaccgagcgagatcgacattaagacagcctcgagcccgctttctcatagttccgagacagaactgacactatttggctttaaagatttagaactggccggttcaaacgacgatacatgggacccaggaagcccggtacggaaaccagctttagcacccaagggtcctaagcttcctcatgccccgccttgggtgaaatctccccccctgctcatgcaccagaaccgagtagccagccttcaggaggagcttcaagacataacaccagaagaggagttatcatacaaaaccaacggactggccctgtctaagcgttttatcacccggcaccaatccatagacgtaaaggatactgcgcacctcctgcgagcattcgaccaggcgtccagcagaaaaatgtcctacgacgaaatcaactgccaaagttacttgtcagagggtaaccagcagtgtatcgaagtcccagtggatcaggaccccgactcaaaccagactatttttgctagtacactccgctcaatcgtgcagaagagaaatcttggagctaatcactacagttcggacagccaactttcggctggactgaccccaccgaccagcgaagacgggaaggccctcatcggcaagaagaaaattctttcaccatcaccgtcccagctatctgagagcaaagagctgctcgagaatattcccccaggacctctctctagaagaaaccacgccgtccttgaaagaagaggaagcggggcctttcccctggaccatagtgttactcagactagacaagggttcctgccacccctgaacgtcaactctcatcctcctatcagtgatattaatgtgaataataaaatctgtagcctgctgtcatgtgggcagaaagtgctgatgcccaccgttccaatttttcccaaagagtttaagagtaaaaagatgttactgcgtcggcaaagtttgcagacagagcagataaagcagttggtgaacttctag

SEQ ID NO: 14708 - DNA, 1674 bp, Artificial Sequence
  Description of Artificial Sequence: Synthetic coding sequence
atggaccagagcagagttcttctgtgggttaaagctgaaccattcattgtcggagccctgcaggttccccccccctcaaaatttagcctgcactacctgcgcaaaattagcacatacgtccagattcgcgctactgagggtgcataccctagactctactggtcaacatggaggcacatcgcctgcgggaagctgcagctcgccaaagaccttgcctggttgtattttgagatcttcgattcactgtccatgaaaactcccgaagaacgccttgagtggagtgaagtgctatccaattgcatgagcgaggaggaagtcgagaagcagcgcaatcaactgagcgtggacactctgcagttcctgttattcctgtacattcaacaactcaacaaggtctctctcagaacaagcctgattggggaggaatggcccagcccaaggaataaaagccagtcgcctgaccttacagagaagagcaactgccataacaaaaactggaacgactactcccaccaggcgttcgtctacgaccacctctctgatctgctagaactgctgttagatcccaaacagcttacagccagttttcacagcacccatagctctctggtttcacgcgaggcagtagtcgccctgagctttctaatcgaggggaccatcagccgggcaaggaagatataccctctgcacgagctggcactctggcagcccctgcatgcggacagcggctttagcaagatcagtaaaaccttctcgttttacaaactagagacttggctgagaagctgcttgacgggtaacccctttgggacctctgcgtgcctgaagtccgggaagaaactcgcttgggcccaccaggttgagggcaccacaaaacgcgcaaagatcgcttgcaacactcatgtcgcacccaggatgcaccggttagttgttatgtcacaggtgtacaagcagactctggcaaagtcttcagacacgttggccggggcccacgtgaagatccacagatgtaatgagtccttcatctatctgctgagtccgctgcgatctgttactattgaaaagtgtcggaacagcatctttgtgctgggccccgtgggcactacattgcacctgcactcatgtgacaacgtgaaagtcattgcagtgtgccacaggctatcaatcagttccaccactggctgcatcttccacgtgttgaccccaacgcgtcctctaatactctctggcaatcagactgtaactttcgcgccctttcatacccactaccccatgcttgaagatcacatggcccggaccgggctcgccacagtgcccaactattgggataatccgatggtagtttgcagagagaacagtgacacaagagtgttccagctcctgcctccctgtgagttctatgtcttcatcatccctttcgaaatggagggggacactacagaaatccctggaggactgccgtccgtgtatcagaaggccctcggtcagagggaacaaaagattcagatctggcagaagacagttaaagaagctcaccttaccaaagaccagcgcaagcaatttcaggtcctagttgaaaacaagttttatgagtggctgatcaacactggacatcggcagcagcttgacagcttggtgccccccgccgcaggctcaaagcaggcagcaggttag

SEQ ID NO: 14709 - DNA, 648 bp, Artificial Sequence
  Description of Artificial Sequence: Synthetic coding sequence
atggtcttcagaaggtttgtggaggtgggcagggttgcctacgtgtccttcggtccccacgctggtaagctggtggctatcgtggacgtgattgatcagaaccgcgcactcgtcgacgggccttgcacccaggttaggcggcaggctatgccatttaaatgcatgcagttaacagatttcatccttaagttcccccacagcgcccaccaaaaatacgtcaggcaagcctggcagaaagccgatattaacacaaaatgggcggccacccgctgggccaagaagattgaggctagggaaaggaaagctaaaatgacagatttcgatcggtttaaagttatgaaagctaagaagatgagaaatcgcatcatcaagaacgaggtgaagaagcttcaaaaggccgccctgctgaaggcgtcccccaagaaggcaccaggaaccaaaggaaccgccgccgcagccgctgccgcggctgctgctaaagtcccagccaagaagattacagcagctagcaagaaggcacctgcccaaaaggtgccagctcagaaggccacgggacagaaggccgctccagctccgaaggctcagaaaggtcagaaggctccagctcaaaaagcacctgcaccgaaagcctccggaaagaaagcttag

SEQ ID NO: 14710 - DNA, 888 bp, Artificial Sequence
  Description of Artificial Sequence: Synthetic coding sequence
atggagctgatccaggataccagccgtcccccgctggagtacgtcaaaggcgttcctctcattaagtacttcgctgaagccctgggacctcttcagtccttccaggctcggccagatgacctgctgattaatacgtaccctaagtcagggaccacatgggtgagtcagatccttgacatgatttatcagggcggtgacctggaaaagtgcaatagggctccaatctatgtgcgggtcccattcctcgaagtgaacgaccccggtgagccctccggcctggagacattaaaggatacaccccctccacgactgatcaaaagtcacttgccactcgccttgctgccgcagactctcttagatcagaaggtcaaagtggtctacgtagcgaggaaccccaaagatgtggctgtttcttactaccacttccatcggatggagaaggcccacccggaacctggcacatgggattcttttttagaaaagtttatggcaggcgaggtgtcatacggcagttggtaccagcacgtccaggagtggtgggagctaagtagaacccaccccgtactgtatctgttttatgaagatatgaaagagaaccctaagcgtgagatccagaaaatcctagagtttgtaggaaggagccttccagaggaaaccatggatttcatggtacagcacacttcttttaaggagatgaaaaaaaacccgatgactaattacacgacggtccctcaggagctgatggatcacagcatcagcccttttatgcggaagggaatggcaggagattggaaaacaacttttacggttgcacagaatgaaaggttcgatgcggactacgcagagaaaatggccgggtgcagcctctcctttcgctccgagctgtag

SEQ ID NO: 14711 - DNA, 1368 bp, Artificial Sequence
  Description of Artificial Sequence: Synthetic coding sequence
atgagctccctgggcgccagcttcgtccagatcaagtttgacgaccttcagtttttcgaaaactgcggcggaggatccttcggcagtgtatacagggcaaaatggatttcacaggacaaggaagttgctgtgaagaagctgctcaaaatcgaaaaagaggcagaaattcttagtgtgcttagccaccgaaatattatccagttttacggggtgattttggagcctccaaactatggcatagtgaccgaatatgcaagcctcggatcactgtacgactatattaatagcaacagatcagaggagatggatatggaccacatcatgacctgggcaacagacgtggctaagggtatgcattacctgcacatggaggcaccggtgaaggtcattcaccgggatctgaagtccaggaatgttgtgatagccgccgatggtgttctaaaaatttgtgatttcggagcctccagattccacaaccacacaacacacatgagtctcgtggggacttttccgtggatggctcccgaagttatacagagcctcccagtttcagaaacatgcgacacatattcttatggcgtggtgctctgggagatgctgactcgggaggtaccctttaagggtctggaagggcttcaggtggcttggcttgtagtggaaaaaaatgagcgcttaactatcccaagctcttgccctagaagcttcgccgagctgcttcatcagtgttgggaagctgatgctaaaaaacggccgagcttcaagcaaattattagtatcctcgagtcaatgtccaacgatacatctctgcctgataagtgcaattcgttcctgcacaacaaagcagagtggcgctgtgagatcgaagcgactttagagcgcttgaaaaaacttgagcgcgacctttctttcaaggagcaggaactgaaggaaagggaacggcgcttgaaaatgtgggaacagaaactaaccgagcagtcaaatacgccccttttactgccgttggccgctcgcatgagtgaagagtcctactttgagagcaagactgaggagagcaactccgccgagatgagctgtcagatcacagccaccagtaatggggaaggccatggaatgaatccatccctgcaggcgatgatgcttatgggttttggggatattttcagcatgaacaaggccggggcagtcatgcactccgggatgcagattaacatgcaagctaaacaaaactctagcaaaactacttcaaaacggcgcgggaagaaggtcaacatggcactcggattttctgattttgatctgtcagagggggatgatgacgacgatgacgatggggaggaggaggataatgacatggacaacagcgaatag

SEQ ID NO: 14712 - DNA, 423 bp, Artificial Sequence
  Description of Artificial Sequence: Synthetic coding sequence
atgagattccggttctgcggagatcttgactgccccgactgggtgttggccgagatctcaaccctggcaaagatgagcagtgttaagctgcgtctcctttgtagccaagtgcttaaggaacttctcgggcagggtatcgattatgagaagatacttaagctgaccgccgacgctaagttcgaatcaggcgacgtgaaagctactgttgctgtgctgagttttatcctctcttccgccgccaagcactccgtcgacggagagagcttgtcttcggaactacagcaactgggcttgcctaaggaacatgcagcctctctgtgcagatgctatgaagagaagcagagtccattgcagaagcatctgcgagtttgtagcctcagaaagcttaagcaagcgcagaccctgatgagttcactcggatag

SEQ ID NO: 14713 - DNA, 573 bp, Artificial Sequence
  Description of Artificial Sequence: Synthetic coding sequence
atgaccgcctccgccagcagcttctcttccagtcagggcgtgcagcaaccgtccatctactccttttcacaaataactagatctctgttcctgtccaacggcgtagccgcgaacgataaactcctgctctcatctaatcgaattacagccattgtcaatgcaagtgtggaggtagtcaacgtcttcttcgagggtatccagtacattaaagttccagtgaccgacgctagagatagccgattgtatgacttctttgaccccattgcggacctgattcataccatagacatgaggcagggacggactctccttcactgcatggccggtgtcagcagaagcgcaagcctgtgcttagcctatttgatgaagtatcactcaatgtctttgctggacgctcatacttggactaaaagcaggaggcctatcattaggccgaataacggattctgggaacagctgatcaattatgagttcaagctctttaataataataccgtcaggatgattaacagtcccgtcggcaatataccagatatatatgaaaaggacctgcgcatgatgatatcaatgtag

SEQ ID NO: 14714 - DNA, 3576 bp, Artificial Sequence
  Description of Artificial Sequence: Synthetic coding sequence
atgcttagaaagctgacaatcgagcagatcaacgattggttcaccatcggtaagactgtgaccaacgtcgagctgctgggagcaccaccagctttcccggccggcgctgcccgggaggaggtacagcgtcaggacgtagctccaggggccggaccagcagctcaagcacctgccctggcacaagcaccagctagacctgcggccgcctttgagagaagcctttcacagcgaagctctgaagtggagtacattaataagtatcggcagttggaagctcaagagctggatgtttgccgctccgttcagcctacctccggtcctggtcctagaccgagtcttgccaagttgtcctccgtgacttgcattcctggcacaacctataagtaccctgatttgcctatcagtcgctacaaagaggaggtggtgtctttgattgagagcaacagtgtggtcatcatacacggggctaccggcagtggtaaaagcacacagcttcctcagtacatcctggatcactacgtgcaacgcagtgcgtactgttctatcgtagtaacacagccacggaagattggcgcatcctccatagctagatggatctctaaggagagagcttggacactcgggggggttgtgggataccaggtggggcttgagaagatcgctaccgaggacacccgcttgatttacatgaccactggcgttttattgcaaaaaatagtgtccgccaagagtctcatggagtttactcacatcataatcgatgaagtgcatgaaaggactgaagaaatggattttttgttactagtagtcagaaagctgctgcgtactaatagccgctttgtgaaagtcgtcttgatgtccgctaccatttcctgtaaggaattcgctgactatttcgccgtgccagtgcagaacaaaatgaaccctgcatatatctttgaagttgaaggaaagccgcattcggtcgaagagtattatctgaatgacctggaacatatccaccactccaagctctccccgcacctcctcgaggagcctgtcatcactaaggatatctacgaggtggctgttagcctcatacagatgttcgacgacctggacatgaaggagagcggaaataaggcctggagcggggcccagttcgtactggaacggtcatctgtgttggtgttcctgcctggactgggagaaattaattatatgcacgagctccttacatctcttgttcacaagaggttacaggtctaccccctgcacagctccgtggctttggaggaacaaaataacgtgtttctctcacctgttcccggatacaggaagattatcctttcaacaaatatagccgagtcttcagttacagtgcctgacgttaagtacgtcatcgatttttgcttaaccagaacattagtgtgcgacgaggacacaaattaccagagtctcaggctgtcatgggcctcaaagacatcttgcaaccagaggaaggggagggctgggagagtgagcagaggatactgttatcgactggtgcataaggatttttgggataattcaatcccggaccacgtggtgccagagatgctccgatgtccactgggctctaccatactgaaagtcaagctgctagatatgggtgagccccgcgctctcctcgccacagctctgagccctccgggtctgtccgatattgaacgcacaattctgttgctgaaggaagtgggcgcgctggctgtgtctggtcagcgcgaggacgaaaatccgcacgacggggagctgacattcttgggtcgtgtgttggcccaattgcccgtgaatcagcagctggggaagctcatcgttcttggacacgtcttcggctgcctggatgagtgtctcattattgcagctgccctcagccttaagaatttctttgctatgcctttccggcaacacctggacggctaccgcaacaaagtgaacttctcaggttcatctaaatctgactgcatcgcccttgttgaggcgtttaagacatggaaggcttgtcgccagaccggtgaactccggtacccaaaggatgaattgaattggggacgactgaactatatccaaattaaacgcatccgagaagtggccgagttatacgaggagctcaagacccgtatttctcagttcaatatgcatgtggattcgcgccgaccggtgatggatcaggagtacatatataagcagaggttcatcttacaggtggtgttggcaggtgccttttacccgaattattttacctttgggcaaccggatgaggagatggcagtccgtgaactggcgggcaaggaccccaaaacaacagtggtacttaaacacatccccccctatggctttctgtactacaaacagttgcagtccctgtttaggcaatgcggtcaggtaaagtccattgtgttcgacggcgccaaggcgttcgttgagttctccaggaatccgacagaacgatttaagaccctacccgccgtgtacatggccatcaagatgtctcagttaaaggtttctttggagttgagtgtccacagcgccgaggagatcgaaggaaaagttcaggggatgaatgtgagtaaattgcggaacactagggtgaacgtggattttcagaagcagactgtcgaccctatgcaggtctcttttaacacttccgacaggtcccagaccgtgacggatctgctgttgactattgatgtcacagaagtcgtggaagtgggccatttctggggttaccgcatcgatgaaaacaacagcgagattcttaaaaagctgacagccgagatcaaccaactaacattagtacccctgcccacacatcctcatccagacttagtctgcctagctccattcgccgactttgacaagcagcgctacttccgcgcgcaagtgctgtacgtgtccggcaattctgccgaggtattctttgttgactatgggaataaatctcatgtggatttacacctcctgatggaaataccatgccagttcctggagctgccctttcaggcactggaatttaaaatttgcaaaatgcgacccagcgccaagtccttggtgtgtggaaaacactggagcgacggcgcctcacagtggttcgcttccctggtgtcaggctgtacactgcttgtcaaggtctttagtgtggtacacagcgtcctacatgtggatgtgtatcaatactccggtgtgcaggacgccatcaacattagagacgtgctaatccagcagggatatgccgaattaaccgaagagtcctacgaatctaaagttaacattctcagagctgctatcaacaaactcgtttgtgatggaccgaatggctgtaaatgtctgggacctgagagagtggcccagttacaggacatcgcccggcagaagctgttaggacttttctgtcaatcaaagcctagagaaaagatagtccctaaatggcatgagaagccctatgagtggaaccaggtagatccaaagctggttatggaacaggcagacagggagtcatcccgtggaaaaaacactttcctttaccagttgcataaactggtagtcctgggcacctag

SEQ ID NO: 14715 - DNA, 906 bp, Artificial Sequence
  Description of Artificial Sequence: Synthetic coding sequence
atgaccagacacggaaaaaattgtacagccggagcggtgtacacataccacgaaaaaaaaaaagacaccgctgccagtggctacggcacccaaaacatcagactctcacgggatgctgttaaagactttgattgctgctgcttaagcctccagccctgtcatgaccccgttgtgacccccgacgggtatctctatgagagagaagccatacttgagtatatcttgcatcagaagaaagagatcgcaagacagatgaaagcctatgagaaacagaggggcacccgtcgcgaggaacagaaggaactccagcgggctgcctctcaggaccacgttcggggtttcctggaaaaggaaagtgctatcgtttctcgccccctcaacccgttcacagctaaagccctttcaggaacttccccagatgacgtgcagcccgggccctccgtcggccctccttccaaagacaaggacaaagtgctgcccagcttctggattcctagtctgactcccgaggcaaaagcaacaaaactggaaaagccctccaggacagttacgtgccctatgtcggggaagccattgcgcatgagcgacctcacgcccgtgcactttacccctctggacagctctgtggacagagtcggtctgataacacgatcagaacggtatgtgtgtgcagtgacacgcgactctctgtccaacgcgacaccgtgcgccgttctgcgtcctagtggggcggtcgtgaccctcgagtgcgtggaaaaactgattaggaaggatatggtcgaccccgttactggcgacaagctgacggaccgcgacatcatcgttcttcagaggggtggaactggcttcgctggaagtggggtgaagctccaggccgagaaaagtaggccagtgatgcaggcctag

SEQ ID NO: 14716 - DNA, 1509 bp, Artificial Sequence
  Description of Artificial Sequence: Synthetic coding sequence
atgcagtcatgtgaatcgtccggcgattccgctgacgatcccttatcacgcggattacggcggcgaggtcaaccaagagtagtcgttatcggcgctgggctagctggcttagcagctgccaaagcgctcctcgaacaaggctttacagacgtgaccgttctcgaggccagctctcacatcggaggcagagtgcaatcggtcaagctcggccacgcgaccttcgagctcggtgccacatggatccatgggagtcacggcaatcccatttatcacctggcggaggcaaatgggctgctggaggagactaccgatggcgagcgttccgtcggccgtataagcctctactctaaaaatggtgtggcctgttacttgactaaccatggccgtcggataccaaaagatgtggtggaggagttttctgatttgtataacgaggtatataacctgacacaggagttcttcaggcatgataagcccgtcaacgccgagtcacagaactctgttggcgtgtttacgcgagaagaggtgaggaatcgcataagaaatgaccccgatgatcctgaagccaccaagcgcctgaagctcgccatgattcagcagtacttgaaagtggagtcttgtgagtccagtagccactctatggacgaggtgtctctgtccgcttttggggaatggaccgaaatccctggtgctcatcacatcatccccagcggattcatgagggttgtggagcttctggccgaggggatacccgcacacgtgatacagctggggaaaccagtcagatgtatccactgggatcaggcatccgcccgccccagggggcccgagattgagcctaggggagtgttaaaaagacagtacacctccttcttccggccaggcttacctacggagaaggtcgccgcgattcatcgcttgggcattgggactaccgataagatcttcctggaattcgaggagccattctggggcccagaatgtaactcattgcaattcgtctgggaagatgaagctgaatcacacactctgacctacccaccagagctgtggtataggaaaatatgtggctttgatgtcctttatccccctgagcggtacggtcacgtcctgtccggttggatatgtggcgaggaggctctggtcatggaaaaatgtgacgatgaggctgttgcagaaatatgcacagagatgttgagacagttcaccggaaaccccaacatccctaaaccccggcgaattttgaggtcggcatggggctctaatccttacttccgtggaagctatagctacacccaggtgggaagcagtggtgctgatgtggagaagttagctaaacctctgccttatacagagagttcaaagactgcgcctatgcaggtactgtttagcggcgaagctactcacagaaaatactatagcacaacccatggagccctccttagcggtcagcgagaggccgccagactgatagaaatgtatcgtgacctcttccagcaaggaacgtag

SEQ ID NO: 14717 - DNA, 579 bp, Artificial Sequence
  Description of Artificial Sequence: Synthetic coding sequence
atggggactttcgatctttggactgattacctcggtctggcgcacttggtgagagctctcagtggcaaagaggggcccgagacgaggttgtctccacagccagagcctgagcccatgctggagcctgtgagcgccctcgagcctatgccggcgcctgagtcagtgcccgtgccaggacccaaagatcaaaagaggagcctggaatcaagtcccgctcctgagaggttgtgtagcttctgtaaacataacggagaatctagggccatatatcagagtcacgtcctgaaagacgaggcgggaagagtactctgccctatactcagagattacgtctgtcctcagtgtggggcgacgcgggaacgggcacacacgagaagattttgtcctttgacaggccaggggtacacttcagtgtactcccatactaccagaaatagcgcgggcaaaaaattagtacgacctgacaaggctaagacccaggacaccgggcaccgtcgcgggggcggcggcggggcaggcttccggggggcaggaaaaagcgaacctagtccaagctgcagcccctctatgtccacctag

SEQ ID NO: 14718 - DNA, 2568 bp, Artificial Sequence
  Description of Artificial Sequence: Synthetic coding sequence
atggccgttgaagacagtaccttgcaggtagtcgtccgagtccggccacctacacctagggaactagatagtcagcggcggccagtggtccaggttgtggatgagcgagtgctggtgtttaatccagaagagccagacggaggtttcccgggactgaagtggggggggacccacgacggtcccaagaaaaagggaaaagaccttacattcgttttcgatcgagtcttcggagaagcagcaactcagcaggacgttttccagcatacgacacatagcgttctggactcctttctccaagggtataactgtagtgtcttcgcctatggagccaccggagcggggaaaacacataccatgcttgggagagagggggacccagggattatgtacctgactaccgttgagctctacaggcgcctggaagcccggcagcaggagaagcacttcgaggtgttaatctcataccaggaggtgtacaatgagcaaattcatgatctccttgagcccaagggacctctggctattagagaggatccagacaagggggtagtggtacaaggcctttcttttcaccaaccggctagcgccgagcagctgctagaaattctcacccgcggcaaccggaacaggactcagcatcctacagacgctaacgctacatctagcagaagccatgcaatcttccagatttttgtgaaacaacaagatcgagtgcctggcttgacccaggctgtccaagtggccaaaatgagcctcatagacttggccggctccgagcgcgccagttcgacccatgcaaaaggtgagcggctcagagagggcgctaacattaatcgaagcctactcgcgctgatcaatgttctgaacgcactcgctgacgctaaaggccgcaaaacccatgttccatatagggactccaaactgacccgcctgcttaaagattctctaggcggaaattgccggaccgtcatgatcgccgccattagcccctcctctcttacctacgaggacacatacaatacgctaaaatacgccgaccgcgccaaagagatcagactcagtttaaagagtaatgtcaccagcctggactgccacatttcccagtacgctacaatctgtcaacaactccaagctgaagtggccgcactgagaaagaagctgcaggtttatgaaggcggggggcagccacctcctcaagatcttcccggtagcccaaagtctggtccacctccagaacatctgcccagtagcccactacccccccaccccccaagccagccttgcacaccagagttaccagcaggaccacgagctttgcaagaagagtcactgggtatggaagctcaggtggagagagctatggagggtaattcgtccgaccaggagcagagccccgaagacgaggatgagggccccgctgaggaggtgcctacacagatgcccgagcagaacccaacccatgccctgcctgaatcacctaggctcactctccagccgaagcccgtagtggggcattttagtgctcgggaactggacggggacagaagtaagcagctggcgcttaaagtactttgtgttgcccaaagacagtacagccttctgcaggcagccaatctcctcacacccgacatgattactgagtttgaaactttgcagcaactggtgcaggaggaaaagatcgagccaggggccgaggcacttaggaccagtggtctggcgaggggggctcctctcgcacaggaactatgttcagaatccaagccccccggatatacagggccagtgacgcggaccatggctaggcgactctctgggcccctgcacacgctcggcattccacccggacccaactgtaccccagcacagggcagtcgctggcctatggagaagaagcgaaggagaccttctgcattagaggccgacagtcccatggcgccaaagcggggtacaaagcgtcagcgccagagctttctgccctgtctacgaaggggttccctgcccgatacgcagccctcccaggggccctcaacaccgaagggagagcgggccagcagcccctgccacagcccccgggtgtgccctgctactgtgatcaagagcagagtccctctgggcccgagcgccatgcaaaactgttctaccccattggctctccccactagagacctcaacgctacgttcgatttgtccgaggaacccccatccaagccgagcttccacgaatgtatcggctgggacaagattccccaggagctgtctcgcctggatcagccattcatccctagagctcccgttcctctgttcacgatgaagggccccaagccaacctcctctcttccaggtacatcagcatgcaaaaaaaaacgcgtcgcctcctcatccgtttcacacggcaggtcccggatcgccaggctgccgagcagcactttaaagagaccggctggcccgcttgtcctgcccgaattacccctaagccccctctgccccagcaaccgacggaatggcaaagatctgatccgcgtggggcgcgctctgagtgcaggaaatggagtaactaaggttagctag

SEQ ID NO: 14719 - DNA, 444 bp, Artificial Sequence
  Description of Artificial Sequence: Synthetic coding sequence
atgtggaaatttccaggggggctgagcgagcctgaagaagacattggcgataccgccgtccgagaggtgttcgaggaaaccgggatcaagtctgagtttcgcagtgtgctatcaattcgccagcagcataccaacccaggtgcatttggaaagtctgatatgtatatcatctgtcgactgaagccatattcgttcacaattaacttctgccaggaggagtgcttgcggtgtgaatggatggacctcaatgacttggccaaaacagaaaacacaacacctattacctccagagtagcgcgtctgctgctctacggttacagggaagggttcgataaaatcgatctgaccgtggaggagctccccgctgtgtatacggggcttttttataagctttaccataaggaattgcccgagaattacaaaacaatgaaaggcattgactag

SEQ ID NO: 14720 - DNA, 3327 bp, Artificial Sequence
  Description of Artificial Sequence: Synthetic coding sequence
atggctcttagacccggagcagggtccggtggcggtggtgcagcaggtgcaggcgctgggagcgcagggggaggtggatttatgtttccggtcgcaggcggtattcgccctccccaagccgggctgatgcccatgcagcagcaaggtttcccaatggtgagcgtcatgcagcctaatatgcagggcataatggggatgaactactccagccagatgtcacagggaccaattgctatgcaagcaggaattcctatgggtcccatgccggccgccgggatgccctaccttggacaggcccctttcctgggaatgagaccacctggaccccaatacactccagatatgcagaagcagtttgccgaggagcagcagaaaaggtttgaacagcaacagaaattgctcgaagaggaacggaaacgacgccagtttgaggagcagaagcagaagctgcgcctgctaagcagcgtcaagcctaaaaccggagaaaagagcagggatgacgccctcgaggccatcaagggaaacctggacggattttcaagagacgcaaagatgcatcctaccccagctagccaccccaaaaaaccaggtgtcggtgttttcccatcacaagatccagctcagcccaggatgccgccttggatttacaacgaatcacttgtgccagacgcctataaaaaaatcctcgaaacaaccatgactccaaccgggattgataccgctaagctctaccctattctgatgtcgagtggtttacccagggagactttgggacagatatgggctctggcaaatagaactacccctggaaaactgaccaaggaggagctgtacacagttttagctatgatagctgtcacacaggtggttaagcccgaggaagacgatttccaagacttccaggacgcatccaaatcaggttccttggacgacagcttttcagatttccaggaattgccagcctcgagcaagacgagcaactcacagcacggcaattccgctccatcccttctaatgccactcccaggtacaaaagctctgcctagtatggataagtacgccgtgttcaaaggcattgccgcagacaagagcagcgagaataccgttccccctggagatccaggtgacaaatattcagcatttcgagaactcgaacagactgcagagaataagccactgggtgagagttttgcagagttcagaagcgcagggacagacgatggattcacagacttcaagacagccgactccgtttctcctttggagcctccaaccaaggacaaaactttccctccaagtttcccgtccggcaccatccaacagaaacagcagacacaggtcaagaacccgctcaacctggccgacttagatatgttcagctcggtcaactgttcaagtgagaagccgttatcattctcagccgttttctcaacaagtaaatcagtttcaacaccacagtcgacgggatccgccgctacgatgactgcattagctgccacaaagactagcagcctggccgacgacttcggcgagttttctctctttggagagtactccgggctggctcccgtgggcgagcaagacgacttcgcggactttatggccttctccaattcatcaatcagtagcgagcagaagcccgacgataaatacgatgccctcaaggaggaggccagtcctgtccctctgacatcgaacgttggaagcacagtcaaggggggtcagaattccacagcggcaagcactaagtacgacgtttttcgccaactaagcttggaagggtctgggctgggagtggaggatctgaaggataataccccatctggtaaaagcgatgacgactttgctgactttcacagcagcaaattttcctcaattaactccgataagtctttgggagagaaggcggtggccttccgtcacaccaaagaggactccgcttccgttaaaagtctcgatctccctagcattgggggaagctccgtcggtaaagaggatagcgaagacgcgctcagtgtgcagtttgatatgaagctggctgacgtcggcggcgacctcaagcatgttatgtcagacagtagtctcgacctcccaaccgtcagtgggcagcatccaccagcagctgccggctctggatctccctccgccacctcaattttacagaaaaaggagacatcctttgggtcaagtgagaatatcactatgacaagtctcagcaaagtcacgacattcgtatccgaggatgctttgcctgagacaacgtttcctgcactcgcgagcttcaaagatacaattccgcagacgtctgagcagaaggagtacgaaaacagggactataaggatttcaccaaacaagaccttccaacggccgagagatcccaagaggcaacgtgtccaagccctgccagttcaggggctagtcaggaaactcctaatgaatgctctgacgactttggcgaattccagtccgagaaaccaaaaatcagtaaattcgactttctggttgccactagccagagcaaaatgaagagtagcgaggagatgataaaaagcgagctggccactttcgaccttagtgtccagggcagccataaacgcagtttaagcctgggggacaaggagatttctaggtccagtccctctcctgctctcgagcagccctttcgggatcggtccaatacactcaacgaaaagcccgcattgccagtcatccgagataagtacaaagacctgaccggagaggtcgaggagaatgaacggtacgcttatgaatggcaacggtgcttagggagtgccctcaacgtcattaagaaagcaaatgatactttaaacggaatttcgtcctccagcgtatgtacggaagtcatccagagtgcccagggaatggagtacctgctgggagtcgtcgaagtttaccgcgtcacaaagagggtcgaacttgggattaaggccactgccgtttgctctgaaaagttgcagcagctgttgaaagatattgacaaggtgtggaataacttgatcgggtttatgagcctggccacgcttactcctgatgagaatagccttgatttttcttcttgtatgttgcgcccagggataaagaacgcccaggagcttgcttgcggcgtctgtctgttgaacgtcgactctcgcagccgcaaagaggagaagcccgccgaagagcatcccaagaaggcattcaattccgagacggattcatttaagctggcatatgggggtcaccagtatcatgctagttgtgccaatttttggatcaactgtgtggagcctaaacctccaggcctcgtgcttcccgatctactgtag

SEQ ID NO: 14721 - DNA, 1257 bp, Artificial Sequence
  Description of Artificial Sequence: Synthetic coding sequence
atggaaactcacatcagttgcctattccctgaacttctcgccatgatcttcggctacttagacgtgcgtgataaagggcgcgccgcacaagtttgtaccgcttggcgggacgcagcttaccataagtccgtgtggcgcggcgttgaggcaaaactccatctgcgcagagccaatccaagcttatttccttctctgcaagcccgcggaattagacgtgttcagatcctgagcctccgcagatccctcagctatgtgattcagggaatggctaacatcgagtctttaaatctgagtggttgctataacctaacggataatggcctgggtcatgcatttgtgcaagagataggcagtctccgggcccttaacctgagtctgtgcaaacagattaccgatagttctctaggacgaatcgcgcagtatctcaaagggctcgaggtgcttgagctcggtggctgctccaacataacaaacaccgggctcctgctaatcgcttggggcctccagcggctcaaatccctcaaccttagatcttgtcgacacctatcggacgtggggatcggccatctggccggcatgacaaggtcagccgcagagggttgcctggggctagagcagctgactctccaagactgtcagaaactgactgatctttccctgaagcatatcagccgaggcctcactggtctgcggcttttgaacctgtctttttgtgggggaataagcgatgccgggctgctccacttgagccatatgggatctcttagatcactcaaccttcggagctgtgataacatctcagatacaggaataatgcacttagctatgggctcattgcgcttgtccggtctcgatgtttctttttgcgataaagttggcgatcagtcgttggcatatatagcccaagggctggatggcctcaaatcactatctctttgctcctgtcacatatcagacgatggaattaataggatggtacgtcagatgcatggtttgaggacgcttaatatcgggcaatgtgttagaataacagacaagggactggagcttatcgctgaacacctatcccaattgactggcatagatctctacggttgcacccgtatcaccaaacgcggcttggaacgaattactcaattaccttgcttgaaggtgctcaacctgggattgtggcagatgactgattctgagaaggaagctcgtggagatttcagtcctctttttaccgtgagaactagaggatctagccgcaggtag

SEQ ID NO: 14722 - DNA, 1371 bp, Artificial Sequence
  Description of Artificial Sequence: Synthetic coding sequence
atggccgcagcccttaagtgtctgcttactctcgggcgctggtgtccagggctgggggttgccccccaagctagagctctggcggctctggtgccgggggtgacacaggtggacaacaaatctggattcctgcagaaacgacctcacagacagcaccccgggatcctcaaattgcctcacgtgcgtctgcctcaagcactggccaatggcgcccaactgttgctgcttggctccgccgggcctaccatggaaaaccaggtgcagacacttacttcatacttgtggtcacggcatctgccggtggagcccgaggaacttcagaggcgagcgcgtcatctcgaaaagaagtttctggaaaaccctgacctgagtcaaaccgaggagaagttacgtggtgcagtcctgcatgcgctcagaaagactacataccattggcaagagctttcctatacagagggcctgtccctcgtttatatggccgcacgcctcgatgggggatttgcagctgtaagtcgcgcgtttcacgaaatacgggcacggaatcctgccttccaaccgcaaactctcatggacttcggatctggcaccggctcagtcacctgggcagctcactccatttgggggcagtccctgagggaatacatgtgtgttgatagatccgccgctatgctcgtgctggccgagaaactacttaaaggtggcagcgaatccggggagccctatatacctggggtcttttttaggcagttcctcccggtaagcccaaaggttcagtttgatgtcgtggtgtcagcgttcagcctctccgaactgccctctaaggccgatcggactgaagtggttcagacactctggcggaaaacaggacatttcctggtgcttgtggagaacgggactaaagctggtcatagtctcctgatggacgcgagggacctcgttctgaaagggaaagaaaaatcgcctctcgacccaaggcctggcttcgtgtttgctccttgtcctcacgagctgccatgcccacagctgactaacttggcatgctctttcagccaggcttaccatcctatcccatttagctggaataaaaagccgaaggaagaaaagttttctatggtcattctggccagagggagcccagaggaagcacatcgatggcctcggattactcagccggtcctaaaaaggccccggcacgtgcattgtcacttgtgttgcccagatggtcatatgcagcatgctgttttaaccgccagaagacacggacgggacttgtacagatgcgctagggtgtcctcctggggcgacctgctgcctgtccttacacctagcgctttccctccatcaactgcacaagatcccagcgagagttag

SEQ ID NO: 14723 - DNA, 756 bp, Artificial Sequence
  Description of Artificial Sequence: Synthetic coding sequence
atggacatgaagcggcgtattcatcttgaactgcgtaaccggacgcccgctgctgtgcgcgagctagtgctcgacaattgtaaatctaacgacggaaagattgagggactcacagctgaatttgtcaatctcgaattcctttcactcattaatgtgggccttatttctgtgtctaatttacccaagctgcccaaattgaagaagctcgagctgtcagaaaaccgcatcttcggcgggctcgacatgctggcagaaaaattgcctaatttgactcatctcaacttgtccggcaacaagctcaaggacatctctacacttgaacccttgaagaagctggaatgcttgaaatccctggaccttttcaattgcgaagtgactaatctgaatgattaccgggaatccgtctttaaattactcccccagctcacctatttagatggttacgacagggaagaccaggaagcacccgatagtgacgcagaggttgacggtgtggatgaagaggaagaagatgaggaaggagaagatgaagaggacgaggacgatgaggatggcgaggaagaagaattcgatgaggaggatgatgaggacgaggacgtagaaggcgatgaggacgacgatgaggtgagtgaggaagaggaagagtttggtcttgatgaggaggacgaagatgaggatgaggatgaggaggaagaagaaggcggcaagggcgagaaacgcaaaagagaaacggacgacgaaggcgaggacgattag

SEQ ID NO: 14724 - DNA, 510 bp, Artificial Sequence
  Description of Artificial Sequence: Synthetic coding sequence
atgtctgcaccccctgcgctgcagattcgagaagctaacgcgcaccttgccgccgtgcacagacgagcggcagaattggaggccaggctggacgcggcagaaaggacagtgcatgcccaagccgaaaggctggctctacatgatcagcagctgcgcgccgctctggacgagcttggcagggccaaagacagagagattgccaccctacaggagcagttgatgacaagcgaggcaactgtgcactcactgcaggccaccgtgcaccagcgagatgaactcattcgccagttgcagccccgggctgaacttttgcaggacatctgtcggcgccgaccgccacttgccggtctactcgacgccctcgcagaggccgaacgcttgggaccgctcccagcatcagatccagggcaccctccacccggcggtccgggccccccgctcgacaactcaacaggggaggaggcagaccgtgaccacctccagccagccgtattcggcacgaccgtgtag

SEQ ID NO: 14725 - DNA, 2079 bp, Artificial Sequence
  Description of Artificial Sequence: Synthetic coding sequence
atgaaaatcttctgctcacgcgccaatccaacaactggatccgtagaatggctggaggaggatgaacactacgattaccatcaagagatcgcccgtagctcctatgctgacatgttgcacgataaagacaggaacgtgaagtattatcagggtataagggctgcagtgtctagggtcaaggaccgcgggcagaaggccttggtgctcgacatcggcactggcactggcctgctgagtatgatggccgtaactgcaggcgccgacttctgttatgccattgaggttttcaaacctatggcagatgccgctgtcaaaatcgtcgaaaaaaatggattctcggataaaataaaggtgataaacaaacacagcaccgaggttactgtcggcccggagggtgacatgccctgccgcgctaatattttggtcaccgagttattcgacaccgagttgatcggcgaaggggctctgccgtcttacgaacacgcacacaggcatctcgtggaagaaaattgcgaggcagttcctcaccgggcgacagtatacgcccagctggtagaatctggtcgcatgtggtcttggaacaaactgtttcctatacatgtgcagacaagccttggagagcaggtcattgttcctcccgtagacgtcgaatcctgccctggcgctcccagtgtctgtgacattcagcttaatcaggtcagccccgctgacttcaccgtgctcagcgacgtgctcccaatgttttcaatcgattttagcaaacaggttagttcaagtgcagcatgtcattctaggagattcgaacccttaacaagcggacgcgcccaggtggtgctctcgtggtgggacatagagatggatcctgaaggaaaaatcaaatgtactatggcgcctttctgggcccattccgatcccgaagaaatgcagtggcgggaccactggatgcagtgtgtgtatttcctgccccaggaagagcctgtggtgcaaggctctgccctgtatttggtagctcaccacgacgattactgtgtgtggtatagcctgcagcgaacctcccccgagaagaatgagcgagtgaggcagatgcgccccgtgtgtgattgtcaggcacatctgctttggaaccgaccacggtttggcgagatcaatgaccaggatcgtactgatcgatacgttcaggcactgcgcacagtcttaaaacccgacagtgtgtgcctttgtgtaagtgacggctctttattatccgtcctagctcaccatctaggcgttgagcaggtattcactgttgagagctccgccgccagccataagctccttcgaaagattttcaaagccaatcacctggaggataagattaatataattgagaagcgcccagaattactcaccaacgaagacctccagggacgcaaagtcagcttactacttggggagccatttttcaccaccagcctccttccgtggcacaatctgtatttttggtacgtaaggacagcagttgaccagcaccttggtcccggcgccatggtgatgccccaggccgcttcattacacgctgtagttgttgagttccgcgatctgtggcgcattagatcaccttgcggcgattgcgaaggatttgatgttcacataatggacgacatgattaaaagagcgctagacttcagagaatcacgcgaagccgagcctcacccactttgggaatatccttgccgctctctgtccgagccatggcagattttgacatttgacttccagcagcctgtgccgttgcaaccactgtgtgcagaaggaacagtagagctaaggcgaccaggccagtctcacgccgccgttttatggatggaataccatctgactcctgaatgcaccctttcaactggattgttagaacctgcagatccggaggggggatgctgctggaatccacattgcaagcaggccgtttatttttttagccctgctcccgacccccgcgcactgctgggtggtcctagaaccgtgagctacgcagtggagttccacccagacactggcgatattatcatggagttccgacatgctgacacccccgactag

SEQ ID NO: 14726 - DNA, 468 bp, Artificial Sequence
  Description of Artificial Sequence: Synthetic coding sequence
atgaccgtcgaagggccgccccctaaagacacagggattgcccgcgtccctcttgctggagctgctggcggcccaggcattggcagggcagccggcaggggcattccagccggcgtgcccatgccacaagcccccgcaggactcgcaggacccgttcggggcgtggggggcccctcccaacaagtgatgacaccccagggtagaggcaccgttgcagctgcagcggccgcggccactgcatcaattgcaggcgctcccactcaatatccaccagggagagggggtcctccgccacctatgggccgcggagcacccccacctggcatgatggggcctcctcctggaatgaggcccccaatgggacccccgatgggtattccgccaggaagggggacccccatgggcatgccgccacccgggatgagaccaccaccgcccgggatgcgtggaaaatgcctgcaatggtag

SEQ ID NO: 14727 - DNA, 402 bp, Artificial Sequence
  Description of Artificial Sequence: Synthetic coding sequence
atgacaagaggaaatcagcgcgagctggccagacagaagaacatgaaaaaacagtcagatagtgtgaagggcaagcgtagagacgatggcctgtctgcagctgcccggaaacagtcagctccaagctcgcttccccctgggaccagacgcagctgttcaagaagcagaaagcgtcagactcgaaggcgccggaatccctcgagcttcgtggcaagctgcccgaccttgttaccatttgcttgtgtgccaggagcttcaccaacaacactcgctttcccacccgtagtcctgactgggccgagcactgatggtattccctttgccctttctctacagcgcgtgccattcgtcctaccatcacctcaggtggctagcctacctctgggacactcacgcgggtag

SEQ ID NO: 14728 - DNA, 1809 bp, Artificial Sequence
  Description of Artificial Sequence: Synthetic coding sequence
atggccgagttccgtgtgagggtcagtacaggcgaggccttcggagctggtacctgggataaagtgtcagtgagcatcgtcggtactaggggagaaagcccgcctctcccgttagataatctggggaaggagtttactgcgggtgcggaagaagacttccaggtcaccctccctgaagacgtcgggagagtattgctgctgagggtgcacaaggcgcccccggtgctgcccctgcttggaccccttgctcctgatgcctggttctgcaggtggttccaactcaccccgccgagaggcggccatctgcttttcccctgttatcagtggctggaaggagccggtacactggtgttacaagagggcaccgctaaggtgtcctgggctgatcaccacccagtgctgcagcagcagaggcaggaagagttgcaggcccggcaagagatgtaccagtggaaagcctacaatcctggttggccacactgtctggacgagaagactgttgaggatcttgagctgaatatcaagtattcgacggctaagaacgcaaacttctatttgcaggccggcagcgccttcgctgaaatgaagatcaaggggctgctggatagaaagggactgtggcgatctcttaacgaaatgaaaaggatattcaactttcggcgtacccctgcggccgagcacgcgttcgaacattggcaggaggatgccttctttgccagccagttcctgaacgggctcaacccagttcttattaggcgttgtcactatctgccaaagaattttccggtaaccgacgccatggtggccagcgtgttgggtccaggtacctcgttgcaggcagaactggaaaaggggtctctcttcttagtcgaccatgggatcctaagcggtattcagaccaacgtgatcaatggaaaaccccagttctctgccgcccccatgacactgttgtaccagtccccgggatgcggacctctgctgcccctcgcaatccagctttcacagacgcccggccctaactcccctatcttccttccaaccgacgacaaatgggactggctactcgcaaagacctgggtgcgcaatgccgagttttcttttcacgaagcactgactcacctgttgcatagccacctgctccccgaagtcttcactttggctactcttcgccagctgcctcactgccaccctctgtttaagtctactggcatcggaatcgaaggattctctgaacttatccagcggaatatgaaacagcttaattacagtctgctgtgtctaccggaagacattcgcacgcggggcgtggaggatatacccggctactactatcgagacgatggaatgcaaatctggggtatcccctccagtctagagacccgcgaggctctcgtgcagtacgtgacaatggtgattttcacatgttccgcgaagcatgctgctgtgtctgcaggccaattcgactcctgtgcgtggatgcctaacctgccgccgtctatgcaattaccaccccccaccagtaaaggcctcgccacatgcgaggggttcattgccactctcccgcccgtgaacgctacatgcgacgtcatccttgctctgtggctgctgtcaaaggaaccgggggaccagcggcccctgggtacttacccagatgagcacttcactgaagaagcccctcgcagaagcattgcgactttccaatccagacttgcccagatatcacggggaatccaggagcgcaaccaaggtctcgtgctcccatacacatacctggacccccctctgatcgagaattcagtgtctatatag

SEQ ID NO: 14729 - DNA, 3123 bp, Artificial Sequence
  Description of Artificial Sequence: Synthetic coding sequence
atggtctctagcgcgcaaatgggattcaacctccaggctctgctcgagcagctgagccaagatgaactgtccaagttcaaatatctcatcacgacattttctttggctcatgaactgcaaaaaattccccataaggaagtggacaaggcagatggtaagcaacttgtagaaattttaaccacccactgcgacagttactgggtagaaatggcctccctgcaggttttcgaaaaaatgcaccgcatggatctgtctgagagggcaaaggatgaggtgcgagaagctgctttaaaatctttcaacaagcgaaaaccactaagcctcggaatcacccgcaaagaaagaccgcccttagatgtagatgaaatgctggaacgttttaaaaccgaggctcaggacaaagacaataggtgcagatacatcctcaaaacgaaatttcgtgaaatgtggaaatcgtggcctggagattcgaaagaggtccaggtgatggccgagagatacaagatgctgatacctttctccaacccgagggtgctgcccggtcctttcagctataccgttgtgttgtacggacccgctggcctggggaaaactaccctggcccagaagttgatgcttgactgggctgaagataacctgattcataagttcaagtatgccttctatttgtcctgtagagaactgtcccgtctcgggccctgcagtttcgccgaattagtcttcagagattggccagaactgcaggacgatattccacacattctcgctcaggcccgtaagattttattcgtaattgacgggttcgacgagctcggtgctgcccctggagccctcatcgaggacatctgcggcgactgggagaagaagaaaccagttcctgtactgctgggctccctgctgaaccgggtgatgctccctaaggcagctctgctagttaccacccggccaagggctttgcgcgacctgcggatccttgccgaagaacctatttacatccgggtcgagggttttttagaggaggacagaagggcctactttctccggcacttcggcgacgaagatcaagctatgcgagctttcgagctgatgaggtcaaatgctgcacttttccagctgggctcagcccccgctgtgtgttggatcgtatgcacaaccctgaaactccaaatggagaaaggcgaggaccccgtacctacatgtctaactaggaccggattgttcctgcgatttctatgttccagattcccacagggcgcccaattgcgaggcgccctgcgtacactgtcgctgttagcggcccaaggactttgggcccagaccagcgtgctgcatagggaagatctcgaaagactgggagtgcaggaatctgacttgaggctgttcttggatggagatattctaagacaggatcgtgtctcgaagggctgctatagtttcatccatctgtcttttcagcagtttttgacagcactcttctacacccttgagaaagaggaggaggaagatcgcgacgggcacacttgggatatcggggatgtgcagaagctactcagtggcgttgagcgccttcggaaccctgatttgatccaggcaggatattatagcttcggtctggccaacgaaaagagggctaaggagctggaagccacatttggatgtaggatgagtcctgatatcaaacaggaactgctgaggtgtgacatatcctgtaagggcggccactcaacggtcaccgacttacaagagctgttggggtgtctatatgagagccaggaggaggagctagtaaaggaagtgatggcccaatttaaagaaatctcactccacttgaatgcagtagatgtggtgccaagttccttctgcgtgaagcactgcagaaaccttcagaagatgagccttcaggttatcaaagagaacctgcctgagaacgttaccgccagtgagagcgatgctgaagtagagcgcagccaggacgatcagcatatgctgcccttttggaccgatctgtgctcaatctttggatctaataaggacctgatgggactcgccatcaatgatagcttcctttcagcaagtctggtgcgcatactctgcgaacaaatagccagcgacacttgtcacctccagcgtgttgtgttcaagaatatttccccagctgacgcccaccgaaatctgtgtttagctctgcggggccacaaaactgtgacctatctgactctgcaaggaaatgatcaagacgacatgtttccagctctgtgtgaggtcttgagacatcccgaatgtaacctgcggtacttgggtctcgttagctgttcagccacaacacagcagtgggcggatctctccctcgccttggaggtcaatcagtcactgacttgcgtcaatctgtcagataacgaactgcttgatgaaggggccaaactgctttacaccaccctgcgacacccaaagtgttttctgcaacggctttcattagagaactgtcatttgaccgaggccaactgtaaagatcttgcagccgttctcgtggttagccgggaactgacccatctgtgtctagcaaaaaaccccatcgggaatactggggtcaaattcctgtgcgaaggcttaaggtaccctgagtgcaagctgcagaccttggtgctttggaattgcgacatcacgagtgatggctgttgcgacctcaccaagcttcttcaggaaaagtcttctctgttatgcctggatctcggcctaaaccatataggcgtgaagggcatgaaatttttgtgcgaggcactgcggaagccactctgcaacctgaggtgcctgtggttatggggctgctccattccccctttctcttgcgaagacctgtgttctgcgttgagttgcaaccagtcactggtgactctcgacctaggccagaatcccctggggtctagcggtgtgaagatgctctttgagacactgacttgctctagtggtaccctgcgtactttgaggctgaagatcgacgacttcaacgacgaactgaacaaactattagaagaaattgaggaaaagaacccccagctgattattgataccgaaaagcaccacccctgggctgaacgtccatcctctcacgacttcatgatctag

SEQ ID NO: 14730 - DNA, 3864 bp, Artificial Sequence
  Description of Artificial Sequence: Synthetic coding sequence
atggttcccggcgaggaaaaccagctggttccaaaggaagcacctttagaccatacaagcgataagtctcttctggatgccaacttcgagcccgggaaaaaaaattttctgcacctcacagataaagacggagagcagccgcagatcctcttagaagattcatctgcaggagaggactccgtgcacgaccgcttcattggccccttacctagagagggcagcgggggatcgacatccgactatgtctcccaatcttatagctattccagcattcttaacaaaagtgagacggggtacgtggggctggtgaaccaggccatgacttgctatctaaactctctgctgcagactcttttcatgactcccgagttcaggaatgctttatacaaatgggaattcgaggaatccgaagaagatcctgtcacttctatcccctatcaactccagcggctcttcgtgcttctgcagacctcgaagaaaagggccatcgagacaactgacgtgactagaagcttcggatgggattcaagcgaagcctggcagcagcacgacgtccaagagctgtgcagggtgatgttcgatgctcttgaacagaaatggaagcagaccgaacaagcagatcttattaacgagctgtaccagggcaaactcaaagactatgtgaggtgcctcgaatgcggctacgaaggatggcggatcgacacttatcttgatattccactggtaatccgaccctacgggtcttcccaggcttttgcaagtgtggaggaggccctgcatgcttttatccagcccgagatcttggacgggccaaatcaatacttctgtgaacggtgtaagaaaaagtgcgacgcgcggaaaggactgcgttttcttcatttcccttatctattaactttacagctcaaacggttcgactttgattacacgacaatgcacagaatcaaactgaacgaccgcatgactttccccgaggagctcgacatgagcacatttatagatgtagaagacgaaaagagccctcagaccgagagctgtacagacagcggagctgaaaacgagggatcatgccattcggaccagatgtcaaacgactttagcaatgacgatggggtcgatgaaggaatctgtctcgaaacaaattctggcactgaaaaaatatctaagagtggactcgaaaagaactcacttatttacgaattatttagcgtgatggtacattctggatcagcagccggaggacactactacgcctgcattaagagtttctccgacgaacagtggtactcattcaatgaccagcacgtgtcccggattactcaggaggacattaaaaagacacacggtggctcaagtggctcccggggatactattcctctgctttcgcctcttccacgaatgcctatatgctaatttaccgacttaaggaccccgccagaaacgcaaaattcctcgaagttgatgagtaccccgagcatatcaaaaacctggttcagaaggagagggagttagaggagcaggaaaagagacagcgcgagatcgagcgcaatacctgcaaaatcaagctattctgcctccaccctaccaagcaagtcatgatggagaataagcttgaggtgcacaaagacaagacccttaaagaggcagtggagatggcgtataaaatgatggacctagaggaagtcattcctctcgactgctgtaggcttgttaaatatgatgagttccatgattaccttgagaggtcttatgagggggaagaggatacaccaatggggctgctgcttggaggtgttaaaagcacgtatatgttcgacctgttattagagacaagaaagccagaccaggtgtttcagtcatacaaacctggggaggtaatggtgaaagtgcatgtggttgaccttaaagcagagtctgttgctgctccaatcaccgtgagagcttacctcaatcagactgtaaccgagttcaaacagctaattagtaaggctatacacttgcctgctgagacgatgaggattgttctcgaacgctgctacaacgacctgcggcttctgtctgtgtcctcaaagacactcaaagcagagggtttctttaggtcgaacaaggtgtttgtcgaatccagcgaaacacttgactatcaaatggcctttgccgactcccacctgtggaagctgctggacaggcacgccaacaccataagactgtttgtgctgttgcctgaacagtcccccgtcagctatagcaaacgcactgcttaccaaaaagccgggggtgactcgggaaacgttgacgacgattgcgagcgagtgaagggccctgtcggctcgctcaagagcgtcgaggctattctcgaagaatctacggagaagctgaaatcgttaagcctgcagcagcagcaggatggagacaatggcgattctagtaaatccactgaaacatcagattttgagaatatcgaatcacctctgaatgagagagattcatccgctagtgtggataatcgcgagttggaacaacacattcagacatcagatccggagaatttccagtctgaagagagatcggactctgacgtgaataacgacagaagtactagctcagtagatagcgatattcttagcagttctcacagcagtgacaccctgtgcaacgcagacaacgcccagatcccccttgccaatggtttagactcacactctatcacctccagtagaagaactaaggccaatgagggaaaaaaggaaacctgggacactgccgaggaagacagtggcacggattcagagtacgacgaaagcgggaagtctcgcggcgaaatgcagtacatgtatttcaaagccgagccatacgccgccgacgaagggagcggagagggacataagtggctgatggttcacgtggacaagcggattacgcttgctgcatttaagcaacacctggagcccttcgttggggtgctgagctcacacttcaaggtcttccgggtttacgctagtaatcaggaatttgagagtgtccgtctaaacgagaccctgagttcattctccgacgataataagattactatccgcctaggccgcgcgctcaagaaaggtgaataccgcgtaaaagtgtaccagctgctggttaacgaacaggaaccttgtaaattcttattggatgccgtttttgcaaaggggatgaccgtacgtcagtctaaggaagaactcattccacagctacgagagcagtgtggtctcgaactgtctattgaccgattccgactgcgtaagaaaacttggaaaaacccaggaacagtgtttctcgactaccacatctacgaggaggatatcaacattagtagcaactgggaagtcttcctagaggttctcgatggtgtcgagaaaatgaagagtatgagccagctcgctgtgctatcgcgacggtggaagccatctgaaatgaagcttgatccttttcaggaggtggtgctggaatcatccagcgtggatgagttaagggagaagctcagtgagatctctggaatccctctggacgacatcgagttcgcaaaggggcgtgggacattcccttgtgacatcagtgttctggacatacaccaggaccttgattggaatcccaaagtgtcgaccttgaacgtctggccactgtacatttgcgacgatggggcagtcatcttttatcgcgacaaaaccgaggagctgatggaactgaccgatgaacaacgcaatgagctgatgaaaaaggagtctagccggctgcagaagactgggcaccgagtaacatatagccctaggaaggaaaaggcactcaagatttacctggacggcgcacccaataaggatctcacacaggattag

SEQ ID NO: 14731 - DNA, 420 bp, Artificial Sequence
  Description of Artificial Sequence: Synthetic coding sequence
atgccctggagagcagggaacggagtgggattggaggcgcaggccggcactcaagaggccggcccagaagaatactgccaagaggaacttggcgccgaagaggaaatggcagctcgggccgcatggcccgtgctccgatctgtcaacagccgcgaactgtcccgaattataatatgcaaccactccccccgcatcgtcctgcctgtctggttgaactattatggcaagctacttccataccttacattacttcctggacgagactttaggatccataactttcgctctcacccctggctgttcagagacgcgaggacccatgataagctgctagtgaaccagaccgagctgttcgttccgtccagcaacgtcaacggtcaaccagtgttcgccaacattacactgcagtgtatcccctag

SEQ ID NO: 14732 - DNA, 582 bp, Artificial Sequence
  Description of Artificial Sequence: Synthetic coding sequence
atggaaggctgtgtttctaatttaatggtgtgtaatctcgcttactcaggcaagctcgaggagttaaaggagtccatactggcagacaaaagccttgctaccaggaccgaccaagctggctggagcccactgcacattgccgctagtgccggccgcgatgagattgtcaaggctctgctgggaaagggggcccaggttaacgcggtgaatcagaacggatgcacccctcttcattacgctgcatctaaaaaccggcacgaaattgccgtgatgctgcttgaaggaggagctaatccagatgctaaagaccactacgaagcgacagcgatgcaccgggccgccgcgaaaggtaatctcaagatgattcatattctactctattataaagccagcaccaatatccaggacacagaggggaacacgcctttacatcttgcctgtgatgaagagagggtcgaggaagcgaagttgctcgttagccagggtgctagtatatatatcgaaaataaggaggaaaagacccccttgcaggtcgctaaaggtggtttaggactgattcttaagcgaatggtggaaggttag

SEQ ID NO: 14733 - DNA, 612 bp, Artificial Sequence
  Description of Artificial Sequence: Synthetic coding sequence
atgagcgaaaatgctgctcccggactgatcagcgaactgaagctggccgttccctggggccatatagcggccaaggcttggggatcactgcaggggcctcctgtgctttgtctacacggatggttggacaatgccagttctttcgatcgcttgatccccttattgccccaagatttttattacgtggcgatggacttcggcggtcatggtctgagtagccactattctcccggggtcccctactacttgcagacgtttgtgtctgaaatccgccgagtggtcgcggccctgaaatggaaccgatttagcattctcgggcactccttcggaggagtggtgggagggatgtttttctgcacttttcccgagatggtggataagctgatattactggatactcccctcttcctcctcgaatctgatgagatggagaacctcctcacctacaagcgcagagcaattgaacacgtcctccaagtcgaagccagccaggagccttctcatgtgttcagcttaaagcagctgctgcagaggcagcgcacggctcttacctcatccgctggttcatgcgtccggattccatccggctcttgtcggccgatgtcgtgttag

SEQ ID NO: 14734 - DNA, 765 bp, Artificial Sequence
  Description of Artificial Sequence: Synthetic coding sequence
atgccggcgggatcaatgagcaccacagggtaccctggagtgtgttcgactacttcctataggactcattgctacatccccgtgacctctagcgtgaccctttcgtctagcgacttgagccccacttttggccactgtctgccttcctcttatcagggaaacctgtggctgcttgattactgccaggagagctatggggaagccccgacatgtaagtcaccaagctgtgagccaaagacttgttccaccaccggatgcgacccatcaaattcctctgttccttgtaattcaccaagcgccggccaggtgttctcggtgtgtgaaactaccaatgtctcgccatcccccagttgctccccatccacccagaccaacggatacgtctgcaattgtcatattccgaccaggaacgcatccaaagcttgccagaccctccgcaatggctccaattgtttcggccagcttaattgtctatccaaatcatttcagaccctgaatcactgtagactcagcactttgggctacaagtcctaccagaatccatgtttcataccctcctacgtgtcccccttatgttatatttccaactcttgccagccacaatcttacctggtccgcaattatcattactcctcgtatcggcctacgtcttgcagacccctgtcttatctgagccgcagcttccggagcctaagctacatcccatctaccttccctcctctcaggtatttgtgctccggctccaggcctctgaaatgttactag

SEQ ID NO: 14735 - DNA, 1338 bp, Artificial Sequence
  Description of Artificial Sequence: Synthetic coding sequence
atgcgcgagattgtgcaccttcaagcaggacaatgcggtaatcaaatcggagctaaattctgggaggtcatctccgacgagcatgggatcgaccccacaggcacatatcatggagacagcgatcttcagttggaacgaattaacgtgtactacaacgaagctaccgggggaaagtatgtgccaagggctgtcttagtggatctagaaccgggcaccatggactccgtgcgaagcgggccttttgggcaaatttttcggcccgataatttcgtattcggccagtccggggcagggaataactgggctaagggtcattacacagagggcgccgaactcgtcgactccgtgctggacgtggtgcgtaaagaagccgaatcttgtgattgcctacaggggttccagcttacacattccctggggggtggaaccggttccggcatgggtacactgcttatctccaaaatcagggaggagtaccccgataggatcatgaacacctttagcgttgtcccttctccaaaggtctccgacaccgtcgtggagccctacaacgccacactcagtgtccaccaattagtggaaaacaccgacgagacgtattgtatcgacaacgaggcgttgtatgatatctgctttcgcaccctgaagctaactacccctacctacggggacttgaatcacctggtcagcgctacaatgagcggcgtgaccacttgtctcaggtttcctggtcaactgaatgccgacctgcgcaagttggcggttaacatggtgccatttccgcggctgcatttttttatgcctggcttcgctccgttgacgtcacgcggctctcaacagtatcgtgctctaacggtgccagaactgacacagcagatgttcgatgcaaaaaacatgatggctgcttgcgatccaagacatgggcggtacctgaccgtggccgctgtattcagagggcgtatgagcatgaaagaggtcgatgagcagatgctaaatgtgcagaacaaaaacagttcatacttcgtggagtggatcccaaacaacgtgaaaaccgccgtgtgcgacatcccccctcgaggactaaagatgtccgcaacattcatcgggaattctacagcgattcaggagttattcaagaggatttccgaacagtttaccgccatgttccgtagaaaggcattcctccattggtatactggggaaggaatggatgagatggagtttaccgaagctgaaagcaatatgaacgatctcgtgtctgagtatcagcagtatcaggatgccacagccgaagaggaaggggagtttgaggaagaagctgaggaggaggtggcttag

SEQ ID NO: 14736 - DNA, 750 bp, Artificial Sequence
  Description of Artificial Sequence: Synthetic coding sequence
atggccgagaggggtgagctcgatctcacgggcgctaagcagaatacaggggtttggctggttaaggtcccaaagtatttgagccagcagtgggctaaagcttccggccggggtgaagtagggaagctaagaatcgccaaaacccagggcaggacggaagtctccttcactcttaacgaagatctggctaacatccacgatatcggaggcaaaccagcctcagtgtccgccccccgcgagcaccctttcgtcctccagagtgtcggcggacaaactctgacagtctttacagaatcctcatcagataaattgtccctggaaggcatagtggtccagagagctgaatgtcgtcccgctgcttccgaaaactacatgaggctgaagaggctacagatagaagaaagcagcaaacctgtacgcctttctcaacagctcgataaggtggtaacaacaaactacaaaccggtggcaaaccaccagtacaatattgagtatgagcgtaaaaaaaaggaggatgggaaacgcgcaagagccgacaaacagcacgtgctggatatgctcttttctgcgtttgagaagcatcaatattacaatctcaaggacctagtcgatatcactaaacagcctgtggtgtacctaaaagagatcctcaaggaaattggggtgcaaaacgttaaagggatacacaagaatacttgggagctcaagccagaatatcggcattatcagggtgaggagaaaagtgattag

SEQ ID NO: 14737 - DNA, 2511 bp, Artificial Sequence
  Description of Artificial Sequence: Synthetic coding sequence
atgtggtccctgggttgtgtgatagctgagctttttctggggtggcctctgtaccctggcgcatcagagtatgatcagataagatacatctctcagactcagggactccccgccgaatacttgctctcggcaggtacaaagacgaccagatttttcaatcgcgaccccaacctaggctaccctctctggcgactgaaaacccctgaagagcacgagcttgagactgggattaagtctaaggaggcgagaaagtatatatttaattgtctggacgatatggcccaggtgaacatgtcgaccgatttagaggggactgacatgctcgccgagaaagcagacagacgggaatacattgatctcctgaagaagatgctgacgatagacgcagataagagaattacaccgctcaagacacttaaccaccagttcgtcactatgacgcaccttctcgatttcccacactcaaatcacgtcaagtcttgttttcagaatatggaaatctgtaagcgcagggtccacatgtacgacactgtgtcccagatcaaatctccatttacaactcatgttgcccccaacacctcaaccaacctaactatgtcatttagcaatcagcttaacacagtgcacaatcaggcttctgtgctggcgagttcttcaaccgctgcagccgccacgctcagtctggctaacagcgatgtgtccctgctcaattatcagtcagccctgtacccttccagtgctgcccctgtgccaggcgtcgcacagcagggggtatccttgcagcccggcaccacccagatttgtactcagactgacccattccagcagacgttcatagtgtgcccaccagcctttcagacaggtctccaggcgacaactaagcatagcggatttccggttcggatggataatgcggtgcccatcgtgccacaggcccctgctgcacagcctctgcagattcaatctggggtccttacgcagggatcatgtaccccgctgatggtggccacattgcacccccaggtagccaccataactccacagtatgcagtgccattcacactgtcatgtgctgccgggaggcctgctcttgtcgagcagaccgccgctgtacttcaggcatggccaggtggtacacagcaaatactattgccctctacctggcaacagctgccaggggtcgcgctacacaacagcgttcagcccactgcaatgatcccagaagcaatgggctcaggtcagcagctggctgattggagaaatgcacattctcatgggaaccagtactccacgataatgcagcaaccgagcctgctgacgaatcacgttactctcgctacagcccagcccttgaatgtgggcgtcgctcatgttgtgcggcagcagcagtctagcagcttaccgagtaaaaaaaataagcaatctgctccggtcagctcaaaatcttcactggatgtgttacccagtcaggtctactccctggtcggctcttccccattgcggaccactagctcctacaatagtctggtgccagttcaggatcagcatcagcccattatcatccccgatacaccatcgccacctgtgagcgtcatcactattaggtcggataccgacgaggaagaggataataagtataaacctagcagctccggacttaagccgaggagcaatgtcatttcgtatgtgaccgtcaacgattctcccgacagcgactcgtccctgtctagcccatacagtaccgataccctatccgccctgcgtgggaactccgggtcggtcttggaggggccaggtagagtggtggccgacgggacaggcaccaggacgatcatcgtcccacccctgaagacacagcttggcgattgcacagtcgccactcaagctagcggcctgcttagcaataaaactaagccagtcgcatccgtttctggccagtctagtgggtgctgcatcaccccaactgggtacagagcccagaggggaggtaccagtgcagctcagcctctcaacctctctcagaaccaacagagcagtgctgcgcctactagccaggagaggagttctaaccctgcgccgcgccgccaacaagctttcgtggctcccctctcccaagccccttacacgttccagcacggaagccctctgcatagcactggacacccccacttggcaccggctccggcacacctgcctagccaggcacacctgtacacatatgcagctcctacctccgcagctgccctcggatcaacatcctccattgcccacctgttcagcccacagggctccagcagacacgccgccgcgtatacgactcaccctagcactctggttcatcaggtgccagttagcgtgggaccttccctgctgactagtgccagcgttgctcccgctcagtatcagcaccagttcgctacgcagagttatattggatcaagcagagggagcacgatctacacagggtatccactgtctccaacaaagataagccagtacagttacttatag

SEQ ID NO: 14738 - DNA, 2352 bp, Artificial Sequence
  Description of Artificial Sequence: Synthetic coding sequence
atgtcccaggtgaaaagcagctactcatacgatgcaccctccgattttatcaacttttcatctcttgacgacgaaggcgacactcagaacatagatagctggtttgaagaaaaggccaacctcgaaaataagctcctgggcaagaatggaaccggaggattatttcaaggcaaaacccctctcaggaaggccaatttacagcaggccatcgtgacccccctgaagcctgtggacaacacctactacaaagaggccgagaaagaaaatctggtggagcaaagcattccttcaaacgcatgttcaagccttgaggtggaagcagcgatctcacggaagaccccagcccagccacagcgccgctcacttcgacttagtgcccaaaaagatctggagcagaaagaaaagcatcacgtgaaaatgaaggctaagcgctgcgccacaccagtgatcatagacgagatccttccatctaagaaaatgaaggtgagcaataacaaaaagaagcctgaagaagaaggatcagcccaccaggacactgcagagaaaaatgcatcctctccagagaaggctaagggccgccacactgtcccgtgcatgccaccagctaagcaaaaattcctgaagtcaaccgaggaacaggaactggaaaaaagcatgaagatgcagcaggaagtggtggagatgcggaaaaaaaacgaggaattcaaaaagctcgccttggccggtattggccagcctgtgaaaaaaagcgtatcccaggtcactaaatccgttgacttccatttccgaaccgatgagagaatcaaacagcacccaaagaatcaggaagagtataaggaagtgaactttacctctgagctgaggaaacatccatcttctcccgccagggttacaaaaggatgtactatcgtgaaacccttcaacttgtcacaggggaagaagaggacattcgacgagacagtgtctacttatgtacctctagcccagcaggtcgaagatttccacaagcggacccccaataggtatcatctgaggtccaagaaggacgatatcaaaacagggtcttgctctgtgactcaggcaggcgtgcaatggagggatcatgggagcctacagtgcccgacccctggactgaaacagtccagttgtctatcactgccaaatcttctgccctccaagtcttccgtgactaaaatctgccgagacccgcagacacccgtactgcagacaaaacatcgggcacgggccgttacttgtaaatctacagcagagctggaagcggaggaactggagaagctacagcagtacaaatttaaagctcgggaactggaccctaggattcttgagggaggaccaatactgcccaaaaagccgccggttaagcctccgacggagccaatcggtttcgatctcgagatcgaaaaacgtattcaggaacgcgaatccaaaaaaaaaacagaggacgaacacttcgaatttcattctaggccctgcccaacaaaaattctggaggatgtggtgggggtgccagagaaaaaagttctaccgattacagtgcccaaatcccctgcttttgccttgaagaacagaattcgcatgcctactaaggaagacgaggaggaagatgaacccgttgtgattaaggcacagccagtgccacactatggggttcccttcaaacctcaaattcccgaagcgcgcactgtggaaatctgtcccttttcttttgacagtagagacaaagagagacaactgcagaaggaaaagaagatcaaggaattgcaaaaaggcgaggtgcccaagttcaaggctctgccactaccccactttgatactattaaccttcccgaaaagaaggtgaagaatgtgacccagatagagcctttctgcttagaaaccgacagaagaggagcgttaaaagcccaaacctggaagcatcagctggaggaggagctacggcagcagaaagaggctgcctgcttcaaggctcggcccaataccgttattagtcaggagccttttgtgcctaagaaggaaaagaagagcgtcgcagaaggcctttcagggtccctggtgcaagagcctttccagctggcgaccgagaagcgcgcaaaggagcgccaggaactagaaaagaggatggcagaggtcgaggcccaaaaggcccaacagttggaggaggcacggctccaggaggaagaacagaagaaggaagaactggctaggctgcggcgtgagctggtacacaaagctaatcctattaggaagtaccagggcctagagatcaagagctccgatcagcctctgaccgttccagtctcaccaaagttttctaccagattccactgttag

SEQ ID NO: 14739 - DNA, 2061 bp, Artificial Sequence
  Description of Artificial Sequence: Synthetic coding sequence
atgggcagttaccttagcgtgccagcctacttcactagtagggacctgttccggtgctctgaatgccaggactctttgaccaactggtactatgagaaagatggaaaactctattgtccaaaggattattgggggaaattcggggagttctgtcatggctgcagcctcctcatgacaggacctttcatggttgcaggcgagttcaagtatcatccagaatgctttgcctgcatgagctgtaaggtgattattgaagatggcgatgcatatgctctggtgcaacacgctacgctgtattgtggtaagtgtcacaatgaagtggtgctagcacctatgtttgaaaggctgtccacggagtcagtgcaggaacaactgccgtattctgtgaccctaattagcatgccggctaccaccgagggtcgtagggggttctcggtgtcagtggagtcagcatgttctaactatgccaccactgttcaagtgaaggaggtgaacagaatgcatatcagtccaaacaaccgcaatgcgatacaccctggagataggattttggagatcaatggcactccggttagaaccctgagggtggaggaggtggaggacgcaatctctcaaacctcgcaaacgctgcaactgctgatcgaacacgaccccgtttctcaaaggctcgatcaactgagacttgaggcccgtcttgcaccgcacatgcaaaatgcagggcacccccacgccctctctactctggacacaaaggagaatctggagggcaccctgcggcgtcgcagcctgcgccggtccaacagtatctccaagtctcctgggcccagctctcccaaggagcccttgctgttttctagagatatttcgcgatccgaatcactacgctgctccagttcatactcacagcagatatttaggccttgtgatctcatacacggggaggtacttgggaaaggcttctttggtcaggccatcaaggttacacataaggctaccggtaaggttatggtgatgaaagagctaataagatgcgatgaagagacccagaagacatttctcaccgaggtgaaggtgatgaggagtctcgaccatccgaatgtgttaaagtttataggggttctctacaaggataagaagctgaatctcctcaccgaatatattgagggtggtacattgaaagacttcctcaggagcatggatcccttcccttggcagcaaaaagttcgctttgccaagggaatcgcctctggaatggcctatctgcacagcatgtgtatcatacaccgtgatttgaacagtcacaactgcctgattaaattggacaagacagtggtcgtggcagacttcggcctgagtcgactgatcgtggaggagagaaagcgcgcccccatggagaaggcaacgacaaagaaacgcaccctccgtaaaaatgatagaaaaaagagatatacagtcgttgggaacccctattggatggctcccgagatgttaaacgggaaatcttatgatgaaaccgttgatatctttagcttcggaattgtgctctgcgagattatcggtcaggtgtatgccgacccagactgtctgccacgaacacttgattttggcctgaatgtgaaactcttttgggaaaagtttgtgcctacggattgcccccccgccttcttcccgctagccgccatctgctgtaggctggaacctgagagtcgggcccccccaggagccgcaggggaagggcccggatgcgcggatgacgagggtcccgtccgccggcagggcaaagtgactataaagtacgaccctaaggaacttaggaaacacctgaacctcgaggaatggatactggagcagcttacccgactgtacgactgccaggaagaggaaatcagcgaactggaaattgacgtcgatgagctcctggatatggaatccgacgacgcttgggcatcaagggtcaaagaattgctggtggactgttacaaacctacggaggccttcatttccggcctgctagacaaaatacgggccatgcagaagcttagcaccccacaaaaaaaatag

SEQ ID NO: 14740 - DNA, 840 bp, Artificial Sequence
  Description of Artificial Sequence: Synthetic coding sequence
atgagagctctcacagttcagcgagtcaagtttgccatggatcttcccctcctgaaaagggctgggcaggacctggccgagaagactaagaactttgtaagtcgatctctggtcataggcgaggttctatccatggccgatatggccactggagtgaaatgcgggataatttactggctctttggaggggctatacgcaacctcggctctcccgagcatgtgacaaaatggtttcagcccttgcaggagcaaaagtatacaggcatgttcgcaatgactgagagagggcatgggtccaacgcccgaggcatacagacagaagccacattcgacctctctgcacaggagtttgtgatcgacaccccctgcgagaatgctgagaagatgtatataggaaatgccatgtacggcaattacgccgcagtttttgcgcagctgatcatcgatggacgcagtcaaggacctcattgcttcatcgtgccagtgagagacgaaaatggtagtctttatcctggggttaccgcgatcgatatgatgtataaagaaggcttacatggagtggataatggaatactcatcttcgacaaagtgagaatccccagagagaatttactagataaattcggctcagtggcccctgatggccagtatcactcccctatacgtaacaaatctgctagattcaatgcaatgttggctgcgctaactccctcaaggcttgcagttgcatttcaggcaatgggggccatgaagttgggtctgactatcgcgatccgctatagccatcggagcagaatcatcagccagaattgctgctctgctcctgccggactctactag

SEQ ID NO: 14741 - DNA, 597 bp, Artificial Sequence
  Description of Artificial Sequence: Synthetic coding sequence
atgactctacgatgtctggagcccagcggaaatgggggcgagggcacacgctcccagtggggcactgctggaagcgcggaggaaccttccccccaggcggccagacttgccaaagccctccgggagctcggacagaccggctggtattggggaagtatgaccgtcaatgaggcaaaggagaaactgaaggaggctcctgaaggcactttcctgatccgggattctagccattccgattatctgctgacaatctccgtgaagaccagtgccggcccaaccaatttacgtatcgaataccaagacggcaaatttcgtctcgactcaatcatctgtgtcaagagcaagctcaaacagtttgactctgttgttcacttaatcgactattacgtacagatgtgcaaagataaacggacaggaccggaggcccctcgaaacgggaccgtgcatctatacttaacaaaacctctgtacacctctgcccctagtctccaacacctgtgtagactgacgataaacaaatgtacgggggccatttggggactcccactgcccacccgtctcaaagattacctcgaagagtataagttccaggtctag

SEQ ID NO: 14742 - DNA, 570 bp, Artificial Sequence
  Description of Artificial Sequence: Synthetic coding sequence
atggaggctgatggggatggcgaggaactggcccgcctgaggtcagtgttcgcagcgtgtgacgcaaatagaagcggcagactggaaagagaggaattcagagcactgtgcaccgagctcagagttcggccagccgacgccgaggccgtgttccagcggttggatgcagatagagacggcgctatcaccttccaggagttcgcccgagggttcctcggtagtcttcggggtggtcgcagacgcgattggggacctctggatcctgctccagccgtcagcgaagccggcccagaaacgcatgattccgaggaggatgagggcgacgaggacgccgccgcggccctggctactagctgcggaccggctagtccaggccgcgcctggcaggatttccaggcccgattaggagatgaggcaaagtttataccaaggttcggatatacaatctccaaaccagcctttgtgttcgtgcggcatctcatcaccttgtgcgccctcagctgggcaaagaaagagggcagagagacattgtggacgatagaggagggaggcgccaagatggcagagtag

SEQ ID NO: 14743 - DNA, 300 bp, Artificial Sequence
  Description of Artificial Sequence: Synthetic coding sequence
gccctcgacgtggcagtgaagaccttccctccagaacgtcacgtggccgtgaagtgctttgggaaaaagaaagagaaaaagaataacgctaacagtcccgcatcagtttcaaatcccactgtaaccaagcatgccttcggaatggaagaagaactgcagcgcgagggcagtatcgagacattgagcaattcaagcggttctactagcggatccattcccaggaactttgatggatatagaagtcctttacctacgaacgagtcccagccgttgtccctgttcccgacgggattcccgtag

SEQ ID NO: 14744 - DNA, 1170 bp, Artificial Sequence
  Description of Artificial Sequence: Synthetic coding sequence
atggagcggaaagatttcgaaacatggctggacaatataagtgtgaccttcttgagccttactgatctccagaagaatgaaaccctggatcaccttataagcctgtctggagccgtccagctgaggcacttgtcaaataatctggaaacactactgaagcgagactttctgaagttattgcccctggaactttccttttatctgttaaaatggctcgatccacagactctcctgacctgctgcttagtgtcaaagcaatggaacaaggtgatctcagcatgtaccgaagtgtggcagaccgcttgtaagaacctcggttggcagatcgatgatagcgtgcaggatgccctccactggaaaaaagtgtacctcaaggcaattctgcgtatgaaacagctcgaggaccacgaggcattcgagaccagctcccttatcggccacagtgccagggtatacgccctttactacaaggacggactcctgtgcactgtcttttccgtggactacaacgacgaattagacatcctcgtttctggctctgcagacttcactgttaaggtctgggccctgagtgctggcacctgtcttaatacactgaccggccacactgagtgggtgacgaaggttgtgctgcagaagtgcaaagtgaaatccctgctgcactctccgggagactatatcctgttgtccgcagacaaatacgagataaaaatctggccaattgggcgagagataaactgcaaatgcctgaaaactttgtctgtgagcgaggatcggtcaatctgcctgcagccccgtctccatttcgacggcaagtatatcgtgtgttcatccgccctgggcctctaccaatgggattttgccagctatgacatcctcagggttatcaagactcccgagatcgctaatctcgcattgttaggcttcggtgatatattcgcccttctgtttgataacaggtatctctatataatggatctaaggaccgaaagtctaatttcacgatggcccctccccgaatatagaaagtccaagcgaggttcatcattccttgccggcgaagcatcttggctcaacggcctggacggccataatgacacaggacttgtgttcgctacgagtatgccagaccacagcatccatctagtgttgtggaaggaacacgggtag

SEQ ID NO: 14745 - DNA, 2439 bp, Artificial Sequence
  Description of Artificial Sequence: Synthetic coding sequence
atgaagaaacaatttaatcgcatgcggcagctggccaatcagactgtgggcagagctgaaaaaacagaagttctcagcgaggatttgctgcaggtggagaagaggctggagctagtaaaacaagtctcacatagcacgcacaaaaagttgactgcctgtttacagggccagcagggggccgaagccgacaagagaagcaagaaacttccccttacaaccctcgcccaatgcctcatggaagggagtgctatactaggggatgatacgttgctggggaagatgttgaaactgtgcggcgagactgaagacaaattagcccaggagctgatccactttgagcttcaggttgaacgcgacgtgatcgaacccctgttcctcctcgcggaggttgagattcccaatatccagaaacagcggaagcacctggccaagctggtactggacatggactcctcccgaacgagatggcagcaaacaagtaaatctagtggcctgtcctcttcactgcagccggctggggccaaagccgacgcccttagggaagagatggaggaggcagccaacagggtggaaatatgcagagaccagctatctgctgacatgtactcttttgtggcaaaggaaatcgactatgctaactacttccaaacactcatcgaggtgcaagcagaataccacagaaaatccctgacacttctgcaagctgtgctgcctcagatcaaggctcaacaggaggcttgggtcgaaaagcccagcttcggcaaacctctcgaagaacacttgaccatcagtggtagggagattgcgttcccaatcgaagcatgcgtgaccatgctcctggaatgtggcatgcaggaggagggtctgtttcgagtggctcctagcgcgtctaagctgaagaaattaaaagctgccttagattgttgtgtggttgatgtacaggaatattctgcagacccccacgccattgcgggggcactgaagtcctatcttagggagctgcccgaaccactgatgacgtttgagctgtacgacgaatggatccaggcaagcaatgtgcaggaacaggacaagaagctgcaggccctgtggaacgcgtgcgaaaagcttcctaaggcaaaccacaacaacatccgatacctgatcaaatttctttctaaactgtccgaatatcaggacgttaacaaaatgacaccctctaacatggccatcgtgttgggtccaaaccttctgtggcctcaagccgaagggaatattaccgaaatgatgactactgtgagcctacagattgttgggattatcgagcccatcatccagcacgcagattggttcttccctggcgagattgagttcaacatcacgggtaattacggatcccctgtccatgtaaatcataatgccaactattcatcgatgccatcaccggacatggatccggccgaccggaggcagcctgagcaagctcggcgcccactatcggtagccaccgacaacatgatgctggagttttacaagaaagacggcatgggagtgagggtgatggacacaaactgggtcgcccgacgcggcagctctgcaggacgcaaggtgtcatgtgcccctccatctatgcagcccccagctccccccgctgaactggccgcacccctgccgtcaccactgccggaacagccccttgattcccccgccgcgcctgcactgtctccgtccggcctgggactccagcccgggcccgaaagaacaagcacaacaaagagcaaagagctgagtccaggctctgcccagaaagggagtcctggatcctctcagggcacggcctgcgccggtacacagcccggcgctcagccaggagcacagccgggagcctctccatccccctcacaaccgccggcggaccaatcccctcatacactccgcaaggttagcaaaaagctggcgcccattcccccaaaggtgcctttcgggcagcccggcgccatggcagatcagtccgccggccaaccctctccagtgtctctcagtcccacaccacccagcactcccagcccctacgggctctcctacccccagggttactcccttgcctcggggcagctgtcaccagcagccgccccccctcttgctagtccctccgtttttacaagtacactgtccaaaagccgcccaactccaaaaccaagacagagacccactttgcctccgccacagccgcccaccgtaaacctctccgcttcatcaccccaatcaacagaagctccaatgttggacggtatgtcccctggggagagcatgagcaccgatttggtgcactttgacatcccttccattcacattgaacttgggtcaacccttcggttgtctccccttgaacatatgcgaaggcacagtgtaaccgataagagagactccgaggaagaatcagaatcaactgctctctag

SEQ ID NO: 14746 - DNA, 1119 bp, Artificial Sequence
  Description of Artificial Sequence: Synthetic coding sequence
atgtcgaagtctgagtcacccaaggagcccgagcaacttcgaaaactgtttatcggaggtttatctttcgagaccaccgatgagtctctcaggtcacactttgagcagtggggtacgctcacagactgcgtcgtaatgcgggatcccaacaccaagcgttctcggggtttcggttttgtcacatacgctaccgtggaggaagttgatgctgccatgaacgccaggcctcacaaggtggacggcagagtggtggaacctaagcgggccgttagcagagaagactctcagcggccaggcgcccacttaacagttaaaaaaatattcgttgggggtattaaagaggatactgaagagcaccacctcagggactactttgagcagtatgggaagatcgaagttatagaaatcatgaccgatcgaggatccggaaagaagcggggattcgccttcgtcacctttgatgatcatgatagcgttgataaaatcgtgatccaaaagtatcacaccgtgaacggccacaattgtgaagttagaaaggccctgtccaagcaggaaatggctagcgcctcaagttctcagcggggccgtagcggcagcggcaactttggcggcggccgaggaggcgggttcgggggaaacgacaattttggacgcggcgggaattttagtggcagggggggatttggagggtcccgcggtggcgggggatatggtggaagcggcgacggctacaacgggtttggcaacgacggagggtatggcggagggggacccggctatagcggtgggtctcgggggtacggttcaggcgggcagggatacggaaatcagggcagcgggtacggagggtcaggaagctatgattcttacaacaacggtggcggcggcggctttgggggggggagtggatctaacttcgggggggggggatcctataacgactttggtaattacaacaaccaatcttcaaactttggtcccatgaagggcgggaacttcggtggcagatcctcaggcccttacgggggtggaggccaatactttgctaaaccacgaaaccagggcggttatggcgggtcctcctcgtcatcttcttatggttccgggcggcgcttttag

SEQ ID NO: 14747 - DNA, 1491 bp, Artificial Sequence
  Description of Artificial Sequence: Synthetic coding sequence
atgaagctgggcaagaagccaatgtacaagccagtagacccctactccagaatgcagagcacatataattataacatgagagggggagcatacccaccacgatatttctaccccttccccgtgccccctttgctctaccaggtcgaattaagtgttgggggtcagcaattcaacggcaaagggaagacacggcaagccgcaaaacacgacgccgcagccaaagcactgcgaatcctccagaatgagccactcccagagcgcctggaggtaaacgggcgtgaaagtgaagaggagaatctgaataaatccgaaatttcccaggttttcgagatcgctctaaagcggaaccttcccgtgaacttcgaagtggcccgggaatcaggtccgccacatatgaagaactttgtgactaaggtgtcagtgggtgagtttgttggggagggcgagggtaagtctaagaagataagcaagaaaaatgccgcaatagctgttctggaagagctcaagaagttgcccccacttccggccgtggagagagtgaagccgcggataaaaaaaaagaccaagcctatagtcaagccccaaacaagccctgaatatggccagggcattaaccctatctctagactggcacagatacaacaggctaagaaggagaaggagcccgaatatactctgctgaccgaacgcggactcccccggagaagagaatttgtgatgcaagtcaaggtcggaaaccataccgccgaaggaaccggaacgaacaaaaaagtggccaagagaaacgccgccgagaacatgctggagattctggggttcaaggttccccaagcacagcctaccaaacccgccttgaaaagcgaagagaagacccctatcaagaagcctggagacggtcgcaaggttaccttttttgagccaggcagcggagatgaaaatggaacttcaaataaagaggacgaattcaggatgccatacttatctcaccagcagctcccggccggcatcttgcctatggtacctgaagtggcccaggctgtcggggtgtctcagggacaccacacaaaggatttcacacgggctgcccctaatcctgccaaggcaactgtcactgccatgattgccagggaactcctttacggaggcactagcccaaccgccgagacaatcctgaagaacaatatcagttctggacacgtgcctcacggacccctgacgcgaccctccgaacaattggattacttgagtagggtgcaaggattccaggtggagtacaaggacttccctaaaaataacaagaacgaatttgtgtcattgattaattgcagttcccaaccaccgctgatttcacacggaattgggaaggacgtcgagtcatgccacgatatggcggcgctgaacattcttaagttgttgtcagagctcgaccagcaaagcacagagatgcctcgcacaggaaatggcccgatgtctgtctgcggccggtgctag

SEQ ID NO: 14748 - DNA, 5835 bp, Artificial Sequence
  Description of Artificial Sequence: Synthetic coding sequence
atgtcaaacttctacgaggaacgtacaacgatgattgcggctcgtgatctgcaggagtttgttccctttgggcgcgaccactgtaagcaccacccaaacgctctgaatctacaattacggcagttacagccagcctctgagctctggagcagcgacggcgctgcaggattagtcggctccctccaggaagtgaccatccacgaaaagcagaaggaaagctggcagctgcgcaagggggtaagtgaaattggcgaagatgtcgattacgatgaggagttgtacgttgcaggcaatatggtgatttggagcaaagggagtaagagccaggctttagctgtctacaaagcctttacagtagattcccctgtgcagcaagctctgtggtgtgattttattatatctcaggataagtccgaaaaggcctattcgtctaacgaggtggaaaaatgcatttgtattttgcagtcctcttgcatcaatatgcactctatcgagggaaaagactacattgcctcacttccctttcaggtcgcaaatgtatggcccaccaaatatggcctgctgttcgaaagatccgcaagttcacacgaggtgccaccggggtcccctagagagccgttgcccactatgttcagcatgcttcatcctctcgacgaaattacccccctcgtatgtaagagcgggtccctcttcggcagctcccgcgtgcagtacgtggtcgaccatgctatgaagattgtgtttctgaataccgacccaagcattgtcatgacctacgatgctgtgcagaatgtgcactccgtgtggacattgcggcgcgttaagtctgaagaagagaatgttgtccttaagtttagcgaacaggggggcacacctcagaacgtggctacgagctcctcgttgaccgcccacctgagatctctcagcaaaggggattctcccgtaactagtccattccagaattattccagcatccactctcagagtagatcaacatcgtcccccagtctgcacagtcgatcacctagcatcagcaatatggcagctctgtcccgcgctcattcgccggcattaggcgtccattccttctccggagttcaacggtttaacatctcaagccacaaccagagccctaaacgacacagcatttctcatagtcctaactccaattcaaacggaagcttcctggcgccggagacggaacctattgtccctgagttgtgtatagaccacttatggaccgagacaatcaccaatatcagagaaaaaaactctcaggccagcaaagtcttcattacgtccgacttgtgtggacaaaagttcttgtgcttccttgtcgagagtcagttacaattgagatgcgttaagttccaggaaagcaacgataagactcagcttatatttggcagtgttaccaacataccagctaaagacgctgcacccgtcgagaagatcgatacaatgctggtgctggaggggtccggcaatttagtgctgtacacaggtgtggtgcgagtcggtaaggtgtttatcccgggactgccagcaccctccttgaccatgagcaatacaatgccacgcccaagcacccccctggacggagttagtacgcccaaaccactttccaagctgctgggctccctggatgaggtggtcctgctcagccccgtgccagaactacgcgatagttctaaattacatgacagcctctacaacgaggattgcaccttccaacagctgggaacctatatccattcaatcagagatcctgtacataatcgggtgacgctggagcttagtaatggcagcatggtaaggatcactatccccgagattgccactagcgagttagtccagacttgtttacaggcgatcaagtttatcctccccaaggaaatcgccgtgcagatgctggtcaagtggtataatgttcatagcgcaccaggcggcccctcataccactcagagtggaatttatttgttacatgcctcatgaacatgatgggatataatactgaccgactcgcttggacccggaatttcgacttcgaaggcagcctgtccccagttatcgcccccaaaaaggcgcggccttccgagacaggatccgatgacgactgggagtatcttctgaactctgactatcatcagaatgttgagtcccacctgttgaacaggtcattgtgtctgtccccgagcgaggcctcccagatgaaggatgaggacttcagtcagaacctgagcctggactcctccactttactgttcacccacatcccggcaatcttctttgtgctgcatttagtgtacgaggagttaaagctgaacaccttgatgggtgaggggatatgttctcttgtggaactgttagtgcagctggcgcgggacctcaagctgggaccctacgtggaccattactaccgggactatcccaccttagtccgcacaaccggccaggtgtgtaccattgaccctggtcaaacaggattcatgcaccacccgagcttctttacctctgaacctccttcaatctatcagtgggtcagttcatgtcttaaaggcgaaggcatgcctccctacccgtatctgccgggcatttgcgaacggtcacggttagtggtgctgtctattgccttgtacattctcggagatgagtcgctggtctctgatgagagctctcagtatctgacgcgcattacaatcgcgccgcagaaactacaggtggagcaagaggagaataggttttcctttcggcatagcacatcagtttcctccctggctgaaaggctcgtggtgtggatgactaacgtgggctttacactgcgcgatctcgagacattacccttcggtatagcattgcccatcagagacgccatttaccattgtcgcgaacagcctgcctcggactggccagaagcagtttgcctgttaatcggcagacaggatttgtcaaagcaggcctgcgagggcaacttgcccaaagggaagagcgttttatcgtctgacgtgccttcggggactgagaccgaggaggaggacgatgggatgaacgacatgaaccatgaggtgatgtctctaatttggagcgaggacctaagggtgcaggatgttcggcgcctgctccaatctgcacaccctgtgagggtcaacgtagtacagtaccctgagctgtcagaccacgaatttatagaggaaaaagagaatcgcttgttgcaactgtgtcaacgaacgatggcactacctgtaggaagaggtatgtttactcttttctcgtatcatcccgtgcctactgagcccctgccaataccaaagctgaacctcaccggtagagctcctccaagaaatactactgtcgacctcaactccggaaacatcgatgtgcctcctaatatgacaagctgggcatcattccacaacggggtagcagccggcctgaagattgcgccagcatcccagattgacagtgcctggatcgtctataataaacccaaacacgctgaactggccaacgaatatgcaggtttccttatggcgcttggcctgaacgggcatctgacgaagttggcaacccttaatatccacgattatctgaccaaagggcacgagatgacgagcattgggttactgctgggtgttagcgcggcgaaactggggacgatggatatgtccattactcgtttgctgtcaattcatattccggcattgctgcctcccacctccacagagttggacgtcccccataacgtccaggtggccgctgtcgtcggtataggtctcgtttatcagggcactgctcatcgtcataccgctgaggttctgctcgccgaaattgggcgcccacccgggccagagatggagtattgcaccgaccgggagtcctacagtctggctgccggacttgctctcggaatggtgtgtctgggccatgggagcaatctgatcggaatgagcgatctgaacgttcccgaacaactataccaatacatggtcggaggccacaggaggttccagaccggcatgcacagagagaaacacaaaagtcccagctaccagatcaaggagggagacactatcaatgtcgatgtaacttgccctggtgccactcttgcactagccatgatctatctaaaaacaaacaatagaagcatcgccgactggctgcgggcccctgacaccatgtatctcttggactttgtgaagccagaatttctcttattgcgaactctcgcgcgatgcttaatcctctgggatgatatccttcccaactcaaagtgggtcgacagcaacgtgccgcagattattcgggagaatagcattagcctgagcgaaatcgagctcccctgtagcgaggatctgaacttggagacattgtcacaagcccatgtgtatattattgccggtgcttgtttgtccctaggcttccggttcgccggtagtgagaacctcagtgcattcaattgcctgcataagtttgctaaggatttcatgacctacttaagcgcacctaacgcgtcggttactgggccacacaatctggagacctgtttgagcgtcgtcctgctatctttagctatggtgatggctggtagcgggaacctgaaggttctacagctgtgccgattcctgcacatgaagaccgggggggaaatgaactacggattccacttagcccatcacatggcattgggtttgctgtttttgggcggcggcagatatagtctgtcaacatcgaactcgtctattgcagctctgctgtgcgccttatatccacatttccccgcccactcgaccgacaacaggtaccacctccaggccctgaggcacctctacgttctggccgccgaacctcgtttactggtgccagtggatgtcgacactaacactccatgctatgcactcctcgaggttacctacaaaggaacccagtggtatgagcaaacgaaagaagaactaatggctcccaccctcttgcccgaactgcacctgctcaaacagattaaggttaaaggacccaggtattgggaactccttatcgatttgagcaaagggacacagcaccttaagagtatcttgagtaaggatggtgtcttgtacgtcaagctgagggccgggcagttatcatataaggaagacccgatgggatggcaatctttactggctcaaacagtagccaatcgtaatagtgaggcgagggcttttaagccagaaacgattagcgcgttcactagcgatcccgccctgctgtcattcgccgagtacttttgtaagcccactgttaacatgggacaaaaacaggagattctagatctcttttctagtgtgctgtatgagtgcgtgactcaggagactcctgagatgctcccagcatacatcgccatggatcaggccataagacgactgggcaggcgcgagatgtccgaaacaagtgaactctggcaaataaagctggtgctggaattcttctcgtccagatcgcaccaggaaagactgcagaatcatccgaaaagaggactctttatgaacagtgaatttctgcccgtagtcaaatgcactatcgataacaccctggatcaatggctgcaagtaggaggggatatgtgtgtgcacgcatacctgagcggccagccactggaggaaagtcaactgtcaatgctggcctgtttcctggtgtatcacagcgtgccagccccccagcatctgcccccgataggacttgagggctcaacaagtttcgctgagctgctgttcaagttcaagcagctgaagatgccagtcagagcattgttgagactggctccactgttgttggggaacccccaaccaatggtcatgtag

SEQ ID NO: 14749 - DNA, 1263 bp, Artificial Sequence
  Description of Artificial Sequence: Synthetic coding sequence
atgctcaaggccgtcatcttgattggaggaccccagaagggcacacggttccggcccctgtctttcgaggtgcccaagccactcttcccagtggccggcgtgcccatgatccaacaccatatcgaggcctgtgcacaggttcccgggatgcaggagatcctgttgattggcttctaccagcccgatgaacctctaacccagtttctggaagccgcccagcaggaattcaacctgccagtgagatacttacaggagtttgcccctttaggaaccgggggtggtctataccactttcgagatcagatactcgcaggctcaccggaggcattcttcgtgctcaatgcagacgtatgttcagattttcccctgtctgcgatgctggaggcccaccggcggcagcggcatccatttctcctcctcgggacaacggcaaaccggacgcaatcactcaactacggctgcattgtggaaaacccccagacgcacgaggttctgcactacgtcgaaaaaccatccacattcatcagcgatataattaactgcggcatttatcttttctccccggaggcgttgaagcctctgcgtgacgtgtttcagcggaaccaacaagacgggcagctggaagactcacctggactatggcctggggccgggactatccgtctagaacaggacgttttttcagccttagcaggtcagggccaaatctatgtgcacctaaccgatggaatctggtctcagattaagagcgcaggatccgctctgtacgcctctcgactatatttatccagataccaggatacccaccctgagagactcgctaagcatacacccggaggaccatggattcgagggaacgtgtacatccaccctactgcaaaggtggcccccagtgccgtgctcggcccaaatgtgtccataggaaaaggagttaccgttggcgaaggagtgcggcttcgggagtcaatcgtcctacatggcgccaccctgcaggagcatacctgcgtcctccactctattgtcggctggggctccaccgtgggccgctgggccagggtggagggcaccccttccgatcccaatccgaatgacccccgcgcacggatggattcggagagcctctttaaagatgggaagctattacccgccataacgatcctgggctgtagggtcaggatcccagcggaggttttgattctgaactccattgtgctgccacataaagagctgtcgcggtcttttaccaaccagatcattctgtag

SEQ ID NO: 14750 - DNA, 1257 bp, Artificial Sequence
  Description of Artificial Sequence: Synthetic coding sequence
atgagggaatgcatcagtatacacgtcggccaggctggagtacagattggcaatgcttgctgggagttgtactgcctggagcatggaatccagccagacggacagatgccgtcagacaagacaattggcggcggcgatgactcatttaacacctttttcagtgagacaggcgccggcaaacatgtccccagggccgtttttgtggatctcgagcctactgtggtggatgaggtcaggacaggtacctatcggcagctgtttcacccagagcagttgatcaccggcaaagaagatgctgcgaacaattatgcacgtggccactacactattgggaaggagattgtggacctagtcttagatcgcattcgaaaacttgcggatctttgcactggactgcagggattcttgattttccacagttttggcggcggcaccggcagcggatttgcttccctcctgatggagcgactgtccgtggattacggaaaaaaatctaagttggagttcgccatttaccccgccccccaggtctccaccgccgtggtcgaaccatataactctatccttacaactcacacaactctggagcacagtgactgcgcctttatggtcgataatgaagccatttatgacatatgccgtagaaatctagatatcgagcggcctacttacaccaacctgaatcgtctgattggccagattgtgtcctcgatcactgcctccctcagatttgacggagcccttaatgtcgacctgactgagtttcaaaccaacctggtaccctacccaaggatccattttcctttggcaacttacgcgcccgtcatttcagctgagaaagcctatcatgagcagctaagtgtggccgagattaccaatgcgtgttttgagccagcgaatcagatggtgaaatgcgaccctcggcacgggaaatacatggcgtgctgtatgctttacaggggcgacgtcgttcctaaggatgttaacgcggccatagccacaattaagacaaaacggacaattcaattcgtagattggtgccccactgggttcaaggtcgggattaattatcaaccgcccaccgtagtgcctggcggagacctggctaaggtgcaacgcgcggtgtgcatgctgtccaatactaccgcgatagcagaagcgtgggctaggttagacttagcagcgttagagaaagactatgaggaggtgggagtagattcagtggaggccgaggccgaggaaggtgaggaatactag

SEQ ID NO: 14751 - DNA, 417 bp, Artificial Sequence
  Description of Artificial Sequence: Synthetic coding sequence
atgcagcttcccccatttgacatgtggaaagactattttaatcttagccaggtggtgtgggcccttattgcatcccgcgggcagcggctagaaacacaagaaatcgaggagcccagcccaggaccacctcttggacaagaccaaggtctgggggcacctggagccaatggcgggctgggtaccctttgcaatttttgtaaacataatggtgagtcacgacacgtatattcttctcaccaactgaaaacaccagatggcgtcgtggtgtgccccattctgaggcattacgtttgccccgtgtgtggggcaaccggcgaccaggctcacactcttaagtactgccccctgaacggtgggcagcagtccctctatagacgtagcggacggaactccgcgggccgccgcgttaaaagatag

SEQ ID NO: 14752 - DNA, 375 bp, Artificial Sequence
  Description of Artificial Sequence: Synthetic coding sequence
atgagggccagtccatgtatctcccagccggctgcctcgtggcacccgcgacccagcgctttgaggcccacggctggttccggacccgatactcggacacctggcacagtcgaggatggtagcgcaccttgcccggcctttcggtctcctgctgtgagcccatgtggcgaagagccatgttgctttcagataagccccgcagaagaaaccctggagctgggcaggttggtgtcccccggtaattgcgacactctctcacccagagccgcaggattttatgcttgtcacgtgaggtccctcatcccctgtcgctcaaccaaagggcgctggccgttgaccgcttcagctgctggtcttagcagttttagcggatag

SEQ ID NO: 14753 - DNA, 363 bp, Artificial Sequence
  Description of Artificial Sequence: Synthetic coding sequence
atggctgagccctcctcagcccgacgcccagtgcccttgatcgagtctgaattgtacttcctgatagctcgatacctgtcagccggcccatgcagacgcgcggcacaggtactggtccaggagctggagcagtatcaattactcccaaagcggctggactgggagggcaacgaacataatcggagttacgaagagctagtactgagtaataaacatgttgcccctgaccatctcctacagatttgtcaaagaattggtccaatgctcgataaggagatccctccatctatcagcagggtgacgagtctgcttggcgcaggccgacagagccttctcagaactgcaaaaggcacactaatttag

SEQ ID NO: 14754 - DNA, 2607 bp, Artificial Sequence
  Description of Artificial Sequence: Synthetic coding sequence
atgatcccgaaaagccttgtacaggctgctgagacacaacggggactttgtgagccaggcgggaaggggagagaaggacggtcagggggcaagggagaaacacggcccagaggggtgggcacccaggaaggcaagggcaccatacccggctcaccccgagaaaagcgcggggagaggggcgaaggggacccagcactgctgccggctgaggacctgtggagactgcctggttctaaagacaggctgaggtcatccctgctcccacccccgggcccaccctcatcagattccgggcccggccccccatcctctcactctggaaagaccgcacagggtccaagaacgctgaactgggcccgtaagcagtccgcacgaacctcaagcaatctttgcgcctggtccctggcaatggccaccaagatggctgagattccatccagtccttacgagcctgggcagcgcggaatgaaggacactcaacgtggagatgcacctcaaagaggaagcccagagcccagaattttgcagctggctcgggttggaaatgtgtatctgaaggaagagtcgtcccgatcaggccgtttggaggcgaaaaaatggatccccacaaaatttctagaaaatctgagcgttcctcacgttgatctgggaggcaatcaattgtggtcgggcggcatggaagcactgacgacacagctggggcccggccgagaggggagctcttctcccaattccaaacaggaactgcagccctactcaggaagcagcgcccttaaacccaaccaggtcggagaaaccagcctctatggagtgcctatcgtgtctctggttattgacggacaggagcgcctgtgcctggcacagattagcaacacgttgctgaagaactacagctacaacgaaattcataaccgcagagtcgctctgggcattacctgtgtgcagtgcacacctgtccagttagagatccttaggcgcgccggtgctatgcccattagttcacgacgctgcggcatgatcaccaagcgggaggcagaacgactttgtaagtcatttctcggagagcacaagccgccgaagctgccggagaatttcgccttcgacgtggtgcacgagtgcgcttggggatcgcgaggctcctttatccccgcgagatacaactccagccgcgccaagtgcatcaaatgtggatactgctccatgtacttcagccctaataagttcatcttccacagccatcgaactccggacgcaaagtacactcagccagacgccgccaacttcaattcatggcggcggcatttgaaactgtccgacaagtcggccaccgacgaactgagccacgcatgggaggatagaggccttggtctggccacgggggcatcagggcctgctggacccggcggcccagggggaggcgctggggtgcgaagttacccagttatcccggtaccttccaagggctttggactgttacaaaagctgcctcctccattgttcccgcatccatacgggttcccaacagccttcggcctgtgcccaaaaaaagatgatccggtcctgggagccggcgaaccaaagggtggatcatatgtgagcgcgttcaggccagtggtgaaagacaccgagagtatagctaaattgtacgggagcgctagagaggcatacggcgccgggccagctcggggccccggccccggagcgggtagcggcgggtacgtcagtcccgatttcctaagtgaaggttcctcttcttacaactctgcttcacccgatgtcgacactgctgacgagccagaagttgacgtagaatccaatcggttcccagatgatgaagacgcccaggaggaaactgaaccatccgcaccttcggctggcggtggcccagatgcaggtaggccagccttcggtgatcttgcggctgaggatctggtgcgccgtccagaaaggagccctccttcaggcggtggcggatacgagctgagggagccctgtggtcctcttggtggaccggcccccgccaaggtcttcgcaccggagcgggacgaacacgtgaaatccgccgctgtggccttggggccggccgcctcctacgtgtgtacacctgaggcccatgaacccgacaaagaggacaaccactctccagctgacgacttggaaacccgcaagagctatcccgatcagaggtcaatctcacagccaagccccgctaacacagaccgcggcgaggatggactgacattggatgtgaccggcactcacttagtagagaaagacattgaaaacctggcgagggaagagctgcagaaactgcttctggagcagatggagcttcggaaaaagttagagcgcgagtttcagtctctcaaggacaattttcaagaccagatgaaaagggaacttgcatatcgcgaagaaatggtgcaacagttacaaatcgtgagagataccctctgcaacgagcttgatcaggagaggaaggccagatacgccatccagcagaagttgaaggaagcccatgacgccctccaccacttttcctgcaagatgctcaccccgagacactgtacaggaaactgctcgttcaagccaccacttctaccatag

SEQ ID NO: 14755 - DNA, 3585 bp, Artificial Sequence
  Description of Artificial Sequence: Synthetic coding sequence
atgcatgacctgccaccagactctggggcccgacgtggcgggcgaggactggccgatcattcatttcctgctggagctcgggcccctggccagcctccaagtagaggagctgcatacaggagagcctgcccacgagatggcgaacgtggaggcggaggtaggcctcgtcagcaggtgtcgccaccacgcagcccccagcgcgaaccccgtggcggccagctgcgcacacctcgcatgaggcccagttgtagccgaagcctcgagagcctgagagtgggtgctaagcccccccccttccagcgctggccaagtgactcgtggattcgctgcggtgcccaccgtgattgggacgaacctcctcctaggggcggccgcatggatggttggtccggcgacagagcccgagcagcagctcctacagggctacaaccacccggatgcaaggatcacgggtgctcaagtgggtctcctttccgggaccctgccggcagctccgtcatccggagcggcaagggcgacaggcaggagggaccatcttttctgaggcctccggccgtgacagtaaagaagcttcaaaaatggatgtataaggggaggttattgagtctcgggatgaaggggcgagcccgggggaccgcccccaaggtgacgggcactcaagccgcatccccgaacgtcggcgccctcaaggtacgcgagaatagggtgttgtctgttccacctgatcagagaattaccctgacggacttgtttgagaacgcctatggcagttctatgaaaggaagggagctcgaggaactaaaagataatattgagtttcgcggccacaagcccctcaacagcatcactgtttccaaaaagaggaactggctgtatcagtcaacacttcgcccactgaacttagaagaagagaacaagaaatgccaggatcggtcccacctcagcatctcccccgtgtccctgccaaaacaccagctgagccagagctttctgaagagctccaaggagtactgtacatacgtagtgtgtaacgccacaaacagttccctctcaaaaaattgtgccttggacttcaatgaggagaacgacgcagacgacgagggcgagatctggtacaatcccattcccgaggacgacgacctgggaatctccagtgccctgtcctttggtgaggcagatagtgccgttctcaaactcccagcagtgaacctttccatgctgtccggttctgatctgatgaaagcagaaagacacacagaggacagtctctgctcttccgagcacgcaggcgatatccagactactagatctaacggtatgaaccccatacaccctgcccatagtactgagtttgtgcagcaatacaagcaaaaactgggccataagacccaggaggggatcatggtcgaggacagccccatgctgaagagcccttttgccgggtcaggcatcctggcggcaactaactcgacagagctgggaatcatggagccctcgtccccaaacccttcgcctgtgaaaaagggttcctccattaattggagcttgccagacaaaatcaagtctccaaggacagtgagaaagctcagtatgaagatgaagaaactgcctgagttttctcgaaaacttagtgtgaaaggcaccttgaattacatcaatagtcccgacaatacaccatctctgtccaagtataactgccgggaagtccaccacactgacatcctgccctccggtaacacgaccacagccgccaagcggaatgttattagtcgctaccacctggacactagcgtatcctctcagcaatcgtatcagaagaagaattcaatgagctctaagtactcatgcaagggcgggtacctgtccgacggagatagcccagagcttaccaccaaagccagtaaacatggtagtgagaataaattcggcaagggcaaggaaatcatctcaaactcttgctcaaagaatgaaattgacattgacgcttttcgccactactcgtttagtgatcaaccgaaatgttcccagtacattagcggacttatgtcagtccacttctacggggctgaggatctcaaaccgccacgcatcgacagcaaggatgtcttctgtgccattcaggtcgacagtgtgaataaagcacgaaccgcactgctgacttgtcgcaccaccttcctcgacatggatcacacattcaatatagagattgagaatgcccagcatctaaagttggtggttttcagctgggaacccaccccacgcaaaaatcgggtttgctgccacgggactgtggtcctcccaacattatttagagtgaccaaaactcatcagctggccgtaaaactggagccccgtggcctcatttatgtcaaagtgaccctcatggagcaatgggagaacagcctgcacggcctggatatcaaccaggagcctataatttttggagtggacatccaaaaagtcgtcgaaaaggagaacattggtctgatggtccccctactcattcagaaatgcatcatggaaatcgagaaaagaggatgtcaggtcgttggactgtacaggttgtgcggatccgcagcagtaaagaaggagttaagggaagcgttcgaacgagacagtaaggccgtggggctctgcgagaaccagtaccccgacatcaatgtgataaccggagtgcttaaagattacctgagagagctgccctcacccctcatcaccaagcagctttacgaggccgtgctggatgccatggccaagtcgccgctcaaaatgtcttcaaacgggtgtgagaatgacccaggcgatagcaaatacacagtggatctgctggattgcttaccggaaatcgagaaagcaacgctcaaaatgctgcttgaccatctcaagttggtggctagctaccacgaggtgaacaaaatgacctgccagaatctcgccgtgtgtttcggcccagtcctcttgtcccagcgacaggagccttccacccacaacaacagggtatttacagactcagaagagctggcgtccgcactggactttaaaaaacacatcgaagtattgcactacttgttgcagttgtggcccgtccagagactaaccgtcaagaagagcacagacaacctgttccccgagcagaagtcctcactgaactatcttcggcagaaaaaggagcgcccacacatgttaaacctatctggtactgattcatctggcgtgctgaggccccgacagaacagactcgactcgcccttatccaaccgctatgctggggactggagctcctgcggcgaaaattatttccttaacaccaaagagaatttaaatgacgtcgactacgacgacgtgccaagcgaggaccggaagattggcgaaaattattccaagatggatggacccgaagttatgatcgaacagccaataccaatgagtaaggagtgtactttccagacatacttaactatgcagactgtggagagtactgtggatcgaaaaaataacttgaaagacctacaggagtccatcgacacgttaatcggcaatttagaaagggagcttaataagaataaactaaacatgtccttttag

SEQ ID NO: 14756 - DNA, 1353 bp, Artificial Sequence
  Description of Artificial Sequence: Synthetic coding sequence
atggaccccggaaatgagaattctgcaaccgaggctgccgctattattgatctagatccggatttcgagcctcagtcccggccacgaagttgcacgtggcccctgcccagacctgagattgcaaaccagcctagtgagccacctgaggtggagcctgacctgggtgaaaaagctattgagtcagccccagagaagcgactaacattggcccaaatctacgaatggatggttagaacagttccatatttcaaggacaagggagactccaattctagcgcaggatggaaaaacagcataagacataacctgagcctgcactccaagttcattaaggtccacaacgaggcaacgggcaaaagtagttggtggatgctcaatcctgagggcggtaagtctggaaaagcccccaggaggcgagcagcctctatggactcttctagcaagctgttaaggggacgctcgaaggcacccaaaaaaaagccctcagtacttccagctcccccagaaggtgccacccccacctcacccgtgggacatttcgccaaatggtctgggagcccctgcagcaggaatagagaggaagccgatatgtggacaacatttcggccccggtcctcctctaatgcttcctccgtgtctacccggttgtcccccctgcggccggagagcgaagtcttagccgaggagattccagcctccgtttctagctacgcaggaggggtcccccctaccctgaacgaggggctcgagctgctcgacggattaaacttgacatcaagtcactctctcttgagcagatctggcttatcaggattcagcctgcaacaccctggtgtcactggacccctacatacctacagctcgtccctgttttcccctgcggagggccccttgtcagccggtgaggggtgtttcagttcctctcaagcgctggaagctcttctgaccagcgacacacctccaccccctgccgatgtgttgatgacccaggtcgatcctatcttgtcacaggccccaacgcttttacttctgggcggtctgccatcctcgagtaaactggccacgggcgttggcttgtgcccgaagcccctcgaagccccaggcccatccagcctggtcccaacactttctatgatcgcaccaccgcccgtgatggcgtctgccccaattccgaaagctctcgggactcccgtgctgacaccacccaccgaggctgcgtcacaagaccggatgccccaggacttggatcttgatatgtacatggaaaatttggagtgtgacatggataacattatttccgaccttatggacgagggagaaggcctcgatttcaatttcgaacccgacccttag

SEQ ID NO: 14757 - DNA, 1125 bp, Artificial Sequence
  Description of Artificial Sequence: Synthetic coding sequence
atggccgggtacctttcggagtccgacttcgttatggtagaagagggtttttccactcgggacttgctgaaagagctgacattaggagcatcccaggcgacgacagacgaggtcgcggccttctttgttgcagacttgggggccattgtgcgtaagcatttctgcttcctcaagtgcctaccacgggtgagaccattctacgccgtcaaatgcaattctagccctggggtcttgaaggtgctggctcaactcggccttggcttctcctgtgccaataaagcggagatggagctcgtgcagcatattgggattcccgcttctaaaattatttgtgctaacccgtgcaaacagattgcccaaattaagtacgccgccaagcatggaatccagctgctgtcattcgacaatgaaatggagctggctaaggtggtcaagagccacccctcagctaaatttgtgcagcagcggggaactgcctgtctgattaggatggtgctgtgtatagccaccgatgactcccattccctcagttgcctgtcactgaaattcggtgtgagcctgaaatcctgtcgtcaccttctggaaaacgccaaaaaacaccatgtggaggtggtcggcgtgagtttccacatcggatccgggtgtcccgaccctcaagcatacgcccaatctatagcggatgcccgactggtctttgaaatgggaacagaactgggtcataaaatgcacgtcctggacttaggcggcgggttccccggtactgagggtgccaaggttagatttgaggaaatcgcttctgtaatcaactctgctctcgacctctattttcccgaagggtgtggagtggatatctttgctgagctgggccgctattatgtgacatctgctttcaccgtggccgtatcaatcattgcaaaaaaggaggtgttgctcgaccagcctggaagggaggaggaaaatgggagcaccagtaaaaccatcgtgtatcatctggatgaaggagtgtacgggatcttcaattccgtgttgttcgataacatttgcccaacccccatcctccagaagagcaagaaccattccccctgttatatgtcattggagtctatccattttattgcagtgtag

SEQ ID NO: 14758 - DNA, 1629 bp, Artificial Sequence
  Description of Artificial Sequence: Synthetic coding sequence
atggatcgtagcaagcgcaattctatcgccgggttccctcctcgtgtagaacggctagaagagttcgaaggaggcggtggaggggagggaaacgtaagtcaggtcggtcgagtgtggcctagcagttaccgcgccttgatcagcgcttttagtaggcttactcgtttggatgactttacctgtgaaaagatcggctccggattttttagcgaagtgtttaaggtcagacatagagcaagtggccaagtcatggcactgaagatgaacactctctcctccaatagggctaacatgctgaaagaggtgcaactcatgaacaggctctcgcatcctaacatcttgagattcatgggcgtctgtgtacatcagggccaacttcatgctcttacggagtacattaacagcgggaatctagagcagcttcttgattccaacctgcatctcccatggacggtcagggtgaagttggcctacgacatcgccgtggggctgtcatatctccattttaaaggaatattccacagagatcttacctccaagaattgtctgattaaacgagatgagaatggttacagtgcggtggtggccgatttcggattagccgagaaaattcctgatgttagcatgggctccgaaaagttggcagtcgtgggcagtcctttttggatggcacccgaggtcttacgggatgaaccctacaatgaaaaagccgacgtcttctcttacgggattatcctgtgcgaaatcattgcccggatacaggcagaccccgactatctgccacggaccgagatggatccaaagttgcgtccatcttttgttgagatcggcaagaccctcgaagaaattctatcccggttgcaggaagaagagcaggagagagacaggaagctgcagccaaccgccagggggctcctggagaaagccccaggcgtgaagcggctctccagcttagatgacaaaatcccccataagtctccttgccccaggaggacaatttggctgagtcggtcccagtcggatatcttttcccggaagcctcctagaaccgtgtctgtgctagacccctactacaggcctcgcgacggagccgctcgcacaccaaaggtgaacccctttagtgctcgacaggatctgatgggcggcaagatcaaattctttgatttaccctccaagtccgtgatttctctggtctttgatttagatgcccctggaccggggactatgcctcttgccgactggcaggaaccgttggctccccctatcagacgatggaggtccctaccaggctcccccgagttcctgcaccaggaggcttgtcctttcgtggggcgggaggaatccttgtccgatggccctccaccacgcctgagttcgctcaagtaccgcgtcaaagaaattcctccctttcgggcctccgcattgccagccgcacaagctcatgaggctatggattgctcaattctccaggaggaaaatggctttgggagccgaccacagggcaccagcccatgccctgcaggggcttccgaagagatggaggtggaggaacgccctgctggcagcacaccagccactttcagtacatcagggatcgggctccagacccagggtaaacaggacggttag

SEQ ID NO: 14759 - DNA, 786 bp, Artificial Sequence
  Description of Artificial Sequence: Synthetic coding sequence
atgggtagcagaaagaaggagatcgctctacaagtaaatatctcaactcaggagctttgggaagagatgttatcaagcaaaggcctcactgtggttgacgtctaccagggctggtgcggcccctgtaagcctgtcgtctctctgtttcaaaagatgcggatcgaagtgggactggaccttctgcatttcgccttgatcaaagatgaggccttgtcagatgaggacgaatgtgtgtcccacggtaaaaataatggggaagacgaggatatggtgtcatctgagcgcacttgtactttggcaatcatcaaacccgatgccgttgctcatggtaagacggacgagatcattatgaaaatccaggaagccggcttcgaaatcctgactaacgaagagcgcacaatgaccgaggctgaggtgcgacttttctaccagcacaaagctggagaggaggcgttcgaaaaactagtgcatcacatgtgtagtgggcctagccacctcctgattttgaccagaacagagggttttgaagatgttgtgaccacatggaggacagtcatgggtccccgtgatcctaacgtggcaaggcgtgagcagcccgaatcccttagagcccagtacgggacagaaatgcccttcaatgctgttcacggctccagggatcgcgaggatgccgaccgagaactcgccctgttgttcccaagcctcaagtttagtgataaggacaccgaagcaccccagggggagtctagtacacagcctcgcttgaagatcaccgatctcgactag

SEQ ID NO: 14760 - DNA, 1767 bp, Artificial Sequence
  Description of Artificial Sequence: Synthetic coding sequence
atggaggccgcggatgcttcgcgttctaatggtagcagcccagaagctagagacgcgagatctccgtccggccccagcgggtccctcgaaaatggaactaaagccgacgggaaggatgccaagaccacgaacggccacggaggcgaggctgctgaaggtaagtcattaggctcagctctgaagcctggagaaggaagaagcgctctcttcgccggcaacgagtggcgtagacctattattcagtttgttgagagtggtgacgataagaattcgaattacttttcaatggacagtatggaagggaaacggtcaccttatgctggcctccagctaggcgctgccaagaagcccccggttacattcgctgaaaagggggagctccggaaaagtattttttccgagtcacgcaagccaactgtatctataatggaacccggagagactcggagaaacagctatcccagagcagatacaggcctcttcagccgatccaaaagcggaagtgaagaggtgttgtgtgatagttgcataggaaacaagcagaaagcggtgaaaagttgcctggtgtgccaagcttctttctgtgagttacacctgaaaccccacctggagggcgccgcgttccgagaccatcagctcctggaacctatccgggacttcgaggcacgcaaatgccccgtgcatggaaagaccatggagctattctgccagaccgatcagacttgtatatgctacctgtgcatgttccaggaacataagaaccattctactgtaacagtggaagaagccaaggcagaaaaggaaactgaactgtccctccagaaagagcagcttcagctgaagatcatagagatcgaggacgaggcagagaagtggcagaaggagaaggatagaatcaagtcttttaccactaatgaaaaggccatccttgaacagaattttagagatctggttcgcgacctagagaaacagaaagaagaagtcagagcagccctggaacaaagagagcaggatgccgtggaccaggtgaaggtgattatggatgctctcgacgagagagcaaaggtgctgcacgaagataaacaaacacgagagcagctgcatagcatcagcgatagcgtcctgttcctccaggagttcggagcactgatgagtaactatagtctgccgcctcccttaccaacgtaccatgtgctactcgagggagaaggcttaggccagtccctgggcaacttcaaagacgatctcttgaatgtctgtatgcgtcacgttgaaaagatgtgcaaagccgatctgtctcgcaatttcatcgagagaaatcatatggagaatggcggagaccacaggtatgtgaacaactatacaaacagttttgggggtgaatggtccgcgcctgacacgatgaagcgctatagcatgtatctgacccctaaaggcggagtgcggacaagctatcaacccagtagcccagggaggtttaccaaagaaactacccagaagaattttaataatctgtacgggacgaaaggaaactacacttcgcgcgtctgggaatactcctcatctatccagaacagcgataatgatctgcccgtggttcagggctccagctcttttagcttgaagggttaccctagtctgatgagatctcagtctcccaaggcgcagcctcagacgtggaagtctggaaaacagacgatgctgagccactaccgaccattttatgtgaacaaaggaaacggcatcggcagcaatgaagcaccctag

SEQ ID NO: 14761 - DNA, 3567 bp, Artificial Sequence
  Description of Artificial Sequence: Synthetic coding sequence
atgaaaaaaaaacaaactgtgcagggtacattcagcaagctctttgggaagaagcacacgacgacgccctccacctccctttacgcaaccaaccccccctggatatttactcaggaggcacctgaagaaggaaccggcggatttgatggcatttattatggcgacaatcggtttaataccgtctccgagtctggtaccgccacgcttaaggctcggccccgggtgaggcctttattaacattcctgcctcttaatgcacaagaaaatcacgggctcgcagtgccaactccctcggtgcctgacgatttcgccgataaggaggtcacaggcacctcgtccctggtcaatgggaacctccgactttatagtagcgtcggggatttgcggcctggtcagtatggacaggacctgctgataccaccaccgcctccgggaccggcaccaggaccgcctcaagacatctccgagcccccaggcggttcaccactgccttcccccccttcaaccgcaccccctccccctccactcttgctcgagccaccaccgccaccctcaatggccccacctcctccgcccgtcttggaggccctttctccgccccacacactctcctccccgagtatccccactccaccagacttcatccctccggctccaccccttgcgtttcttgcgcctcctccgccgcccgtgcctgcccctgcgcctcccgctcctgcttcgccccataccgttggtaccagactttttccacctgggggagttacgaaatggaagagcgacgtggccctgaacggtaggcaggcggaggccacacgggcctccccacccaggagccccgcagagcccaagggttccgcactgggccctaaccccgaaccacatctcacttttcctcggagctttaaagtccccccaccaaccccagtgcgaacatctagcattcccgtacaagaagcacaagaagcaccaaggaaagaagaaggagccacaaagaaggccccttcaaggctgccacttccaccatctttccacatacgcccggcctcccaggtctaccctgacagagcccccgagcctgactgtcctggcgagctgaaagcaactgcacccgctagtccaagattggggcaatcccaatctcaagcagatgagagagccggaaccccaccaccagctccaccactgccacccccagccccaccattgccaccccctgctcctcctctccctccagcagcaccgcctcttccatgtgcccaaaaggctgctcacccgccagctggatttaccaagactccaaagagctcgtctcccgctctcaagccaaaacccaatcccccatcccccgaaaacactgcaagtagtgccccagttgactggcgcgacccaagtcaaatggagaaattaagaaatgagcttgccgcctacctgtgtgggagccgccgggaagataggttcctttcacatagaccagggccaaccgtcgcccctcaatccaaagagggaaaaaaagggcctaggctgccagaaaaggagacactacttagtctcccagccaaagacacacctccgggagtgccagagaagagccttggcgggtctagtttaaccgaaacagaggctgctccatccctgacattgccatccgttgattatattccacaggattctcccactccctccgtccgccagatacgcaacgaactggaagcacgcctgtccagcgcagccgagaaagaagccaaaccaagcatcggctctcttcctcctaagcctaggctcgaaggagggcgaatatgtgagaacggcgctgacgatgataagttgtccaaacctgtggccaagaatttgcctccccaatctaccactcttctgcctaccacatctctgcagcctaaggccatgctcggtccagcaatccctcctaaggcgactccggagccagccattccaccaaaagctaccctgtggcctgctactccaccaaaagcaacactgggaccggcaacaccactcaaagccacctccggtccgacaacccccttaaaagccacttcagggccagcaatagcttccaccgccacaacgctcccaactaccacttctcagctgatggccgagaaggacagcggcccagcgggacaaccagagaaacctgcgtcgcaggaggtgtctaccccgagccaggcacgcggagagggctctcccagtgaagccacaagactccctacccaaggcgccagaagcagcgctgcatttcctcctaaaacctccccaggggggggagaggtaccttgcctttacaagccacattgtcaccagtcaagcctgtcccgggaagtcgccgtggtgatgcccactttagcacgagggggagccgctggccccggcgagcccgtggaggtgaaggaacctcctggacttcccgccaaaccacctgccagcgcgcagcccactgacgagctgcttaggcatccggttacaggtgaggtggttgaacggggtagccctatggccttactattagcagcacggcaacgggctcaaaaaggccgatcagtgggggctgccctcgggaggtcaagtctgcccggcagcttacgtgatcactctcatcaagcagaggcatcaagtgattctatcttccacagtcaggggaccccgaattctttcacggttgtcccgaagctgccaaaagaggccgagaaggattcgcccctcacaactgaaatccctaacaagtgggggccgaggctggggcgcgatgctgaaggcacagaactttctcggcgccataattggaccaaaccggagccccaggctccggtggcatgggagcgcgttgcgccttccaaccttcctcaaggtcatcccctccctaagtccttttccagcccaccaagccccagtaataaacgagaagaagaggaggaagagttcaacttcgaggtgattccaccgccccccgaattctcaaatgaccctgagcctccagcccccgcactgcagtatctaggtagacaaagctctcctccaaggaacaattatagcgacttgcgccagctgcctaatgctggcccaggagctcctcctgctctgggcttttccagatttcctgccggagctcgctacgcaggcgctggcggccttgagcgcttttcgggaggtgggcggagcctaataaagaagcggctctacgtcggagaaccgcatcgtggacccggtctgccccacggcgggaccggccggtctctatcaagtccgaactgtttcggtccccaacccgggggccccgaaatgcggagagtgaactctgcggggagagcgcccccagggggcctgcacgcccctaggctcagtctggagggggcggccaggggtgcggccgaagcgaaacacaaagctccaggctctgcagattatgggtttgcacccgccgctggccgatctccatatactaccaccagatatgggtcacccataaacacgttcactgtacggcccggaacacgacaccccattagctatgtctgcagcggtgcccacaggaaggcaacatcatag

SEQ ID NO: 14762 - DNA, 2598 bp, Artificial Sequence
  Description of Artificial Sequence: Synthetic coding sequence
atggccgtggcccgagtggatgcagccttgcctcctggagaagggagcgtggtcaactggagcggccagggcctgcaaaagctggggccaaacctcccgtgtgaggcagatattcacacactgattttagataagaaccagattatcaagcttgaaaatttagagaaatgcaaacgcctcatccagcttagtgtggctaataaccgattagtgaggatgatgggagtggcaaagctgaccctgcttcgcgtgcttaatcttccacacaatagtatcgggtgtgtagagggccttaaagaattggtccacctggaatggctcaatctggccggtaataatctgaaggcgatggagcagataaattcatgcaccgccctccagcacctcgacttgtccgataataatattagccagattggcgatctatccaagctggtctccctaaagactttacttctgcacggcaacatcattacatccctccgtatggctccggcctatctgcctcgttcactcgctatcctgagtttggcagagaatgagatcagggacctgaatgagatcagcttcctggccagcctaactgaactggagcagctgtctataatgaacaacccctgcgtgatggcaacaccctctataccgggctttgattacaggccttacatagtctcatggtgtcttaacctgcgagtgctggacgggtatgtgatcagtcagaaagaatccttgaaagctgaatggctgtacagtcagggaaaaggacgggcataccgccccggccagcacattcagctggtgcaataccttgccacagtgtgtcccctcacgagtacactgggcttgcaaacagccgaggacgcgaagctggagaaaatactatcgaaacagcggttccaccagcggcagctgatgaaccagagtcagaacgaggagctgtcaccactggtgcccgtggagacaagagcctctcttattcctgagcattcatcacctgtccaggattgccagatctcccaggagagcgaaccggtgattcaggtgaatagctgggtaggaatcaactcaaacgacgaccagttgttcgcagtgaagaataatttcccagcctctgtgcatacaacaaggtactctcggaacgacctgcacctagaggacatccagaccgatgaggataaactgaactgctctctgttaagctctgagagtacctttatgcctgttgcttccgggttgtctccactgtctcctacagtggaactgcgcctgcagggtattaacctgggtctggaagatgatggagtggcggacgagagcgtcaagggactggagtctcaagtgctggacaaagaagaggagcagccactgtgggctgcaaacgagaacagcgtgcagatgatgagatcagaaattaacaccgaggtcaatgagaaggcgggactcctcccgtgcccagagcctactataatcagcgctatcctgaaggacgataaccactcattgacctttttcccagaaagcacggaacagaagcagtctgatatcaagaagcctgagaatacacagcctgagaataaggaaaccatttcacaagctacctctgaaaagctgcccatgatattaacacagcggtccgtcgcactgggccaagacaaagtagcgctgcagaagctgaatgacgcagccactaagctgcaggcctgctggcgcggcttctacgcccgcaattataacccacaggccaaagacgtaagatatgagataaggctgaggaggatgcaggagcatattgtttgcttaacggatgagattcgcagacttcgcaaagagcgtgacgaggagcgtatcaagaaatttgtgcaggaggaggcctttcggttcctgtggaatcaagttcggtccctgcaggtgtggcagcaaaccgttgaccagcgtctgagttcctggcatacggatgtcccccctatcagcagtacacttgtgccgtcaaagcacccgctcttcacacagtcccaggagtcctcctgtgatcagaatgccgattggttcatagcatccgatgtggccccccaggagaagagcctacccgaattccctgacagcgggttccattccagtttgacagaacaagttcactctctgcagcactctctcgatttcgagaaatccagcactgagggcagcgagagcagtattatgggtaacagcatcgacaccgtgcggtacggcaaagagtctgacctgggcgatgtttctgaggagcacggagagtggaataaggagagctccaacaacgagcaggacaactctcttctggagcaatatttaacttcagtgcagcagttagaagacgccgacgaacgcaccaactttgataccgagacacgcgacagtaaactgcatatcgcttgcttccctgtacaacttgacaccctgagcgatggagcgagcgttgacgagtcccacggaatttcaccaccattgcagggagagatatcccaaacacaggagaattctaaattaaatgcagaggtgcagggacagcagccagagtgtgacagcaccttccagctgctgcacgtgggcgtgactgtctag

SEQ ID NO: 14763 - DNA, 1275 bp, Artificial Sequence
  Description of Artificial Sequence: Synthetic coding sequence
atgagcgttgggtgtcctgagcccgaacccccacgatctctgacttgctgtggccccggtacagccccaggccctggagcaggcgttccactgctcacggaagatatgcaggcccttactttgaggacacttgccgcaagcgatgtgaccaaacattacgagctcgtaagagagctcggcaagggtacatacggaaaagtcgatctggtcgtgtataaaggtaccggcacgaagatggcactgaagtttgtaaataagtcgaaaactaagctcaagaacttcctaagagaggtctccatcactaactccctgtcatcgtctccatttatcattaaagtcttcgacgttgttttcgaaaccgaggattgctatgtcttcgcccaggaatacgcgcccgcaggagatttgtttgacataatcccgccccaggtgggtctccccgaggacacggttaaaaggtgtgtccaacaactgggtcttgccttggactttatgcacggccgccaactggttcatagggatattaagcccgagaatgttctgctttttgatcgagagtgtagaagagtaaagctggcagactttgggatgacaagaagagtgggatgtcgggtcaagcgcgtctcgggaacaatcccatacacggcacccgaagtgtgtcaggccggccgtgcagatggcctggcagtagatactggggtcgacgtctgggccttcggggttcttatattctgtgtactcactgggaatttcccttgggaggccgcaagcggggcggatgcctttttcgaggaatttgtccgctggcagagaggcaggttacccggcctgccaagccagtggcgtcggtttacggaaccggccttgaggatgttccaacggctgctggcactcgaacccgaacgtagaggtcccgctaaggaagtgtttagattcctgaagcatgaactgacatccgaactacgacggcggcctagccaccgcgcccgcaaaccacccggtgacaggccgcccgccgcaggacctctcagactcgaggcacccggccctctgaaacgcaccgtcttaacagaaagcggatcagggtcccggcctgcaccccccgcagtaggtagtgtgcctctgcccgtgcctgttccggtcccagtgccagtgcctgtgccggttccagaacccgggttggcccctcaaggtccacctgggagaacggacgggcgggcagacaaatctaaaggacaggtcgtactcgctacagctatcgagatttgcgtgtag

SEQ ID NO: 14764 - DNA, 1632 bp, Artificial Sequence
  Description of Artificial Sequence: Synthetic coding sequence
atggccactaggcgactgggggtgggcgagactctgggcgcactcaatgccgctctgggaccaggcggacctgtgtggataaaggagacgaggacgcgccaccttcgctctcgcgacttcctggcaccccaccgagccttgcaagcaaggttcgatgacggccaggttcctgagcacctcctccacgcactagcatgcctgcaaggaccgggtgttgcgcccgtcctgcgctgtgctcccacgcctgcgggcctatccctacagctgcagcgaagtgctgtgtttgaaagagttttgtctgccgtggctgcttacgccacaccggccagcccagcttccctggggcagagagtactgctccattgtcccgcacttcgatcctctccctgtgccctaagactttcacagctgcgaaccgtgctggtggctgaccatctggcacgggcgctccgggcgcatggtgtctgtgttagactggtgcccgcggttcgtgacccccacatgctgacattcctccagcaacttcgcgtggactggccagccgccagcgaaagagcatcctcacacactctcagatcacatgcattggaagaactaacaagcgccaacgatggacggacactcagccctggcattctcggacgactgtgcctcaaggaactggtggaagagcagggccggacagcaggatacgatccgaatcttgacaactgccttgtcaccgaggatttgttgtctgttcttgcggaacttcaggaagccctatggcactggcctgaagatagccatccaggtctcgccggagctagcgacaccggaactggcggctgtctggttgtgcacgttgtcagctgcgaagaagagtttcagcagcagaagttggatttgctgtggcagaaactggtggacaaagccccccttagacagaagcacttaatttgtggaccagtgaaagtggcgggcgccccgggtacacttatgacagccccagaatactatgagtttcgccatactcaggtgtgtaaggcctctgccctgaaacatggaggcgatctggcccaagaccctgcgtggacagagatcttcggtgtcttatcggtcgccactattaagtttgaaatgctttctactgccccacagtctcagctgtttctcgctctcgccgatagcagtattagcacaaaaggaaccaagagtggtacttttgtgatgtataattgcgcccgcctcgctactctgttcgaaagctacaagtgttccatggaacagggactctaccctactttccctccagtctcaagtctcgattttagtctcctgcacgacgaaggcgaatggctcctgctgttcaattccatcctcccgttcccggacctactcagccgcaccgccgtgttggattgtacagctccgggcctgcacatcgccgtgagaacggaaatgatatgcaagttccttgtgcagctgtcgatggacttcagctcttactataacagagttcacatcctcggtgaacctcggccacatctgtttgggcagatgttcgtgagactgcagttattgcgagcagtgcgtgaagtcctgcacacaggtctggccatgctgggattgcccccattaagccacatctag

SEQ ID NO: 14765 - DNA, 1353 bp, Artificial Sequence
  Description of Artificial Sequence: Synthetic coding sequence
atgggaaagagttttgccaactttatgtgcaaaaaagacttccaccctgcgtcaaagtccaacatcaagaaagtctggatggccgaacagaaaatatcctatgacaagaagaagcaggaggagcttatgcagcagtacctaaaggagcaggagtcctatgacaatagactgttgatgggagacgaaagggtaaagaatggcctgaattttatgtacgaggctccacccggcgccaaaaaagaaaacaaggagaaagaggaaacagaaggtgagacagagtacaaattcgagtggcaaaaaggtgcgccccgggagaaatatgcaaaggacgacatgaacatcagggatcagccgttcggcatccaggtccgtaacgtacggtgcattaagtgtcataaatggggtcacgttaataccgatcgagagtgccccctttttggattgtccggtattaacgcctccagtgtcccaacggacggcagtggacccagcatgcacccctccgaactgatcgccgaaatgaggaactctggattcgccctgaagcggaacgtgctcggaaggaacctcacggccaatgatccctcacaggagtacgtagccagtgagggggaagaagaccctgaagtcgagttcctcaaaagcctgacaacaaagcagaagcaaaaattactgaggaagctggatcgcctggaaaagaaaaagaaaaagaaggatcggaaaaagaagaaattccaaaagtctcgtagcaagcataagaaacataagtcatcctcctcaagcagctcaagcagctctagctcatccagcaccgaaacctcagaatcctcctcagaatccgaatctaataacaaagagaagaagattcagcggaagaaaaggaagaaaaacaagtgttccggtcacaacaactcagactccgaagagaaggacaagagtaagaagagaaaattgcacgaggaactgagtagctctcaccacaaccgggagaaagccaaggaaaagccccgtttcttgaaacacgagtcttcacgagaagacagtaaatggagccattcggactcagacaaaaaaagtagaactcataaacactcacccgagaagagggggtctgagaggaaggagggctcttcccggtctcacggccgggaggagagaagtaggcgcagtagaagccgctctccgggcagttacaagcagagagaaacacgaaagcgcgcccaacgcaacccaggggaagagcagagtaggaggaatgattctaggagtcacggaaccgatctgtatcgcggagaaaagatgtacagggagcacccggggggaacccacacaaaggtcacgcagcgcgaatag

SEQ ID NO: 14766 - DNA, 1152 bp, Artificial Sequence
  Description of Artificial Sequence: Synthetic coding sequence
atgagtcccgaagtagcccttaatcgcatcagccccatgctttctcccttcatctcttccgtggtccgcaacggaaaggtggggctcgacgccacaaactgcctaaggataactgaccttaagtcaggttgcaccagcctgacccctggacccaattgtgaccgcttcaaacttcatatcccttacgcaggcgaaacgctcaaatgggatattatctttaatgcacaatatcccgaactcccgccggacttcatctttggggaagatgctgagttcctgccagacccttctgccttgcagaatttggccagctggaacccatctaaccccgaatgcttgctgctggtggtgaaggaactggtgcaacagtaccaccagtttcagtgctcacggctccgagaatcttctcggcttatgttcgagtaccagaccctgttggaagaaccccaatacggagaaaacatggagatctacgcaggaaagaagaacaactggaccggagagtttagtgccaggtttctgctgaagctgccggttgacttctcgaatattccgacatatctgctgaaggacgtaaatgaggatccgggggaggacgtagccttacttagcgtatcctttgaggacactgaggcgactcaggtttaccccaagctttacctttcccccagaattgagcacgctctgggggggagctctgcactacatatcccagcttttcctgggggcggctgcctcatcgactacgtaccccaggtgtgccacctcctgaccaacaaggtgcaatatgtgatccagggatatcacaaacgaagagaatacatcgcggccttcctgtcccattttggcacaggggttgtggagtacgatgccgaggggttcacgaaactgaccctgctcttaatgtggaaggacttttgtttcctcgtgcatattgacctccctctgtttttccctagggatcagccgactcttacttttcaatccgtgtaccacttcaccaattctgggcaactgtattctcaggctcaaaagaactacccctactccccccgctgggatggcaatgagatggctaagcgtgccaaggcttactttaagaccttcgtcccacagttccaggaagcagcatttgctaatgggaaactctag

SEQ ID NO: 14767 - DNA, 675 bp, Artificial Sequence
  Description of Artificial Sequence: Synthetic coding sequence
atgcccaacagatgcggcatcatacacgtacgtggccccatgccccctaataggatctctcacggtgaagtccttgaatggcagaagacattcgaagagaagctcacacctctgttatctgtgcgggagtctttaagcgaagaagaggctcaaaaaatgggccgcaaggatcccgagcaggaagtcgagaagtttgtcacctccaacacccaagagctcggtaaggacaaatggctctgccccctctcaggtaagaaatttaagggaccagaatttgtgcgaaagcacatctttaataagcatgctgagaaaattgaagaagtcaagaaggaagttgcgttctttaataacttcctgacggatgctaaacggcctgctttgccagagattaagcccgctcagcctcccggacccgcgcagattttgccgcctgggctgacacctggcctcccttatccacaccaaacaccacaaggattgatgccatacgggcaaccacgcccacctatagggttatggtcttggtgttgccccccctgttccccccaggaggcactgcatacacctatgccccggatggtgctggtggagggcacgatgatgccatccgaggccagagaagtgatcctggggaacctcgctacaggctggttcgtcgaaacccagggcccctag

SEQ ID NO: 14768 - DNA, 4806 bp, Artificial Sequence
  Description of Artificial Sequence: Synthetic coding sequence
atggaggccgggagcgttgttcgggctatttttgatttttgtcctagcgtcagcgaggaacttccgcttttcgtcggggacataatcgaggtgttagctgttgtagatgagttctggcttctgggcaaaaaggaagacgtcacaggtcagtttccttctagctttgttgaaattgtaaccattccgagtctgaaggaaggcgaaagactctttgtttgtatctgcgagttcacaagccaggagctcgataatttgcccctgcataggggggaccttgtaattctggatggcatcccgaccgccggttggctccagggaagatcttgctggggagcgcgcgggttcttcccttcctcgtgcgtcagagagctatgtttgtccagccagagcaggcagtggcactcacagtccgctctgtttcagattcccgagtattccatggggcaggcaagagccctgatgggcctttccgcccaactcgatgaggagctcgactttcgggaaggcgatgtcatcacaattattggggtgcccgagcccggctggttcgaaggggagctggagggccggagaggaatttttccagaaggttttgtggagctcctgggccccttgcgtactgtagacgaatccgtctcctcaggcaatcaggatgattgcatcgtgaacggtgaggtggacaccccagtgggagaggaggaaattgggcccgacgaagatgaagaagagcctggtacatacggtgtggccctgtatcgatttcaggcgctggagcccaacgagctggatttcgaggtcggtgacaagatccggatcctcgcgacactggaggacgggtggttggaagggtccctgaaaggcagaacgggcatctttccttaccgcttcgtgaaactttgtcccgacaccagagtggaggagacaatggctcttccgcaggagggctccctggcgcggatcccagaaacaagtctggattgtctcgagaataccctgggagtcgaggaacagcgccacgaaacttccgatcacgaagccgaagagcctgactgtatcatttctgaggcacctacaagccccctcggccacctcaccagcgagtacgacaccgatcgcaacagctaccaggacgaagacactgcgggtggaccaccaagatctcctggcgtggagtgggaaatgcctctggccaccgactctccgacaagtgacccaaccgaagtggttaacgggattagcagccagccgcaggttccctttcatcccaatcttcagaaatctcagtattattcaaccgttggcggttcgcacccacacagcgagcaatatccggacctacttccgcttgaagcacgaacaagagactatgcaagcctccctcctaaaagaatgtatagccaacttaaaaccctacagaagccagtgctcccactctatagaggctcatccgtctcagcttcacgggtggttaagccccgccagagcagcccccagctgcataacctcgcctcatataccaaaaagcaccatacgagctcagtttatagcatatcggagcggctcgaaatgaagcccggtccacaggctcagggactagtcatggaggctgccacgcattcccaaggggacggcagcacagacctggatagcaagttaactcaacagctcatcgaatttgagaaatccctggccggtcctggaacggagccagataaaatattgcgacacttcagcataatggactttaattccgagaaggatatcgtgcgcggctcatctaagctaatcacagagcaagaattgcccgagcgacgcaaagcgctgcggccgccacctcccaggccgtgcacaccggtatctacctcaccacacctccttgtcgaccagaacctgaaaccggcccccccactggtagtgagaccctcgaggccagctccacttccgcccagcgcccagcagcgcacaaacgctgtgtcccctaaactgctttctcgccatagacccacatgtgagacacttgagaaggagggaccgggacacatgggtcgaagcctggaccaaactagtccctgccctcttgtgctggtgaggattgaggagatggaaagggacctcgacatgtacagccgggctcaggaggaactgaatctgatgttagaagagaagcaagatgaatcgtcaagggccgagacactggaggacctgaaattctgcgagtccaatattgagtctctgaacatggagcttcagcagctgcgggagatgaccctgctcagttcccagtcaagctcccttgtcgcccccagcgggagtgtgtccgccgagaaccccgagcagcgaatgcttgagaaacgggcaaaggtgattgaggagctattgcagacggaacgggactatatccgcgatcttgaaatgtgcatcgagcgcatcatggtacctatgcagcaggctcaggtgccaaacatagacttcgaagggctgtttggcaatatgcagatggtgatcaaggtgtccaagcaacttttagccgcccttgagatcagcgatgctgtgggtccagtctttctcggtcacagggatgagctggaaggcacctacaaaatctactgtcagaatcatgacgaggcaatcgcgctcctggagatttacgagaaggatgagaagattcagaaacaccttcaggactcgctcgcagaccttaaatccctgtacaacgagtggggttgcacaaactacattaatctgggaagcttcctcatcaaacccgtgcagagagtgatgagataccccctgcttctcatggagctactgaacagtacccccgagtcacaccccgacaaggtccccttgactaatgcggtgttagcagtgaaggaaattaacgtcaatattaacgagtacaagcggcggaaagaccttgggaaaaattcgattatcgcggagaaggagtatgcccatgcagaggagtcagccttcctgacttactcgttagtcctaaaatatcgcaaaggtgatgaggatagcctgatggagaagatatctaagctgaatatacactccattattaaaaaatcgaatagagtcagctcccacttgaaacacctgacgggcttcgcgcctcaaattaaggacgaagtatttgaggagaccgaaaagaactttagaatgcaggagaggctaataaagtcatttatccgggacctgtcactgtacctgcagcacatcagggagtcagcatgcgtgaaagtagtggccgccgtgtctatgtgggatgtgtgcatggaaagaggacacagagacctggagcaattcgagcgggtccaccggtatatttccgaccagctgttcaccaatttcaaagaacggaccgagcgtttggtcattagtccgctgaaccagcttctttctatgtttacgggcccgcataaactggtgcagaaacgctttgataaactcctcgacttctacaactgcacggaaagagcagaaaaactgaaggacaaaaagacactggaagaactccagtcagcccggaacaactacgaggcattgaatgcacagctgcttgatgagctgcctaagttccaccagtacgctcaaggtctgttcactaattgcgtgcatggctatgccgaagctcattgtgactttgttcaccaggctctggagcagttgaagcccttgctcagtttgttaaaagtagcggggcgggagggcaacctaattgctatttttcatgaagaacattccagggtcttgcaacagctacaggtattcacattcttccctgagagcctgcccgcaactaagaagcctttcgaaagaaagacaattgatcgacaatctgctagaaaacctctgcttggactgccttcatatatgttgcagtccgaggaacttagagcctcactgctcgctagataccccccggagaagctttttcaggccgaacgtaactttaatgccgcacaggacttagacgtgtcattgctggaaggcgacctggtaggcgtgatcaagaagaaagaccccatgggctcgcagaatcgctggctcatagacaacggggtaaccaaagggttcgtatactccagctttctaaaaccctataaccccagacggagtcacagcgatgccagcgtcggaagccactccagtacagagagcgaacatggttctagctcccctcggtttccccggcaaaattccgggagcactcttacctttaatcccagttcaatggcggtgtcatttacttccggatcctgtcagaaacagcctcaggacgcgagtccaccaccaaaggagtgcgatcaaggcactctgtcagcctcattaaacccttccaactcagagagtagtccttcacgctgtcccagcgacccagatagcacatcccagccaaggtccggagattccgccgatgttgcgagggacgttaaacagccaacagccactccgcgctcatataggaactttagacaccccgaaattgtgggctattctgtgcccgggcgcaatgggcagagccaggatctggtcaagggctgcgcccgcaccgcacaggccccagaagatcgcagcaccgagccagacgggtcagaagcagaggggaaccaggtttactttgccgtctatactttcaaggctaggaaccccaatgagttgtctgtctccgccaatcagaaactcaagatcctggaattcaaggatgttacaggtaacaccgagtggtggctcgctgaagtaaatggtaaaaaagggtacgtacccagcaattacattcgaaaaaccgagtacacctag

SEQ ID NO: 14769 - DNA, 1596 bp, Artificial Sequence
  Description of Artificial Sequence: Synthetic coding sequence
atgaagtgccattatgaagcgctgggggtgaggagagatgccagtgaagaagaactaaagaaagcctatcgtaaattagcactgaaatggcacccagacaaaaatttagacaatgctgccgaggctgccgagcagtttaagctcatccaagccgcctatgatgtcctgtccgacccacaggagcgtgcatggtatgataaccaccgggaggccctgttgaaaggggggtttgacggtgaataccaagatgatagcctggatctactacgctatttcactgttacttgttacagcggctatggcgacgatgagaagggcttctatactgtgtacaggaatgtgtttgagatgatcgccaaggaggaattggaatctgtattggaggaagaggtggatgacttccctactttcggcgatagccagagtgactatgacacagtcgtacacccattctatgcatattggcagtcgttctgcacacaaaaaaatttcgcttggaaagaagaatacgatactcgtcaggccagtaatcgctgggagaaaagagctatggaaaaggagaacaaaaaaattcgcgataaagctcgcaaagagaaaaatgaactcgttagacaactggtggctttcattcgcaaacgcgataagcgtgtccaggcccacagaaaactagtggaagaacaaaatgccgaaaaggcaaggaaggctgaagaaatgaggaggcagcaaaaactgaagcaggccaaattggtggagcagtaccgggagcagtcatggatgacaatggcgaatctggaaaaggagctccaggagatggaagctagatacgagaaggagtttggggacggtagtgatgaaaatgagatggaagagcacgagctgaaggacgaagaggatggaaaggattctgacgaagctgaagacgctgaactgtatgatgatctatactgtcctgcgtgtgataagtccttcaaaaccgaaaaagcaatgaagaatcacgaaaagtctaaaaagcatagagaaatggtggcactactgaagcaacagttggaggaggaagaggaaaatttcagcagaccccagatagatgaaaaccctctcgacgacaattccgaagaggaaatggaggacgccccaaaacagaagctcagcaagaagcagaaaaaaaaaaagcagaaacctgctcagaattacgatgacaactttaatgtgaatggacccggggaaggggtcaaggtggaccccgaggatacaaacctcaaccaggattcagccaaagaactcgaagacagcccacaggagaacgtgagcgtaacagagataatcaagccctgcgatgatcctaagtcagaggccaagtcagtgcccaaaccaaagggaaagaagacaaaagacatgaagaagcccgtccgggtgccagccgagccccagacgatgtcagtacttatttcttgcacgacttgccacagtgagtttccttcgagaaacaaactgtttgaccacctaaaagccaccggacacgcacgggcgccttcctcctcatcgctcaacagcgccacaagctctcagagcaaaaaagaaaaacgcaaaaatcgatag

SEQ ID NO: 14770 - DNA, 1353 bp, Artificial Sequence
  Description of Artificial Sequence: Synthetic coding sequence
atggtagtccaggccgctgtggcaccaaatcggagccaaagacttctgttaaaaatcccttacggcagtcttcgccgacgtagcgtggaacgtatgacggagggacgaaggtgtcaggtccacctgttggatgatcgtaagctcgagttgttggtacagcccaagttgctcgctaaggagctgttggatttggtcgcaagccattttaacttaaaggaaaaagagtatttcggcattgcattcactgatgaaaccggacacctgaattggttacaactggaccgccgggtgcttgaacatgatttcccaaaaaagagcgggccagtggtcctgtacttttgtgttaggttttacattgagtcaatcagttacctgaaagacaatgcaaccatcgagctcttttttctcaacgccaagagctgtatatacaaagaactgatcgacgttgactctgaggtggtgttcgagctggctagctacattctccaggaggcaaaaggcgatttctcttccaacgaggtcgtgcggagtgacttaaaaaagctgcccgccctgcctacccaagctcttaaagaacacccatccctggcatattgcgaggatcgggttattgagcactataagaaattgaatggccaaacaagagggcaggcaatcgtcaactacatgtccatcgtggagtccctgcccacttacggtgtccattattacgcagtgaaggacaagcagggcattccatggtggctcggactctcatataaaggtatctttcaatatgactaccacgacaaggttaagccacgcaagatctttcaatggcgccagttggagaacctgtactttcgggaaaaaaagttctctgttgaagtacatgatcccaggcgtgctagcgtgactaggcgcacatttggtcattcaggaatcgctgttcatacgtggtatgcctgcccggctctgatcaagtccatctgggctatggcaatatcgcaacatcagttctacctggaccggaagcagagcaaatctaagatacatgctgcacgatctctgtcagagatcgcaatagatctgaccgaaacagggacgctgaaaactagtaagctagccaatatgggctccaagggaaaaattattagtggatccagcggcagcctcctgtcttccggacggcagcggcccgcagggggcaccccccctgagcacggttgggacccaaggggggatcccggcagatggggggagttgcaactggggcggctgcagggaaagttgctacagtcctggctctgcttccctgatcaggggtgggatcccaacgctaatcttaggaagctcctgccaggcatcaaatag

SEQ ID NO: 14771 - DNA, 1020 bp, Artificial Sequence
  Description of Artificial Sequence: Synthetic coding sequence
atggagggcgagcctcctcctgttgaagagcgccgtcgcctgcaggaggaactgaatgagtttgtggaaagcggatgcagaacgctggaggaagtaacagcttcccttggatgggatctggatagtctggaccccggggaggaagaggcagccgaggatgaggttgttatctgtccgtacgatagtaatcatcatatgcctaagagcagcctcgccaagcatatggcctcctgcaggttgcgcaagatggggtacaccaaagaagaagaggacgaaatgtataacccagagtttttctacgagaacgtgaagattccatccatcacgctcaacaaagacagtcagttccagatcattaagcaggcgaggacagctgtcggcaaggattcagattgttacaaccagcgcatttactccagtttaccggtggaagtccctctgaaccacaaacggtttgtttgcgacttaacccaagctgaccggctcgctctgtacgacttcgtggtcgaggaaactaaaaaaaagcggagcgactcacagataatcgagaacgatagtgatctcttcgtggatctggccgccaagatcaaccaagataacagtcgtaaatcgccaaaaagttacctggagatcctagccgaagtgcgcgattataaacggcggcggcagtcataccgcgctaagaatgtgcacattacaaagaaaagttataccgaggtgattagggatgtgattaatgtgcatatggaggaactgtctaaccactggcaggaagagcaggagaaagccgaggacgacgcggagaaaaatgaggaacgtcgaagcgcctcagttgatagcagacaatccggcggatcttacttggacgcagaatgctccaggcatagaagagacaggtctaggtctccccacaagagaaaacggaacaaagacaaggataagaactgtgagtcccggcgccggaaggagcgggacggggagcgccaccatagtcacaagcgcaggaagcagaagatttag

SEQ ID NO: 14772 - DNA, 6810 bp, Artificial Sequence
  Description of Artificial Sequence: Synthetic coding sequence
atggctgagcctagcagcgctagacgccctgtccccttgatagaaagtgagctgtattttctgattgcccgatatctgtcggccgggccctgtcgacgggcagctcaagtgttggtacaagagctcgaacagtaccagctgctgccaaagcgtctcgattgggaggggaacgagcacaaccggtcctacgaggaactcgtcctatctaataagcatgtggcccctgatcacctgctgcagatctgtcagaggattggacctatgttagataaggagatccctcccagtatctctagggtcacgtctttactcggcgcaggcaggcagtccctgttacgaacagctaaggactgtcgacacactgtgtggaaagggtcagctttcgccgctcttcacagaggccgccctcctgagatgcctgttaattatggatcacctccgaatctggtggaaatacacaggggaaagcaactcactggatgttcgacgttctctaccgctttccctggcactatgtatcagcatattaaaatgcacaggcgcatcctcggtcatctatctgctgtatattgcgttgcgttcgaccggactggccatcggatttttactggaagcgatgactgcctggttaaaatatggtccacacataacggccggcttctttccacgctgcggggccatagtgccgagatctccgatatggccgtaaattatgagaacactatgatcgccgcaggttcctgcgacaaaattatcagggtgtggtgtctcagaacatgtgcacctgtggctgttctgcagggtcacacgggcagcatcacttccctgcagtttagtccaatggctaaaggtagtcagaggtatatggtttccaccggcgctgacgggacggtgtgtttttggcaatgggatctggagtccctgaagtttagtcctcgaccactcaaatttaccgagaaacctagacctggggtgcagatgttgtgtagctccttttccgtcggaggaatgtttctagcaaccggatcaactgaccacgtgataaggatgtatttcctagggtttgaggctccagaaaagatcgccgaactggagagccacactgacaaagtggactcaatccagttttgcaacaatggcgaccggttcctgtctggctcccgggatgggaccgccaggatatggcgctttgagcagctggaatggaggagtattttgcttgatatggctacacggatttctggagacctgtcaagtgaagaggagcggttcatgaagcctaaagtgactatgattgcgtggaaccagaacgactcgattgttgtgactgcagtcaatgatcatgtgcttaaggtgtggaactcttacactggccagctgttgcacaatttaatggggcacgccgatgaagtatttgttttggagacccatccctttgattcacgcatcatgttgagcgcaggtcacgacggttctatatttatctgggacattacaaagggcaccaagatgaaacattactttaatatgatcgaaggccaaggccatggcgcggtgtttgactgtaaattttcccaagacggacaacacttcgcttgtactgattcccacggtcacctcctcatcttcgggttcggctgctcaaagccatatgagaaaattcctgaccaaatgttttttcataccgactatcgaccgttaatccgagattctaacaactacgtactggatgagcagacccagcaggctcctcacctgatgccccctccctttctggtagatgttgatgggaacccccaccccacaaaatatcagagactggtgccaggaagggagaacagcgccgatgagcacctcattccccagctgggctatgtggccacatcagacggtgaagtgatagaacaaattatcagtttgcaaacgaatgataacgatgagcggagcccagagtcttctattcttgacggcatgattaggcaattgcaacaacagcaagatcagcggatgggtgccgaccaggatactattccccgaggactcagcaatggcgaagaaactccaagaagggggtttcgccggctttcactggacattcagtccccacccaacatcggacttcgccggtctggtcaggtcgaaggcgtaaggcagatgcaccagaacgctccacgtagccaaatagccacagaacgggatttacaagcatggaagcgccgggtggtagtgcctgaagtgcctcttggtatttttcgtaaactcgaggactttagactcgagaaaggtgaggaggagagaaacctttatatcatcgggagaaaacgcaagacacttcaactttcccacaagagcgatagcgtggtcctcgtttctcaatccagacaaaggacttgtcggaggaaataccccaactatgggcgacgaaatcggtcttggagagagttgtcatccggaaacgagtcctcctccagcgtgagacatgaaacctcatgtgaccaaagtgaagggagcggctcaagcgaagaggatgaatggcgcagcgaccgaaaaagcgagagttacagtgagtcgtccagcgatagctcctcccgatatagtgattggacggcagacgcaggcattaatttgcagccgcctctaagaacctcatgccggcgacggattacacgcttttgcagttcatcggaggatgagatctctacagagaacctgtcaccccccaagagaagacggaaacggaaaaaagaaaacaaacccaagaaagagaatctgcgaaggatgacccccgctgagctcgcgaacatggaacacctttatgagtttcacccaccagtttggattacagatactaccctcagaaagtcacccttcgtgccacagatgggtgatgaggtcatttattttagacaggggcatgaagcctacatcgaggcggtgcgccggaacaacatctatgaactgaaccctaacaaagaaccctggagaaaaatggacctcagagaccaggaactcgtgaagatcgtcggaatcagatatgaagtgggcccacctaccctgtgctgtctgaaactggcgttcattgatccagccactggtaagctgatggacaaaagtttttctatcagataccacgatatgccagatgtcatcgattttctggtgctgcggcaattctacgacgaggcccgccagcgaaattggcagagttgcgatcgcttccgtagtatcatagacgacgcctggtggttcggcaccgtgctgtcccaggagccatatcagccccagtaccctgattcccatttccagtgctatattgtcagatgggacaacacagaaatcgagaaacttagcccatgggacatggaaccgattcctgataatgtggatccgccggaagaattgggcgcaagtatctccgttacgaccgacgagctggaaaagctcctgtacaaaccacaggccggcgaatggggacagaagtctagagacgaagagtgtgaccgtataatttctgggattgatcagctgctgaatcttgacatcgctgccgccttcgcgggtcccgtggacttgtgcacttacccaaagtattgtaccgtggtcgcctatccaacggacctgtacacgatcagaatgagactcgtaaatagattctacaggcgactgtctgcacttgtatgggaggttaggtacattgaacataacgcccgaactttcaacgaacccgagtctgtcattgcccgaagcgctaagaagatcaccgatcagctattaaagtttattaaaaatcagcactgtacgaatattagtgagctcagtaacacaagtgaaaacgacgagcagaatgcagaggatctggacgactctgacctaccaaagacaagcagcggtcgtaggcgagttcacgatggcaaaaaaagtatccgcgctacaaattatgttgagagcaattggaaaaaacagtgtaaagagttggtgaacttgatcttccagtgcgaggattccgagccattccgccagcccgttgacctggttgagtatcccgactacagagatattattgacactccaatggactttggaactgtgcgagagaccttggatgcagggaattacgattcccccttagagttttgtaaggacatccgacttatatttagcaatgctaaagcgtataccccaaacaaacgatcaaaaatctacagcatgactctacgcctttctgccctgtttgaggagaagatgaagaagatttcttccgatttcaagataggccagaagttcaacgaaaagttgcgtcgtagccaaagattcaagcagagacagaactgcaaaggagacagtcagcctaataagtctatcagaaacctgaagcctaagcgcttgaagtctcagactaaaattatcccagagctggtcgggagccccacgcagtcgacctcttccagaactgcctacctcggcacacataagacatccgctggaatctcttccggtgtgaccagcggcgatagttctgattcagctgagtctagtgaacgtagaaaacggaatagacctatcactaacggaagcactctaagcgaatctgaagtggaggacagccttgctacttcactgagttctagtgcatcctctagtagtgaggaaagcaaggaaagttccagggctagagagagctcatctcgctcaggtctgtcgcggtcaagcaatctgagggtcaccaggacccgcgccgcgcagcggaagaccgggcccgtctctttagcaaatggatgcggccgaaaggcaaccagaaagcgtgtttatctatctgacagcgataataatagtctagagaccggcgagattctaaaagcgagagccgggaacaacagaaaagtccttagaaaatgtgccgccgtggcagccaacaaaattaaactaatgtcagatgtggaggagaacagcagcagtgagagtgtgtgttccggccgcaaattgccacatcggaatgcgtcagccgtggctcgaaagaaactgctccataattctgaggacgagcagtcgctcaagagtgaaatcgaggaagaggaattgaaagacgagaaccagctgctgcccgtgtcttcatcccatactgcacagagcaacgtggatgaatcggagaatagggattccgaaagcgagtcggatttgagggtggcccgcaaaaactggcacgccaacggttacaaaagtcatacgcctgcccccagtaagacaaagtttctcaaaatcgaatcctccgaggaggattccaagagccacgatagcgatcatgcctgcaatagaacagcaggcccttctacgtccgttcagaaactcaaggcagaatccataagcgaggaggccgactccgagcctggtcgatcaggcggccgcaagtataatacctttcacaaaaatgccagcttcttcaagaaaacaaagattctcagtgatagtgaggattctgaaagcgaggaacaggatcgcgaggatggcaagtgtcataagatggagatgaatcctataagcggcaatctgaactgtgaccccattgctatgagccagtgctcatcagaccacggatgtgaaacggaccttgactccgacgatgataaaatcgaaaaacccaataacttcatgaaagattctgcttctcaagacaacggattgtcacggaagatttcccgtaaacgagtgtgcagctccgatagcgactccagtctgcaggtggttaagaaaagttctaaggctcgcacagggcttctgcggattactagaagatgcgccgccaccgccgcgaacaagattaaactgatgagcgacgtcgaagacgtcagcctggagaatgtacacaccagaagcaagaacggtcgcaaaaaaccccttcacctcgcatgcactacagccaagaaaaagctaagtgactgcgaagggagtgtccactgtgaagtcccttctgagcagtacgcatgcgagggcaaacctcctgatccagattctgagggctcaacaaaggtgcttagtcaggcactgaacggggatagtgatagtgaagacatgctgaacagtgaacataaacatcgacacactaacattcacaagattgatgcacccagcaaacggaagtcctcttccgtgacgagctcaggggaggactccaagagccatatccccggctccgagacagaccgcactttcagtagcgagagcaccctagctcagaaagccactgctgaaaataacttcgaggtggaattgaattacggcttacgaagatggaacggtagacgcctgcgcacttacggtaaggccccttttagcaaaacaaaggttatccatgattcccaggagacggcagagaaggaagtcaagagaaaaaggagtcacccagaactggaaaacgtcaagatcagtgagaccacagggaatagtaagttcagaccagacactagctccaagagcagcgacctgggatctgtgacggagagcgacatcgactgtacagacaataccaagacgaagagaaggaaaacaaaaggtaaagccaaagtcgtaagaaaaggaaagacgtttacggcgaacatcagcaagaccgtgcgccggcagaggcagtctaaacggccccgtctgagtgtcgatgataatgactgggaggatctcgactatgctaagagtaaaagggtgctgagacggtctaaaatcaagacgcgtaaccaaggcaggaggactgtaaggtatcatgatggagacgatgaccgctcgcttgagaacgtgctggacttcaatggttgcacgctttag

SEQ ID NO: 14773 - DNA, 492 bp, Artificial Sequence
  Description of Artificial Sequence: Synthetic coding sequence
atgacagctccttcttgcgctttcccggtccagtttcgacagccctcagtgtccggactgagccaaatcacaaaatcactgtatatcagcaacggtgtggcagccaacaataaacttatgctgtcttcaaaccagatcactatggtgatcaatgtgtctgtggaagtggtaaacactttatatgaggatatccaatacatgcaggtgcctgtggctgatagcccaaatagccgtctgtgcgacttctttgacccaatcgccgatcacattcactctgttgagatgaaacaaggtcgcaccctgttgcactgtgcagcgggggtgtccaggagcgccgcgctgtgcttagcgtacctcatgaaatatcatgctatgtcccttctcgacgcccatacctggactaagagctgtcggcctattattagacccaatagtggcttttgggaacagttgatacactatgaattccagctttttgggaaaaatacttag

SEQ ID NO: 14774 - DNA, 756 bp, Artificial Sequence
  Description of Artificial Sequence: Synthetic coding sequence
atgatctccaccacttctaaagagaccaagaaagacacaaagctatactgtatctgtaaaaccccgtatgatgaaagcaaattttatatcggctgcgacctgtgcaccaattggtatcatggtgaatgcgtcgggatcactgaaaaggaagccaaaaaaatggacgtttacatatgcaacgattgcaaacgagcacaggaagggtcgagtgaagagttgtattgtatctgcaggactccctacgatgagagtcagttctatattggctgtgatagatgtcagaactggtatcacggccgctgcgtgggcatccttcaatccgaagctgaactgatcgatgaatatgtctgtcctcaatgccaaagcacagaggatgccatgaccgtgctgacgccactaaccgaaaaagattatgagggactgaagagagtgttgcgatcgctgcaggcacacaagatggcgtggccatttttggagcccgtggatcctaatgatgcccccgattactacggagtgatcaaggaacccatggacctggcgaccatggaggagagagtccagcgaaggtactatgagaagctaacggagttcgtcgcggacatgactaaaatcttcgataactgccggtattacaaccctagtgattcccccttttaccagtgcgcagaggtcctcgaaagcttcttcgtacaaaagttgaagggtttcaaagcctcccgttctcacaataacaaactgcagagtactgcctcctag

SEQ ID NO: 14775 - DNA, 501 bp, Artificial Sequence
  Description of Artificial Sequence: Synthetic coding sequence
atgtattcattgaaccaggaaatcaaagcattttctagaaacaacctgaggaagcagtgtacccgcgtgactacactaaccggaaaaaaaattatcgaaacatggaaggatgcaaggattcacgtcgtcgaagaggtggaaccttcctctggggggggatgcggctacgtgcaggacttgagctccgatctccaggtaggcgtgatcaagccctggcttctcctaggatctcaggatgctgcacacgatctggacaccctgaaaaagaataaggatggggtagtgctcgtacattgtaacgctggggtttcaagagccgccgccatcgttatcggtttcctgatgaactccgaacagacatcttttacaagcgctttttccctggttaagaacgcaaggccctccatctgtcctaactcggggtttatggagcagctgcggacttatcaggaggggaaggagtcaaataagtgcgaccgcatccaggagaattcctcttag

SEQ ID NO: 14776 - DNA, 963 bp, Artificial Sequence
  Description of Artificial Sequence: Synthetic coding sequence
atgtctaagtccgcctcccctaaggaaccagaacagctgagaaaactgttcattggtggacttagtttcgagaccaccgacgaatctctccggagccatttcgagcagtgggggactctgactgattgtgtcgttatgagagaccctaacacaaagcgcagcagaggtttcggctttgtcacatatgcgactgtagaggaggtagatgcagcaatgaatacgaccccacataaggtagacggccgggtggttgagcccaagcgcgcagttagccgggaagacagtcaaaggcctggcgcacatctcacagtgaagaagatattcgtaggcggcattaaggaggatacagaagagcaccacttgagagattacttcgagcaatacggtaaaattgaggtgatcgagatcatgactgaccgcggatcaggtaagaaaagaggtttcgcgttcgtcacattcgacgaccacgatagtgttgataaaattgtgatccagaagtaccatacagtgaaaggacataactgcgaggtccgcaaggcgctaccaaagcaagagatggcttctgccagcagctctcagagagggaggagaggaagtggcaattttggcggaggacgcggcgatggctttggtgggaatgataacttcgggagaggagggaattttagtggtcgcggaggcttcggaggaagttgcggcggggggggctatgggggaagtggcgacggttacaatggctttggcaacgacggatcaaacttcggcggcggcgggagctataacgattttggtaactataataatcagagcagcaacttcggacctatgaaggggggtaactttggcggacgctctagcggcccgtacggtgggggtggccagtactttgcaaagcctcagaaccaagggggctatggtgtgagcagtagttcctcttcgtatgggagtggccgccgcttttag

SEQ ID NO: 14777 - DNA, 357 bp, Artificial Sequence
  Description of Artificial Sequence: Synthetic coding sequence
atgtcgttactgaacaagccaaaatcagagatgacacccgaagaactccaaaagagagaggaagaagagttcaacacgggccctctgtccgtgctgacgcagtccgttaagaacaacacccaggtacttatcaactgccggaacaacaaaaaactcttggggcgagtaaaggccttcgatcgccattgtaacatggtgttggagaacgtgaaagagatgtggacggaggttccaaaaagcgggaaaggtaaaaagaagagcaaaccagttaataaggatcgctacatcagcaagatgttcctacggggggacagcgtgattgtggtgctaagaaatcccctgatcgccgggaagtag

SEQ ID NO: 14778 - DNA, 1179 bp, Artificial Sequence
  Description of Artificial Sequence: Synthetic coding sequence
atgaaggacaccctagggcaggcccagcagcgtgtagcagaactggagcctttgaaggaacaactgcgcggagctcaggaacttgctgcatcatctcagcagaaggctacactgctgggggaggagctagcctccgcagcggcagctcgcgatagaacaattgctgagctgcaccggagcagactggaggtggcagaagtaaatggtcggctcgcagagttagggctgcacctgaaagaagagaagtgccagtggagcaaggagcgagccggcttgttgcaatccgtggaagccgagaaggacaagattcttaagctgagtgccgaaattctcaggctcgaaaaagcagtccaggaagagaggacacagaatcaagtgttcaaaacagagttggcacgagagaaggattcatctttagtgcagttaagcgagagtaaaagggagttgacagaactgcgctccgcactgagggtgctacaaaaggagaaagagcagcttcaggaggaaaagcaggaactgctcgaatatatgaggaagctggaggcacgcctggaaaaagtggccgacgagaaatggaatgaggacgcaaccaccgaggatgaagaggctgcagtgggcctctcctgtcccgcagccttaaccgacagcgaggacgaatcacccgaagacatgaggttacctccatacggcctctgcgaacgtggcgacccaggttcctccccagcagggccacgtgaggccagccccttagtggtgatttcacagcctgctcctatttctccacacctgagcggccctgctgaagattcttcatctgatagcgaggccgaggacgaaaagtccgtattaatggccgccgtccagtctggaggtgaggaggcgaatctactgttgccggagcttggatccgccttctatgacatggctagtactatattctgccgggcccaaattgctctgctacccctttcccccgccagcacaccatcccccacgacatctgggttcacagtgggcaccctgagcgagaccagcaccggcggtcccgccacccccacttggaaagaatgtcctatatgcaaagaacgtttccctgccgaatctgataaggacgctttagaagaccacatggacggccacttcttttttagcactcaggatcctttcacatttgagtag

SEQ ID NO: 14779 - DNA, 600 bp, Artificial Sequence
  Description of Artificial Sequence: Synthetic coding sequence
atgacaccgctggctccctgggacccaaagtatgaggctaaagccggacctcggccggtgtggggcgccaattgctcctccggtgctagcttcagtggcagaacactgtgccacccctcgttttggcctctctatgaggccgctagcggcaggggcctgaggcccgttgcacctgctactggtcattggaacggccaacaggctccacccgacgccggctttcccgtggtgtgctgtgaagacgtgtttctcagcgatcctttgctgccacgcgggcagcgggtccctctttatttaagcaaggccccacagcagatgatgggatccctcaaattgttgcctcctcccccaattatgagtgctcgcgtgctgccaagaccatcaccctcgagaggtccttccacggcctggttatctggaccagaactgatcgccctgactgggctcttgcagatgagtcagggagagccacggcctagctcaagtgccgtgggtccccctgatcacacatccgatccaccttccccatgcggttctcccagctcttcgcagggggccgacctgtctcttcctcagactcccgacacacactgcccttag

SEQ ID NO: 14780 - DNA, 1155 bp, Artificial Sequence
  Description of Artificial Sequence: Synthetic coding sequence
atggaaggactggggcgcagctgtctgtggctacggcgtgaactgtcgcccccccgcccacgcttactgctgctggattgcagatctcgggaactatacgagtcagctcggatcggtggagcgctgtctgtggccctgcccgcgctcctgcttcggcggctcaggagagggtctctatcggtccgagcccttctgccaggacctcctctccagcctccgcccccagcccctgtccttctttacgatcagggaggaggccgccgcagacgcggagaggcagaggctgaggccgaggagtgggaggctgagtctgtgcttgggactctacttcagaaactccgggaagagggctatctagcttactatctgcaaggcggattttccaggttccaggcggaatgccctcatctctgcgaaacaagcctggcaggacgggcggggtcttcgatggcccctgttcccgggcctgttccggtcgtcggcctaggatccctctgcctcggctcggactgcagcgacgccgagtctgaggcagatcgcgactccatgagctgtgggttggactctgagggagcgaccccaccaccagtgggcctaagagcatcctttccagttcagatcctgcccaatctctatttgggcagcgcccgggattcagctaatctcgagtccctggccaaactcggtattaggtacatcctcaatgtgactccaaatcttcctaacttctttgagaaaaacggtgacttccattacaaacagatccctatcagcgaccactggtcacagaacctctcaaggttctttcctgaggcaatcgaatttattgatgaggcattgagtcagaactgcggagtgctagttcactgccttgctggggtgagtcgctccgtgacagttacagtggcttatctgatgcagaagttgcacctctccctgaatgacgcttatgatcttgtgaaacgtaagaagagcaatatctccccgaacttcaattttatgggccagctgttagattttgaacgctcactgagattggaagaacggcattctcaagagcagggatccggcggacaggcttcagccgctagcaatcctccctcgttcttcaccacccccactagtgacggagccttcgagctggcacctacctag

SEQ ID NO: 14781 - DNA, 2208 bp, Artificial Sequence
  Description of Artificial Sequence: Synthetic coding sequence
atggcggagcccctgctgcggaaaacatttagccggctacggggcagggagaagctgccacggaagaagtccgacgcaaaggagcgcggacacccagcacagagacctgaaccatctccgcctgaaccggaaccccaggcacctgagggctcccaggcgggggctgagggcccctcatcccctgaagccagccgatcgcccgctagaggagcatatctccagagccttgaaccctctagccggagatgggttctgggtggggccaagcccgctgaggatacatcactcggacccggcgtgcctggaactggagaacccgcaggagagatctggtataaccctatacccgaagaagacccgcgaccacctgctccagaaccccccggaccccagcctggatcagcggagtctgaagggttagccccccagggggccgcacccgcctctcccccgaccaaggcttcccggacaaaatcgcctggtcccgcgcgtcgtctgtcgatcaagatgaaaaaactcccagagttgagaagacgtctcagcctgcgaggtccacgcgccggccgggagcgcgagagggcggctccggctggttccgttatcagtcgttaccatctagatagctccgtgggaggcccgggtccggccgccggacccgggggtaccagatcgcctagagcaggctacttgtctgatggagactcgccagaaagacctgccggaccaccttcccccacaagtttccgtccttacgaagtcggtccagccgctagggccccacccgcggctctgtggggccgtctgagccttcacctgtacggccttggcgggttgcggccagcgccaggagccacccctcgtgacctgtgttgcctgctgcaggtggacggggaagctcgggcaagaacaggaccgctccgcggagggcctgacttccttagattggaccatacctttcacctcgaactggaggccgcacgtcttttaagagcgctggtgctcgcatgggacccaggggtcagacgccacaggccttgcgctcaaggaaccgtgctgcttcctaccgtctttaggggctgtcaggctcaacagctggctgtgcggctggagccacagggactcctgtacgccaagttgaccctctcagagcaacaggaggccccagccaccgcagagccaagagtcttcggcttacctctgcctctgcttgtggaaagggagcgacctcccggacaagtgcctcttatcatacagaaatgtgtgggtcagatagaacgccgaggcttgagagtcgtgggattgtacagactgtgcggatcggccgcagtgaagaaggaattgcgcgacgcgttcgagagggacagcgcagccgtctgtctctccgaggacttgtatcccgacatcaatgtgataaccggaatcttgaaggactatctgagagagcttccaactcccctcataacccagcccctctataaggtggtgctggaggccatggccagggatcccccaaatcgggtgcctcctacgactgagggaactagaggcctgctgagttgtctacctgacgtagagcgcgccacgcttactctcctgctggaccatctaagacttgtgtctagttttcacgcatacaaccgtatgacgccccagaatttggcagtatgttttggacctgtcctactgcccgccaggcaggccccaacccggcccagagccaggagcagcggccccggattagcttccgcagtggatttcaaacatcatatagaagttctacactatctgctccagagctggccggatcctaggttgcctcgtcagtctccggatgtcgcaccctatctgaggccgaagaggcagccccctctgcatctgccgctggctgatcccgaggtggtgacccggccaagggggaggggtggtccagaatcgccaccttccaatcgatatgccggcgactggtctgtgtgcgggagagacttcctgccatgtggtcgagacttcctgagtggcccagattacgatcatgtcactggatcggatagcgaggatgaggacgaagaagtgggggagccaagggtgacaggggattttgaggatgatttcgacgcgcctttcaaccctcacctgaacctgaaggactttgatgccctgattctagacctggagagagaattgagtaaacagataaatgtttgcctgtag

SEQ ID NO: 14782 - DNA, 660 bp, Artificial Sequence
  Description of Artificial Sequence: Synthetic coding sequence
atgccgcgcggcaggaaatccaggaggcgcaggaacgcccgggcagcagaggagaacagaaacaacagaaagatccaggcctctgaagcgagcgagaccccaatggcagcctcagttgtggctagcacccccgaggacgatctgtctggacccgaggaagacccttcaacccccgaagaggcgagcaccacacccgaggaggcaagcagtaccgcgcaggcccagaaacccagtgttcctcgttcgaattttcaggggaccaaaaaaagcctcctgatgagcatccttgcccttatcttcattatgggcaactccgctaaggaggcgctcgtctggaaagtgctcgggaagctggggatgcaacctgggcggcagcactccatatttggagatccaaagaagattgtcaccgaggagttcgtgcgccgcggttatctgatctataagccggtgcctcggagctctcctgtcgaatatgagttcttctggggaccgcgggcccatgtcgaaagctctaaactgaaagtgatgcacttcgtggctagggtacggaacagatgtagcaaagattggccttgtaactacgactgggatagcgatgatgatgcagaagtggaagcaatcctgaattctggagcaagaggttactccgctccctag

SEQ ID NO: 14783 - DNA, 702 bp, Artificial Sequence
  Description of Artificial Sequence: Synthetic coding sequence
atgaatttaaatttcacttcacctctgcaccccgcttcctctcagcgccctacaagcttcttcatcgaagatatcctgttacacaagccaaagcccttgcgggaggtcgctccagatcatttcgcctcctccctcgcatccagggtgcccttacttgattacggatatcctttgatgcccacccccacacttttggctcctcatgcccatcaccctctccataaaggagaccatcaccacccttattttttgactacgagcggaatgccagtgcctgctctgtttccccatcctcagcacgccgagttgcctggcaagcactgtaggcgtcgaaaagctaggactgtgttctccgactcacagctaagtgggctggagaagcggtttgagatccaaagatacctgtctactcctgagagagtcgagctggctactgcactgtccctgagcgagacacaggtgaaaacgtggttccagaataggcgcatgaaacataagaagcaactccgtaagtcccaggatgaacccaaggcaccagatggccccgagagtcccgaaggcagtcctaggggctcagaagccgccactgccgctgaggcaagactgtccctaccagcgggtccctttgttttgacagagcctgaagatgaggtggacatcggagacgagggggagctgggatccggtccacatgttttatag

SEQ ID NO: 14784 - DNA, 873 bp, Artificial Sequence
  Description of Artificial Sequence: Synthetic coding sequence
atggaactccctgcagtaggtgagcatgtttttgctgtcgaaagtatcgagaaaaagaggatcagaaagggaagagtagaatacctggtcaagtggcggggctggtcaccaaagtataacacatgggaacctgaagaaaacatactggatccaaggcttttaattgccttccagaacagggagaggcaggagcagctcatgggctatagaaagcggggcccgaagccaaagcccctggtcgttcaggttcccaccttcgctaggcggagcaatgtcctgacgggtctgcaggatagcagcacggataatcgtgccaagttggacctgggcgcgcaggggaaaggccaagggcaccaatatgaactgaattcgaaaaaacatcaccatcacgccgttggcttgaatctgagccacgttcggaagagatgcctctccgaaacccacggcgagagagagccatgtaaaaagcggctcaccgcaaggtcaatttctactcctacatgcctcggcggctcacccgcagccgagcggccagcggacctgcccccagctgccgcactgcctcaacccgaggttatcttgctcgatagtgacctggacgaaccaatcgatctcaggtgtgtgaaaactcggtcagaggctggcgagccgccaagcagtctccaagtcaaacccgagactcctgcgtcagccgctgtcgccgtggccgcggccgccgctccaacgaccaccgccgaaaagccacctgccgaggcacaagatgaacctgccgagagcctgagcgaatttaagccatttttcggaaatatcattataaccgatgtcacagcaaactgcttgaccgtgacattcaaagaatatgtgactgtctag

SEQ ID NO: 14785 - DNA, 744 bp, Artificial Sequence
  Description of Artificial Sequence: Synthetic coding sequence
atgacagaggatagtcaacggaacttccgaagcgtgtattatgaaaaggtagggttcaggggtgtggaggagaagaagtcccttgaaatattgttaaaggatgatcgtcttgataccgaaaaactatgtactttcagtcagaggtttcctctcccatccatgtacagggccctggtgtggaaggtgctattaggcatccttcctccacaccacgagtcccatgccaaggtaatgatgtaccggaaagaacagtatttggatgtattgcatgctcttaaggtcgttaggtttgtgagcgacgccacaccccaggcggaggtctacctgcgtatgtaccaactcgaatctggcaaattaccccgttcgcctagttttccgttgccaaaggctttcgaacagtacctgaatttggaggacgggcgcctcttgactcatctccgcatgtgtagcgctgcacccaagttgccttacgatctttggttcaaaaggtgttttgcgggatgtctgccagagagttcactgcagcgagtctgggataaagtggtgtctgggtcttgcaagatcctcgtgttcgttgctgtcgagatcttactgacattcaagattaaggtgatggccttgaattccgccgagaagattacgaagtttctggagaatattcctcaagacagctcagatgcgatcgtcagcaaagctatcgatctgtggcacaagcactgcgggacccctgtgcacagctcttag

SEQ ID NO: 14786 - DNA, 546 bp, Artificial Sequence
  Description of Artificial Sequence: Synthetic coding sequence
atggtatcctcgtgctgcggcagcgtctcatcagagcagtcttgtgggttagagaactgttgccggccatcttgctgccagacaacttgctgtcgcacaacatgttgccgcccaagttgctgtaaaccccagtgttgccagagcgtgtgttatcagccaacatgttgtcatccgtcttgctgtattagtagctgttgcagaccatattgttgtgaatctagctgttgtcgaccttgttgttgtcagacgacatgctgcagaacgacatgctgtcggacaacctgctgttgcccttcgtgttgtgtgagttcttgttgccggcctcagtgttgtcaatcggtctgctgtcagcccacatgctgtaggccatcatgctgcatttcttcctgctgccacccctcttgctgcgagtctagttgctgtaggccttgctgttgcgtgcgaccagtgtgtggacgtgtctcctgccacacaacatgttacaggccaacatgcgtcataagcacatgccccagacctctgtgctgtgcaagctcttgctgttag

SEQ ID NO: 14787 - DNA, 1086 bp, Artificial Sequence
  Description of Artificial Sequence: Synthetic coding sequence
atggcattgaacgtcgcgccagtacgcgacactaagtggctgacactggaggtctgtagacagttccagagagggacatgctctaggtcagacgaagaatgtaagttcgcacaccccccaaaaagctgtcaagtagagaatgggagggtaattgcgtgtttcgactccctgaagggccgttgttcaagggagaactgtaaatatttacaccctcccacacacttaaaaactcagttggagatcaacggccggaataacctgattcaacaaaagacggccgctgccatgttggcccagcaaatgcaattcatgtttcccggcactcccctccatccagtacccacctttcccgtgggccccgcaattggaaccaatacagcaatcagttttgcaccttatctggcacccgtaacaccgggcgtgggcctcgtccctaccgagatcctgcccacaactcctgtgatagtgccaggtagccctcccgtcaccgtgccaggaagtaccgccacccagaagctcctgaggaccgacaaattagaagtgtgtagggagttccagcggggtaattgtgctcggggcgagaccgactgcagatttgcccatcctgctgatagcactatgattgacactagtgataacactgtgaccgtgtgcatggactacatcaaaggaaggtgtatgagggaaaagtgcaagtacttccatcccccagcccatctgcaggcaaagattaaggcagcacagcatcaggcaaaccaggccgctgtggccgctcaggccgctgccgccgcagccacggtcatggcctttccacccggcgcccttcaccccctgccaaaacggcaggctctcgagaagagcaacggaactagtgccgtgtttaatcccagcgtgctgcattaccagcaggcgctgacctctgctcaactgcagcagcacgcagccttcattccaacggataattctgagatcatatcccgcaacggcatggagtgccaagaatctgcgctccgcatcacaaaacattgttactgcacatactatcctgtttcctcctctatcgaactcccccaaactgcatgttag

SEQ ID NO: 14788 - DNA, 1017 bp, Artificial Sequence
  Description of Artificial Sequence: Synthetic coding sequence
atgttgaaaaacaagggacacagtagcaagaaagataacttggcagtcaatgcagtggctctgcaggaccacatcttgcatgaccttcagttgaggaacctttctgtagcagatcactcaaagacacaagtccaaaaaaaggaaaacaaaagcctgaaacgggataccaaggctattatagacactggcctgaaaaaaacaacccagtgcccaaaactcgaggacagtgagaaggaatacgttctagatcctaagcctccgcctctcacattagcacagaagcttggccttatcggtccgcctccaccgcccctgagcagcgatgagtgggagaaggtgaagcagcgctcgttgctgcagggggatagtgtgcagccatgtccaatatgcaaagaggagttcgaactaaggcctcaagttttctctatccggggtaaaaaccaataccagactcgcgttatccatgacggggcacgcctatttcgaattaagtgtgtaactcgcatccaggcatactggcgcgggtgtgtagttaggaagtggtacaggaacctcaggaagacagttcctccaaccgacgctaagctgcgaaaaaagttctttgagaaaaagttcacagagatatctcacagaattctatgcagttataacactaacatcgaggagctattcgcagaaattgatcaatgtctggccattaacaggtcggtcctgcagcagctggaggagaaatgtggccatgagatcacagaggaggagtgggaaaagattcaggttcaagccctgcgccgggagacccacgagtgttccatatgccttgcaccacttagtgctgctggtgggcagagagtgggcgccggccgccgatcaagagagatggccttacttagttgcagtcatgtgttccaccacgcttgccttctggcactggaagaattcagcgttggcgatcgcccgcccttccatgcatgtcccctatgtaggtcctgttaccaaaagaaaatcttggagtgctag

SEQ ID NO: 14789 - DNA, 1098 bp, Artificial Sequence
  Description of Artificial Sequence: Synthetic coding sequence
atggcagcagccgcagcgggcactgcgacttcacagcgattcttccagtctttttccgacgccttaattgacgaggacccccaggctgccttagaggagctcacgaaggctctggaacagaaaccggatgatgcacagtactattgtcagcgtgcttattgtcacattctgctgggtaactactgcgtagccgtcgcagacgctaaaaaaagcctggagctcaaccctaacaattctaccgcaatgctccgcaagggaatctgtgagtatcacgagaaaaactatgctgctgctctggaaaccttcacagaaggacagaagctcgacatagagacagggttccacagggtcggacaagcagggctgcagcttttaaccagcagtgacccgcccgcccttgactcccaatcagctggcatcactggtgcagacgctaacttctcagtgtggataaagcgatgccaggaagcacaaaacggtagtgagagcgaggtctggacccaccagtcgaagattaagtacgactggtaccaaactgaatcacaggtcgtgataaccctgatgatcaagaatgtgcagaaaaatgacgtgaatgtggagttttccgaaaaggagttgtcagcgctggtgaaacttccgagtggagaagattacaacctgaagttggagctgctccacccgattatccctgagcaaagcacttttaaagtgctcagcacgaagattgagattaaactaaaaaagcctgaggccgtgcgttgggagaaactagagggccaaggcgatgtgccaacacctaagcagttcgtcgctgatgtcaaaaatctttacccttcatcttctccttatactcgtaattgggataaacttgtgggtgaaatcaaggaggaggaaaaaaatgagaagcttgagggagatgccgcccttaatcgtctgttccagcagatttattcagacggttctgacgaagtgaaaagagcgatgaataaaagttttatggagtcaggcggtaccgtgctcagtactaattggtctgatgttggcaagaggaaggtggagatcaaccctcccgacgatatggagtggaaaaagtattag

SEQ ID NO: 14790 - DNA, 1389 bp, Artificial Sequence
  Description of Artificial Sequence: Synthetic coding sequence
atggataaggacagtcaaggcctgctggacagtagtctgatggcctcaggaacagccagccgctctgaggacgaggaatctctggctggccagaaacgggcctccagtcaggcactcggtaccatacctaaaaggcgatcttcctcccgctttatcaagcgcaagaaattcgacgacgagctcgtggagagctctctcgcgaaatcttctactcgcgccaagggagcaagtggggttgaacctggcagatgcagcgggtctgaacccagcagtagtgaaaagaaaaaagtgtctaaggcaccgagcactccagtgcctccatcccccgcacctgcccccgggctgacaaagcgtgtgaagaaatcaaaacagcctttgcaggttactaaagacttgggccggtggaaacctgctgacgacttattgctgattaacgccgtgctgcagaccaacgacttaaccagtgtgcacctcggtgtgaaattttcatgcaggtttaccctccgtgaagttcaggaacgctggtatgcattgctttacgacccagtcatctctaaactcgcatgccaagccatgcggcagctgcaccccgaagccatagccgctattcagagcaaagctttattctcaaaggctgaggagcagctgctctctaaggtcggctctacctcccagcctacactggaaaccttccaggatttactccaccgccacccggatgccttctatttggctcggactgcgaaggcgttgcaggcacactggcagctaatgaagcagtactatttgcttgaggaccagactgtccaacctctccccaaaggtgaccaagtgctaaacttctccgatgcggaggacctcattgatgactccaagctgaaggatatgagggacgaagtgttagaacatgagctgatggtcgcggacaggagacaaaaacgagaaattcgtcaactagagcaggagctgcataaatggcaagttctggtagatagtataacggggatgagtagccctgacttcgacaatcagactttggcagttcttcggggccggatggtccgctacctgatgagatcacgcgagatcacactagggcgcgccactaaagacaaccagattgatgtagacctgagtctcgaaggccctgcatggaaaatatcccgcaagcaaggagtgattaagctcaagaataacggtgactttttcatcgctaacgagggccgcaggcctatttatatcgatggcagacctgtcctgtgcgggagtaaatggcggttgtccaataactctgtggtagagatagcctccctcagattcgtcttcttgattaaccaggatctaatcgcactcatcagagctgaggctgctaaaatcaccccccaatag

SEQ ID NO: 14791 - DNA, 963 bp, Artificial Sequence
  Description of Artificial Sequence: Synthetic coding sequence
atgtccgttggcttcattggcgccggccagctggcatacgctctggccagaggttttaccgcggccgggatcttgtctgcgcataaaattatagcctcatcccctgaaatgaacctccccaccgtctccgctctgcgaaagatgggcgtcaaccttacccgcagcaacaaagaaaccgtgaaacattccgacgttctgtttctggcagtcaagcctcacattatacctttcatcctggacgagatcggcgccgatgtgcaggccagacatatcgtggtgagctgtgcagccggcgtgacgataagcagcgtggagaagaagctcatggcctttcaacctgcccccaaagttatacgttgtatgaccaacacaccagtggtagttcaagagggtgcaaccgtatatgcaacgggcacccatgccctcgttgaagatggccagttgctggaacagctgatgagttcagttggattttgcacggaggtggaagaagacctgatcgatgcggtgacaggactttctggctccggaccagcctacgcctttatggccttggacgcgctggctgatggcggcgtgaagatgggcctacctaggaggcttgctatccaactgggagcccaggctctcctgggggcagctaaaatgttactcgacagcgagcaacacccttgtcagcttaaagataacgtctgttctcccggcggggcaaccatccacgccttgcactttctagagtctggaggttttaggtcattgttgatcaatgcagtggaggcgtcttgcattagaactcgtgagctccagtccatggccgaccaggagaagattagccccgccgccctcaaaaagacactcctggacagagtcaagctggaatctcctaccgtttcaactttaaccccatctagccctggcaaacttctaacaaggtctctcgccctgggagggaagaaggattag

SEQ ID NO: 14792 - DNA, 2370 bp, Artificial Sequence
  Description of Artificial Sequence: Synthetic coding sequence
atggaggacggcccgtcaaacaatgcaagttgttttaggagactaaccgagtgttttctgagcccaagcctgaccgacgaaaaggtaaaggcatatctgagcctgcaccctcaagtgctggatgagttcgtatccgaatcagtctctgcagaaactgtggaaaagtggttgaagcgaaagaataataagagcgaggatgagtctgctccaaaggaagtgagtcggtatcaagatacgaacatgcagggggtggtatacgagttgaattcttatatcgagcagcgcctggacaccgggggcgataaccaactcctgctgtatgaattaagttccataattaagattgctacaaaagcagacggcttcgccctctactttctgggagagtgcaacaatagcttgtgtatcttcaccccgccagggattaaggagggaaaacctagactcataccagccggtccaattactcagggtacaacagtttccgcttatgtggcaaagtcccggaagaccctgctggtagaggacatcctgggcgacgagagatttcccaggggcaccgggcttgagagcggaacccggatccagtctgtcctctgcctgcccattgtcaccgcgataggagatcttatcggtatattggaactctatcggcactggggcaaggaggccttttgcctctctcaccaggaggtagccacagccaacctggcctgggcttcagtagccatccaccaggttcaggtctgccgagggttggctaaacagactgaactgaacgacttccttctggatgtgtcaaaaacatactttgacaatatcgttgccatcgactcactgcttgagcacatcatgatttacgctaagaatcttgtgaacgctgacagatgcgctttgtttcaggtagatcataaaaacaaggagctatactccgacttattcgatatcggtgaagaaaaagagggaaaacccgtgttcaaaaaaacaaaagaaatccgtttcagcatcgagaaaggaatagccgggcaagtagccaggaccggcgaggttctcaacattcccgacgcctacgccgacccaagatttaaccgggaggtcgacctctataccggttataccacgcgcaacatcctgtgtatgcctatagtgtcaagaggatccgttattggcgttgtccaaatggttaataagatctctgggtcagccttttccaagaccgatgaaaataacttcaagatgttcgcagtattctgcgctctggctttgcactgcgcaaatatgtaccaccgcatccggcactctgagtgcatttatagggtgacgatggaaaagctctcctaccacagcatctgcacctcagaggaatggcaaggccttatgcagttcacgttgcccgtgaggttatgcaaggaaatcgagctgttccatttcgatatcggcccgtttgaaaacatgtggcctggcatcttcgtctatatggtgcatagatcatgcggcacctcatgctttgaattagaaaagttatgtcgattcatcatgtcggttaagaagaattacagacgggtgccatatcataactggaagcatgctgtcactgtcgcccattgcatgtacgccatcttgcaaaataatcacaccctgttcactgatctcgaacgtaaaggtctgctcatcgcatgtctgtgccacgacttggaccatcggggcttttccaattcatacctgcaaaagtttgaccatcccctggccgccctctattcaacgtcaaccatggaacagcatcacttctctcaaacagtaagcattctacagctggaggggcataatatcttctccacgctctcttcttctgaatacgaacaagtgctcgagattattaggaaggcaatcattgcaaccgaccttgccctgtacttcggtaatcgcaaacagctggaggagatgtaccagactggatcactcaatctgaacaatcagtctcatcgggaccgggtgatcgggctcatgatgactgcctgtgatttgtgctcagtgactaaactctggccagtaacaaagctaacggccaatgacatttacgctgagttttgggccgagggcgacgaaatgaagaagctgggcatccagcccattccgatgatggatagggacaagaaggatgaggtgccacagggccagctcggcttctacaatgctgtggccatcccctgttataccactctcactcagatcctgccgcccacagagcccctcctgaaggcatgcagggacaacctgagccaatgggagaaggtgataaggggagaggagaccgctacatggatttcatcccctagcgtggcacagaaagcagctgcttccgaggattag

SEQ ID NO: 14793 - DNA, 645 bp, Artificial Sequence
  Description of Artificial Sequence: Synthetic coding sequence
atggacgattccgagaccggctttaatctgaaagtggtgctggtgtcattcaaacagtgtcttgatgagaaggaggaggtgcttcttgatccgtatattgcgagttggaagggacttgttagattcctcaattcgttagggaccattttctccttcatcagcaaggatgtggtaagtaagctccgaattatggaaaggttgagaggcggaccccagtccgaacattatcggtctcttcaggcaatggtcgcacatgaactgagcaaccgcctggttgatcttgaacgcaggtcccatcacccagaatcaggctgccgcaccgtgctgcgcctccatcgggcgctgcattggttgcagttgtttctcgaaggcctaagaacttcccccgaagatgcccggacttctgctctatgcgcagactcttacaacgcctctctcgcggcataccacccatgggtggtccgaagggcagtaacggtggcgttttgtactctgccaacacgagaagtgtttctggaagcaatgaatgtcggaccccctgagcaggccgtacagatgctgggggaggctctgccgttcatccagcgagtgtacaacgtcagtcagaaattgtacgctgaacactctctcctggatctaccatag

SEQ ID NO: 14794 - DNA, 4293 bp, Artificial Sequence
  Description of Artificial Sequence: Synthetic coding sequence
atgacgagcgcggctgagatcaagaagccccccgtggctccgaagccgaagttcgtcgtggccaataataaacctgcacctcctccaattgcacctaaaccggatatcgtgattagctctgtcccgcagtctacaaaaaaaatgaaaccagccattgcacctaagcctaaggtcctcaaaacctctccagtgagggagatcggccaatccccgtccagaaaaattatgctgaacctcgaggggcacaaacaggagttagccgaaagcacagataacttcaattgcaagtacgagggtaaccagtctaatgactacatttcgccaatgtgttcttgctcgagcgagtgtattcacaaactcgggcacagggagaacctgtgcgtgaaacagctggttctggaacctttagaaatgaatgaaaatctcgagaattctaagatcgatgagactctgacaatcaaaactcggagtaagtgcgatctctacggcgaaaaagccaagaaccagggtggggtggtgctgaaagcgagcgttctggaggaagaactgaaggacgccctgatccatcagatgcctccgttcatttccgcccagaagcataggcctactgacagccccgagatgaacggcggatgcaattccaacggacaatttcgcattgagttcgcggatctgtccccttccccctctagtttcgagaaggtgcctgatcatcacagctgccatttgcagctcccatctgatgagtgcgaacattttgaaacatgtcaggatgatagcgaaaaaagcaacaactgtttccagagctcagagctagaagccctcgagaacggaaagaggtcaaccctcatttcctctgatggcgtgtccaagaagtccgaggtcaaggatcttggcccgctggagatccaccttgtcccatacacccctaagttcccaactcccaagcctagaaagacaaggacagcaaggttgcttaggcagaaatgcgtggacactccatccgagtctaccgaggagccgggcaactccgatagttccagtagctgccttaccgaaaattcattaaagataaataaaatctcagttttgcatcagaacgtcctctgcaaacaggaacaggtcgataagatgaagctcggtaataagtctgagctcaacatggaatccaattcagacgcacaggatctggtcaactcccagaaagcgatgtgcaacgagacaacttcgttcgaaaagatggcaccctcttttgacaaggactcaaatttgagtagcgattcaactactgtggatggaagctctatgtctctcgcggtcgacgagggtacaggtttcattaggtgcaccgtgtcgatgtccctgccgaagcagttgaagctcacctgcaacgagcacctacaatctggcaggaatctgggggtgtccgcaccacagatgcaaaaggaaagtgtcattaaggaagagaatagcctgagaattgtgcccaagaaaccgcagcgacatagcctgcccgccacaggagttctgaaaaaggccgcttctgaggagcttctggagaaaagcagctacccttcttcggaagagaagtcttcagaaaagtctctggaacgcaatcacctgcaacacctgtgtgcccagaaccgcggcgtgagctctagtttcgatatgcctaagagagcctccgaaaagcctgtctggaagttgccacacccaattctgcctttcagcggtaatccggaatttcttaagagtgttacagtctcaagtaattccgagccatctaccgcactgaccaagccccgggctaagagcctatctgctatggacgtggaaaagtgcaccaaaccatgtaaagactccacaaagaagaatagcttcaagaagttgctcagcatgaagctgtcaatttgttttatgaagtcagacttccagaagttttggtccaagtcaagccagctgggagataccactacaggccacctctccagcggcgaacaaaaaggaatcgagagtgattggcaggggttgttggttggtgaggaaaagagatccaagcccatcaaagcgtatagcactgagaactatagcctggagtcccagaaaaagagaaaaaagagcaggggccagacatccgcagccaatgggctgcgggccgagtctctggatgatcagatgctgtcacgggagagcagcagtcaggcaccctataagtctgttacctccttgtgcgctcccgaatacgaaaacataaggcattatgaagagatcccggagtatgaaaacctgcccttcattatggcgattagaaagacccaggagttagagtggcaaaacagctcttccatggaggatgcagacgcgaatgtgtatgaggttgaagaaccgtatgaggcacctgacggccaattacagctggggcctaggcatcagcacagttccagtggcgccagccaggaagaacagaatgatctgggcctgggtgacctgcccagcgatgaagaagaaattattaatagctccgacgaggatgacgtgtcctccgaaagttccaagggggaacctgacccgcttgaggacaagcaggatgaagacaatggcatgaagtctaaggtccatcatatcgcaaaagaaataatgtcatctgaaaaggtcttcgtagatgtccttaagctactccacattgatttcagggacgcagtggcccacgcctccagacagctaggcaagcccgtgatcgaagataggatcctgaaccagattctctattatttaccccagctttacgaactcaaccgcgatctcttaaaagaattagaggaaagaatgttacactggaccgagcagcagaggattgccgatatattcgtcaagaagggtccctatctgaagatgtacagcacctacatcaaggaattcgataagaacatcgccttgctagatgagcagtgtaagaaaaatccggggttcgctgcagtggtgagagaattcgaaatgtccccaaggtgcgccaacctcgccttaaaacactacttactgaaacccgtgcagagaatcccacagtacaggttactgctgacagactatctgaaaaatctaattgaggacgctggcgactacagagatacgcaagacgcgctcgcagtagtgatcgaagttgctaatcacgccaatgataccatgaaacagggcgataacttccaaaaactcatgcaaatacagtacagtctaaacggacaccacgaaatcgtgcagccaggccgtgtttttcttaaggaaggcattttgatgaagctttcccgcaaggttatgcagcctcggatgttctttctctttaatgacgctctgctgtacaccacacccgtccaaagtggaatgtataagctgaataacatgttgagtctcgctggtatgaaagtgcgcaaacctacacaggaagcttatcagaacgagctgaagatcgaatctgtagagcgctcattcatcttaagtgctagcagcgcaactgagcgcgacgagtggctggaagccatctcccgcgccatcgaagaatacgccaaaaaaagaatcaccttttgcccttcccggagtctggacgaagcggacagtgagaataaggaagaagtatcccccctggggagtaaggcacccatttggatcccggatacacgcgccaccatgtgcatgatttgtacttcagaatttacactcacctggaggagacatcactgccgagcgtgcggtaaaatcgtgtgtcaggcctgcagctctaacaaatatgggttagattatctgaaaaaccagccagctagggtatgcgaacactgctttcaggagctgcagaagctggatcatcagcacagtccacggattggctcacccggtaatcacaagagcccatcttccgcattatccagcgtactgcattccatcccgtcagggagaaagcagaagaaaattcccgcggctcttaaggaggtttcagcaaacactgaggactcttccatgtccgggtatctctataggtccaaagggaacaaaaagccctggaagcacttttggttcgtgattaagaacaaagttctatatacctatgccgctagtgaagacgtggcagcccttgagagccagcctcttcttggcttcacagtcattcaggttaaggatgaaaactctgaatcaaaggtgtttcagctcctgcacaaaaacatgctgttttacgtcttcaaagcagaggatgcccattcggctcagaagtggatcgaggccttccaggaggggacaatactctag

SEQ ID NO: 14795 - DNA, 1641 bp, Artificial Sequence
  Description of Artificial Sequence: Synthetic coding sequence
atgggcgcctatttatcacaacctaatactgtgaagtgtagcggggacggcgttggggcgccccgcctccccctcccctacggatttagcgcaatgcagggctggagagtgagtatggaggatgcacacaactgcatacctgagctggatagtgagaccgctatgttttctgtttacgacgggcatggaggtgaagaagttgctctctattgtgcaaagtacctccccgatattatcaaggaccagaaggcttataaagaaggaaagctgcagaaggcactcgaagatgcattcttggccatcgatgcaaagttgacaacggaggaagttattaaggagctagcacagattgccggccggcccactgaggacgaggatgaaaaagaaaaggtggccgatgaagacgatgtggataatgaagaagccgctctgcttcatgaggaggccacaatgacaatcgaagagctactcaccaggtatggccagaactgtcataagggaccaccgcactccaagtctgggggcgggacaggggaggagcccggctcccagggtctgaatggcgaggcaggtcctgaggatagcaccagggagaccccaagtcaggagaacgggcctacagccaaggcctataccgggttttctagcaattcagaaaggggtactgaggctgggcaagtaggtgaacctggaattcctactggggaggccggtccaagctgctcgtcggcctcagacaaactccccagggtagcaaaatctaaattttttgaggacagcgaggacgagtcagacgaggccgaggaggaggaggaggattccgaggaatgcagcgaggaagaggacggatacagttctgaggaagcagagaatgaggaggatgaagatgacactgaagaggctgaggaagatgacgaagaggaagaggaagaaatgatggtgcccggcatggagggcaaagaggaacccgggagtgattctgggacaaccgctgtggtagccctaattagaggtaagcaactgattgttgccaacgctggcgactccagatgcgtagtctcagaggccgggaaagctttggacatgtcttacgaccataaaccagaggatgaagtcgagctggctcgcatcaaaaacgccggaggcaaggtgaccatggacgggagagtgaacggcggcctcaatctctcccgcgctataggggaccatttttataaacgaaataagaatctgccacccgaggaacagatgatcagcgcacttcctgatataaaagtcttgacgctgactgatgaccatgagttcatggtgatcgcctgcgatgggatttggaacgtcatgagctcacaggaggtcgtggacttcatccaaagtaagatttcccagagggatgaaaatggggaactccgcctgcttagttctattgtcgaagaactgctggaccagtgcttggccccagacacttcaggtgacggaaccgggtgtgacaatatgacgtgcataattatctgtttcaagccgaggaacaccgctgagctgcagccagagagcggcaaacgcaaactggaggaagtgctcagcaccgagggggccgaagaaaacggcaattctgataaaaagaaaaaagcgaagagagactag

SEQ ID NO: 14796 - DNA, 273 bp, Artificial Sequence
  Description of Artificial Sequence: Synthetic coding sequence
atgagcactgctatgaacttcggcaccaaaagctttcagccacgcccacctgacaaggggtcatttccactggatcacctgggggagtgcaagtcattcaaggagaaattcatgaagtgtctacacaacaataatttcgagaacgctctgtgcaggaaagaaagcaaggagtacctcgaatgccgcatggaacggaagctgatgctgcaggagccacttgagaaattgggctttggcgacctcacaagtggtaaatctgaggccaagaaatag

SEQ ID NO: 14797 - DNA, 726 bp, Artificial Sequence
  Description of Artificial Sequence: Synthetic coding sequence
atgaacagtgggaggcccgagaccatggaaaacctgccggcactctatactattttccagggagaggtggctatggttacagattacggagccttcatcaagatccctggatgccgaaagcagggactggtacaccgtacgcatatgagtagctgtagagtggacaaaccctctgagatcgtggatgtcggcgacaaggtgtgggtaaagctgatcggtagggaaatgaaaaatgaccgcattaaagtgtctttgtccatgaaggtcgtgaatcaaggtaccgggaaggacctcgatccaaataacgtgattatcgagcaggaagaacgtcggcggcgctcatttcaggattacaccggccagaagataaccttagaagcggtgctcaacacgacttgcaaaaagtgtgggtgtaaaggtcacttcgctaaagactgcttcatgcagcccggcggaacgaaatactctttaatcccagatgaggaggaggagaaggaggaggctaagtctgctgaatttgaaaagcctgatccaaccaggaatcctagcagaaaacgtaagaaagaaaaaaagaagaagaaacacagagatcgaaaaagctcagacagcgattctagcgactcggagtccgataccgggaagcgtgccagacacaccagcaaggactctaaggccgctaagaaaaaaaagaagaaaaaaaaacacaaaaagaaacacaaagagtag

SEQ ID NO: 14798 - DNA, 1758 bp, Artificial Sequence
  Description of Artificial Sequence: Synthetic coding sequence
atggctgcagctgctgccgcagtgggacccggagccggcggggccggctccgccgtccctggcggcgcaggcccatgcgcgaccgtatcggtgtttcccggtgctcgcctcctcacaataggcgatgccaacggtgagattcagaggcacgccgagcagcaagccctgcggctcgaagttagggccggacctgactcggccggcatagccttgtattctcatgaggatgtctgcgtgttcaagtgctctgttagccgcgagacggagtgctcaagggtggggaaacagtcattcatcataaccctgggctgtaatagcgtcctgattcagtttgccaccccaaatgacttttgctctttttacaacattctgaaaacctgccgcggacatacgctggagcgctctgtcttcagcgaacggaccgaggagtcctctgctgtccagtactttcagttttatggctaccttagccaacagcagaatatgatgcaggattacgtgcgcactggcacttaccaacgcgccatcctccaaaaccatactgatttcaaagataaaattgtgttggacgtgggctgtgggtcaggaatcctcagctttttcgccgcccaggccggcgctcggaagatttacgccgtagaagcatcgactatggcacagcacgctgaggtcctggtgaagtcaaacaacctaactgacagaattgtggtaattcctgggaaggttgaagaagtctcactcccagaacaagttgatatcattattagcgagcctatgggatacatgcttttcaatgaaagaatgctggagtcctatctacacgctaaaaaatatctcaaaccatccgggaacatgtttcccaccatcggggatgtgcatttggccccattcaccgacgagcagctgtacatggagcagttcacgaaagctaacttctggtaccaacctagttttcacggggtggatctgtccgcattaaggggggccgcagtggatgagtactttcgccagcccgttgtggacacctttgacataaggatcttgatggccaagagcgtgaagtataccgtgaacttcctagaggccaaggagggtgacctgcaccgcattgagattccatttaagtttcatatgctgcattccgggctggtgcacggactcgctttttggtttgatgtggcttttatcggatcaataatgacagtttggctgagtacggcccctactgaacctctgactcactggtaccaggttaggtgcctctttcagtcccccctctttgctaaagccggcgacaccctgtctgggacatgtctcctgattgctaataagcgacagtcctacgatatatcaatagtggcacaggtcgaccagaccggctctaaatcttccaacctcctcgacctgaaaaatccgtttttccggtacactggcacaacccccagtcctcctcccggaagccactatacctcacctagcgagaacatgtggaataccgggagcacatataatctgagctcaggcatggccgtagccgggatgcctaccgcctatgatttaagctccgtgatcgctagcggctcctctgtcggccataacaacctgatccccctcgggagctccggtgctcagggctcagggggaggcagtacgtcagcacattacgcagtcaacagtcagttcaccatggggggccccgctatttctatggcctctccgatgtcaatcccaaccaacacgatgcattacgggagctag

SEQ ID NO: 14799 - DNA, 771 bp, Artificial Sequence
  Description of Artificial Sequence: Synthetic coding sequence
atggcctccggtagacctgaggagttatgggaggctgtggtgggcgccgccgagcgtttccgtgccaggaccggaaccgagctggttctgctgacagctgcccccccccctccacctcgtccaggtccgtgcgcctacgccgctcacgggagaggtgccctggcagaggccgccagacggtgcctccatgatatcgctctcgcgcacagagccgctactgcagcaagacctcccgccccccctccagcccctcagcctccttctccgactccctctccacctcggcctaccctggcgcgggaagacaacgaggaagatgaagacgagcccactgagacagaaacctcaggtgagcagctgggaatcagtgacaatggaggcctgttcgtgatggacgaagacgctacccttcaggacttgccgcccttttgcgagtccgaccctgagtccaccgatgacggatcactttctgaagagacacccgctggaccacccacctgttcagtacccccagcctccgccctcccaacccagcagtacgccaagtcactgccagtgtccgtgccagtgtggggcttcaaagagaaacgcacggaagcaagaagcagtgatgaagagaacggtcctccctcatctcctgatctggaccgcatcgccgcttcaatgagagctctggttttgcgcgaagccgaagacactcaagtgttcggagacctaccacgtccccggctcaacacatctgatttccagaaactaaaaaggaagtactag

SEQ ID NO: 14800 - DNA, 4293 bp, Artificial Sequence
  Description of Artificial Sequence: Synthetic coding sequence
atgtgtcttgaatctaatctctctagctgtaagcacctgccatgctgcggtaaactgcatttccagagctgtcatgggaacgtgcataagttgcaccagtttcctagtcttcaagggtgtactagcgctggatatttcccatgttctgacttcaccagcggcgcacctggtcatctggaggagcatattagccagtcagagcttacccctcatctgtgtacgaactcactgcacttaaatgtggtccccccagtatgcctgaaagggtccctttattgcgaggactgcttgaacaagcctgcaagaaattccattattgatgccgccaaggtatggcccaacattccaccaccgaacacacagcccgccccactggccgtgccactatgcaacgggtgcggcactaagggcaccggaaaagagacaaccctgctactcgcaacatcattgggcaaagctgcatcaaaattcggctccccggaggtggctgtggctggccaggtactggagaacctgccaccaattggcgtcttttgggatatcgagaactgtagcgtgccctcagggcgctccgccacagctgttgtacagagaattagagagaaattttttaaaggccatagggaggctgaatttatctgtgtctgcgacatcagcaaggagaacaaagaagtcatccaggaactgaataattgtcaggtcacagtggcccacataaacgcaactgcaaaaaacgctgccgatgacaagctgaggcagtcattacgccgcttcgccaacactcatacagcacctgccactgttgtcttggttagcacagatgtgaacttcgcactggaactaagtgacctgcgccacaggcatggatttcacatcattctggtccataagaaccaggcatccgaggccctgctgcatcatgctaacgaactgattcgtttcgaggagttcatcagcgacctgcctcctagattgcctctgaagatgccccagtgtcatactcttctctacgtctacaacctgcccgcaaataaggacggcaaaagcgtgagtaaccgtttaaggcggttgtctgataactgcgggggcaaggtactgtccattacgggctgctcagccattctacgctttatcaaccaagatagtgcagaaagggcccagaaacggatggaaaatgaggacgtcttcgaaaagaaggataaggaagaaacagtgttccaagtgagttacccttccgcatttagtaaactggtggcctcaagacaggtaagtccccttcttgcctcccagtcctggtctagcagggccagtccactcgccttcaatatagcgaattcctctagcgaagctgactgcccggatccattcgcgaatggtgctgacgtccaagtcagcaacatcgactaccgattgtcacgaaaggagctccagcaattgttacaagaggcatttgccagacatggaaaggtgaagagcgtggaactttcccctcatactgattaccaactcaaggccgtggtgcaaatggagaacctgcaggatgcaatcggcgccgtaaattcactccatcgttacaagattggtagtaagaaaattctcgtgtctctggcaaccggcgccgcatccaaatctttaagtctgcttcgtttcggtcataagcttaatgtgtccgacttgtataaacttactgacactgttgctatacgagagcagggaaacgggagactggtgtgcctgttgccaagttcgcaggcacgtcaatcacctttaggcagcagtcagtcgcatgacggatcctcgaccaactgtagcccaatcatcttcgaagaattggagtaccatgaacccgtatgtcggcagcattgcagcaacaaggacttttcttttccagattgttatattgccgagttcggcgacctggaggttgttcaggagaaccagggcggagttccactggagcacttcattacctgtgttccaggggtgaacatcgccactgctcagaacggaataaaggtagtgaaatggatccataacaaaccaccaccgcccaacaccgacccctggctgttaaggagcaagtccccagtcggtaatccccagctgatccagtttagcagggaggttattgacctactcaagtcacagcccagctgcgtgatcccaatctcacattttataccttcctatcaccatcactttgctaagcagtgccgcgtatcggattatgggtacagcaagctcatagaattgctggaggccgttccccacgtgctacaaatccttgggatgggaagtaagagactgcttacccttacccatcgggcccaggttaaaagattcactcaggacctgcttaaactgctaaagtctcaggcttcaaaacaagtaatagtgagagagtttagtcaggcataccactggtgtttttccaaagactgggatgtcacagagtatggcgtctgtgaactcattgacattgtgagtgaaattcccgatacaaccatctgcctgtcgcaacaggataatgagatggtgatctgcattcccaaacgcgaaagaacgcaggatgagattgagaggaccaaacagtttagcaaggatgtggtcgacttacttcggcaccagcctcacttcaggatgccctttaacaagttcatcccttcctaccatcatcactttggtcgtcaatgtaagctcgcttactatggtttcaccaagctcctggaactcttcgaggcaattcctgacactctgcaagtattagaatgcggggaggagaagatcctcaccttgactgaagtggagaggttcaaggctcttgctgctcagttcgtcaaactcctgagatctcagaaggataactgcctgatgatgaccgatctgctgacagagtacgctaaaacctttgggtacaccttcaggctgcaggattacgacgtatcttccatctcagcactcactcaaaaattgtgccacgtcgttaaggtcgctgacatcgagagcggcaggcaaatccagttgatcaaccgcaaaagcctgaggtcattgacagcacagctcctggtgctacttatgtcatgggaaggcactacccacctgagcgtcgaagaactcaagcgacactatgaatcaacacacaatacaccacttaatccgtgcgagtacggcttcatgaccctaacagagctactgaaatccctgccctatttggttgaaaccgccgccgccttcgacttacaaatcgagctcaagtttgcagggggttactctctacttctggaggagatccttgaatacattcctccacctttcctgagccctctgcccagtttcctgcctcccccaccattctttttttttgtcttttttgtgatcttcatcttcttcattttcgtgtttgtacagttcgtagtttttgtattctttatcgtggtgtttgttttctttatcgtcgtgtttgtgttcaccaacgataagatggaggaatgtgtgaagctgaccagtctctacctcttcgcaaagaatgtgcgtagcctcctgcatacataccattaccagcagatcttccttcacgaattttcgatggcttacactaagtacgtcggagaaacactccagccaaaaacgtatggccactcctccgttgaggaactgcttggagcgatcccccaggtagttgtgcagtttttgcaaaaaaatgggaaggagctaagctgtgaaaactaccttaatctctatgccaaagccggaaggctctctagcctttctttgagtccggccaaccacgaaaaccagcccagcgaaggagagaggatcttagaagtgccagaatctcacaccgccagcgagttaaagctgggagctgacggaagcgggcctagccatacagaacaggaattgctgaggcttaccgatgacagccccgtagacctcctgtgtgctcccgtccctagttgtctcccctcaccacaactaagacctgatcctgtaattctccagagcgctgatctgattcaatttgaagagcgccctcaagaacctagcgaaataatgatccttaaccaggaagaaaaaatggagatcccgatccctggtaagtcaaagacgctaacgtctgatagttcttcgagttgcatctctgctgccgtccccgtcccaccgtgtccatcctccgaaacctccgagtctctcttgtccaaggatccagtcgagtccccggctaagaaacaacctaaaaacagggtgaaactcgcagcaaacttttctctggcccctattacaaaactctag

SEQ ID NO: 14801 - DNA, 2346 bp, Artificial Sequence
  Description of Artificial Sequence: Synthetic coding sequence
atgggccagctgagggattggtttccaaatactcaggacctagccggcaacgatcaagaaaacatcagacacgctgatcggaataactcagacgataaccatctcgctagtgaggatacctcagccaaacaatcaggcaaaccggggatctatgaggacagagacccattgcgcgtgtctatcagccgcgaacaaagcttttttgggtccccactcgcacacgatccttttagttgtctgcagttggtgggccaggagaatgtgtgcggcgatgattacgacgaggctgtaaaactaaaggagagcgtggtggaaaaccacgccgtgctgtcttacgctgtggaggaggagcatgcctatctgggaccaacagtgaagccagatgacaaggcgaagacactgtcttacgaaccactgtcttccgcaacggtgagcacagggtctttgctttcttatgaaaacactgatctgagtctcacagatcccgagtctttctcagagcacatggatgactccaaacaggagtccactacctccaaagaggaggaaactaatatcataagctcaatcgtgcccagtacgcaggacatctaccagcgacagaacagttctgacgttcataagtcgctcttgccagctgtggacgagacaacctgtgggcatacacacttccagcagatgatcgataaatacatcaacgaggctaatctaatccccgagaaaaccgatcttcaagaattggaacacatttttcccaatctgcatcaccagctgttcaaaccccttgagccccaccccgacttcgacttatcttcttcctcctcaggtattagtcccgacaatagggatttctaccaaaggagcgattcttctagtgagtcccattgcgccacaggtctgagtaaaagcacagtttattttactgccctaagacggaccagcatgcactcttctctgaatacgagcccgaaccaacagcctgacacaaatttggcccatgttggcgcccatagctttgccacggaaaacatcattggcggcagtgaacaatgctttgaacaactgcaacccgagtattcttcccaggaggaatcccaacatgcggatctgccgtcaattttttcaattgaggcgcgagactccagtcaaggaatgaagaatcagaattatccttctgaagaacacaccgaaattttgcagaacaagaagaaaatagtgcatttccaactgtctattgggaacctatctagtgtgtatagcagcagcgatgaagccaacgttttcgatcagcttaacgtccagcatagcacaccatgtgggtctaatagcagcgaatgctctacaaagcaccagctggagtcccggaaggagagtatgggatttgaggaactttctaagagaggagtcgtgacaatgctacagagtcaaggcctgattgaggataacaagaacgaaacatgtagggtcctggacatcaatccccaggtagaggaaacggattctcgactatgcgtccggactgtggagatgggcacctctattcaggcaccctatagtctcaccactcaaaatgaaaaatatttcgaaaatagcgctgaaacggacataccaaagataactaagaagctgtcacagctgggagagtctgagctgtttgccagttccgggagtttcagcctccagtcaagtataccggtgtgggaaaccgagaccggccatgggattatggaggagccggagctgaccctgatcagcacgaccgatacatccatagctgagatggatttcgccaacctgactctagaggaaaaatccgagaatgaggctaagtgctttttccaggtgtcagagtttctgccccttgtgagtgccaccgaggcctctgattaccccgctgtgtccgagctttccattgagaagcctagaacggcgtctactgaaacgccaaggaggctaacaccagtgcctgggagcctgcaggaggctttcataaaaagaaagaagtcattcatggagaggtcacatcagcgtcagaaggaaattcgcaacaagatccacgtaagtgaaaacagccagatcaagacggtgaaagagaaaccttcaattagcagttcagtgtctagattgaaaggcgtaaacaaagtccgggcgtccttcccagaggaccggaaaaccacacaggcactcagacaccagagaggtttgcggttatacaaccagctggctgaggtgaagcagcagaaagaagaaaagactaaacaagaagcatatgcccagaacagagcgcgggctaaggaatttcacaagaaaacactggagaagctgcgtgcgaagaacacctgctag

SEQ ID NO: 14802 - DNA, 513 bp, Artificial Sequence
  Description of Artificial Sequence: Synthetic coding sequence
atgggcaagcggtacttctgtgactattgcgaccgctccttccaagacaatttacataaccggaaaaagcacctgaacgggctgcagcatctgaaggccaaaaaggtgtggtatgatatgtttcgagacgctgctgctattctgttggacgagcaaaacaagcgtccttgtagaaaattccttctcaccggccaatgcgacttcggtagtaactgtaggttttcacacatgtcagaacgggatttgcaggagctctccattcaagtggaggaagagagacgggcacgcgaatggctgctcgatgcccctgagcttccagagggtcacttggaggattggctggagaagcgggcaaagcgcctgagttccgcaccaagctcccgcgctgagcctataaggaccacggtttttcaatatccagtggggtggcccccagtccaggagctccctccaagcctgagagcgcctcctccaggaggctggccacttcagcctagggttcaatggggatag

SEQ ID NO: 14803 - DNA, 1542 bp, Artificial Sequence
  Description of Artificial Sequence: Synthetic coding sequence
atggcgtctgtcctgtcaaggcgccttggcaaaagatcactgctcggcgcgcgggtgctgggaccgtccgcctccgaggggccctctgctgctccaccctccgaacccttattggaaggtgctgccccccaacctttcacgacttcagatgacactccatgccaggaacagcctaaggaggttctcaaagcaccctctaccagcgggctccagcaggtggccttccaacccggacagaaggtgtatgtgtggtatggcgggcaggaatgcacagggttggtggagcagcacagttggatggagggacaggtgacagtgtggctgttggaacagaagctgcaagtttgttgtcgagtcgaggaagtgtggctcgctgaactccagggaccttgccctcaagcccccccactagaacccggcgcccaagctttggcttacagacctgtatctcggaatattgatgtgccaaagaggaaatcagacgccgtcgaaatggatgaaatgatggccgcaatggtcctgacctccctgtcgtgcagccccgtggtacagagcccgcccggcactgaggcgaacttttctgcttcgcgcgcggcatgcgacccatggaaagagtccggggatatcagcgactctggatcgagcactacatccggccactggagtggctctagcggagtgagtacaccgtcccctcctcacccccaggcctcccccaagtacctaggggacgccttcggctctcctcagacggatcacggtttcgagacagacccggatccatttcttttggacgaacctgccccccggaagagaaaaaatagcgtgaaggtcatgtataagtgcctgtggccaaattgcggtaaggttctgaggtcgatagtgggaattaaacgtcatgtgaaggcgctgcacctgggcgacaccgtggattctgaccagtttaagagggaagaagatttctactataccgaagttcagcttaaagaagaatcagcggcggctgccgctgccgccgcagcaggaacacctgttcccggcaccccaaccagcgaaccagcccctacgccaagtatgaccggtctgccattaagtgctctcccaccacctctccacaaggcacaaagttctggacccgaacatcccggacccgagagctctctgccatccggcgcccttagcaagtctgcacctggctccttttggcacatccaggcagaccatgcttaccaagctctcccgtctttccaaatccccgttagcccccacatctatacaagtgtgagttgggctgctgctcctagtgctgcatgctctctctctccagttaggtcccgctccttaagtttttccgagccccagcagcctgcccctgctatgaagagccacctcatcgtaacgagtcctccacgggcacagtctggcgcccgaaaggcacgaggcgaagctaagaagtgtaggaaggtctatggaatagaacaccgcgatcagtggtgcactgcctgccggtggaaaaaggcctgccagagattcttagattag

SEQ ID NO: 14804 - DNA, 555 bp, Artificial Sequence
  Description of Artificial Sequence: Synthetic coding sequence
atgggcaacggtatgaacaaaattctgccaggcttgtacattgggaactttaaagacgctagggacgcagagcagcttagcaaaaacaaggtaacccatattctgtcggttcacgacagcgcaaggccaatgctggagggggtgaagtatctgtgcatccctgccgccgactcgccatcacagaaccttactagacattttaaagaatccattaagttcattcacgagtgccggctgcgaggtgaatcttgcctcgtgcactgcctggccggggtgagcagaagtgtcacgctagtgattgcatatattatgacagtcacagatttcggatgggaggatgccttgcacacagtcagggccggccggtcctgcgccaacccaaatgtcgggtttcaaagacagctgcaggagttcgagaaacacgaagtccaccagtaccggcagtggctgaaggaggagtatggggaaagccctctccaggatgcagaggaggccaaaaatattctggctgctcctggaatcctgaagttctgggcttttctgcgacgactgtag

SEQ ID NO: 14805 - DNA, 642 bp, Artificial Sequence
  Description of Artificial Sequence: Synthetic coding sequence
atgttgcagctccgagactcggtagactcagccgggacatcccctactgctgtgctggcggctggcgaggaggtgggtgccggcggcggacccggtggtggccgaccgggggcaggcacacccctcaggcaaacactgtggcccctgagtattcatgaccccactcggcgggcccgtgtaaaggagtattttgtgtttcgaccaggctcaatcgagcaggccgtggaagaaattagagtcgtggtccggcctgtagaggatggcgaaatccaaggcgtgtggctcctgactgagcgagagggcttcgggattcgcattcagtgggataagcagagtaggcccagctttataaataggtggaacccctggtcaacgaatgtgccctacgctacctttaccgagcaccccatggccggcgccgatgagaaaacagcctcactttgtcagttggaaagctttaaagccttgctcattcaggccgtgaaaaaagctcagaaggagtcacccttgccgggccaggccaacggcgtactcatcctggaacgtcccctgcttatcgagacatatgtggggctcatgtcctttattaacaacgaggccaaattgggctattctatgaccagaggtaagatcggattctag

SEQ ID NO: 14806 - DNA, 888 bp, Artificial Sequence
  Description of Artificial Sequence: Synthetic coding sequence
atggaactcatacaggacacctccagaccaccacttgaatacgtcaaaggggtgcctctgattaagtacttcgctgaagcccttgggcccctccagtcgttccaggcccgccccgacgatctcctcattaatacttaccctaagtctggaacaacctgggtgagtcaaatcctggatatgatctatcagggcggtgacctcgagaaatgcaatcgggctccaatatatgtacgcgtaccttttctggaagtgaacgatccaggtgagccaagcggccttgagacgctgaaagacactccaccacctagactcatcaagagtcatctaccgctcgctctgctgcctcagactctgttggatcagaaggtaaaagtggtgtacgtggcaaggaacccaaaagatgtcgccgtctcctattatcattttcacaggatggagaaagcacaccctgaaccaggaacatgggatagcttcttggaaaagtttatggccggggaggtgtcttacggcagctggtatcaacacgtgcaagaatggtgggaactgtcccgcacccacccagttctctatctgttttatgaggatatgaaggaaaaccctaaacgggagattcagaagattttggagtttgttggcaggtccctgccagaagaaaccatggacttcatggtgcagcacacatcgttcaaggagatgaagaaaaaccctatgacaaattacacaactgttccacaggaactgatggaccattctatttctcctttcatgaggaagggaatggcgggagattggaagaccacattcaccgtggcccaaaatgagagatttgacgccgactatgctgaaaagatggctgggtgcagtctatccttccggagcgaattgtag

SEQ ID NO: 14807 - DNA, 3867 bp, Artificial Sequence
  Description of Artificial Sequence: Synthetic coding sequence
atgcctcgtaaggggacgcagcccagtactgccagacgaagggaagagggcccaccccccccaagtccagatggcgcctcgtccgacgccgaacccgaaccaccttcaggccgtactgagtccccggctacagcggcagaaacagcttcagaggagttggataaccgctccttggaagaaatccttaactccattcctcccccccctcctcctgccatgacaaacgaagccggagcccccagactcatgatcacgcatattgtgaatcagaacttcaaatcctatgcaggggagaagatcctcgggccgtttcacaaacgctttagctgtattattggtccaaacggctcagggaaatcaaatgtaattgatagcatgctctttgtgttcggctaccgcgcccaaaaaatccgatctaaaaaactgtccgtcctgatccataactctgacgagcacaaagacatacagtcctgcacagttgaagtacactttcaaaagattatcgataaggagggagatgactatgaagtgatcccaaactccaatttttacgtctcaaggactgcgtgtcgcgataatacatctgtttaccacatctcgggtaagaaaaagacttttaaagacgtgggaaatctgttgcgctcacacgggatcgacttggaccataacagattcttgattctccagggggaggtagagcaaatcgccatgatgaaaccaaagggccagaccgaacacgatgaaggtatgctggagtatctggaggatattataggctgcggccggttaaacgagccgataaaggtcctgtgcagaagagtcgagattcttaacgaacaccggggcgagaagctgaatcgagttaaaatggtagagaaagagaaggacgccctcgagggtgaaaagaacattgcaatcgagtttctgacgctggagaacgagattttcagaaagaagaaccatgtgtgccagtattatatatatgaactgcagaaacggatcgccgagatggagacccaaaaagaaaagatccacgaagatactaaggaaattaacgagaagagcaatattctgtccaatgagatgaaggccaaaaacaaagacgtaaaggacaccgaaaaaaagctcaacaaaataacgaagttcattgaggagaacaaggaaaaatttactcaactagacctagaagacgtgcaggtccgtgagaagcttaagcacgcaacatccaaagcaaaaaagctggaaaagcaactacagaaggacaaagagaaagtagaagaatttaaatcaattccagccaaaagcaataacatcatcaacgaaaccacgacaagaaacaacgccctggaaaaagagaaagagaaggaagagaaaaagctcaaagaagtaatggatagtcttaagcaggaaacacaaggcctgcagaaggagaaagaatccagggagaaagagttaatgggattttccaaatcggtgaacgaggctcgcagtaagatggatgtggctcagtccgaactcgacatctatctctctcgccacaacacagcagttagccagctgacgaaggcaaaagaggcattgatagctgctagtgagacacttaaggaaagaaaagctgccatcagagatatcgaaggtaagctgcctcagaccgagcaggagctgaaagagaaggaaaaggaacttcaaaaactgacacaggaagagactaacttcaagtctctggtccatgacttgttccagaaggtcgaggaagctaaatcaagcctagcaatgaacaggtcccggggaaaagtgctcgatgcaatcattcaggaaaagaagagtggccgaattcccggcatttacggtcgattaggcgacctcggagccattgatgaaaaatatgacgtggcgatctcctcttgctgtcacgcactggattacattgtcgtggactccatcgacattgcccaagagtgtgtaaactttttgaaaagacagaacattggcgttgccactttcattggcctcgacaaaatggccgtctgggcgaagaaaatgactgaaatacaaacacccgagaacacaccaaggctgttcgatctagtgaaggtcaaggatgagaagatcaggcaggccttctactttgccctccgcgacaccctggtggcggacaatctggaccaggccacccgggtcgcatatcagaaggatcggaggtggcgcgtcgtcacactccaggggcagatcatcgagcagagcggaaccatgacaggggggggatcgaaggtgatgaaaggtaggatggggtcgtcactggtcatagagattagcgaggaggaggtcaataagatggagagccagctgcagaatgactcaaaaaaggcaatgcagatccaagagcagaaggtccaactcgaggaaagggtggttaaactgaggcactccgagcgcgagatgaggaacacgctggagaagtttacggcctctatacagaggcttattgagcaagaagaatacctgaatgtgcaggtcaaggaactggaagcgaatgtattggccaccgcacccgataagaagaagcaaaagctgcttgaggaaaacgtctcagctttcaaaacagaatacgatgccgtggcagagaaggccggaaaggtggaagcggaggtaaagcggctgcacaataccatcgtcgaaataaacaatcataaactgaaagcccagcaggataagttggacaaaatcaacaagcaactggatgagtgcgcaagtgccatcactaaggcccaagtggccatcaagacagcagatcgaaaccttcaaaaggcgcaggatagtgtgctcagaacagagaaggagatcaaagacactgagaaggaggtggacgaccttacagctgagctgaaatccttggaggacaaggctgcggaggtagtaaagaacactaatgcggctgaggagtcacttcccgagattcagaaggaacatagaaacttgctccaggaactgaaagtgattcaggagaacgagcatgctctacagaaggatgcattgtccataaagctgaagctcgagcagattgatggccacattgcagagcataactcaaaaatcaagtactggcacaaggagatcagcaagatctcacttcacccgattgaagataatccaatcgaggagatcagcgtcctgtcccctgaggacttggaagcaatcaagaatccggacagcattaccaaccaaattgcacttctcgaggctcgatgccatgagatgaagcccaacctgggtgcaatcgccgagtacaagaagaaggaggagctctatctccagcgcgtggccgaactggacaaaatcacatacgagagagactccttccgtcaggcctacgaggatctgcgcaagcagagactcaacgagttcatggctggcttctacatcattacaaataagcttaaagaaaactaccagatgctcaccctcggcggagatgccgagttggagctcgtcgactcactggacccgttttctgagggcatcatgttctcagtgaggcccccaaaaaagtcctggaagaaaatcttcaacctcagtgggggagagaagaccctctcttctctagccctcgttttcgctctgcaccactataaaccaacgcctctttacttcatggacgaaattgacgcagccttggacttcaaaaatgtttccatcgtagctttctacatttacgagcagacaaaaaacgctcagttcatcattatttcactgcggaacaacatgttcgagatttccgaccggctgattgggatttacaagacctacaacattactaaatctgttgctgtgaacccaaaggagatcgctagcaagggtctttgttag

SEQ ID NO: 14808 - DNA, 2856 bp, Artificial Sequence
  Description of Artificial Sequence: Synthetic coding sequence
atgctgggatccatggctcgtaagaagccgcgaaacacatcgcggctcccactggccctgaaccccctgaagagtaaagatgtgttggccgtactggccgagcgtaatgaggctatcgtccccgttggagcctgggtagaaccggcttctcccgggagcagcgaaatccccgcatacactagtgcatacctgatcgaagaggaattgaaagagcaactccggaagaaacaggaagccttgaagcacttccagaagcaagtgaagtatagggtgaaccagcagatcagactccgtaagaaacagcaactccagaaatcatacgaacgggcccaaaaggaaggaagcatcgcaatgcagtctagtgccacacaccttacctctaagcgcaccagcgtgtttccaaataatttgaacgtggccatcggaagtagtaggttgcctccgtctctcatgccaggagacggtatcgaagatgaggaaaatcagaacgaattatttcaacagcaagcacaggcactaagcgagaccatgaaacaagcacgtcacagactggcctcatttaaaacagtgataaagaaaaaggggtctgtcttccccgacgatggaagaaagagcttccttacgcgcgaggaagtgctgtcccggaagcctgcgtctacgggcattaacacaggcatccggggtgagctccccattaaagtgcatcaaggactccttgcggcggtcccttaccaaaattacatggaaaatcaagaactagactatgaggaacccgattatgaagaatcctcctccctggttactgatgagaagggaaaggaggacctctttggccgggggcaacaagatcagcaggccatccattcagaggataaaaacaaacctttcagtagggttcaaaaagtgaaatttaagaatcccctctttgtgctgatggaggaagaagaacagaagcagttgcacttcgaaggtcttcaggacatactgccagaggcgcaggactacttcctggaggcccaaggagacctgctggaaacccagggggatcttactggaatccagtccgtgaagcccgacacacaagctgtggagatgaaggtgcaggtaacggagccagaggggcaagccatcgagcctgagggacagcctattaagacggaaacacaaggaatcatgctgaaggctcaatcaatcgaacttgaggaaggaagcatcgtcctcaagactcaagactttcttcccaccaatcaggcattattaactaaaaatcaggatgtgttactgaaagaccattgcgtgttaccaaaggatcagagtatcctcctgaaataccaagaccaggacttccttccccgggaccaacacgtattgcacaaggatcaagatatactgcctaaataccaggatcagaatttcctgcctaaggatcaaaatttcctcagtagagaccagcacgtgttgcccaaagatcaagatatcctgccgaagtaccaagatcagaattttctacctaaagatcagaattttctgtctagagatcaacacgtcttgcccaaggatcagaacatcttgcctaagtatcagggacaggacttccttcccaaagatcaggacttcctctcccgcgaccagcatgtgctgcccaaggattggaatatcctgcccaagtgccaggaccaggacttcctgcccagggatcaaggagtgctacccaaggaccagaatatcctgcctatttgtcaggatcaggactttttgcctagggatcaggggtatctcccaaaagaccagaatatcctacctatctgccaggacagagactttctgccaagggacttacatgtcttaagcaacgaccagaacatcttgcccaagtgccaggaccaggactttctaccaaagtaccagaaggtgcattttaaagaaccttatagcgacatgaccgacgagaaagggagagaagatttttctttggccgactaccagtgccttccccccaaaagtcaggaccaggacgatataaagaaccagcaacctgcttcctttatgcgcgaagaaagagtgagggaagaacttcccctcgattaccaccaatacgttgtgccaaagatccaggatcaagactccccacgagagcagaacaagcatattaagctgccctctagtttcgagaaatgggaaatagctcgggggaacaccccaggagtaccgttagcatatgatcgttaccagtcggggttgagtaccgagtttcaggcccccttagcgttccagagcgatgtggataaagaggaagataagaaggaaagacagaagcagtacctgcgacaccggcggctatttatggacatagagagagagcaggtcaaagagcagcaacggcagaaagagcagaaaaaaaagattgagaaaattaaaaagaagcgggaacaggaatgctacgctgcagagcaaaggatactgcgaatgaacttccatgaagacccctattctggggaaaagttgagcgagatcttggcccagctccagctgcaggaaattaaagggacccgcgaaaaacagcagcgagagaaagagtatttacgatacgtggaagccctgcgcgcccagatccaggaaaagatgcagttgtacaatatcaccctgcctcctttgtgttgctgcggccccgatttctgggatgcacatccggacacatgtgccaacaactgcattttttataagaatcaccgtgcctacactcgtgccttgcattccttcatcaactcctgtgatgtcccggggggcaatagcactctgagagtggccatacataatttcgcgtccgcccaccggagaacactgaaaaatttgtag

SEQ ID NO: 14809 - DNA, 1248 bp, Artificial Sequence
  Description of Artificial Sequence: Synthetic coding sequence
atgtctccggaggtggctctaaacagaatcagtcccatgttgagcccattcatcagctcggtggtgcgtaatgggaaagtaggtttagacgcgaccaactgtctaagaatcacagacctgaaatctggatgcacatcactgactcctggccctaattgcgatcggtttaaactacatataccctacgcaggcgaaactttgaagtgggatatcatcttcaatgctcaatatccagagctgcctccagatttcatcttcggcgaagacgccgaatttctgccagatccctccgcgctgcaaaacctggcaagttggaacccatcaaatcccgagtgtctcctgctcgtggtcaaagagctggtgcagcagtatcatcaattccagtgttcgagattacgtgagagcagtcggctcatgttcgagtaccagaccctgctcgaagagccccagtacggcgagaacatggagatctatgccggcaagaaaaataattggactggagaattttctgccaggtttcttttaaaactgccagtggactttagtaacatcccaacctaccttttgaaagatgtgaacgaggaccctggagaggacgtcgcattactaagcgtgtcgtttgaagacaccgaagctacacaggtgtacccaaaactttatctgtctccacgtatcgagcacgcattgggaggttcgtccgccctgcacattccagcatttcctgggggtgggtgcctgatcgactacgtgccccaagtgtgccatcttttaacaaataaggtgcagtacgtcatccaggggtaccacaagcggcgcgaatacattgcagccttcctcagccatttcgggaccggggtggttgagtatgacgctgaggggttcacgaagctgaccctcctgctcatgtggaaagatttttgcttcctggtgcatattgatctgcccttgttcttcccccgggaccaaccaactttgacattccaatccgtgtaccatttcacaaatagtggccagctgtacagtcaagcgcagaagaattacccatatagccctaggtgggatgggaacgagatggccaagagggccaaagggtgtcagggttctcgtgacgcgtgttctccctgggaacaggtgttagcctttgccgtcgccaagaccggatgtaaattactccagccccagcggaactggccaagcagtcggggtccaccatggcgtgcatctgaaggcgagagaacagcgcaatag

SEQ ID NO: 14810 - DNA, 903 bp, Artificial Sequence
  Description of Artificial Sequence: Synthetic coding sequence
atgctgagcgctgtagctcggggctatcagggatggtttcacccctgtgcaaggttatccgtgaggatgtcttcaaccggaatcgatcgcaagggcgtactagctaatagagtggcagtggtcacaggcagcaccagcgggattgggttcgccatcgcaaggaggttggctagggacggggcccacgtggtgatcagctccaggaaacagcagaacgtggacagggccatggccaagctgcagggcgaggggcttagcgtcgcgggcattgtgtgccatgtaggcaaagcagaagacagggaacagttagtggccaaggctctggaacattgtggcggggtagatttcttggtttgttcggccggcgtgaaccctcttgtcggctccacattggggactagcgaacagatttgggataagattctaagtgtgaacgtaaaatcccccgcgctgctgttgagtcagcttctgccctacatggagaatcgacgcggtgccgttattctggtatcttcaatcgctgcctataatccggtggtagcgcttggtgtgtacaatgtgtctaaaacagccctgctgggtctgacacgcaccctggcactggagttagcccctaaagacatacgggtgaactgtgttgtgcccggaatcatcaagaccgacttttctaaggttgttcgaatcgggtttatgggcatgagcctttctggtcgcacatccagaaatataatatcctgcagagggctcggttcccagaggacagtgcaggaatcgtgcccctcctgcgcattacagatgcccgccacctcaacaggacgtaccctgcggtggcaggcaaccccactgggatccgaaagatcggggggcggctgcgttgccgtcgttccaggccccggagcttag

SEQ ID NO: 14811 - DNA, 1014 bp, Artificial Sequence
  Description of Artificial Sequence: Synthetic coding sequence
atgagatttgataccctgtgggagaacaagctgatgcagagtcgcgccgtggacgggttccacagcgaggagcaacagttgctgctacaggtgcagcaacagcatcagccacagcagcagcaacaccatcatcatcatcatcaccagcaggctcagcctcaacagacagtgcctcagcaggctcagacccagcaggtgctgatcccagcatcacaacaggcgaccgcgcctcaggttattgtgcctgattctaagctgatccaacacatgaatgcttcgaatatgagcgccgccgccacagcggctactcttgctctgcctgctggggtcacacccgtgcagcagattctgacaaattcagggcagctcctgcaggtcgtgcgcgccgccaatggcgcgcagtacatatttcagccccagcaatcagtggtcctacagcagcaggtgataccccagatgcaacctggcggagtgcaggcgcctgttatccagcaggtattggcccccctgccaggcggtatctcaccgcagacaggcgtgattattcagccacagcagatcctctttaccgggaataagacacaggtgattccaaccacagtcgcagctccgacccctgcgcaagctcagatcacggcgactggccagcaacagccgcaggcacagccggcgcagacgcaggcacctcttgtactccaggttgacggcacgggagatacgtctagtgaggaagacgaggacgaagaagaagattatgacgatgatgaggaagaggataaggaaaaggatggagcagaagacggccaggtagaagaggaacctctcaacagtgaagacgacgtgagtgatgaagaagggcaagaactttttgacaccgaaaatgtggtcgtctgccagtatgataagatccataggtccaaaaacaaatggaagtttcacctgaaggatggaatcatgaacctgaatggacgggattacatttttagtaaggctataggagacgctgagtggtag

SEQ ID NO: 14812 - DNA, 282 bp, Artificial Sequence
  Description of Artificial Sequence: Synthetic coding sequence
atggcccaatccggtggagaagccaggcccggccctaagacagccgtccagattagagttgccatccaagaggcggaggacgtagatgaactggaagatgaagaagaaggcgccgaaacgagaggcgctggcgatccagcacggtatctgtcacccggatggggctccgcaagtgaagaggagccttcacgcggccatcgaaacaggagcagcgtcaatagcagaacgatgctggcgtcttttatcgtcagcagcgcaccatcaaccgccccatccacgtag

SEQ ID NO: 14813 - DNA, 255 bp, Artificial Sequence
  Description of Artificial Sequence: Synthetic coding sequence
atgaaagtaaaaattaaatgttggaatggcgtggcaacgtggttatgggttgccaacgacgagaactgtggtatatgcagaatggcgtttaatggatgttgccctgattgtaaagttcctggcgacgactgcccgctcgtgtggggccagtgcagccactgctttcacatgcattgcattctgaaatggctgcatgcccagcaagttcaacaacactgccccatgtgtagacaagaatggaagttcaaggaatag

SEQ ID NO: 14814 - DNA, 612 bp, Artificial Sequence
  Description of Artificial Sequence: Synthetic coding sequence
atggctcacgtgtccagtgaaacccaggatgtgtcaccaaaggatgagctgaccgcttctgaggcctcaacacgctctcccctctgtgagcacaccttccccggcgatagtgatctgaggtccatgatcgaggagcatgccttccaggtgctttcccagggctctctccttgagtctccttcctacacagtctgcgttagcgaacccgataaagatgatgattttctgtctctaaatttcccgaggaagctctggaagatagtggagagcgatcagttcaaatctatatcttgggatgaaaacggaacttgtatcgtcatcaacgaggagctgtttaaaaaagagatattagaaactaaggccccttatagaatctttcaaacagatgcgataaaatcatttgtgcgccagttaaacctctacggcttttccaaaatccagcagaacttccagcggtccgccttcctagccactttcttgtcagaggagaaggaaagctcagtgctgagtaagattcgatttaccaaaatgaaactttccaggtcaagtacctacgaaaacagatatctgtgctgtaacctccatttgaaggacgagagcaattatagctag

SEQ ID NO: 14815 - DNA, 1794 bp, Artificial Sequence
  Description of Artificial Sequence: Synthetic coding sequence
atgcccagcccacagcttcttgtgttgttcggatcacaaacaggaacagcgcaggatgtgtccgagaggctgggcagagaggccaggagacgccgcttgggctgtcgggtgcaagccctagactcatatccggttgttaacttgatcaatgaacccctggtcattttcgtatgtgctaccactggacaaggcgacccaccagacaatatgaagaacttttggcgctttatcttcaggaaaaatctgccgtccactgctctttgccagatggatttcgctgtgctgggcctgggggatagttcttacgccaaattcaactttgtagcaaagaagcttcatcgccgcctattacagctggggggaagtgcccttctgccggtgtgtctgggggacgatcagcacgaactgggacctgacgctgccgtggacccatggctgagggacttgtgggaccgcgtcctggggctgtaccctcctcctcctggcctcaccgagattcctcccggcgtccctctgccttccaagttcaccctgctcttcctccaagaggctccttcaacagggtctgaaggtcagcgagtggcccatcctggaagtcaagagccccccagcgagtctaagccctttctggctccaatgatatcgaaccagcgggtgactgggccctcccactttcaggacgtcaggctgattgaattcgatattcttggcagtggaatcagcttcgccgccggcgacgtagtccttatccagccaagcaattctgcagcacacgtgcagaggttctgtcaggtgcttggactggatcctgaccaactgtttatgctgcagccaagagaaccagacgtgtcatcgcctacccgactccctcaaccatgctctatgaggcacctggtgagccactacctggatatcgcttccgtgcctcggcgatccttctttgagctcctcgcttgcctcagtcttcacgagttggaaagagaaaagctgctagaatttagttccgctcaagggcaggaggaattgtttgagtactgtaaccgtccaagacgtactatcctggaggtcttgtgtgatttccctcataccgccgccgccattccacccgactatttgttggatctgattccagttattagacctcgggcctttagcatcgcctcttccctactcacccacccctcacgtctgcagattctagttgccgtcgttcagttccagaccagactgaaagagccccgacgtggcctctgttccagctggctggctagcctggatcctggccagggtcccgttcgcgtaccactctgggtcagaccgggatccctcgcctttccagagactcccgacaccccagttattatggtgggtcctggaaccggtgtggctcctttcagggcagccatccaagagcgggtcgcccagggacagacaggcaatttcctgttcttcggatgtcgctggcgggatcaggacttctactgggaggccgagtggcaggaactggagaaaagagattgtcttaccttgattccagccttcagccgggagcaggagcagaaagtttatgtccaacacaggttgagggaactcggcagtctggtatgggaacttctggaccggcagggagcttacttctacctggctgggaatgctaaatcaatgcccgccgacgtgagcgaagctttgatgtctatctttcaggaggagggcggactctgttcccctgacgccgccgcctacctggccagactgcaacagacaaggaggttccagacagaaacctgggcatag

SEQ ID NO: 14816 - DNA, 1860 bp, Artificial Sequence
  Description of Artificial Sequence: Synthetic coding sequence
atggacgaccagcaggctttgaactccatcatgcaagacctcgccgtgctgcataaagccagcaggcctgctctgtcgctccaagaaacccgcaaggccaagtccagctcgcccaaaaagcagaacgacgtcagggtgaaatttgaacaccgcggcgagaaaaggatactgcagttccccaggcccgtgaaactggaggatctgcgttcgaaggctaaaatagcattcgggcagtcaatggatcttcattacaccaataatgaactggtcataccactgaccacccaggacgacctggataaggctgtggagctcctggaccgatctatccatatgaagagtttgaaaatactgctggttataaacggttcaactcaggccaccaacctcgagcccctcccctctctggaagacctcgacaacaccgtgttcggcgccgaaaggaagaagcgtctgagcattatcgggcccacgtcccgcgacaggtcttcgcctccaccaggctacatcccagatgagctgcaccaggtggccaggaacgggagtttcaccagtatcaacagcgaaggggaattcattcctgagtccatggaccagatgctggatccactgagcttatcttcccctgagaactctgggagcgggtcatgtcccagtctcgattcacccttagatggcgagagctatccaaaaagtaggatgcccagggcccaaagctatcctgacaaccatcaggagttctcagattacgataatcccatatttgagaagtttggaaaaggaggcacttatccaaggaggtaccacgtgagctaccaccaccaggaatacaacgacgggcggaagacttttccccgtgctcgtcgaacccagggcacctccctgagatcacctgtatctttctcgcccacagatcactctctatcaacctctagcggctcttcaatcttcaccccagagtacgatgactcaagaatccgacgtcgaggaagcgatatcgataaccctactctgacagtgatggatatctcacccccaagccggtctcctagagcacccactaattggagactcggcaaactgctgggccagggggctttcggcagagtctatctctgttacgatgtcgacaccggtagagagttggcggtgaagcaggttcagtttgaccccgatagcccggagaccagtaaggaagtgaacgcactcgagtgcgagatccagctgttgaagaacctgctgcacgagcgcattgtgcagtattacgggtgtttacgagacccccaggaaaagactctatcaatatttatggagtacatgcctggtgggagcattaaagaccagcttaaggcttatggggctttgactgaaaacgtgacaaggaagtacacccgccagatcctggaaggggtccattatcttcactctaatatgatcgtgcacagagatatcaagggggcaaacattctccgcgattccaccggtaacgtgaaactgggggacttcggtgctagtaaacggctgcagactatctgtctgtccgggactggtatgaagagtgtcacagggaccccctattggatgtcgcccgaggtcattagtggcgaaggttatgggcgtaaggcggatatctggtccgtcgcgtgtacagttgtagagatgctgacagagaaacctccttgggctgaattcgaagctatggccgcaatcttcaagattgctacacagcccacgaatccaaaactcccaccccacgtgagcgactatactcgtgatttcctgaagagaatttttgtagaagcgaagctgaggccatctgctgatgaattactgaggcacatgtttgtccattaccactag

SEQ ID NO: 14817 - DNA, 828 bp, Artificial Sequence
  Description of Artificial Sequence: Synthetic coding sequence
atgtcaactatcggctccttcgagggcttccaggcggtgtcattaaagcaggagggggacgaccagccctctgagaccgaccacctcagcatggaggaggaagaccctatgccgcgtcagatttcccgacagtcgtctgtaactgagtctactttataccctaatccttaccatcagccatatatatcccgcaaatattttgcaacccgtcctggcgccatagaaactgccatggaagacctgaagggccacgttgccgagacttccggagaaaccattcagggattttggcttctgactaagatcgatcactggaacaatgagaaagagcgtatcctgctggtgaccgacaagaccctactgatctgtaagtacgattttatcatgctttcctgcgtacaactgcagagaatccccctttcggccgtgtatagaatctgcttgggaaagttcaccttcccgggcatgagcttggacaaacgtcaaggtgaaggccttcggatatattgggggtcgccagaggagcagagtctgttgtcccggtggaacccatggtctactgaggtcccttacgctaccttcacagaacaccctatgaagtatacatcagagaaatttctcgaaatttgtaaactttctggcttcatgtccaagctcgtgccagcgattcagaacgcccacaagaattccaccggcagtggaagaggaaaaaagctcatggtgctgacagagccgatattgattgaaacatacaccggcttgatgtcctttattggaaatcgcaataaattgggctattctctggcccgggggtcgattgggttttag

SEQ ID NO: 14818 - DNA, 1629 bp, Artificial Sequence
  Description of Artificial Sequence: Synthetic coding sequence
atggcagccgcggctggagccgctgccgcgcctggcagccgagaacctcaagaccgcccggaatgtggcgccgggcatcctggccctcgttactacaggcaccctgagcggtggctcttacggcccgaagcatttctcggccctctgcgaaccagggcgccttcagctgaagatagccagagagagcgacctgccgccagatccggaccggccatgtcaagaagggtagtgcgccagtcaaagttcaggcatgtgttcggacaggccgctaaggccgatcaggcatatgaggacattcgcgtttccaaagtgacctgggacagctcgttttgcgctgtgaatccgaagttcctcgctattattgtagaggcagggggcggcggagcgttcatagtccttccactcgcaaagaccggccgtgtcgacaagaactacccacttgttacaggccatactgccccagtgctggatatagactggtgtccacataacgacaacgtaattgcatccgcaagcgacgatacaactataatggtatggcagatcccggattacacccccatgagaaacatcacagagcccatcataactctggagggtcattctaagagggtaggcatcctgtcctggcatcctaccgccaggaatgtactgctctcagccggaggggacaatgtaatcattatctggaacgtcggcactggcgaagtgctgctctcccttgacgatatgcatcccgacgtcatccattcagtgtgttggaatagtaatggctcattgctcgcaaccacctgcaaggataagacactgcgaattatagacccaaggaaagggcaggtggtggctgagcggttcgccgcccatgagggaatgcggcccatgcgagctgtgttcacccgacaggggcacattttcaccaccggcttcacacggatgtctcagagagaacttggcctttgggatcccaataactttgaagagcccgtggccctgcaggagatggacacttctaacggcgttttgctccccttctatgacccagactcgtctatcgtctacctttgcggaaaaggagactcatctattcgatatttcgagatcacagacgagcctccctttgtacactacttaaacacattctcaagtaaagaaccgcagcgagggatgggctttatgcccaagcgcgggctggatgttagtaagtgtgaaatcgcacgcttttacaagctccacgagaggaaatgcgagcccatcataatgaccgtgccgcgaaagtccgatcttttccaggacgacttatatcccgacactcccgggcccgagcccgcattggaagcagacgagtggttgagtggccaggacgcagagcctgtcctcatttcactccgcgacgggtacgtgccgcccaaacatagggaactgcgagtaactaaacgcaatatactggatgtgcggccgccatccggacctaggcgatcccagagcgcaagcgatgcccccctgtcgcagcatacgctcgagaccctgctggaggaaatcaaggctctccgcgaacgtgtccaggcccaggaacaacggataacggccctcgagaacatgctctgtgaactcgtagacggaaccgattag

SEQ ID NO: 14819 - DNA, 2550 bp, Artificial Sequence
  Description of Artificial Sequence: Synthetic coding sequence
atgtccgacacccgacggcgcgttaaggtttacaccctcaacgaagacagacaatgggatgaccgtggaaccggacatgtgagttctacttacgtggaagagctgaaaggtatgtcattgcttgtaagagcggaaagcgatggctctcttctcctggagtctaagattaacccgaatactgcctaccagaaacaacaggacaccctgatcgtttggtccgaggcagaaaattatgatctcgcactgtctttccaggaaaaagccggctgcgatgagatatgggaaaaaatctgccaggtgcaggggaaggacccctctgtggaagtcacgcaggacctcatcgatgaaagtgaagaggagcgctttgaagaaatgcccgagacaagccacttgattgacttgccaacgtgcgaacttaacaaactggaggaaattgccgatttagtgactagtgtgctgtcttcacccattaggagggagaagctggccctggccctcgaaaacgagggctatataaagaagctgctccagctatttcaggcctgtgaaaacctggagaataccgagggccttcatcacttatacgaaattataaggggcatcctgtttctaaacaaagcaacgctttttgaggtgatgtttagcgacgaatgtattatggacgtggtgggttgcctcgaatacgatcctgctcttgctcagccaaagaggcatcgtgagttccttacaaagaccgccaaatttaaggaagtgatccccatcaccgacagcgaactaaggcaaaagattcaccagacatacagagtgcagtatatccaagatatcatcctccctacaccatcagttttcgaagaaaatttcctgtctacgctcacaagctttatcttttttaataaagtggagatcgttagcatgctacaggaagatgaaaagtttttgtccgaggtgttcgcgcagctcacagatgaagccacagacgatgataaacgtagggagttagtcaatttcttcaaagagttctgcgctttttctcagaccttgcagcctcagaatcgcgatgccttctttaagactttggcaaaacttggtatccttcctgcgctggagatagtaatgggcatggacgacctgcaagtgagaagcgcagccacagatatcttctcatacctggtcgagttttctccctccatggtcagagaattcgtaatgcaggaggcacagcaaagtgacgacgatattttacttatcaatgtcgttatcgagcagatgatttgtgatacagaccccgagttgggaggggctgtccaactcatgggcttactgaggacgttaattgatccagaaaacatgttagccaccacaaataaaacggaaaaaagtgagtttctgaatttcttctacaaccactgtatgcatgtcctgaccgccccgcttctgacgaacacttccgaggataaatgcgagaaggattttttcctgaagcattacagatacagctggagctttatctgtacccctagtcactctcactcacattcgaccccatcctccagcatttctcaggacaatattgtggggagtaacaaaaacaatactatctgtcccgacaactaccaaaccgcccaactgttagctctgatcctcgagctcctgactttctgtgtggagcatcatacgtatcatattaagaactacatcatgaacaaggacctgctgcggagggttctggtccttatgaacagtaaacacacattccttgcgctctgtgctcttcgctttatgagaagaatcatcggccttaaggatgaattttacaatcgctacattacaaagggcaacctttttgaacccgtgatcaacgcattacttgataatggcacccgttacaatctgctcaacagtgcggtcattgaactgtttgaattcatcagagtcgaagacatcaaaagcttgaccgctcatatagtggagaacttttataaagccctcgagagtatcgagtacgtacagaccttcaaggggctgaagaccaagtacgaacaagagaaggataggcagaatcagaagcttaattccgtaccaagcattctgcggtccaatcgatttcggcgagatgcaaaagccctggaagaggatgaagaaatgtggtttaacgaagacgaggaggaggaggggaaagccgtggtggcaccagtggagaagcctaagcctgaggatgacttccctgacaattatgaaaaattcatggaaactaaaaaggctaaagagtctgaggacaaggagaacctacctaagcggacgagccccggaggcttcaaatttacattttcgcattcagcttcagctgccaacgggaccaacagtaaatcagtagtcgcacaaattccccctgccacttcaaatgggtcatcttccaaaacaactaatctaccaacctccgtgaccgcaaccaaaggctccctcgtgggattggtggattacccagatgatgaggaggaagacgaagaagaagaatctagtccccgcaaaaggccacgactcgggtcttag

SEQ ID NO: 14820 - DNA, 669 bp, Artificial Sequence
  Description of Artificial Sequence: Synthetic coding sequence
atgggagacattcccgctgtgggactgtccagttggaaagcctctcccggtaaggtgacggaggccgtgaaggaggcgatagacgccggatataggcacttcgactgcgcatacttctaccataacgaacgagaggtcggagccggtatacgctgtaaaattaaagaaggtgctgtgcgcagagaagatctgttcatcgccaccaaattatggtgtacatgccacaagaaatctctggtggaaacagcctgtcgcaaatccctcaaggcgctgaagctgaattatttggacctctatctgatccactggcccatggggttcaagcctccccaccctgaatggattatgtcttgcagtgaactgtccttttgtctttcgcaccccagggttcaggacctccctctggatgagagcaacatggtcattcccagcgataccgacttcctggacacctgggaaattctaataagattccagatacagagaaacgtaatagtcatacctggatcgatcactccatctcatatcaaagaaaacattcaggtatttgatttcgagttaacgcaacacgatatggacaatatactttctctcaatcgtaacttgcgcctggcgatgtttccgattactaaaaaccataaagactatccttttcacattgagtattag

SEQ ID NO: 14821 - DNA, 1080 bp, Artificial Sequence
  Description of Artificial Sequence: Synthetic coding sequence
atgcccaacccgtcaagtacctccagtccttacccattgccagaagagatccgtaacctgctagcagacgtcgaaaccttcgtagccgatattctaaaaggcgaaaatctgtcaaagaaagcaaaggagaaacgggaaagtttgataaagaaaataaaggacgtcaagtccatctacctgcaggagttccaggacaagggggatgctgaagatggcgaagaatacgatgacccgtttgccggacctcctgacacaattagcctagctagtgagcgctatgataaagacgacgaggctccgagcgatggagcacagttccccccaattgccgcccaggatctgccctttgtcttgaaggccgggtacttagagaagcggcgcaaagatcactcgtttcttggttttgaatggcagaaacgatggtgtgcactgtctaagactgtgttttattactatggctccgataaggataagcagcaaaagggcgagttcgctattgatggctactccgtgcggatgaacaacacactgcgaaaggatggtaaaaaggattgctgcttcgagatcagcgcgcccgacaagcgaatctatcaatttaccgcggcttctcccaaggatgcagaagaatgggtgcaacagctgaagtttgttctgcaagatatggaatcagatataattcccgaggactacgacgaaaggggcgaattgtacgatgatgtcgatcaccccctgcctatctccaatccgctgacctcctcgcagcccatcgatgatgagatctacgaagaactgccggaggaagaggaagacagcgcccctgtgaaggtggaagaacagcggaagatgtcgcaggactcagtccatcacactagcggagataaatctacggactacgccaacttttaccaggggttgtgggactgcaccggggctttttctgatgagcttagtttcaagaggggggacgtcatttacatactaagcaaagaatacaacaggtacggctggtgggtcggcgaaatgaagggcgcgatcgggctagtgcctaaggcgtacattatggagatgtacgatatatag

SEQ ID NO: 14822 - DNA, 1227 bp, Artificial Sequence
  Description of Artificial Sequence: Synthetic coding sequence
atgaagtgtgagcattgcacgcgaaaggaatgtagcaagaaaaccaaaaccgatgatcaagaaaacgtgtccgccgacgccccatctccagcacaggagaatggagagaaatgcgatacgtccaagcacaaagtgctcgtcgtgtcagtctgcccacagtctttaccatattttgcggctaaattcaacctcagtgttacagatgcctcccgccgcctctgcggtttcctgaaaagtttaggcgtacattatgtatttgacaccaccatcgcagctgacttcagtattttggaatcccagaaagagttcgtgaggcgataccgtcaacatagcgaggaggagaggactctacccatgttaactagcgcctgtcccggatgggttcggtacgccgaacgcgtcttgggccggcccatcaccgcccatctttgcaccgctaagagccctcaacaggtcatgggctccctggtgaaggactattttgcccgccagcaaaacttgtctcctgagaaaatcttccatgtgatagtagccccttgttatgataaaaagctcgaagcacttcaggaaagcctgccacctgccctacatggctcacggggggctgactgcgtgcttacatcgggcgaaatcgcgcaaattatggagcaaggagatctgtccgtgcgggatgccgccgtagataccctgtttggagatctaaaggaggataaagtgactagacacgacggtgcaagttcagacggacacctcgcccatatcttccgacatgctgctaaggaactgtttaacgaggacgttgaggaggtgacctatcgtgctttgcgcaataaggattttcaggaagtcactcttgagaaaaatggggaggtcgtgctccggtttgccgctgcctacggcttcagaaacatccaaaatatgatcctcaaattgaagaagggaaagttcccattccacttcgttgaggtcctggcatgcgccggcggttgcctcaacggcaggggtcaagcccaaactcctgatggccatgcggataaggcgctgctgagacagatggagggaatttatgcagatatcccagtgcggcggcccgaatccagtgctcatgttcaggaactgtatcaggagtggttggagggtattaattctccgaaggcgagagaagttctccatactacgtaccaaagtcaggaaaggggaactcactcccttgatatcaaatggtag

SEQ ID NO: 14823 - DNA, 1104 bp, Artificial Sequence
  Description of Artificial Sequence: Synthetic coding sequence
atggcccttaatgtcgcaccagtacgagacaccaagtggttgactctggaggtgtgtcggcaattccagaggggaacatgtagcaggagtgacgaagaatgcaaatttgcccaccctccaaagagttgtcaggtggagaatggcagggtgatcgcctgttttgactctcttaaaggcagatgcagcagggagaactgcaaatatctgcaccctccaacacacttgaagactcaactggagatcaatgggagaaacaatcttatccagcagaaaactgccgccgcgatgctggcccagcagatgcagttcatgttccctgggacccctctccatcccgtgcccacatttcccgttggaccggctatcggcaccaataccgcaatttccttcgctccctatctggcgccagtcaccccaggtgtgggactggtgcctaccgagatcttaccaacaacacccgtgatcgtgcctggaagtcctccggtgactgtgcctgggtcgacagctacgcagaagctgcttcgcactgataaactggaagtctgcagagagttccagagaggtaattgcgctcgcggcgagaccgactgtagatttgctcaccctgcagattcgactatgattgacacgtcagacaatacagtgaccgtgtgtatggattatatcaaaggtaggtgtatgcgggagaaatgtaagtactttcacccaccagctcatctccaggctaagatcaaagccgctcagcatcaggccaaccaggctgccgttgccgcccaagcagctgccgctgccgcaaccgttatggccttccctcctggcgccctgcacccactgccaaagagacaagcactggagaaaagcaacgggacctctgccgtgtttaacccttccgtgttgcattatcaacaggcacttaccagcgcacaactccaacagcacgccgcattcattcccactggctctgttctgtgtatgactcctgcaacaagcatcgtaccgatgatgcatagtgctacttctgctactgtgagtgccgctaccacaccagcgacttccgtaccgttcgcggccactgcgaccgctaatcaaatcatcctgaagtag

SEQ ID NO: 14824 - DNA, 3909 bp, Artificial Sequence
  Description of Artificial Sequence: Synthetic coding sequence
atggcccttaggccaggagctggcagcggcggcggtggagccgccggcgctggagccggcagcgcaggcgggggggggtttatgttccccgtggccggtggcataaggccaccccaggctggactgatgccaatgcagcagcagggcttcccgatggtaagcgtcatgcagccgaatatgcaggggataatggggatgaactacagtagccagatgagccagggtccaattgctatgcaggccggtatccctatggggcccatgccggccgcaggaatgccctatctgggccaggcacctttcctggggatgcgccctcccggcccccaatacacccctgacatgcagaaacagttcgccgaagagcaacagaagcgctttgagcagcagcaaaagctcctcgaggaggaacggaagcgccggcagttcgaggaacaaaagcagaagcttagactgctgtcttcagtcaaacctaagacgggcgagaagagtcgcgatgacgcgctggaggccataaagggaaacctggatggatttagtcgtgacgccaagatgcacccaacacctgcttctcatccgaaaaagcccggccccagccttgaagagaagtttctggtttcttgtgacatctctacctcaggacaggagcagatcaaactcaatacgtcagaagttggccataaagccctgggaccagggagctccaagaaatacccctctctcatggcgtccaatggtgtagccgtggatggctgtgtatctggcacaacaactgctgaggcggaaaacacttctgaccagaatctctccatcgaggagagcggtgtcggtgtgttcccctcccaggatccggcacagccgcgcatgcccccttggatttacaacgaatccctcgttccagatgcttacaagaagatcctggagaccaccatgacgccaactggaatcgacaccgcaaagctctatcctatcctgatgtcctctggcttaccccgggaaacattaggccagatttgggcacttgccaatcggaccacccctgggaagctcacgaaggaggagttgtacactgtcctggccatgatagccgtcacacagagaggggtgccggccatgtcccccgacgcgcttaatcagtttcctgcagctcctattccaacgcttagcggcttctcaatgacgctgcctacacccgtgagccagcctacagtgatcccctccggccccgcaggtagtatgcctctctctctcgggcaacccgtaatgggcatcaaccttgttggcccagtgggtggtgccgcggcacaggcctctagtggctttatccccacataccctgccaaccaggtggttaagcctgaggaggatgatttccaggactttcaggacgcaagtaaaagcggatcattggatgattcttttagcgatttccaggagcttcctgcctcctctaagacatctaactcacagcacggaaattcagccccctcgttactaatgcctcttccaggaactaaagccctgcccagcatggataagtacgccgtgttcaaggggattgctgccgataaatcatcagaaaataccgtcccaccgggtgacccaggcgacaagtactcagcctttcgtgagttagaacagaccgccgagaataagccattgggggaatcgtttgcagagtttaggtccgcaggaaccgacgatggctttactgacttcaagacggcagatagcgtgagcccactcgagccccccacgaaggacaaaacattcccccctagtttcccaagcgggacaatacagcaaaagcagcagacccaagtgaaaaacccgcttaatctggccgatctagacatgttttccagtgtgaattgttccagcgaaaaacccctgagttttagcgcagttttctctacgagcaaatctgtttcaacccctcaatcaacaggaagcgcggcaactatgactgctttagcggcaactaagacatcaagcctagccgatgatttcggggagttctctctgtttggcgaatattcaggcctggcccctgtgggcgaacaagacgattttgccgactttatggccttttctaactcttctatcagctccgagcagaaacccgatgataaatacgatgctctaaaggaagaggcctcacccgtgccactgacgtctaatgtcggctcaactgtgaaaggcggccaaaacagcacggctgcatctaccaaatatgatgtttttaggcagttatccctggagggctctggccttggagttgaggatctaaaagataatacaccttcaggcaagtctgacgacgacttcgccgacttccacagttccaagttctcatcaatcaatagtgataagagcctgggagaaaaggcagtggccttcagacacaccaaggaggatagcgcgtcggttaagtcattagacctgccctccatcggcggctcatccgtaggcaaagaagactcagaagacgccttgtcggttcagttcgacatgaaactggcggacgtcggaggtgatctgaaacatgtaatgtccgatagcagcttggatctgccaactgtttctgggcagcatcctcctgctgcggacatagaggacttgaagtacgccgccttcggttcatactcttcaaactttgccgtgtccaccctgacctcttatgactggtctgaccgagatgatgctacccaagggcggaaactctcgcccttcgtcctgagcgctgggagcggttctcctagtgctacaagtatcctgcagaagaaggagaccagttttggctcatcagagaacatcaccatgacctccctgagcaaggtgacgactttcgtctctgaagatgctctcccagagactacgtttcccgctctggcatcctttaaggacactataccacagacgagcgagcagaaggaatatgaaaaccgcgactacaaagactttaccaagcaggacttgcccactgctgagagaagccaagaagcgacatgcccttctcccgccagcagcggagcgagccaggaaacccccaatgaatgttcagatgattttggagaatttcagagcgaaaagccaaagatctcaaagttcgattttctcgttgctacttcccagagtaagatgaaaagcagcgaggagatgatcaagtccgagctcgctacctttgacctgtctgtccagggaagtcacaagcgttcactcagcttgggcgacaaagagatctcgcggagttcccccagtcccgcactggagcagcctttcagggaccggtccaacacgctaaatgaaaaaccggccctcccagtgatccgggataagtacaaagacctgactggagaagtggaggagaacgaacgatacgcgtacgagtggcagcgatgtctcggatcggcattgaacgttattaagaaggccaacgacacactgaatggcatttccagcagttccgtgtgcactgaagttatccaatccgcacagggaatggaatacctcctgggggtggtagaggtgtaccgcgttaccaagcgtgtggaactaggtatcaaggccacagcagtgtgctctgaaaagctccagcaactgctaaaggacatagacaaggtctggaataatttgattggatttatgtcactcgccacgttgacacctgatgagaacagtctcgacttcagcagttgcatgctgagacccgggataaaaaacgctcaggagctagcttgcggagtctgtctgctcaatgttgatagcagatcaagagcattcaatagtgagacagactcctttaagctggcctacggcggtcaccagtatcacgcctcctgtgcgaacttttggattaactgtgtcgagcccaaacctcccgggctagtccttcccgacttgctctag

SEQ ID NO: 14825 - DNA, 1011 bp, Artificial Sequence
  Description of Artificial Sequence: Synthetic coding sequence
atggaaagcgtcctgtctaagtatgaagaccagatcacgattttcactgactacttagaggaataccctgatacggatgagctcgtttggatccttggcaaacaacacctgctgaagaccgagaagagcaagctcctcagtgatatttctgctagactgtggtttacgtacaggaggaagttctcccccattggtgggacaggaccgagttccgatgccgggtggggctgcatgttacgatgcgggcagatgatgttggcccaggccctgatttgcagacatcttgggagagattggagttgggagaagcagaaggaacagcctaaggaataccagcggatccttcaatgctttttggatagaaaggactgctgctactccattcatcaaatggcgcagatgggtgttggagagggcaagtcaatcggtgagtggtttggacctaacaccgtggcccaagtcttgaagaaattggccttgttcgacgagtggaacagcttagccgtgtacgtgtccatggacaatacggtcgtaatcgaagatataaaaaaaatgtgtagagttttgcccctgtcagctgatacagccggagataggccacctgattccctaaccgcatctaaccaaagcgatgaattgatcttcctagacccccacaccacacagactttcgtggacacagaggagaatggaaccgtgaacgatcagacattccactgcctccagtcgccacagcgaatgaatatactcaacctggatccatcagtggccctgggcttcttttgcaaagaagaaaaagactttgataattggtgctctttggttcagaaggagattttaaaagaaaacttgcggatgtttgaactggtgcaaaagcacccctcccactggcctccttttgtgccacctgccaaacctgaagtaaccacaacaggcgctgagtttattgattccactgagcagctggaggaattcgacttggaggaggatttcgaaatcctgtccgtttag

SEQ ID NO: 14826 - DNA, 3018 bp, Artificial Sequence
  Description of Artificial Sequence: Synthetic coding sequence
atgcttcgtaccgccggccgcgatgggttgtgccggctgagtacctatctcgaagagttagaggctgtagaactcaaaaagttcaagctttatctggggaccgccaccgaattgggagaaggcaagatcccctgggggagcatggagaaagctggccctcttgagatggcacaactcctcatcactcacttcgggcccgaagaagcatggaggctggctttatctactttcgaacgcatcaataggaaggacctttgggaacggggccagagagaggacctggtccgggacactccccctggcgggccatcctcccttgggaatcaaagcacgtgtctgcttgaagtgtccctagtgacccctcggaaggaccctcaggagacctatcgtgattacgtgagacggaaatttcgtctcatggaggatcgtaatgctcgcctgggggagtgcgtgaatctttcccacagatacaccagattactgctggtcaaggagcactctaacccgatgcaggtccaacagcagctactggatacaggaagaggccatgcgcggacagtggggcatcaggccagtcccatcaagatcgaaactctgtttgagcccgacgaggagcgaccagagcctccaaggacagttgtgatgcagggcgccgctggaatcggaaaaagtatgctagcccataaagtcatgttggactgggctgatggtaaattgttccagggccgcttcgactatttgttctacattaactgccgggaaatgaaccagagcgccactgagtgtagcatgcaggatctcatcttcagctgttggcccgagcccagcgcaccacttcaggaacttatcagggtacctgagagacttctcttcatcatcgacgggtttgacgagctcaagccgagctttcatgatccacaaggcccttggtgcctgtgttgggaggaaaagcggccaaccgagctgctcctcaattctcttattaggaaaaagttactgcctgaactgtcacttttaataaccacccgacccaccgctttggaaaagctgcacaggctactcgaacaccctcggcatgtcgaaattcttggctttagcgaagcagaacggaaagaatacttctataagtacttccacaacgcagagcaggcgggccaggtgtttaattatgttagggacaacgaacctttgtttacaatgtgtttcgtccctttggtctgctgggtggtctgtacatgcctgcagcagcagcttgaagggggaggcctgctgcggcagactagtagaactacaactgccgtgtacatgctgtacctgctgagccttatgcagccgaaacccggggccccgcgtcttcagccacccccaaaccaacgcggactttgcagtctcgctgccgacggtctttggaatcaaaaaattctctttgaagaacaggatctaaggaagcatggccttgacggtgaagatgtctcggccttcctgaacatgaacatattccagaaggacattaactgcgagagatattattcctttatccatttatctttccaggaatttttcgccgccatgtactacatcctggacgaaggcgaggggggagccggacccgaccaggatgtgacccgcctgcttacagagtacgctttttccgaaagatccttcctggccctgacatcacggtttcttttcgggctactgaacgaggagactcggtcccacctggagaagagcctctgttggaaggtctccccccatatcaaaatggatctgctgcagtggattcagagcaaagctcagagtgacggttccacactgcagcaaggctcacttgagttctttagctgcctttacgagatccaggaggaggaattcattcaacaggccctgtcacacttccaggtgatcgtcgtgtcgaacatcgcctctaagatggaacatatggtcagcagtttctgtctcaagcggtgtcgtagtgcgcaggttctacacctttacggagccacctattcagcagacggagaagaccgcgccagatgtagcgcgggcgcccatacgcttctcgtccagctccgccccgagcgaactgtgctcttggacgcctactccgagcacctagcagccgcgctttgtacaaaccccaacctgattgaactctcactatatcgcaacgctcttgggtctcgtggagttaagcttctatgtcaggggctccgccatcccaactgcaaattgcagaacctgcggctaaagcgctgtaggattagctcttccgcctgtgaggatctatcagcagctctcatcgcaaataagaatctgaccaggatggacctcagcggcaatggagtcggatttcctggaatgatgctcctctgtgaaggcctgagacaccctcagtgtaggctgcagatgattcagttgcggaagtgtcagctcgaatccggggcatgtcaagaaatggcatcagtgcttgggaccaatccacacctggttgagctggatctgactgggaatgctctcgaggacctcgggctgaggctactttgccaggggttaaggcatcctgtctgtaggctcaggaccttatggctgaaaatctgccggttaaccgccgcagcctgtgatgagctggcttccacgctgtctgtgaaccagagtctgcgcgaactggatctgagcctcaacgaactgggcgaccttggtgtgctgctgttgtgcgaaggactgaggcaccccacctgtaaactccagaccctcaggctcggcatttgtcgacttgggagcgccgcgtgcgaggggttatccgtggttctccaagccaatcacaatttgcgcgaactggatctgtcatttaacgatctcggagattggggcctttggcttctagccgaaggtcttcaacatcccgcctgcaggctccagaagctgtggctttttggcatggacctaaataaaatgacccactctcgcctggcagctttgcgtgtaactaaaccctacctagacatcggatgctag

SEQ ID NO: 14827 - DNA, 618 bp, Artificial Sequence
  Description of Artificial Sequence: Synthetic coding sequence
atggtcagttcctgctgcggctccgtgtgcagcgaccaaggatgcgggctggagacctgttgtcggccttcgtgctgccaaacaacctgctgtaggacgacatgttgcaggcccagctgttgtgtctccagctgctgtaggccccagtgctgccagagcgtttgctgtcagcccacctgctgtaggccgtcttgttgtccctcttgctgccagactacttgctgtagaaccacatgttgccggcccagttgttgcgtttcttcctgttgtcgacctcagtgctgccaaagcgtgtgttgtcaacctacatgttgcagacctagttgcagcatctctagctgttgtcgcccatcatgttgtgtttctagatgttgccggagccagtgttgccagagtgtgtgttgccagccgacgtgttgccggccctcctgttgtatctcttcctgctgtaggccatcttgctgcgaaagtagttgctgtagaccctgttgctgtcggccctgttgttgcttgcgacctgtctgtggtagagtcagctgccataccacgtgctacaggccaacatgtgtgatttcgacttgcccacgaccgctgtgttgcgcgtccagctgctgctag

SEQ ID NO: 14828 - DNA, 573 bp, Artificial Sequence
  Description of Artificial Sequence: Synthetic coding sequence
atgcagagctgcgagtcctcgggcgatagtgccgatgatcctctgtcgaggggcttgagaagaagaggtcagccacgggtcgtggttatcggcgccggcctcgctgggctggcggcagccaaagccctccttgaacagggttttaccgacgtcacagtactcgaagctagctcgcatataggcgggcgcgtgcaatccgtgaagttgggtcacgccacatttgagcttggtgccacctggatacacggctcccatggaaatcccatctaccacttagccgaggctaacggactgctggaggagacgactgacggcgaacgctccgttggacgcatttccctgtattccaaaaacggagtcgcttgttacctcacaaaccacggcagacgcattcctaaggacgtcgtggaggaattctcagacctgtataatgaaccaatgcaggtgctgtttagtggagaggccacacacaggaagtattacagcactactcacggcgctttgctgagcggacaacgtgaggccgcgagactgattgagatgtaccgagatttgttccagcagggcacgtag

SEQ ID NO: 14829 - DNA, 3945 bp, Artificial Sequence
  Description of Artificial Sequence: Synthetic coding sequence
atggccttgaggcctggggccggttcgggagggggaggggctgcgggagctggggcaggatctgctggcgggggtggctttatgttccccgtagcaggagggatccgtccaccacaggctggcctgatgcctatgcagcagcaaggcttcccaatggtgtccgtgatgcaaccaaatatgcagggaattatgggcatgaactactcgtcccaaatgagccagggtcccatcgctatgcaggccggtatccctatggggcccatgcccgcggcaggtatgccctacctcggacaggccccatttctcggaatgcgcccaccaggtccacagtatactcccgacatgcagaagcagttcgccgaggaacagcagaagcgcttcgaacaacagcagaagcttttagaagaagaacgcaaaaggcggcagttcgaagaacaaaagcagaagctccgcttgctgtcgagtgtgaagcctaagaccggtgagaaatctcgggacgacgcactcgaagctatcaaaggaaaccttgacgggttctcacgggacgctaagatgcatccaaccccagcctcacacccaaaaaagcccgggccatcactcgaagaaaaattcctcgtgtcttgtgacatatcaacaagcggacaggagcagattaagctcaacaccagcgaggttggacataaggccctcggtcctgggtcttctaaaaagtatccttcccttatggctagtaatggggtagctgttgacggatgcgtttccggtactaccactgccgaggcggagaacactagcgatcagaacttatcaatcgaagaaagtggcgttggagtgttcccgtctcaggaccccgcacagcccaggatgcccccatggatctataacgagagcctcgtaccagatgcctacaagaaaatcctcgaaacgaccatgacccctacgggaattgataccgctaagctgtatccgattctcatgtcctcaggactgcccagagaaaccctcggtcagatctgggccctggctaatcggaccacacctggcaaacttaccaaggaggagttgtacaccgtgctggccatgattgccgtgacccaacggggggttcccgctatgagccccgatgcactcaaccagtttcctgccgccccgattccaactctctcagggttctcgatgaccttgcccacacccgtctctcaacctactgtcatcccgtccggcccggctggcagcatgcctctcagcttggggcagccagtgatgggcatcaatctagtcgggcccgtcggcggtgcagccgcccaggccagtagcggctttattcctacatatcctgctaatcaggttgtgaagccagaggaggacgattttcaggacttccaggacgcttccaaatccggctctctcgacgatagttttagcgacttccaggagctgccggccagcagcaagacttccaacagccagcacggaaattctgccccctccctcttaatgcccctgcccgggacaaaggcgttacccagtatggacaaatacgctgtgtttaaggggattgctgccgataaatcttccgaaaatactgttccccccggcgacccaggggacaagtactcagcctttcgggagcttgagcagactgcagaaaataagcctctcggcgaatctttcgcagagtttaggtccgcaggaacagacgatggcttcacagatttcaagacagctgactccgtgagccctctcgagccgcccaccaaggacaagacatttcctcctagctttccttcaggaaccatccagcagaagcagcagacccaggtcaagaatcctctgaatctcgccgatttggacatgttctcaagcgttaactgcagctcggagaaacccctctccttctccgccgtgttctccactagcaagtctgtgagtacacctcagtccactggctccgccgccaccatgacagccctggctgcaacgaaaactagtagtctagccgatgatttcggtgaattcagcttgtttggcgaatactctggattggctccagtcggtgagcaggacgactttgcagactttatggcattttctaactccagtataagcagtgaacaaaagccagacgacaaatacgatgccttgaaggaagaggctagcccagttcccctgacatccaacgtgggaagtaccgtaaaaggggggcagaattctactgccgcatctaccaagtatgacgtgttccgacagcttagtctggaagggtctggcctcggggtcgaagacctcaaggataacacccccagcgggaagtcagatgatgactttgccgacttccattcctcgaagttctcctcaatcaattcggacaagagtctgggggagaaggccgtcgcattcaggcatactaaagaggactctgcttcagtaaagagcctggatcttcccagtatcggcggctcttccgtgggaaaagaagattcggaagacgccctgagtgtgcagttcgacatgaagctggcagatgtggggggcgatcttaagcacgttatgtctgacagttccctcgatttgccaactgtaagtgggcagcacccacctgcggcagacatagaggatctgaaatacgccgctttcgggagctatagctctaacttcgctgtctccactcttacctcttacgactggagtgatagagatgatgccactcaaggtagaaagctgtctccctttgtgctctccgccggctctgggagtccttccgcaactagtatcctacagaaaaaggaaacctctttcggctcctccgagaatatcacgatgacctctctatccaaagtaacaacctttgtgtcggaggacgctctacccgagaccacctttccagctctggcctcatttaaggataccattcctcagacgagcgagcagaaggagtacgaaaatcgggattacaaggacttcactaagcaggatctgcccacagccgagcgaagtcaagaagcaacgtgtcccagtccagcttcttccggagcatcccaagagaccccaaacgaatgcagtgacgactttggtgagtttcaatcagagaaacccaagatcagtaaattcgattttttagtcgctacctcacagagtaaaatgaaatcatccgaggagatgattaagtccgagctcgccacttttgacctgtccgtgcaaggatcacacaaaagaagcctctcactgggggataaggaaatcagccggtcgagtcctagcccagctcttgagcaaccttttcgtgacagaagcaatactcttaacgagaagcctgcactccccgtgattcgggacaaatacaaggacctaactggagaggttgaagaaaatgagcgctacgcttatgagtggcagaggtgtctgggctctgcgctgaacgtcattaagaaagctaatgataccctgaacgggatttcgtcctctagtgtatgtacagaagttattcagagcgcccaggggatggagtatttgttaggcgtggtcgaggtgtaccgggtcaccaagcgtgtggaactgggtataaaagcaaccgcagtctgctcggagaagctgcagcagcttctcaaagacatcgataaggtgtggaataacctgatcgggtttatgagcttggctacacttacccctgacgaaaatagcctggacttctctagctgcatgctgagaccagggatcaagaatgcccaggaactggcttgtggcgtgtgcctgctgaacgtggactctcgtagccgcaaagaggagaagcccgccgaggagcaccccaagaaggcgtttaattcggaaaccgatagttttaagctggcttacggaggccatcagtatcacgctagttgtgctaacttttggattaactgtgttgaaccaaagccgccaggactggtgctgccggatctgctttag

SEQ ID NO: 14830 - DNA, 531 bp, Artificial Sequence
  Description of Artificial Sequence: Synthetic coding sequence
atgtccgatgatgacagtcgagcaagtacctcaagcagctcttccagctcctcaaatcagcagaccgagaaagaaacaaatacacccaagaagaaagagagcaaagtgtcaatgagcaaaaactctaaactgctgtccacatccgccaagtcagccgggccaaagggcgataatatatacgagtggcggtccacaatcctgggaccacccggttccgtgtatgaaggaggcgtgttctttttagatatcactttcaccccagagtacccctttaaaccaccaaaggtaacgtttcggacacgaatctatcactgtaacatcaactctcagggagtcatctgcctggatattctgaaggataattggagccctgctctcaccatcagtaaggtgctgttgagtatttgttctctactgacagactgcaacccagccgatcccttagtggggagcatcgctactcagtatatgaccaatcgtgctgaacatgacaggatggcccgccagtggaccaagaggtacgccacctag

SEQ ID NO: 14831 - DNA, 7029 bp, Artificial Sequence
  Description of Artificial Sequence: Synthetic coding sequence
atggacggggtgagttctgaggcgaatgaggagaacgacaacatagaaagacctgtcagaaggcgccactccagcattctcaagccacccagaagtccactgcaggacctcagaggaggcaacgaaagggtgcaggaatctaatgcactgagaaataagaaaaactctcggcgtgtgtccttcgctgatacaatcaaagtgtttcagacggagtcacatatgaaaattgtgcggaagtcagaaatggagggttgttcagcaatggtgccatcccaactgcaactgctcccccccggattcaagcgcttctcttgtctctctctaccagaaacagaaacgggcgagaacctgctgctcatccagaacaagaagttggaggacaactactgcgagatcactgggatgaacactcttctgagtgctccaatccacacacagatgcaacagaaggagttttctatcatcgagcatactagagagcggaaacacgccaacgatcagaccgtcatcttctctgacgagaatcaaatggatctgactagttcacacactgtgatgattaccaaaggactcctcgacaacccaataagtgaaaaatctaccaagatcgatactaccagtttcctcgcaaatctaaaactgcacacggaggacagtcggatgaagaaagaggttaactttagcgtcgatcaaaacacttcttctgaaaataaaattgattttaatgactttataaaacgactgaaaaccgggaagtgttctgcatttcctgatgttccagataaagaaaactttgaaattcctatatattccaaggagcccaactccgcctcaagcacacaccagatgcatgtgtcacttaaggaggatgagaacaattccaacatcactcggctgttcagagagaaagatgatggtatgaactttacccagtgccacactgcaaacatccagactctgattcccacctcgtcagagacgaacagcagagagtctaaagggaacgacattaccatctatgggaacgacttcatggatctgacattcaaccacacattgcagatcctcccggccaccggaaatttctctgaaattgagaaccagacacagaatgctatggatgtgaccaccggctatggtactaaggcaagtggaaataagaccgtgtttaagagtaaacagaatacggctttccaggatcttagcatcaacagtgcagataaaattcatattacacgaagccacatcatgggggccgagactcatatcgtatcacaaacatgtaaccaggatgcgagaatcctcgcaatgacccccgaaagcatctattccaacccaagtattcagggttgcaaaactgtattctatagctcctgtaacgatgctatggaaatgacaaagtgtctgagtaacatgagagaagagaagaatcttctgaaacatgattcaaactatgcaaagatgtattgcaatcccgacgcgatgtccagcttaacagagaaaacaatatattccggagaggaaaacatggatataactaagtcacacacggtcgccatcgacaaccagatttttaagcaggatcagtccaatgtccagattgcagccgccccaacacctgaaaaggagatgatgttgcagaatctgatgacaaccagcgaagatggaaagatgaatgtgaattgtaatagcgttccccacgtgagcaaagaacgcattcagcaatcgctgtccaatccccttagcatttcgctgacggacaggaagactgagctgcttagcggggaaaatatggacctcactgagagccacacttcgaatctcggcagtcaggttcctctggcggcctataacctggcgcctgagtctacatccgagtctcactcacaaagtaaaagttcttctgatgagtgcgaggagataacaaagagtcggaatgaacctttccaacgttcagatattattgcgaaaaactcactgaccgacacatggaataaagataaggattgggtcctgaagattctgccttatttggacaaagactctccacagagtgccgattgcaaccaagagatagccactagccacaacatcgtgtattgtggcggcgtgctggacaagcagatcactaataggaacactgtcagctgggagcagtcactgttttcaactacgaaacctttattcagctctggccagttctcaatgaagaatcatgatactgcaatcagctcccacactgtgaaaagcgtacttggacagaattctaagctggccgagcccctccgaaagagtctgagtaacccgacccctgactattgtcatgacaagatgataatctgttccgaggaggagcagaacatggacttgacgaaatctcatacagttgtaattggcttcggaccttccgagctgcaagaactggggaagactaatctagaacacacaaccggtcagctgaccactatgaacagacagatcgccgttaaagttgagaaatgcggaaagtcaccaatagagaagtcgggtgtcctgaagtccaactgcataatggacgtgttagaggacgagtcagtccagaaacccaagttcccaaaggagaagcaaaatgtcaagatctgggggcgcaagtctgtcggggggcccaagatagacaagaccattgttttctcagaagacgacaagaatgacatggatatcacaaagagttacaccatcgaaatcaaccaccgcccactcttggaaaagagggactgccacctagtccctctggccggtacatccgagacaattctttacacttgtaggcaggatgacatggagataacaagatctcatactactgcactagaatgtaagaccgtgtctcccgatgagatcacgacaaggccaatggacaaaactgtcgttttcgtagacaatcacgtggaattagagatgacagagagccacaccgtgtttatcgattatcaggagaaggagcgcactgaccgtccaaactttgagctttctcagcgcaagtccctcgggacacccactgttatttgcacccctaccgaagaatcagttttcttcccaggaaacggggagtccgatagacttgtggctaatgatagtcaattgacacccctggaagaatggtcaaataaccgagggcccgtagaagtggcagataatatggaactgtccaaatcagcaacatgcaagaacattaaggacgtccagtcacctggttttctcaatgagcccctttcttcaaagtcgcagcggagaaagagccttaaacttaagaatgataaaaccatcgtgtttagtgagaaccataaaaatgacatggatatcacacagtcttgcatggtggagattgataacgagtcagcactcgaagataaggaggattttcatctggccggtgcatccaagactatcctctactcatgtggccaggacgatatggaaattacccgatcccacaccactgctctcgaatgcaaaactctactgccaaatgaaattgcaatccggcccatggataagactgtgctgttcacagacaattatagcgatctggaagttaccgacagtcatacagtgtttattgattgtcaagcaaccgagaagattctggaagaaaaccccaagttcgggatcggcaaggggaagaatctgggcgtctctttccctaaggacaatagctgtgtgcaggagatcgcggagaagcaggccctcgcagtgggaaataagattgtattacacacagaacagaaacagcagcttttcgctgctacgaataggaccaccaacgagattatcaaattccactctgccgcgatggacgagaaggtcattggcaaagtggtcgaccaggcgtgcaccttagagaaagctcaggtagagtcctgtcaacttaacaatagagaccgtcggaacgtggacttcacttcttctcacgccaccgcagtctgcggatcaagcgataactacagctgcctaccgaatgtcatttcctgtacagataatttagaggggtctgcaatgctactgtgcgataaggacgaagagaaggctaactactgcccagtccagaacgacctagcttatgcaaatgatttcgcaagcgagtattacctggaatctgagggccagccgctcagtgcgccttgtccactactcgagaaggaggaggtcatacagacttcgactaaggggcagctcgactgcgttatcaccctgcacaaggatcaggacctcatcaaagaccctaggaatctactggctaaccagaccctcgtgtacagccaggacctgggagagatgaccaaactaaacagtaagagagtgagcttcaaactccctaaagaccaaatgaaggtgtatgtggatgatatttacgttatcccccaacctcatttttcaaccgaccaaccaccccttcctaagaaagggcagtctagcatcaataaagaagaagttattctgtctaaggccgggaacaagagtttgaatatcatcgagaattcaagtgcgcctatctgtgagaacaagccaaagatcctgaacagcgaagaatggtttgccgccgcctgtaaaaaggaattgaaagagaacatccagacaactaactataacactgccctggacttccatagcaattcagacgtgaccaaacaggtcattcagacccatgtgaatgctggcgaggcccccgacccagtgatcacgagcaacgttccttgttttcactccattaagcccaatctgaataatttgaatggaaaaacaggcgagtttctggctttccagaccgtgcacctccccccacttcccgaacagctgctggagcttgggaacaaggctcataacgatatgcatatcgtccaggccaccgagatccataacatcaatattattagtagcaatgcgaaagattctagagatgaggagaataagaaaagccacaatggcgcggaaacaaccagcttacccccaaaaacagtgttcaaggataaagtccggagatgttcgcttggaattttcctgcctagactgcccaacaaaaggaactgttccgtaacaggaattgacgatctcgagcagatacccgccgacacaacggatataaaccacttggaaacccagccggtgagctcaaaggattccggtattggttccgtggccggaaagctcaatctatccccctcccagtacatcaatgaggagaatttaccagtgtaccccgacgagatcaactcttctgactctataaacattgagaccgaagagaaggctctgatcgaaacttaccagaaggaaatatcgccctacgaaaacaagatggggaaaacctgtaattcccaaaagcggacctgggtccaagaagaggaagatattcataaagagaagaaaatccgcaaaaacgaaatcaaatttagcgacactacacaagatcgagagattttcgaccaccacacagaagaggacattgacaaatcggcaaattccgtgctaataaaaaatctgtcccgcacgccatctagttgcagtagtagccttgatagtattaaagcggacggcacatccctggatttcagtacctacagaagctcccaaatggaatcacagtttctgagagacactatatgtgaggaaagtctccgggagaagctgcaagacggccgcatcactatccgggagttctttattctcctgcaagtgcacatcctcatacagaaacctcgtcagtctaacctgcccggaaatttcaccgtaaataccccccccacccctgaagatctgatgctgtcccaatacgtctatcgtccaaaaattcagatttatagggaggactgtgaagcccgcaggcaaaagatcgaagaactcaaactctccgcttctaaccaggataagctactggtagatattaataagaatctatgggagaaaatgagacattgttctgataaagaactcaaagccttcgggatttatcttaataaaattaagagttgcttcaccaaaatgacgaaagtgttcacccatcagggaaaagtagccctttacggcaagttggtccagagtgctcagaatgagcgggaaaaactccagattaagatcgatgagatggacaagatccttaaaaaaattgataattgcctgactgaaatggagacagaaacgaagaatcttgaggacgaagaaaagaacaaccctgtcgaggagtgggattctgagatgcgggctgcagaaaaggagttggaacagttaaagacggaagaagaggagctccagaggaacctgctggagctggaggtccagaaagaacagaccctcgctcagatagattttatgcagaaacagcgcaaccgcaccgaggagctgctcgatcagctgtccctgtcggagtgggacgttgttgaatggtccgacgaccaagccgtgttcacttttgtgtacgacaccattcagctgaccattacctttgaggaatctgtggtgggtttcccctttctggacaaacgctaccgcaaaatcgttgatgtcaacttccagagtctgttggatgaagatcaggctcctccatcttctctgctggtgcacaaactgattttccagtacgtggaggagaaagaatcatggaaaaaaacctgtacaacccaacatcagctcccaaagatgctggaggaattcagtctagtggtgcaccattgccgcctcctcggagaggaaatcgagtacctaaagcgttggggtcccaactataacctgatgaatatcgatattaataacaacgagttgagactcctgttctcatcaagtgcagcttttgccaagtttgaaattaccttgttcctgagtgcctactacccaagtgtgccacttccttcaacaattcaaaatcacgtcggcaatacatctcaggatgacattgcgaccattctatctaaagtccccctggagaacaactacctgaagaacgttgtcaagcagatttatcaggatctctttcaggactgccatttctaccactag

SEQ ID NO: 14832 - DNA, 1638 bp, Artificial Sequence
  Description of Artificial Sequence: Synthetic coding sequence
atgtcaagctgtgtgagctcacagccttctagtaatagggccgctccacaggacgaactcggaggtcggggcagctcaagctctgagagccagaagccttgcgaagcactgcgcgggctgagtagtctatctatccacttgggcatggagagttttatagttgttaccgagtgtgagccaggttgcgccgtcgacctggggttggctcgggatcgacccctcgaagctgatggccaggaagtacccctggacacaagcggttctcaggctagaccccacctgtcaggcaggaaactgtcattgcaggaacgatctcagggcggacttgctgcgggtgggagcctggatatgaacggaagatgcatttgtccctcacttccctactccccagtaagcagccctcaatcttccccgcgattaccacgaaggcccacagtagagtcccaccacgtcagtattactggaatgcaggattgtgtgcagcttaaccagtacactctgaaggatgagattggcaagggcagctacggggtggtaaaactggcctataatgagaatgataacacctattatgcaatgaaagtgctgagcaagaagaagctgatcaggcaggccggatttcctagacgccctccgcctaggggtacacgtccggctccggggggctgcattcagccacgcggcccaatcgaacaggtctatcaggagatagccatcctgaagaagttagaccatccaaatgtagttaagttggtcgaagtgctggacgaccctaatgaagatcatctctacatggtattcgagttggtgaatcagggacccgttatggaggtgccaaccctgaagcctctgagcgaggaccaggcccggttctactttcaggacttaatcaagggaatagagtatctgcattatcagaagattatccaccgcgatattaagccttccaaccttctggtgggggaggatggacatatcaaaattgccgatttcggggtaagcaacgaatttaaaggctctgacgctctgctgtccaataccgtgggcactccagcctttatggccccagagtctctgtccgagacccggaaaatcttttccgggaaggctcttgatgtttgggccatgggtgttactctatactgttttgtgtttggacagtgtcccttcatggatgaaagaatcatgtgcttgcactcgaagataaagtctcaggccctggaatttccagatcagccggatatcgctgaggatctcaaggatctgatcacccgcatgctggacaagaaccccgagtcccggattgtcgtgccagagataaaaatactggtgaaaacaatgatccgaaagaggagcttcggaaacccttttgagggatcaaggagggaggagcgatcactgtcggcgcctggaaacctgctgacgaaaaaaccaacccgcgagtgtgaatccttgtcggagctcaaggaggcccggcagcggaggcaaccgccaggtcataggccggcaccccgcggcgggggtggtagcgcacttgtaagggggtctccgtgtgtagaatcttgctgggctcccgcacctgggtctcccgcgaggatgcaccctctccgacctgaggaggcaatggagccagaatag

SEQ ID NO: 14833 - DNA, 333 bp, Artificial Sequence
  Description of Artificial Sequence: Synthetic coding sequence
atgcccaagcggtcctgccctttcgcagatgtggcccctcttcagctcaaggtccgagtgagtcagcgtgagctgtctcgaggagtgtgcgccgagagatacagccaggaggtgttcgatccctctggtgtcgcttctatcgcatgctcttcatgcgtacgggctgtcgacggcaaggccgtgtgtggccaatgcgagagagccctctgtggccagtgcgtcaggacctgttggggctgcggttccgtcgcttgcaccctatgcggtttggtggactgctccgacatgtacgagaaggttctgtgtactagttgtgcgatgttcgagacctag

SEQ ID NO: 14834 - DNA, 2253 bp, Artificial Sequence
  Description of Artificial Sequence: Synthetic coding sequence
atggaagacctgttcgagacatttcaagacgagatgggcttttcaaacatggaggacgacggtcctgaggaagaggagcgcgtcgcagaaccacaggctaacttcaatactccccaggctctgaggttcgaggagctgctggccaacctgctaaatgagcagcatcagatcgcgaaagagctgttcgaacagctcaaaatgaagaagccttccgccaagcagcagaaagaggtcgaaaaagtgaaaccgcaatgcaaggaggtgcaccaaaccctgattctggaccctgcccagaggaagcggttacagcagcaaatgcagcagcacgtgcaattgctaactcagatccatctactcgctacatgcaatcccaacctcaatcctgaggcgagcagcactagaatttgtctgaaagaattgggaacttttgcccagagctccatagctctgcatcatcagtataacccaaagttccagacccttttccagccttgcaacctaatgggggccatgcagctgattgaggatttcagcacacacgtctcaattgactgcagtccacataaaaccgtgaagaagactgccaatgagttcccttgtctgccgaagcaagtggcctggatcctggcaacttcaaaggtttttatgtatcctgaactgttaccggtgtgtagtctgaaagctaagaacccgcaggataagatcttgttcaccaaggccgaagacaacttgctggctttggggctcaagcatttcgagggaacagaatttttaaacccactgatctctaagtacctgctgacgtgcaaaacagccagacagctgacagttagaattaagaatctgaacatgaatagggctccagacaacatcattaaattttataagaaaactaagcagctgcccgttctaggcaagtgttgcgaggaaatccagccccaccagtggaaaccacccatcgaacgggaggaacacagacttccattttggctcaaagcttccctgccttctatccaagaggagctgcggcatatggcagatggagcaagggaggtcggaaatatgactgggacaaccgagatcaactcagatcagggactagaaaaggacaactccgaactggggtctgaaacgcgatacccactgctgctcccaaagggggtcgtactgaaattgaaacctgtcgcagaccgcttccccaagaaggcctggcggcagaagcgatcttcagtgctcaagccactcctaattcagcccagcccctcacttcagcccagcttcaatcctggcaaaactcccgcccagtccacacatagcgaagcacccccatcgaagatggtgctgcgcatccctcaccctatccagccagccactgtattgcagactgttcccggcgtaccacctttgggcgtgtcaggcggagaatcattcgagagccccgcagccctcccagctatgccgccagaggcccgcacctcgttcccgctgagtgagtcacaaacactgctgagctcggcccctgttccaaaagttatgatgccctcccccgccagttccatgttccggaaaccttacgtccgcaggcggccgtcaaaacgtaggggcgcaagagcatttagatgtatcaagcccgctcccgtcatacatcccgcttccgtgatcttcactgtgccagctacaacagtgaagatagtgtctcttggcggaggctgtaatatgatccagccagtcaatgcggccgtagcccaatcacctcaaaccatcccgatcgccacactcctggtgaacccaacttcttttccttgtcccctgaatcaacccctggtggccagttctgtcagccccttgattgtcagcggcaatagtgtgaatctgcccatccccagcacccccgaagacaaagcacatatgaacgtcgatattgcttgcgctgtggcggacggcgaaaacgcattccagggtctcgagccaaagcttgaaccacaggagctgtctcctcttagcgccaccgtgttcccaaaagtggaacacagtccaggccccccacctgtcgataagcagtgtcaggaaggtctaagtgaaaactccgcttatcgctggacagttgtgaagaccgaggaagggcggcaggctctggagccccttccccaaggcattcaggagagccttaacaactcgtcgcctggcgatctggaagaggttgtaaagatggaacccgaggacgccactgaggagatctcaggttttctttag

SEQ ID NO: 14835 - DNA, 2604 bp, Artificial Sequence
  Description of Artificial Sequence: Synthetic coding sequence
atgcaggccgaagcagcggactggttcagcagtatgccgttccagaagcatgtgtattatccattagcctcagggcccgagggtccggacgttgccgtggctgcggccgccgccggtgctgcctccatggcctgcgctcctccctcagccgctagcggtcccctccctttcttccagttccggcccaggttggagtccgttgattggcgccggttaagtgcaatcgacgtcgataaggtggcaggcgcggtggatgtccttactcttcaagaaaacatcatgaacatcaccttctgcaaactagaggacgaaaaatgccctcattgtcagtcaggcgtggatcctgtgcttttaaaactaatacggcttgcccagtttaccatcgagtatttactgcattcacaggagtttctcacctctcagttacacacactggaggaaagactgaggttatcacactgtgacggagaacaaagcaaaaagctgctcacaaagcaagcaggggagattaagaccctgaaggaggagtgcaagcgaagaaagaagatgattagcactcagcagttaatgatcgaggcgaaagccaattactaccagtgtcacttctgcgataaagcttttatgaaccaggcattcctccaatcacacatccaaagacgtcacaccgaggagaactctcactttgaatatcagaagaacgcacaaatcgagaagcttcgatccgagatcgtcgtgctgaaggaggaattacagctgaccagaagcgaactagaggctgcccatcatgcatcggcagtccggttctccaaagagtatgagatgcaaaagacaaaagaagaagattttctaaaactttttgaccggtggaaagaagaggaaaaggaaaagctggtggacgagatggagaaagtgaaagaaatgtttatgaaggagtttaaagaactgacttcgaaaaactctgctctggaatatcagctttcagaaatccagaagtctaacatgcagattaaatccaacatcggtactctgaaagatgctcacgaatttaaggaagatcgttcaccctacccgcaggatttccacaatgtgatgcagctgttggactcccaggaatcgaaatggacagcgcgcgtgcaggccatccatcaggaacataagaaagaaaaaggtcgcctgctctcccatattgagaagctgagaaccagcatgatagacgacttgaacgcctccaatgtgttctacaagaaacgtattgaggaactcgggcagcgcctgcaggagcaaaacgagttgatcatcacccagcgacagcagattaaagattttacctgcaaccccctcaatagtatctccgaaccgaaggggaatccattggcttggcaggcctttgagtcccaacctgctgctcccgccgtccctatgaacgctcccgcgctccatacactggagactaaatcatccttgccaatggtgcacgagcaggcgttcagttctcacattttggaaccaattgaggagctatctgaagaggaaaaaggccgcgaaaatgaacagaagctcaataacaacaagatgcatcttaggaaagctctgaagtccaattcctctctgaccaagggcctgcgcacgatggtggaacagaatctgatggagaaactcgagacactcgggataaatgctgatatccgcggcatatcaagtgaccaactgcatagggtgctgaagagtgtggagtccgaacggcacaaacaggagagagaaatccctaatttccatcaaatacgcgagttcctagagcaccaggtcagctgcaaaatcgaggagaaagccctcttgagttccgaccaatgttcggtgagccaaatggacactctctcaacgggagaagtcccaaagatgattcaactgccatcaaagaatcgccagctcatccgccagaaggccgtctccactgacagaacatctgtgcccaagataaaaaagaacgtaatggaggatcccttcccaagaaaatcctccaccattaccacacccccctttagctctgaggaagaacaagaggatgatgatcttattagggcatacgcaagccctggcccactgccagtgccacccccacagaataagggaagctttggtaagaacacggtgaagtccgatgccgacggaacagaagggagtgaaattgaggatacagatgactctcctaaacctgccggggtggctgtcaaaactcccactgagaaggtggagaaaatgttcccccatcgtaagaacgtgaacaaaccagttgggggaactaatgtccccgaaatgttcatcaaaaaagaagagcttcaggaactgaagtgcgcagacgtggaagacgaagattgggacatctcttccttagaggaggaaatttctctcggaaagaaatccgggaaggagcagaaggaacctccccccgccaaaaacgaaccccacttcgcccatgtgctgaatgcgtggggagctttcaacccgaaggggcctaagggcgaggggctccaggaaaacgagagcagtaccctgaaatcctcgttggttaccgtgaccgactggtccgacacaagcgacgtttag

SEQ ID NO: 14836 - DNA, 1860 bp, Artificial Sequence
  Description of Artificial Sequence: Synthetic coding sequence
atgtcagggctcgtcctaggtcaaagagatgagcctgctggccacaggttgtctcaggaggaaattcttggcagcactagattggtgtcccagggcttggaggctctgaggtctgaacaccaggctgtcctgcagtcgctaagccagactatcgaatgtttacaacagggaggccacgaggagggcctggtgcacgagaaagcaagacagctgaggcgttctatggagaatattgagcttggcctgagcgaggctcaagttatgcttgctctggcgagccacctcagcacagtagagtcagaaaaacagaagcttagagcccaagtgcggcggctttgtcaagaaaatcagtggctgcgagatgaactggcggggacccagcagcgccttcagcggtctgaacaggccgtggcgcagctcgaggaggagaaaaaacatcttgaatttttgggccagttgagacagtacgacgaagatggacacacatccgaggagaaggaaggcgatgcgacgaaggattcattggacgatttattcccaaacgaggaagaggaggacccttcgaatgggctttccagagggcagggcgctaccgcagctcagcagggcggatatgagattccagcaaggctgcgtactctgcataaccttgtgatacaatacgcagcacagggccgatacgaagtagcagtgcccctatgcaagcaggcactggaagaccttgagagaacgtccgggagaggacaccccgacgtagccacaatgctcaacatactcgcacttgtgtatcgtgatcagaacaagtataaggaagccgcacatctgcttaatgacgcgctcagcatacgcgagtctacacttggcccagaccaccccgcagtcgcagcaaccctgaataatctcgctgtgttatatggaaaaagaggcaagtacaaggaggcagagcccctgtgtcaacgcgctttggaaattcgtgagaaagtgttaggaacaaatcaccccgacgtggccaaacagctgaataatcttgcacttctctgccagaatcagggcaagtatgaagccgtggaacgttactatcaaagggctctagcgatctacgaaggccagctgggccccgataatcctaatgtggctcggactaagaacaatttggcgagttgttaccttaaacagggtaagtatgctgaggctgagacgctctacaaggaaatcctcacgcgggcccatgtgcaggagttcggatccgtcgatgatgaccacaagcctatctggatgcacgccgaagagcgcgaggaaatgagcaaaagccgccaccatgaaggcggaaccccttacgcggagtatggcggatggtataaagcctgcaaagtgagcagcccgacagtcaataccactctgagaaacctgggagccctctaccgcagacagggcaagcttgaggcggccgaaacactggaggagtgtgcgctgcggagcaggagacaaggaaccgatccaatttctcagacgaaggtcgctgagctgctgggtgaatctgacggtaggcggacttcccaagaaggtccaggagactccgtcaaatttgagggcggcgaagatgctagtgttgcggtcgagtggtctggcgatggaagtgggacccttcagagaagcggatccctaggcaagatacgagacgtgttgaggcgctcctccgagctgctagtcagaaaattacaggggacggaaccaagaccctcttcaagcaatatgaagcgcgctgcaagcctgaattatctgaatcagccttcagccgctcccctgcaagtgtcaagggggctgtcagccagcactatggacctctcttccagctcttag

SEQ ID NO: 14837 - DNA, 1137 bp, Artificial Sequence
  Description of Artificial Sequence: Synthetic coding sequence
atgaaggagcagttacccgacctccactctcatttcagcgatcttaatttggaagctcacatgtacgcatcccagtggttcttaactctgtttactgccaagttccccctttgtatggttttccatatcatcgatctcctgctatgcgagggcttgaacatcatctttcacgtcgcgttggcattactgaaaacatctaaagaagacctgctgcaggccgactttgagggggcgcttaaattttttagagtgcagctccccaaacgctatcgggccgaggagaacgctcgtagactcatggagcaggcctgcaatatcaaggtgcctaccaaaaaactgaagaagtatgagaaggagtaccagactatgagggagagccagttacagcaggaagatcctatggacagatataagcgagaaaaccgccggttacaggaggctagtatgcgactggagcaagagaacgacgacttggcacacgagctagtcacctcaaaaatcgctttaagaaatgacctggaccaggcagaggacaaggcagatgtgcttaacaaggagctgctgctcacgaagcaacggctggtcgagacagaggaggagaagcgcaagcaggaggaggaaacagcccagttaaaagaggtgttcagaaagcagctggagaaggcagagtacgagatcaagaaaacaaccgcgatcatcgctgaatataagcagatttgtagccaactgagtactcgcttggaaaagcagcaggcggcatctaaggaggagctggaagtggtaaagggaaaaatgatggcctgcaagcattgttccgacatattttccaaagagggcgctctaaagcttgccgccactgggcgcgaggaccaagggattgaaaccgacgatgagaaggacagcctaaaaaagcagctcagagagatggaactggagcttgctcagaccaaacttcagctggtcgaagcaaagtgtaagattcaggaactcgaacaccaacgcggtgcgttaatgaacgaaatccaggctgccaagaattcctggttctctaagacactgaacagtatcaagacagctactgggacccagcctctgcaaccagcacccgttactcaacctcctaaggagtctacttag

SEQ ID NO: 14838 - DNA, 2631 bp, Artificial Sequence
  Description of Artificial Sequence: Synthetic coding sequence
atgggggattccgatgacgaatacgatcggcgacgccgcgacaagttccgaagggagcggtcggattatgacaggagtcgcgagcgggatgagagaagacggggcgacgattggaacgatcgggagtgggaccgagggagggaaaggcgcagcagaggagaataccgggactacgatagaaatagaagagaacggttctcaccacctcgccacgagctgagtccaccccagaagcgtatgcggcgcgactgggacgagcattcgagcgatccgtaccactcgggctatgagatgccctacgccgggggtggcgggggccccacttacggacccccccagccctgggggcaccctgacgttcatatcatgcagcatcatgtgttgccaatacaggcccgccttgggagcatagccgagatagatctcggggtgccaccgcccgttatgaaaacatttaaggaatttctcctatccctggacgactcagtggatgaaacggaggctgtaaagaggtacaacgattataagctagattttagaaggcaacagatgcaggatttcttcttagctcataaagacgaggagtggtttcgcagcaagtatcaccctgatgaagtgggcaaacggagacaggaggcccgcggggcgctgcagaatagactgagggtgtttctgagtctgatggaaacgggctggttcgataacctgttgttagatatcgacaaagcagatgccattgtaaagatgcttgatgcagccgtaatcaaaatggagggcggaaccgaaaatgacttgcggatccttgagcaggaggaggaagaggagcaggctggcaaaccaggagaaccaagcaaaaaagaagaggggcgcgcaggggcaggcttgggagacggggagagaaaaactaacgataaggacgaaaagaaggaggacggcaagcaagctgagaacgactctagtaatgatgacaaaacaaagaagagcgagggcgacggtgataaagaagagaagaaagaagattccgagaaagaggccaaaaagagcagcaagaaaagaaaccggaagcacagtggagacgattctttcgatgaaggttccgtgagtgaatccgaatctgagtccgagtctggccaggcagaggaagaaaaagaggaggctgaggaggcccttaaagaaaaggagaagccgaaagaagaagagtgggaaaaacccaaggacgcggctggcctggaatgtaagccccgcccattgcataagacctgctccctctttatgcggaacatcgcgccaaatatctccagggctgaaattatctctctgtgtaagagataccccggttttatgagggtggcattgagtgaacctcagccagagagacgcttttttcgtaggggatgggtgacctttgacaggtccgtcaatataaaggagatatgctggaatctccaaaacattcgactccgggaatgcgaactctcaccaggcgtgaatagagacctcactcgaagggtccgcaatatcaacggcattacccagcataagcagatcgtgagaaatgatatcaagctggccgcgaaacttatccacacattggatgaccgcacgcagctgtgggcgagtgaacccggcaccccccctctgcctacgagcctgccaagtcaaaaccctatcctcaaaaacatcaccgactatctgattgaagaggttagcgcggaggaagaggagctgctgggttcttcaggcggcgcaccaccagaggagcctcccaaggaaggtaacccagcagagatcaacgtggaacgcgatgagaaactcattaaagtcctggataagcttctgctgtatctccggattgtgcatagccttgactattacaatacatgcgagtatcccaatgaggatgagatgcctaatcggtgcgggattatacatgttcggggacccatgcccccaaatcggatttcccatggggaggtgctcgaatggcagaagacgtttgaggagaagctgacacccctcctgagcgtacgggagagcttgagtgaggaggaggcccaaaagatgggaaggaaggatcccgagcaagaggtagaaaagtttgttacgtcaaatactcaggagcttgggaaagataaatggttatgcccactgtcaggcaagaaatttaaagggcccgaatttgtacgcaaacacatctttaataagcatgccgaaaagatcgaagaagtcaaaaaagaggtcgccttcttcaataacttcctcactgatgccaaacggccggcactgccagagatcaagcctgcacaaccccccgggcccgctcaaattctccccccaggcctgacacccgggctgccctatcctcaccagaccccccagggcctgatgccctatggacagccccgtccccccatcctaggatatggtgcgggtgccgttagaccggctgtacccaccggtggccctccttacccacacgcaccctatggggcagggcgcggtaattatgatgcctttaggggacagggcgggtatcctgggaaacctaggaacaggatggtgagaggcgaccctcgggccattgtggagtacagggatttagatgcccccgatgacgtggacttcttttag

SEQ ID NO: 14839 - DNA, 1491 bp, Artificial Sequence
  Description of Artificial Sequence: Synthetic coding sequence
atgaagctaggcaagaagccgatgtacaagccggtggacccgtactcacgtatgcaatcgacctataactacaacatgcgggggggcgcataccccccacgctacttctacccttttcctgtcccacctctcttgtaccaggtcgaattatccgtgggggggcaacagttcaatggtaaaggcaagacccgccaggctgctaagcatgatgcagctgctaaggcattaaggattctgcagaacgagcccttgcctgaacgccttgaagttaacggccgcgaaagcgaggaggagaacctgaacaagagcgagatctcccaggtcttcgaaatcgctctgaaacgcaacctgccggtcaattttgaagtggccagagagagcggcccgccgcacatgaagaatttcgtcactaaagtctccgtcggcgaattcgtgggagaaggggagggcaaaagcaaaaaaatttcaaagaaaaatgccgccatcgccgttttggaagaactgaagaagctccctcccttgccagctgtggaaagggtcaagccaaggattaaaaagaagacaaaaccaattgttaagcctcaaacctctcctgagtacgggcagggcattaaccctatttcaaggttagctcagatccagcaggctaaaaaggagaaggagcctgagtacacgttactcacagaaaggggtctgccccgcagacgtgaatttgtgatgcaggtaaaggtcggaaaccacacggctgagggaactggcacaaacaaaaaggtggcaaagagaaatgcagctgagaatatgctggagattctgggattcaaggtgcctcaggcccagccaaccaaacctgccctgaaatccgaagagaagactcctatcaaaaagccgggggacggtcggaaagtcactttttttgagccagggtccggcgacgagaacggaacatctaataaagaagacgagttcaggatgccctacctgtctcatcagcagctaccagctggtatactgccaatggtcccagaggttgcccaagctgtaggagtgtcccagggacatcatacgaaggacttcaccagggcagcaccaaacccagctaaagctaccgtcacagcaatgatcgccagggagctgctttacggagggacgtcacctactgctgaaactatacttaagaataatataagctctgggcacgtgccacacggcccgctgacaaggccgtctgagcaactggactacctctcaagggtccagggcttccaagtcgagtataaggatttccccaagaacaacaaaaatgagtttgtatcactgatcaattgctcctcgcagccccccttaattagccacgggattggcaaggacgtggagagttgtcatgacatggctgcactgaacatactgaagttactctcagaactggaccaacagtcgacagaaatgcctaggactggcaatggcccgatgagcgtgtgcgggagatgttag

SEQ ID NO: 14840 - DNA, 318 bp, Artificial Sequence
  Description of Artificial Sequence: Synthetic coding sequence
atggcgctgaggtatccaatggccgttggcctgaataagggtcacaaagtcaccaagaatgtgtccaaaccccgacatagccggcgtaggggccgcctgactaaacacacgaaattcgtacgcgacatgatcagggaagtctgcggatttgctccctacgagcggcgtgcaatggaacttttaaaagtctccaaggataagagagcactgaaattcattaaaaagcgggtgggcacccacatcagagctaagaggaaacgagaagagttgtcaaatgtgctcgctgcaatgaggaaggcagcggccaaaaaggactag

SEQ ID NO: 14841 - DNA, 3720 bp, Artificial Sequence
  Description of Artificial Sequence: Synthetic coding sequence
atggctaacgatagtccggccaagagcctggtcgacatcgacttatcttccctgagggatccagccggcatcttcgaattagtggaagtggtggggaacgggacttatgggcaggtctataagggccggcacgtcaagacgggtcagctggccgccataaaggtgatggacgtgacggaggacgaggaagaagaaatcaaactcgaaatcaacatgttgaagaagtatagccatcacagaaacatcgcaacctattacggcgcgttcatcaagaaatctcctcctggccatgacgaccagctgtggctggtgatggagttctgcggtgccggctctatcacggacctggttaaaaatactaagggtaatactctcaaggaagattggatcgcctatatcagccgcgagattctgcgtgggcttgcccatctgcatatccaccacgttatccacagggacatcaaaggacagaacgtcctcttgaccgaaaatgcagaagtgaagttagtggactttggggtgtctgcacagctcgatcggacagtgggtaggagaaatacattcatcggcaccccatattggatggcaccagaggttatcgcttgcgacgagaacccagacgctacttatgattataggtccgatctttggagctgcgggatcaccgccatcgagatggcagagggtgccccgccactctgcgacatgcaccctatgagggcgctgttcctcattcccagaaatccccccccaaggctgaaatccaaaaagtggagcaagaagttcttctcctttatcgaaggctgtttggtcaagaactacatgcagcgtccatccactgagcaactgctcaagcacccttttattagagatcagccaaacgagaggcaggtccgcatacagctgaaggaccacatcgataggacaaggaagaaacgcggggagaaagatgagacagaatacgagtattcaggctccgaagaggaagaggaagaggtccccgagcaggagggggaaccctcatcaatcgtgaacgtgccaggggaatctacattaagacgggacttcctgagacttcagcaggaaaacaaagaaaggtcagaagcactgagaaggcagcagctgctacaggagcaacaactcagggagcaagaggaatacaagcgtcaactgctggcagagaggcagaagcgtatcgaacagcagaaagagcagagacggaggctcgaggagcagcagcgtagagagcgagaggctcgaaggcagcaggagagggaacagcgtagaagagaacaggaagagaaacggaggttggaggaactggaaagacggcgaaaagaagaggaggagaggaggagagcggaagaggagaaacgcagagttgagcgagagcaggagtacatccggcgacagcttgaagaggagcaaagacacctggaggtccttcagcagcagctgctccaggagcaggccatgctgttggaatgcaggtggagggaaatggaggaacacaggcaggcagagaggttgcagcgccagcttcaacaggaacaagcctatctcctgagcctacagcacgatcacaggcgcccccaccctcagcattcacagcagcctcccccaccccagcaggagagatccaagccctcattccatgccccagaaccgaaggctcactacgagcccgcagaccgagcccgcgaagtcgaagaccggtttcgcaagaccaaccactccagcccagaagctcaaagcaaacagactggaagggtgcttgagcctcccgtcccatcacggagtgaatctttctccaatgggaattccgaaagtgtacatcccgcccttcagagacctgctgagccacaagtgcctgtgaggaccacatcccgctcaccagtcctctctagacgagactctcctctgcaggggagtggtcagcagaacagccaggctggccagagaaattccactagtatagagccgcggttactctgggagagggtggagaaactggttccccgcccgggctccggttcatcatcgggtagctccaactccggttcacaaccgggaagtcatcccggcagtcagtccggctctggcgaaaggtttagagtgagatccagcagtaagagcgaggggtctccaagtcaacggctggaaaacgccgtaaaaaaaccggaagacaaaaaagaagtgttccgtcccctgaaaccggcagatctgacagcattagctaaagagctacgcgccgtcgaggatgtgcggccccctcacaaggtgactgattatagcagttcttcagaagaatccggcaccactgacgaggaggacgatgacgtggagcaggaaggggccgatgagtcaacctccggccccgaggacacccgcgctgcctcaagcctcaatctgtccaatggtgagacagaatccgtgaagaccatgattgttcacgacgatgtggagtcggaacccgccatgaccccttcaaaggaagggactttaatagtcaggcagacacagtcagctagttcaaccctccaaaagcataaatcctcctcgtccttcacaccatttattgacccgaggttgctgcagatctcccctagcagcggcactaccgtgactagtgtagtggggttctcctgcgatggcatgaggccagaagcaataaggcaagatccaaccagaaaaggctcagttgtgaatgtgaatccgaccaacacgaggccccagtcagacacaccggaaatacgtaagtacaagaagagatttaactctgagatactgtgtgctgccctgtggggtgtcaatcttctggtgggaacagagtccggcctaatgctgcttgatcgcagcggccaaggtaaggtttacccactgatcaaccggcgcaggtttcaacaaatggatgttttggaagggctgaacgtgctggtaaccataagtgggaagaaggataaactcagagtctactatttgagttggctcaggaacaagatattgcacaatgatcccgaggtggagaaaaagcaaggctggacgactgtgggggacctggaaggttgcgtccactataaggtggtgaaatatgagcggatcaagtttttggttattgcgctgaagtcgtccgtggaggtatatgcctgggctccaaagccctatcacaagtttatggctttcaaaagcttcggtgaactggtccacaagccactgctggtggatctgacagttgaggaagggcagcgtcttaaagtgatttacgggagttgcgcagggtttcatgcagtggacgtagatagtggttccgtatatgatatatatctgccaacgcatattcagtgttccattaaaccacacgctatcatcattcttccgaatactgacggcatggaattacttgtgtgttacgaagatgagggggtgtacgtgaacacctacggcaggatcaccaaagatgtcgtgcttcagtggggggaaatgcctacatcagtggcctacatccgttccaaccagaccatgggttggggtgagaaggccattgaaatcagatcagttgagactggtcatttggacggcgtgttcatgcacaagcgggctcagaggctgaaatttctgtgcgaacggaatgataaggttttttttgccagtgtgcgttcaggtggcagcagtcaggtatactttatgacattggggcggaccagcctcttgtcctggtag

SEQ ID NO: 14842 - DNA, 2847 bp, Artificial Sequence
  Description of Artificial Sequence: Synthetic coding sequence
atgtacggatcagcaaggtcagtgggaaaggtggagccctcatctcagagcccaggtcgatcacctaggctacccagaagccctagactggggcacagaagaactaactccacaggaggatcctccggatcctccgtcggtggtggaagcggaaagacacttagtatggagaacattcagagcttaaatgctgcttacgcaacgagcggccctatgtacctctcagatcatgagaacgtggggagcgaaaccccaaaatctacgatgacactaggccggtcagggggtaggctgccttatggtgttagaatgacagctatgggttcctcacccaacattgcctctagtggggtcgccagcgataccattgcattcggagaacaccacctcccaccagttagcatggcttccacagtcccccacagcctgcggcaggcgagagacaatacgattatggatctgcagacccagctaaaggaggtgttgcgcgaaaatgatctgttgcgcaaggacgtcgaggtgaaggagtcgaagctgagctccagtatgaatagcatcaaaacattctggtctcctgagctgaagaaggaacgagcgttgaggaaagacgaagctagcaaaattactatatggaaggagcagtacagggtcgttcaggaggaaaaccaacacatgcaaatgacaatccaggcgctgcaagatgagctcaggatccaacgggatcttaaccagctgtttcaacaggactctagttccagaactggcgagccgtgtgtggccgagctgactgaggaaaactttcaacgtctacacgccgagcatgagcgacaagcgaaagagctattcctgctccgcaagaccctcgaagaaatggaactccgaattgagacccagaaacagaccctaaatgctagagacgagagtatcaaaaaactgttggagatgctgcagagtaagggtctctctgcgaaggcaactgaggaggatcacgagaggaccaggcgactggctgaagccgagatgcacgtgcaccacctcgaatctctgctggaacaaaaagagaaggagaattcgatgctgcgggaggagatgcatcgacggttcgaaaatgcccccgattccgcaaagactaaagcactgcaaaccgtgattgagatgaaggattcaaaaataagctccatggaacgcggattgcgcgatctggaggaagagatccagatgcttaaatcaaacggagcactcagtacagaagagcgcgaagaggaaatgaagcagatggaagtgtaccgatcacattcaaagttcatgaaaaacaaaatcgggcaggttaagcaggagttgtctaggaaagacacggagctgctagcactgcagaccaagttggagacactcacaaaccagttcagcgactcaaaacagcatattgaagtgctcaaggagtcactgacggccaaggaacagagggctgctatactgcagactgaggtagatgcacttagattgcgcctggaagaaaaagagaccatgctgaataagaagacaaagcaaattcaggatatggcggaagagaagggaacccaagccggggagatccacgacctgaaggacatgctggatgtgaaggaaagaaaagtcaatgtgcttcaaaagaaaatcgagaatcttcaggagcagttacgggacaaggagaagcagatgagctctttgaaggagcgagtgaagagtttacaggctgacactacaaataccgatactgccctgacgactttagaggaggcgctcgccgaaaaagaacggactatcgagaggctgaaggagcaacgcgacagggacgaacgcgaaaaacaagaagaaatcgataattacaagaaggatttgaaagatctcaaggagaaagttagtctgctgcagggcgacctctccgagaaggaagcctcactcctcgacctcaaagagcatgcctcctccttagcctcatcaggattaaaaaaggactccagactcaaaactctggagattgctctggaacagaagaaggaagagtgtctaaaaatggagtcccagttaaagaaagcacacgaggccgcactggaagcaagggcgagtcccgagatgagcgaccgcattcagcacctcgagagggagatcaccaggtacaaagacgagtcttccaaggcccaggccgaggtagatagactcctggaaatattgaaggaggtggagaacgagaagaatgacaaagataaaaaaattgcagaactggagtccttgacttctaggcaggtcaaggatcagaataaaaaggtggctaatctgaagcacaaggaacaagtagaaaaaaagaagagcgcgcagatgctggaagaggcaagacggagggaggacaaccttaacgactcatcacagcagttacaggtggaggaactattaatggcaatggaaaaggtgaagcaagagctggaatcaatgaaggccaagctctcaagcacccagcaatcactcgctgagaaggagacacacctgactaacctccgagcagaaagaagaaaacacttggaggaagtgctcgaaatgaagcaggaagctcttttggccgctatcagcgagaaggatgccaacattgccctcctggagttgagtagctcaaagaaaaagactcaggaagaggttgcagcactcaaacgggagaaagaccgattggttcagcagctgaaacagcagacccagaacagaatgaagctgatggccgacaactatgaagacgatcacttcaaaagttcacatagcaaccagacaaaccacaagccgagccctgaccaggacgaagaggaagggatttgggcttag

SEQ ID NO: 14843 - DNA, 2733 bp, Artificial Sequence
  Description of Artificial Sequence: Synthetic coding sequence
atggctgcaactgtcgaggggcctgaactcgaagcggctgctgccgcaggcgacgcttcggaggactctgatgctggatccagagcccttccatttctgggcggcaatcgactgtctctggacctctatcctggcggttgccagcagttgctccacctgtgcgtgcagcagcctcttcagctccttcaggtcgagttcctgcggttgtccacacacgaggatccccaactgctggaggcaacactggcccagctgccacagagcctgtcctgtctccggtccctcgtgcttaaggggggccaacgaagggacactctcggggcctgtctcagaggcgcactcactaacttacccgcaggtttgagtggactagcccacttggcccatctggatctctcttttaactcgcttgagaccctgccagcatgcgtgctccagatgcgaggcttaggggccttgctgttgagccataattgtctatctgaactgcccgaggcccttggcgcccttccagctctgacattcctgacagtcacacacaatcggttgcagaccctccctccagctctgggtgccttgagcacacttcagagactcgaccttagtcagaacttgctcgacaccctccctcccgagataggagggctgggaagtctcttagaattaaacttggcctccaacagattacagtccctgcccgcctctctggccggtttgcgcagcctgcgattgttggtcctacacagtaatctactagcgtctgttccagccgacctcgctaggctgcctctgctcacgaggctggatttgcgcgacaaccagctccgggatcttccccccgaactactcgatgcgccttttgtaaggctgcaggggaatcctctgggtgaagcaagtccagacgccccatcaagtccagtggctgcgttgattccagaaatgcccagactgtttctgaccagcgatctggactcatttccagtgactccacaggggtgctccgttacgctggcttgcggagtgagattgcagtttccagctggagctacggctacacctatcaccataaggtacaggctgctgttgccggagccaggactggtacccttaggaccacacgacgcactgctttctcatgtactcgagttgcagccccatggggtcgcttttcagcaagatgtgggcctgtggctgctgtttacacccccccaggctcggagatgcagagaagtggtggttcgaacacgcaatgataactcttggggtgatctggaaacctaccttgaagaagaggcacctcagcgcttgtgggcccattgccaagtcccccatttctcctggtttttagtggtaagcagacccgtgagtaacgcctgcctggttcctcccgagggcaccttactttgctctagcggccatcccggggtgaaggtcatcttcccccccggggcgacagaagagcccagacgcgtttcaatgcaagtagtgagaatggccggtagggagttacaggccctgcttggagagcctgaggcagccgtctcccccctcctctgccttagccagtcggggccaccctcgttcctgcagccagtcaccgttcagctgcccctcccctctgggattaccggcctgtccttggatcggtcccgcctccacctgctatattgggcccctcccgccgccacttgggatgatatcaccgcccaagtcgtgctcgaattaacacacctgtacgccagattccaggtcactcactttagttggtattggctgtggtatacaacaaagaattgtgtcggtgggctggcaaggaaagcctgggaacgtctgagactccacagggtgaacctaatcgcactgcagaggaggcgagaccccgagcaagtcctgttgcaatgcttgccacgtaacaaggtggacgccacgctgagaaggcttctcgagaggtaccggggacctgagcctagcgacacagtggagatgtttgaaggggaggagttttttgcagcattcgaacgtggcatcgacgtggacgctgatcgccccgactgcgtggaggggcgcatctgcttcgtgttctacagccatttgaagaatgtcaaagaagtctacgttacaaccacactggatagggaagcccaggcggtcagagggcaggtgtccttctacaggggtgcagtgcccgttcgtgttcccgaggaggctgaggccgccagacagcggaagggggctgatgcactgtggatggccactttgccaattaaacttccaagactccgcggcagcgagggcccccggcgaggtgcaggcctgtcactggccccactgaacttaggggatgccgaaaccggctttctcacccagagcaacttgctttccgtagctgggcgcctagggctagattggcctgctgtggccctgcacctcggcgtgtcatacagggaggtgcagcgcattcgacacgagttcagagatgatctagacgagcagataagacatatgctgttttcttgggctgaaagacaggccggacagcctggtgccgtaggactgctggtgcaagctctggaacagtcagacagacaagacgtcgcagaagaggtccgggctgtgcttgaactgggccgacggaagtatcaggacagcatacgaagaatggggctagccccaaaagatccggcgctgccgggctcttctgcgcctcagcccccggaacccgctcaggcctag

SEQ ID NO: 14844 - DNA, 2961 bp, Artificial Sequence
  Description of Artificial Sequence: Synthetic coding sequence
atgtcacagtggacgccagaatataacgagctatacacacttaaggtcgacatgaaaagtgagatcccttcagacgcgccaaaaacacaggagtccctgaagggaatcctgctccaccctgagcccattggggccgcaaaatccttcccggcgggagtcgagatgatcaactcaaaggtcggtaacgagttttctcacctatgtgacgatagccaaaagcaggagaaggagatgaatggtaaccagcaagaacaggagaaaagtctcgttgtgcggaagaaacggaaatctcagcaggctggcccatcttatgttcagaactgtgtgaaagaaaaccaaggcattcttggtctgaggcaacacctaggcacccccagcgacgaagataatgacagctcttttagtgactgtctatcctctcccagcagtagcttacattttggggacagcgataccgttacgagcgatgaggacaaggaggttagcgttaggcactcccaaacgatcctgaatgccaagtctagaagccacagcgcccggtctcacaagtggccccgaactgagactgagtctgtgagcggactgctcatgaagcgcccttgcttgcacggcagtagtctaagacggttaccttgtcggaaacgattcgtgaaaaacaattctagccagaggacacagaaacaaaaggagcgcatcttaatgcaacgtaaaaagagagaggtcttggctcggcgcaaatacgccttgcttccatcaagctcctcgtcgtccgagaatgacctgagttccgaatcttccagctccagctccaccgagggagaggaggacctcttcgtaagcgcttctgaaaaccaccagaataaccctgcagttccatcggggtcaatcgatgaggacgtggtggtgattgaggcctctagcacaccgcaggtgaccgccaacgaagaaattaacgtaacatcaacagatagtgaagtcgagatcgtgacagtcggggaatcttacaggagccggagtactctaggccactcacgctcccactggtcccagggttcctcttcacacgcatcacggccccaagagccacggaaccggagcaggatctcgactgttattcagcccctgcgacaaaatgcggctgaggttgtggatctcactgttgatgaagacgagcctacggtggtgccgaccacttccgcacgcatggaaagccaggcaacttctgcctcgattaacaattccaatcccagcacttctgagcaagcctccgacacagccagcgctgtcacttcatcccagcctagcaccgtgagcgagacgtcggccactttgacatctaatagcaccacaggaacatctataggcgatgactctcggagaaccacctcctcagccgttactgaaaccggcccccctgcgatgcccagactgccctcttgctgcccccagcacagtccttgcggggggagcagtcagaaccaccacgcgcttggacaccctcacacaagctgcttccaacagcacgggcaccacttccaacaccatcaccaccaccaccataccccgcatcctgccgtgcccgtgtcacccagcttcagcgaccccgcctgtcccgtcgaacgcccccctcaggttcaggctccttgcggagccaacagttcatcagggacttcctatcatgaacaacaggcactgccggttgatctgagcaatagtggcatccgctcacacggtagcggctccttccacggagcctccgccttcgacccttgttgccctgtgtccagtagtcgtgccgccatattcggacatcaggctgccgcagccgcaccatctcaaccactctcctctattgatggatatggaagttcaatggttgcacagccacagccacagcccccgccacagccaagtctgagcagctgtcgccactacatgcctccaccatatgcatcccttaccaggcctctgcaccatcaggctagtgcatgtccacattcccacggtaatccccctccccagactcaaccgccacctcaggtcgattatgtgatcccacatccagtacatgcattccattcccagatcagctcccatgcaacatctcacccagtggcgcccccaccacctacgcacctggcctccaccgccgcccccatcccacaacatttgccgccaacgcatcaacccatttcacaccacattcctgccacagcccctccagcacaacgcttgcatccacatgaggtcatgcagcgaatggaggtccaaaggcggcggatgatgcaacaccccacaagggcccatgaaaggccgccccctcacccccacaggatgcaccctaactacggccatgggcatcacatccacgtcccgcagaccatgagctcccatcctagacaagctccggaacgctcggcatgggaattagggattgaggcaggagtaacagcggccacgtacactccaggagcgctccacccccacctggctcattatcatgcacccccacggctccatcacctccaacttggcgctctccctctgatggtcccggatatggcgggctacccgcacataaggtacattagcagcgggctggacgggacatcctttcgtggaccgtttagaggtaacttcgaggagctgatccacctcgaagagagactgggcaatgtgaatcgcggtgccagccagggcactattgaacgatgcacctatccccacaagtataaaaagcggaaactacactgtaagcaggacggggaagagggcaccgaagaggacacagaagagaagtgcacaatctgtctatccatcctagaagaaggcgaggatgtgcgccgtctgccctgtatgcacctgttccaccaggtgtgtgttgaccagtggttgatcacaaacaaaaagtgtccaatttgtagggtggatattgaagcccagctgccctcagagagctag

SEQ ID NO: 14845 - DNA, 372 bp, Artificial Sequence
  Description of Artificial Sequence: Synthetic coding sequence
atggccaaaattaaagcgcgagacctgaggggcaagaagaaagaggaactgcttaagcagctcgacgatcttaaggttgagctcagccagctgcgagtggcgaaggtcactggaggagccgcttcaaagcttagtaagattcgagtggtgagaaagtcaatcgcgagggtcctgacagttatcaaccagacacaaaaggagaatctgcggaagttctacaagggtaagaaatacaagcctctggaccttcgtcctaaaaaaaccagggcaatgcgtcgccgcttaaacaaacacgaggagaatctgaagactaagaaacagcagcgcaaggaacggttatatccacttcgcaagtatgctgtgaaggcctag

SEQ ID NO: 14846 - DNA, 1635 bp, Artificial Sequence
  Description of Artificial Sequence: Synthetic coding sequence
atgaaaattttttgctcccgcgctaaccccaccactggttctgtggagtggttggaagaagatgaacactacgattatcaccaggagatcgccaggtcctcctatgcagacatgctgcacgataaggatagaaacgttaagtattaccaggggattagggcagccgtctcacgtgtgaaggacagaggacagaaggcactagtcctcgacatcggaaccggcaccggcctgctttcaatgatggctgtcactgccggcgccgatttttgttacgctatcgaagaaaactgtgaggcagtgccgcatcgagccaccgtgtatgctcaactggtggagtcagggcgcatgtggagctggaacaagctcttccctatacacgtccagacctctttaggcgaacaagtgatcgtacctccagttgacgtggaatcctgccctggagcccctagtgtgtgtgatatccagttaaaccaggtttctcctgccgattttaccgtgctgagcgatgtgctgccgatgttctctatcgacttcagtaaacaggtgtccagtagcgctgcctgccatagcaggcggttcgagcctctgacttcgggaagggcgcaggtcgtactatcttggtgggatatagagatggatcctgagggaaaaataaaatgcactatggcccctttctgggcccattccgatcctgaggaaatgcaatggagggaccactggatgcaatgcgtctacttccttcctcaggaagagccagtggtacagggctccgcattgtatctagtcgctcatcacgacgattactgtgtatggtattcacttcagagaacaagtcccgagaaaaatgagcgagtaagacaaatgagacccgtatgtgattgtcaggcccaccttctctggaacagaccaaggttcggcgagataaatgaccaggacagaacagaccgatacgtacaggctttacggaccgtgtcccttttgcttggcgaaccgttcttcacgacatccttactcccgtggcacaacctgtatttttggtatgtacgcaccgcggtggatcagcatctgggtccgggagccatggtgatgccacaggccgcatcactacatgcggtagtggtggagtttagggatctgtggcgcatccgctctccctgcggcgactgcgaaggcttcgatgtgcacatcatggacgatatgattaaacgggcccttgactttcgggagagcagggaggccgaacctcaccccctctgggagtacccatgcaggtccctgagcgagccttggcaaattttgacattcgatttccagcagccagtgcccctccagccactatgtgcagaggggaccgtggagctgcggagacctggacagtctcatgcagctgtcctgtggatggagtaccacctgacccctgaatgcaccctctctacaggactccttgagcccgcagacccggaggggggatgttgctggaacccccactgtaaacaggccgtatacttcttctcaccagccccggacccacgagctcttctcggcggccctcgaacagtttcttacgctgtagagttccaccccgacacaggcgacatcattatggaattccgtcacgccgacactcctgattag

SEQ ID NO: 14847 - DNA, 1131 bp, Artificial Sequence
  Description of Artificial Sequence: Synthetic coding sequence
atgcccctgcaggtcagcgattacagctggcagcagaccaagaccgctgtgtttctgagtctaccccttaaaggcgtctgtgtccgggatacagatgtgttttgcactgagaactacctgaaagtcaacttcccacccttcctgtttgaagccttcctgtatgcacctattgacgacgagagttcaaaagccaagataggaaatgacaccattgtgttcacgttgtataaaaaggaggccgccatgtgggaaaccctctcggtaaccggagtggataaggagatgatgcaacgcatcagggaaaagagcattctgcaggcccaggaaagagccaaagaggccacagaggctaaggctgccgcaaagcgagaggatcagaagtacgccctgagcgtgatgatgaagattgaggaagaggagcggaagaagattgaggacatgaaagagaatgaaaggataaaagcaacaaaagcgctcgaggcttggaaggagtatcaacgtaaggctgaggagcagaaaaagatccagcgagaagagaaactgtgtcagaaagagaagcaaataaaggaagaacgcaagaagatcaaatacaagagcctgacccgcaatctggctagcaggaatctggcaccaaaagggaggaattctgagaacatttttacagaaaaactcaaagaggattcaattcccgctccacgcagcgtcggctcgatcaagattaactttactcctagggtttttccgacagctctccgagaatcccaggtggctgaggaggaagagtggctgcacaagcaggccgaagcgcggcgagcaatgaataccgatattgccgaactttgtgatctcaaggaagaagagaagaatcccgagtggctcaaggacaagggtaacaagctgtttgcaactgaaaactacctggccgccatcaacgcatacaacctggctattaggctcaacaataaaatgccactgctttacctcaaccgggccgcttgccatctgaaactcaagaatctccataaagccattgaggacagttcaaaggcctaccgcatcatgaagaggcatctgcggttaatccaccccaccaagttatataagctgatgcttcgccggtttggaatgtag

SEQ ID NO: 14848 - DNA, 4221 bp, Artificial Sequence
  Description of Artificial Sequence: Synthetic coding sequence
atgtggtcactgacggccagtgaaggagaatctacgactgcgcactttttcttgggagccggggacgaaggtctcgggactagaggtatcggcatgcgtcccgaagaatccgatagcgagctgctggaagatgaagaggacgaggtgccacctgagcctcaaatcattgtcggaatctgcgccatgacaaagaagtctaaaagtaagcctatgacccaaatactcgaacgactttgcaggtttgactacctaacagtggtcattctgggcgaagacgttatcctgaatgagcccgttgagaactggccttcgtgccattgcctcatctcatttcacagtaagggctttccattggacaaagccgttgcatattctaagctgcgaaaccccttcctgatcaacgacctggctatgcagtattatatccaggatcggcgggaggtgtataggatcttgcaggaggagggaatcgatctcccccgttatgcggtcttgaatcgcgaccccgctcgacccgaagaatgcaatctgatcgaaggggaagatcaggtagaagtcaatggagccgtgtttccaaagccatttgtcgaaaaaccagttagtgctgaggaccacaatgtgtatatatactatccgtcttccgccggcggcggcagtcagagactctttaggaagatagggtctcgttctagtgtgtattcgccagaatccagtgtgcggaagactgggtcctacatctatgaagagttcatgcccacagatggaacagatgttaaggtgtacacagtggggcctgattacgcacacgcagaggcgagaaagtctccggcccttgatgggaaagtggagagagattctgagggtaaagagatccgatacccagtgatgctgactgcaatggagaagcttgttgcacggaaggtgtgtgtggccttcaagcagaccgtgtgcggattcgacctgttgcgggcgaatggccactcctttgtgtgcgatgtgaacggtttctcttttgtcaagaactctatgaagtactatgatgattgcgcgaagatcctgggcaacaccattatgcgggaactagccccccaattccagattccatggtccatccctactgaggccgaggatattcctattgtccccaccaccagtggcaccatgatggaactgaggtgtgtgatcgcaatcatccgccatggagacagaacaccaaaacagaaaatgaagatggaggtgaaacaccctcgtttcttcgccctgttcgagaagcacggaggctacaagaccggcaagctaaaattaaagagaccagagcagcttcaggaggtgctggacataactcgcctactgctggctgaactcgaaaaagagcctgggggcgagattgaggagaaaacaggcaagcttgagcagctgaaatccgtcctcgagatgtatggacactttagtggcataaaccggaaggttcagttaacctactaccctcatggggtgaaggcctccaacgagggccaggacccacagagggagacacttgcaccctccctactgctggttctgaagtgggggggggagttgacacccgctgggcgcgtgcaggcagaagaactagggagagcttttcgttgtatgtatccaggtgggcagggcgactatgccggattccctggatgtggattactcagactgcatagtacctttcggcacgatcttaagatttatgcttccgatgaaggacgggttcagatgaccgctgcagcttttgcaaagggtctcctagcccttgagggcgaactgacccctattctggtgcagatggtcaaaagtgctaacatgaacggcctcctcgattctgatggggacagtctgtcatcttgtcaacacagagtcaaagcccggctgcatcatatcttacagcaggatgcacctttcgggcctgaagattacgatcaactagcaccaacaaggtcaacaagcctgctgaacagcatgacaattatacagaaccccgtaaaggtgtgtgatcaggtgttcgctctgatagaaaacctgacccatcagatacgcgaaaggatgcaggacccacgctccgtggatctgcagctgtaccattccgagaccctggagctgatgctccagcgatggtcaaagcttgagcgagacttcaggcaaaagtccgggcgctatgacatcagtaagattccggacatctatgactgtgtgaaatatgatgttcagcataatggctccctcggtctgcagggaactgccgagctgttgcgactgagtaaagcacttgcagatgtggttataccacaggaatacggcatctctcgcgaggagaagttggagattgctgtaggcttctgcttacccctgttacgcaaaatactgctagacctccagcgcactcatgaagatgaatcggtgaataaattgcatcctctatatagcaggggagtgctgtcacctgggcggcatgtgaggacccgactctacttcacaagcgaatcgcacgtgcactctcttctgagcgtctttagatatggtggtctcctggatgagacccaggacgctcagtggcagagggccctggactatctgtcagcaatcagtgaacttaattacatgacacagattgtgattatgctgtatgaagacaacacgcaagatccgctgagtgaagaaagattccatgtggagctgcatttttctcccggagtgaaaggggttgaggaggaaggctctgcaccggccggctgcgggtttaggcctgcctccagtgagaacgaagaaatgaaaaccaaccagggcagcatggagaacctgtgccccggaaaggcctccgacgagcctgaccgcgcccttcaaacttccccccaaccgcctgaaggacctggtctcccccgccgcagccccctgatccgaaatcgaaaggccgggagcatggaggtcctttccgagacaagttcctcccgacccgggggttaccgccttttctcctcaagccgcccaccaacggaaatgaagcagagcgggctaggtttcgagggctgctccatggtccctacaatttacccactcgaaaccttgcataatgcgttgagccttcgacaggtgagcgagtttctcagccgcgtctgccagagacatacagacgcacaggctcaggcaagcgcagctctgtttgacagcatgcattcgtcacaggcaagtgataatccattcagcccccccaggaccctccactctccccccctccagctccagcagcgctctgaaaagcctccttggctggaaactagattttgtcacgttggccaggcaggactcgaattactcacctcatccgacttaccagcgtcagcatctcagagcgccggaatcacaggagtgtcacaccggactcagcctgactccagcggcccaagcagtactgtgagttccgccggtcctagttcccctacaaccgtggatggaaattcccagttcgggttttcagatcagccttctttaaacagtcacgtcgccgaggagcaccaaggtctgggcttgttgcaggagacaccaggctctggggcccaggagctgtccattgagggcgaacaagagttgttcgagccaaatcaatcaccacaggtgcctcccatggaaacttcacagccctacgaagaggtgtctcagccatgtcaggaggtgccagatattagccagccatgccaggacatttcagaggcactgtcacagccatgccagaaggtgccagatatctctcaacagtgccaggaaaaccatgacaacggcaatcacacttgtcaggaggtgcctcatatctcgcagccctgccagaagagttcacagctatgccaaaaggtctctgaggaggtttgtcaactctgtctagaaaactcagaggaggtcagccaaccttgccaaggcgtatcagtggaggtcggaaaattggttcacaaatttcatgtgggtgttggttccctagtccaggagaccctggtggaagtgggatctccagcagaagaaattcctgaggaagtgatacagccttaccaagagttttcagtggaagtggggcggcttgcccaggagaccagcgcgatcaatctgctgtctcagggcatccccgagattgacaagcccagccaggagtttccagaagagatcgacttacaagcacaagaagtccctgaagaaattaactag

SEQ ID NO: 14849 - DNA, 1338 bp, Artificial Sequence
  Description of Artificial Sequence: Synthetic coding sequence
atggtcctcgaaggtaaccccgaagtcgggtcacctcgtaccagcgacctccagcatcgggggaacaagggcagttgcgtactgagcagtcccggagaggatgcacagcctggagaagagcccatcaaatacggcgagctgatcgtgctggggtataacgggtgcctcgcatcaggagataaaggaaggcgccggagccgcctggcactgagcagaaggtcacacgctaatggcgtcaaaccagatgtgatgcaccatattagtacaccgttagtcagcaaagcattgagcaatcggggtcagcatagcatttcatacaccctttcaagatcacactcggtcattgtggaatatacccatgatagtgatactgatatgttccagataggtcggagcactgagaatatgatcgacttcgtggttactgataccagcccaggagggggcgcagcagaagggccatcagctcaaagcactatctcgaggtatgcttgtcgcattctgtgcgacaggcgcccaccctacactgcccgcatttacgccgcaggattcgacgcctctagcaatatttttctgggggagcgtgctgcaaaatggcgtacccctgatggcctaatggatggactcaccaccaacggagttctggtcatgcatcctgccggcggattcagtgaagactccgcgccaggtgtgtggagggaaatcagcgtgtgcggaaacgtgtacacgctgcgagatagcagaagcgcccaacagagaggcaagttggtggagaatgagtcaaacgtgctgcaagatggctccctgattgatttatgcggggcaaccctcctgtggcggacaccggcgggacttctgagggcacctacgctcaagcagcttgaggctcaacgacaggaggccaacgctgcacgcccgcagtgcccagtaggactgtccactctggcatttccctccccggcacgaggacgaacggctccagacaagcagcagccctgggtctacgtgcgctgcggccacgtgcacggatatcacggatggggctgccgcagggagcgggggccacaggagcgcgagtgcccactgtgtcggttagttgggccttacgttccgctatggttgggccaggaggccggcttatgcctcgaccccggtcccccttcccacgctttcgctccttgtggtcacgtgtgcagcgaaaagactgcccggtattgggctcagacacccttacctcacggcactcatgccttccacgctgcttgtcccttttgcggggcctggcttacaggagagcatggatgcgtgagattgatatttcagggacctttggactag

SEQ ID NO: 14850 - DNA, 1950 bp, Artificial Sequence
  Description of Artificial Sequence: Synthetic coding sequence
atgggcacggccctggtgtaccacgaggatatgaccgcaaccaggctcctctgggacgaccctgaatgtgaaatagaaaggcccgagcgcctgacagccgcgctcgatagattaagacagagggggctggagcagcgttgcctgcgtttgagcgccagggaagcctccgaagaggaactgggcctggttcactcacccgagtacgtgtctctggtgcgcgaaacccaagtgttagggaaagaggaactgcaggcactcagtggccagtttgacgccatatacttccatcccagcacattccactgcgccaggctggccgctggagcggggctgcagctcgtggatgccgtgctcacgggtgccgtgcagaacggattagccctagttcggcccccaggacaccacggtcagcgtgctgccgctaatggattctgtgttttcaacaatgtagccatcgctgcagcccatgccaaacaaaagcacggcctgcaccgaatcctcgtggtcgattgggacgtgcatcacggtcagggaatccagtacctgtttgaagatgacccatcagtcctgtacttttcctggcacagatacgaacacggaaggttctggccattccttcgagaaagtgacgccgacgccgtaggtcgtgggcagggattggggtttaccgtgaacctcccctggaaccaggtagggatgggaaacgccgattatgtcgccgcttttctgcacttactgctgccactggcctttgaggggcaaatgcaggcaacgcctgagtgctttgcccacttgacccagctgttgcaggtcctcgccggcggccgtgtgtgtgccgttctggagggaggctaccatctggagtccctcgctgagtccgtgtgtatgacagtgcaaacattacttggagaccccgcccctccgttgtctggccccatggctccctgtcagagtgccctcgagtccattcagtctgcccgtgcagcccaggccccgcactggaaatctcttcagcagcaagatgtgacagctgtgccgatgagcccatcctcgcactcccccgagggtcgcccgccacccctattgcccggagggcccgtgtgtaaagccgccgccagcgccccgtcttccctcctggaccagccttgcctgtgccccgccccatctgtcaggactgccgtagccttaactactcccgatatcacgctcgtgcttcctcccgacgtgattcagcaggaagcaagcgctcttagggaagagacggaagcctgggctagaccccacgagagtctggccagagaagaagcactcacagcccttggaaaactgctgtatttgctcgacggtatgctggacggtcaagtgaacagcggcatcgccgccacccccgctagcgccgcagccgctacccttgacgtcgcagttcgtagagggctgtctcatggggcccagcggctgctttgcgtagcgttgggccagctcgaccggcccccggatctggctcacgacgggcggtccctgtggttgaacatccggggcaaagaagccgctgcattgagcatgtttcacgtcagcaccccacttcccgttatgactggtggttttctcagttgcatcctcggattagtgctgccccttgcctatggcttccagccagatttggttttggtggccctgggtcctggccacggcctgcaaggcccccatgctgccctgctcgctgccatgctgcggggactggccggtggacgcgttcttgccctgctggaagagaacagtaccccgcagcttgccggcattttggctcgcgtcctcaatggagaagcaccccccagtctgggcccaagttccgtggccagtcctgaggatgtccaagccctcatgtatttgagaggtcagctggaaccgcaatggaaaatgctgcagtgccacccacacctggtcgcttag

SEQ ID NO: 14851 - DNA, 795 bp, Artificial Sequence
  Description of Artificial Sequence: Synthetic coding sequence
atggccggtgagcagaaaccttcttcgaatctcctggagcaattcattctcctcgctaaaggcacctccggatccgctttaaccgcactaatcagtcaggtcctcgaggctcccggggtttatgtcttcggagaactgctcgagctggcgaacgtccaggagctggctgagggcgccaatgctgcttacctccagctcctgaatctgtttgcatatggaacctaccctgattacattgcgaataaggagtcactgcccgagctctctaccgcccagcagaataagctgaagcacctgaccatcgtgtctttagcgagcagaatgaaatgcattccctacagcgtgctgctgaaggacctcgagatgaggaacctgagagaacttgaggatctgatcattgaagcggtatacaccgacatcatccaaggcaagctcgatcagcgtaaccaattgcttgaagttgacttttgcatcggaagagacatccggaagaaggatattaataatattgtaaagaccctacacgaatggtgcgacggatgcgaagccgtattgctgggaatcgagcagcaagtgttaagggctaaccagtataaggagaaccacaataggactcagcaacaggtcgaagccgaggtgacaaacataaagaagactttgaaggccacagcgagtagctccgcacaagaaatggagcagcagttggccgagagagaatgcccaccacacgccgaacagaggcagcccaccaagaagatgagtaaagtcaaggggctggtcagttcccgccactag

SEQ ID NO: 14852 - DNA, 726 bp, Artificial Sequence
  Description of Artificial Sequence: Synthetic coding sequence
atgtccgcctctctgaactataaaagtttcagcaaagaacagcagaccatggacaacctggagaaacagcttatctgtcctatctgcctcgagatgtttaccaagcccgtggtcatcctcccttgccaacacaacctgtgtaggaagtgtgcatcagacattttccaggcctctaatccttacctccccacgcgtggcggcactacgatggcctcaggggggagatttagatgcccttcctgcagacatgaggtcgtgctggaccgccacggtgtgtatggtctgcagcggaacctgctggtggagaacatcattgatatctacaagcaagaatctacccgtcctgaaaagaagagcgaccagcccatgtgtgaggagcacgaggaagaacgaattaacatttactgcctcaattgcgaagtgccgacctgttcgctttgcaaggtgttcggggctcacaaggactgccaagttgcccctctgacgcacgtgttccagcgccagaagtccgagttgagtgacggcatagctattctcgtcggaagtaatgatagagtgcaaggcgtcatttcacaactggaggatacctgtaaaactatagaaataggatttgaagcacctcctttacagggacaggctgcagccccagcttctgggagtggcgcggatagtgaaccagcgcggcatatttttagcttcagctggctgaacagcctgaatgagtag

SEQ ID NO: 14853 - DNA, 3501 bp, Artificial Sequence
  Description of Artificial Sequence: Synthetic coding sequence
atggccaatgactctcctgcaaagtcattggtggacatcgatctgtcgagtctgcgcgatccggccggcatcttcgaactggtggaggtcgttgggaacggaacctatggtcaggtgtacaaaggacgccacgtgaagactgggcagcttgccgccatcaaagtcatggatgtgaccgaggacgaggaagaggaaatcaaactggaaattaacatgttgaagaagtacagtcaccaccgaaatatcgccacctattacggcgcttttatcaagaaaagccctccaggtcacgacgatcaactgtggctcgtcatggaattttgcggcgccggcagtatcaccgatttagtcaagaatacaaaaggtaatacactcaaggaggattggattgcatatattagtagggagatcctgagaggactggctcatctgcacattcaccatgtgattcaccgtgatatcaagggacagaatgtactgcttacggagaatgccgaagtgaagctcgtcgattttggcgtgagcgctcagttggatagaacagtcggacgccggaacactttcattgggacgccatactggatggcccccgaggtgattgcctgtgacgagaaccctgacgctacttacgactaccgttcagacttgtggtcttgtggcatcacggcaatcgaaatggccgagggggcgccaccactgtgcgatatgcaccccatgagggctcttttcctaataccccgcaacccccccccacggctgaaatcaaaaaagtggagcaagaagtttttttcttttatcgagggttgtttggtcaagaactatatgcagcgcccttcaaccgaacaattattgaaacacccttttataagagatcagcccaatgaacgccaggtgcgaattcagctcaaggatcacatcgatcggacacggaagaagaggggtgagaaagacgagacagaatacgaatatagcggctcggaagaggaggaagaggaagtgccagagcaggagggtgaacccagctcaattgtgaatgtgccaggagagtcaactctcaggcgggattttctgcggctccagcaggagaataaggagcgctctgaggctttgcgccggcagcagctcctgcaagagcagcagctccgcgaacaggaagaatacaaacgtcagctgttggccgagcgacagaaacggatcgaacaacagaaggaacagagaagaaggctggaggaacagcaaagacgcgaaagagaggcccgaagacagcaagagcgtgagcaacgtcggagggagcaggaagagaaacgcagactggaagagctggaacggaggagaaaagaagaggaggaacgccgtagggccgaagaggagaaaagaagggtcgagcgagagcaggaatatattcgcagacaactggaagaggagcagcgtcatcttgaagtattgcagcaacagctgctgcaggagcaagccatgctgttacacgaccaccggcggccgcacccccagcactcacagcaacccccacccccccaacaggagagaagtaaaccatctttccacgctccagagccgaaggcgcattatgaacctgctgaccgagcacgcgaagtgcctgttcggacaacctctcgctcccccgtgctgagcaggagggactcccccttgcaggggagtggccagcagaattcgcaggctggccagcggaacagtacaagcagcattgaaccccggctgctctgggaaagagtcgaaaaactggtgcccagaccaggctctggatctagctcagggtcatcaaacagcggcagccagcccggaagccaccccggctctcagtctgggagcggcgagagatttcgggttcgtagcagctccaagagtgagggctccccttcccagcggcttgagaacgcagttaagaagcccgaggacaaaaaggaggtcttccggccactgaaaccggccgtgcgaatcgatcttacagcactcgcaaaagagttgagggcagtggaggacgtacgccctccacataaggttaccgattattccagcagctcagaagagagtggcaccacggacgaagaagacgacgatgttgaacaggagggagccgacgaatccacctctggacccgaggatactagagcagcctcaagtttaaatctgtctaatggcgagaccgaaagtgtgaagacgatgattgttcacgacgacgtggagagcgagcctgccatgacgccaagtaaggagggaaccctgatcgtacgccagacgcagagcgcctcaagcacactgcagaagcataaaagcagctcctctttcaccccattcattgacccaaggcttttgcagatctccccttctagcggcaccactgtgaccagcgtggtcggcttctcctgcgatgggatgagacctgaggccatccgacaagaccctacccggaagggtagcgtcgtcaacgtaaatccgaccaatacacgcccccaaagtgatacccccgagatccgcaagtacaaaaagcgttttaattctgaaattctgtgcgcagctctgtggggtgtgaaccttctggtggggacagagagtggacttatgcttctagacaggagtgggcaaggaaaggtgtaccctctgatcaatagacggcgattccagcagatggacgtgctggaaggactgaatgtcctagtgaccatcagcggaaaaaaagacaaactgcgcgtatactatctgagctggttgcgaaacaaaattctccacaacgatcctgaagtcgagaagaaacagggctggaccacagtgggtgacttagaaggttgtgtgcattataaggtcgttaagtatgaaagaatcaaatttctcgtaattgcactgaagagcagtgttgaagtctatgcctgggcaccaaagccttaccacaagttcatggcattcaagagcttcggagagttggtacacaagcctttattggtggatctcaccgttgaggagggccagaggctcaaagttatatacgggtcctgcgccgggtttcacgccgtcgatgtggattcaggctctgtatacgacatctacctcccaacccacgtgagaaagaacccacattctatgatccagtgcagtataaagccccatgccattattatattacccaacaccgacggtatggagctgctggtttgttatgaagacgagggcgtctacgtcaatacttatggccgcatcacaaaagacgtcgtgctccagtggggtgaaatgccaacctcggtggcctacatccgatcaaatcagactatgggctggggcgagaaagctattgaaatccggtctgtcgaaacgggacacctggatggcgtatttatgcacaagcgggcccaacggctgaagttcttgtgtgagaggaatgataaagttttttttgcatctgtgagaagtggaggtagctcacaggtctatttcatgactttgggtagaacatccctgctcagctggtag

SEQ ID NO: 14854 - DNA, 2466 bp, Artificial Sequence
  Description of Artificial Sequence: Synthetic coding sequence
atggttgccccggtgttagagacaagtcatgtcttttgttgcccaaatagagtgcgaggagtcctcaattggtctagcggcccccgcgggctgctggcattcggcacctcttgcagtgtggtgctttacgatcccctcaaaagagtggtcgttactaacctgaatggccacaccgcacgcgtgaactgtattcagtggatttgtaaacaagacgggtctccttccaccgagttggtgtctggcgggtccgacaaccaagttatacattgggaaattgaggataaccagctgttaaaggccgtgcacctacagggacacgagggcccagtttacgctgtgcacgcagtgtatcaacgcagaacctccgatccggcgctgtgtacccttattgtgtcagccgcggcagatagtgctgtcaggttatggtccaagaaagggccagaggtgacctggaagactggtcaggtggaacgcggcagagcatggaaaccgccagcaagtctagctctatgttccagatcatgtgatagtatggtctcatgttacgcgtccatattgtgcaaggccctttggaaggaaaaactgcacactttctggcaccacaaccgcatctccttccttccttctgcatttcgacctataccaattttagcgtgtggtaacgacgactgccgtattcatattttcgctcagcagaatgaccagttccagaaagtcctgagcttgtgtggccacgaggattggatacggggtgttgaatgggcggcattcggcagagatctgtttctggcttcatgtagccaggactgcctgattcggatatggaaactttacattaagagcacctcccttgaaactcaagatgatgacaatatccgcctgaaggaaaacacttttaccatcgaaaatgagtccgtcaagatcgcattcgctgtcacactcgagaccgtgttagcagggcatgaaaactgggtgaacgccgtgcactggcaacccgtgttctataaggatggtgtcttacagcagccagtgaggctgctatccgcctctatggacaagaccatgattctctgggcacctgacgaggaatcaggcgtgtggctggaacagcgcgaatggacccccgagatcgtcattagcggacattttgacggagtgcaagacctcgtctgggaccccgaaggggaattcatcattacagtgggcacggaccaaaccacccgtctgttcgcaccatggaaacggaaggaccagagccaggtcacgtggcacgagattgcgcgaccgcagatccacggatacgacctgaagtgtttggccatgattaatagattccagtttgtgtccggtgccgacgagaaagtcctgcgggtttttagtgccccaagaaatttcgtcgagaatttctgcgccatcactggacagagcctaaatcacgtgctgtgtaatcaggatagtgatctcccagaaggggcaactgtgcccgctctgggcctgagtaataaggctgtcttccagggcgatattgcaagccaaccatccgatgaagaagagttactgacctctactgggttcgaatatcaacaggttgctttccagcctagtatcctgaccgagccacctacagaggaccacctcctgcagaatactctgtggccagaagtgcagaaactctacggtcacggctacgaaatattctgcgtaacctgcaatagttctaagactctattagcttccgcctgcaaggcagctaagaaggagcatgccgcaatcatcctgtggaatacaacatcctggaagcaggtgcaaaatctggtgtttcatagtctgaccgtcactcagatggccttttctccaaatgaaaagttcctgctggccgtgtcccgcgatcgcacatggagcttgtggaagaagcaggacacaatttcacccgagttcgagccagtcttctccctgtttgcctttacaaataagattactagcgtgcattctcggatcatctggagttgcgattggtccccagactctaagtacttctttacgggcagcagggataaaaaggtggtcgtgtggggagaatgtgattcaaccgacgattgtatcgaacataacatcggcccctgctcctccgtgctggacgtcgggggtgccgtgaccgctgtatccgtgtgtccagttctgcacccatcacagcggtatgtggttgccgtcggcctggaatgcggcaagatatgtctgtacacatggaaaaagaccgaccaggtcccagagataaacgactggactcactgcgtggaaacgagccagtcgcagtcacataccctcgccatcaggaagctatgttggaagaactgtagtgggaaaaccgagcaaaaggaagccgagggagccgagtggcttcacttcgcctcgtgcggtgaagaccacacagtgaaaattcaccgcgtgaacaagtgcgccctctag

SEQ ID NO: 14855 - DNA, 969 bp, Artificial Sequence
  Description of Artificial Sequence: Synthetic coding sequence
atggtgtcagtgattaatactgtggacaccagccacgaggacatgatacacgatgcccagatggattactacggaacacggctggcaacatgctccagcgacaggtctgttaaaatctttgacgtgcggaatggcgggcagatcctgatcgctgacttgcggggtcacgagggacctgtctggcaggtggcgtgggcccacccaatgtatggaaatatactggctagctgctcttacgatagaaaggtcataatttggcgggaggagaacgggacttgggagaagagtcacgagcatgccggtcacgattcttcagtgaactccgtctgttgggcaccacacgattacggactgattctggcctgtgggagcagtgacggggcaatcagcttgctgacatacaccggcgaagggcagtgggaggttaagaaaattaataatgctcataccataggttgtaatgccgtgtcttgggctcctgcggtcgtgccaggatcactgattgaccacccttccgggcagaaacctaattacattaagagattcgcctctggagggtgcgacaacttgatcaaactttggaaagaagaggaggatggacaatggaaagaggaacagaagctggaggctcacagcgactgggtgcgcgatgtggcatgggctccttccatcggccttcctaccagtacgatcgcttcatgttctcaggatggtcgcgtgtttatctggacctgcgacgacgcctcctctaacacatggtctccaaaacttctgcataagtttaacgacgtcgtctggcatgtgagctggagcataaccgctaacatccttgccgtatccggcggagacaacaaggtcaccctgtggaaggagagcgtcgatggccagtgggtttgtatttctgacgtcaataagggccagggttccgtctccgctagtgtgactgaggggcagcaaaacgaacagtag

SEQ ID NO: 14856 - DNA, 1347 bp, Artificial Sequence
  Description of Artificial Sequence: Synthetic coding sequence
atgtcctcccgtaagctctcaggccccaagggtaggcggctgtccattcacgtggttacctggaatgtcgcctcagccgcccctccgttggatctatccgacttactgcagctgaacaataggaatctgaatcttgacatctacgttatcggtcttcaggaactaaactccggaataatctccctcctgagcgatgcagccttcaacgattcttggtcttccttcctcatggatgtcctgtctcctctaagcttcatcaaggtgagtcacgtgcgtatgcaaggcattcttctgctggtcttcgcaaagtatcaacatttgccgtatattcaaattctctccaccaaatcaacacctactggcctgttcggatactggggaaacaagggcggtgtcaacatttgtctaaagctgtatgggtattatgtgtctataatcaattgccatctgccccctcatatctctaacaactatcagcgcctggagcactttgatagaatcctggagatgcagaactgtgaaggccgggacatccccaacatcctggaccacgatttaatcatatggttcggggacatgaactttcgtatcgaagatttcggcctgcattttgtgcgggaaagtataaagaatcgctgctatggaggcctgtgggagaaagaccaactctccatagcaaagaagcacgatcccttgcttcgcgagttccaggagggaaggctgttattcccccccacttacaagttcgatagaaattctaacgactatgacactagtgagaaaaaaaggaaacccgcttggacggaccgaatcctatggaggctgaaacgccaaccgtgtgcaggccccgataccccaattccgccagccagtcacttttcgctgtcccttcgggggtactccagtcatatgacatatggaatcagtgaccacaaacccgtgtcagggacctttgatctagagttgaaaccccttgtaagtgcccctttgatcgtactcatgcctgaagacctatggacagtcgaaaatgacatgatggtcagttacagctcgacatcagattttccgagttcaccatgggattggattggtctctacaaagtgggactacgggacgtgaacgactatgtgagctatgcctgggtcggtgactctaaagtgtcctgcagcgacaatctcaaccaggtgtatatagacatcagtaacatccccaccactgaagatgaattcctcttatgctattatagcaattcccttcgctcagtggtgggaattagccgcccctttcagatccccccaggctccttgagggaggacccactgggcgaggctcaaccacaaatatag

SEQ ID NO: 14857 - DNA, 1641 bp, Artificial Sequence
  Description of Artificial Sequence: Synthetic coding sequence
atgggggcttacctatcccagcccaacacagtgaaatgttcaggtgatggcgtgggagcacccaggctacccctgccttacggcttttcggccatgcaaggctggagggtttccatggaggacgctcacaattgtatccccgagctcgacagtgagactgccatgttcagtgtgtatgatggtcatggcggcgaggaggtcgcgctctactgcgctaagtacctgccagatatcattaaagatcaaaaggcctataaggaggggaagctgcagaaagctctcgaggatgcatttttggcaattgacgcaaaacttaccacggaagaagtgatcaaggagctggcacaaatcgctggacggcctacggaggacgaggacgagaaggaaaaggtggccgacgaagacgacgttgacaatgaagaagctgctttattacatgaagaggccactatgaccatcgaagaactcctcactcggtacggccaaaactgccacaagggaccccctcacagcaagagcggcgggggcaccggagaagaacctggatcgcaggggctgaacggcgaagccggccccgaggactcaaccagagagacaccctcgcaggagaacgggccaactgccaaggcgtacacggggttctcaagtaactcagaacggggtacagaggcaggtcaagtgggggaacccggtattcccactggcgaagccgggccatcctgctccagcgcctccgacaaactaccccgggtagcaaagtctaaattctttgaagatagcgaggatgagagcgatgaggcagaggaggaagaagaggatagcgaggaatgttcagaagaagaagatggctacagctcagaggaggccgaaaacgaagaggatgaggatgatacagaagaagcggaagaggatgacgaagaggaggaggaagaaatgatggtccccggtatggagggcaaagaagagcccggctccgactcggggactactgcagtggtagctctcattaggggcaaacagcttattgtggccaatgccggcgattcccgatgtgttgtttctgaggcaggtaaagctcttgatatgagctatgatcacaaaccagaggacgaggttgagttagcacggattaagaatgctggcggcaaagtcaccatggatggcagagtcaatggaggacttaacctgtcaagagctataggggatcacttttataagagaaacaagaatcttcctccggaggaacagatgatttcagcactccctgacattaaggtcttgaccctcaccgacgatcacgagttcatggtaattgcgtgcgacggcatctggaacgtgatgagctctcaggaggtggtcgactttattcaaagtaagataagtcagcgcgacgagaatggagagcttagacttttaagttcaatcgtggaggagctcctggaccagtgcctcgcccccgacacatccggggatggcactggctgtgacaacatgacctgtataatcatctgcttcaaacccaggaacacagctgaactgcagccggagagtggaaaacggaagcttgaagaggtcctgtccacagagggcgcagaggagaatggtaactctgataagaagaagaaggccaaacgtgattag

SEQ ID NO: 14858 - DNA, 3840 bp, Artificial Sequence
  Description of Artificial Sequence: Synthetic coding sequence
atgctgcaggccctgcagctgagaactgggttcttttgttttcgggtcctggtggccctttccccctgtgccctgcacgattctggaaggctgactacaggctcgtttaacgttgtgcgagatgaagaagaggaaattaaactagaaatcaatatgctaaagaagtactctcaccaccgcaacattgccacctattacggcgcattcatcaaaaaatctccaccaggtcatgacgatcaactgtggttagtgatggagttctgcggagcgggatcgatcactgacctagttaagaacactaagggaaacaccctcaaggaagattggatagcctatatcagcagagagatccttcgcggtctggcgcatctccacatccatcacgtgattcacagagacatcaagggacagaacgttctcctgacggagaatgcggaagtgaagctcgttgactttggcgtgagcgcacagctggatcgcacagttggtagacggaatacttttatcggtacaccgtactggatggctcctgaggtcatagcatgtgacgagaaccctgacgcgacctacgactatcggagtgatctctggagttgtggcatcaccgccatcgaaatggccgaaggtgctccccccctctgtgatatgcaccccatgcgggccctgttccttatccctcgaaaccctccgcccaggctaaaaagtaagaagtggagcaagaaatttttctctttcattgagggctgcctggttaaaaattacatgcagcgccccagtaccgaacagttgttgaagcaccccttcatccgcgatcagccaaatgagcggcaagtacgtattcagcttaaagaccatattgatcgaactaggaagaagaggggcgagaaagacgaaaccgagtacgaatacagcggcagcgaagaggaagaagaggaggtcccagaacaggaaggggagccttcgtccattgtgaatgtacccggagagagcaccctgcgccgggatttcttgagactccagcaggagaataaggagaggtcggaggcattacggcggcagcaactgctccaggaacagcagttgcgggagcaagaggaatacaaaagacagctgctagccgaaagacaaaaacgtattgaacagcaaaaggagcagcggcggagactcgaggaacagcagcgaagggagcgagaagcccgtaggcagcaagaaagggaacaaagacggagagagcaggaagaaaaacggaggcttgaagagcttgaacggagaaggaaggaggaagaggagcggagaagagctgaggaggaaaagcgcagggtagaaagggagcaggagtatatcaggcgtcaactcgaggaagaacagagacatttggaagtgctgcaacagcagctgctgcaagaacaggccatgctacttcacgatcataggaggccacaccctcaacattcccagcagcccccccctccacaacaggagcgctctaaacccagctttcatgctcctgagccaaaggcacactacgaacccgccgatcgcgcaagagaggtacagtggtcacacctggcatccctcaagaacaacgtatccccagtgagccggtcacattccttttcagatcccagtcctaaattcgcccaccatcatctcagaagccaggatccctgtcccccaagcagatccgaggtgctctcacagagctccgactcaaaatcggaagcccctgatcccacccagaaggcatggtctaggtctgattctgacgaggttccgccccgagtccccgtgcgcaccacgagcaggtctcctgtgttgtctcgaagagacagccctcttcagggatccggacaacaaaatagccaagccggacagcgcaacagcacttcttcaatagaaccacgtttactatgggaacgcgtagaaaagctggtgccaagacccggctcaggatcgtcttctgggtcatccaattcaggtagtcagcctggctcccatccaggctcccaatccggcagtggcgagaggttcagagtccgctccagcagcaaatccgaagggagccccagtcaaaggcttgagaacgcagtgaaaaagcccgaggataagaaagaagtcttcaggccactgaagcccgcagtgcgtattgacctgacagctctggctaaggaactgagggccgttgaggatgtgcgcccacctcacaaggttaccgactactccagctcttcagaggagagtggcacgaccgatgaggaggatgacgatgtggagcaagagggcgccgacgagtctactagcggcccggaggatacccgcgcagcatccagcctaaacctgtcaaacggggagaccgagtccgtgaagacaatgattgtacacgacgatgtagagagcgagcccgctatgaccccctcaaaagaaggaactcttatcgtaagacagtccactgttgatcagaagagggcctcccaccacgagagcaatggctttgccgggcggattcacctactgccggatctgctgcagcagtcccattccagcagcacatcatccactagttcatcacccagtagctcccagcccacacctaccatgtccccacagacacctcaggataagctgacagccaatgaaacgcaatcagcttcatctacacttcagaagcacaagagttctagctcctttacccccttcatagatcctcgcttactgcagatctctccctcctcaggaacgacagtgacatcagtagttggattttcatgcgacgggatgagaccagaagcaattcggcaagacccaacacgtaagggttccgtagtgaatgtgaatccaaccaacactagaccccagagtgacacgccagaaatccgcaaatataagaagagatttaactccgaaatattatgtgccgctttgtggggtgtgaacctgctcgtgggcacggagtctgggttgatgttgttagacagaagtggccagggcaaggtgtacccacttatcaataggagacgctttcagcagatggatgtgttggagggtctgaacgtgttagtgacgatctccggcaagaaagataagctgcgagtctattacctgtcttggcttcgcaacaagatcttacacaacgaccctgaagttgagaagaaacaaggatggaccactgtaggtgatcttgagggctgcgttcactataaggtggtgaaatacgagaggattaagttcctggtcattgctttgaaaagcagtgttgaagtttatgcatgggcccccaagccgtatcataaatttatggcgtttaagagcttcggagagctcgtccacaagccacttcttgtagatctgactgtcgaggaagggcagaggctgaaggtgatttatggaagttgtgccgggtttcacgccgtggatgttgactcagggtccgtgtatgacatctacctgcctacccatatccagtgctccatcaaacctcacgccataataattctgccaaacaccgacggaatggaacttctagtctgttatgaggacgagggtgtatatgtgaacacgtacggcagaataaccaaggatgtggtgttgcaatggggggagatgcccaccagcgtggcgtatatccgctctaaccagaccatgggatggggagagaaggcaatcgagattaggagtgtcgagactggtcatttagatggtgtatttatgcacaagagggcacagcgcctgaagtttctgtgcgagaggaacgacaaggtcttcttcgcttctgtgaggagcggtggatcttctcaagtttacttcatgacgcttggtcgtacctccctgttgtcttggtag

SEQ ID NO: 14859 - DNA, 1989 bp, Artificial Sequence
  Description of Artificial Sequence: Synthetic coding sequence
atggctagttgtcccgatagcgacaactcatgggtcctggctggcagcgagagtctgcctgtggagaccctgggcccagcttctcggatggaccccgaaagcgaacgcgccctgcaggcaccacactcacccagtaaaaccgacggaaaagaactggccggtaccatggatggagagggcacactgttccagaccgaaagccctcagtccggctccatcctgactgaggagacagaggtgaaagggaccttagagggagatgtctgtggcgtggagccgcccggacctggggatacagttgtgcagggggacttacaagaaaccacagtcgtgacaggactgggtcctgatacccaggacttggagggccagtcgccaccccaaagcctaccatctactcctaaggccgcctggattcgggaggaaggccgttgtagttctagtgacgatgatacggatgtggatatggagggacttcgccgcagaaggggccgtgaagccgggccaccccagcccatggtgccgctggctgtggagaatcaggccggtggcgaaggagcggggggggaattgggtattagcctgaacatgtgcctacttggcgccctggtgttgttaggtttgggggtgcttctgttctcaggcggattgtccgaaagcgagacgggaccgatggaagaggttgaacgccaggtgctgccggatcctgaagtgctggaagccgtgggggaccggcaggacggcctgagggagcagcttcaggcaccagtgccccccgatagcgtgcccagcttgcagaatatgggcctgctgctggataagcttgccaaggaaaatcaggatatacggttgttacaggcacagctgcaggcccagaaggaggaactgcagagcctaatgcatcagcctaagggattagaggaagaaaatgcgcaacttcgaggagccctacagcaaggggaggctttccagagggctctggagtctgagctgcagcagctcagagctaggcttcaaggactcgaggctgattgcgtgaggggaccagatggggtgtgtctttctggtggccgtggcccccagggcgacaaagccatcagagagcagggcccgagagagcaggagccagagctgtcgttcctgaagcagaaagaacagctagaggccgaggcccaggctctcagacaggaattggaacgccagcgacgcctactggggagcgtgcaacaagatctagaacgctcgctccaggatgcatctagaggtgatccagcccatgcaggactggctgagctcggacatcgcctggcgcagaagctacaggggctggaaaattggggacaggacccaggcgtgtcagcaaatgcctccaaggcttggcatcaaaagtcccatttccaaaattcccgagagtggtccggcaaggaaaaatggtgggacggtcaacgggacagaaaggctgaacactggaagcacaagaaggaagagtccggccgcgagcgaaagaagaattgggggggtcaggaagaccgggagccagccggccgctggaaggagggccgaccccgggtggaggagtccggttctaaaaaggaaggtaaaaggcaaggccctaaggaacctccccggaagtcaggttctttccacagctcgggggaaaaacaaaagcagccaaggtggcgcgaggggaccaaggagctgccactgagtccagctttttttggcgaggatggaattttcagacatgaccgtttgcgttttagggatttcgtagacgccctcgaggactctctggaggaggttgccgtccagcaaacgggcgacgatgacgaagtggacgattttgaagactttatcttctctcacttttttggagacaaagccctgaagaagagaagcggaaagaaggataaacacagtcagtccccaagggccgccggcccgcgagaaggccatagtcatagtcaccaccaccatcatcggggctag

SEQ ID NO: 14860 - DNA, 2403 bp, Artificial Sequence
  Description of Artificial Sequence: Synthetic coding sequence
atggtagcacctgtgttagagacctctcacgttttctgctgccccaatagagtgcggggggtacttaattggtcctcgggaccccggggactcctcgcctttggaacaagctgctcagtggtcctctacgatccactcaaacgagtggttgttacaaacctcaatgggcatacggcacgcgtcaattgcatccaatggatttgcaagcaggacggtagtccttcgacagagttggtatccggagggtctgataaccaggtgatccactgggaaatcgaggacaaccagcttctcaaagcggtgcacctgcaggggcatgagggccctgtatacgcagtgcacgccgtttaccagcgcaggactagcgatcctgcactttgtaccttaatcgtctctgctgccgcagattccgcggttcgactttggtctaagaaggggcccgaagttccaattctcgcctgtggaaacgacgactgcaggatccacatatttgcccagcagaatgatcagttccagaaagttttgagcctctgcgggcacgaggactggatcaggggcgtagagtgggctgcttttggccgggacctgttcctggcttcatgtagccaggactgcttgatcagaatctggaagctctatatcaaatcaacgtcccttgagacccaggatgatgataatatcagacttaaagagaacaccttcaccattgagaatgagagtgttaagattgcctttgccgttacattggagacagtgctagctgggcacgagaactgggtcaacgcagtgcattggcagcccgttttctacaaggacggcgtgctccagcaacctgtccgactgctgagcgcctcaatggacaagactatgattctgtgggcccccgacgaagaaagcggtgtgtggctggagcaagtgcgagtaggcgaagttggcggtaacacactgggtttctacgactgtcagtttaatgaggacggttcaatgatcatagcccacgcatttcacggcgccctgcatctctggaaacagaacaccgtgaatccaagagagtggacgccagaaatcgtcatcagcggccactttgatggagtgcaggatctcgtatgggacccagaaggcgagtttattataacagtcggaacagatcagaccacgaggttatttgccccctggaaacgaaaagaccagtcacaggtcacatggcacgagattgcccgcccccagatccacggatacgacctgaagtgtctggctatgatcaatcgctttcagtttgtgtctggggcagacgaaaaggttctgcgggtgttcagcgcccccaggaacttcgtggaaaatttctgtgctattactggacagtccctcaatcatgtgttatgtaaccaggattcagatctgcccgagggggctaccgtgccggccctggggctcagtaacaaggcagtgttccagggtgatatcgcatcccagccctccgatgaagaagaattgttgacctcaaccggatttgaatatcagcaggttgcatttcagcccagtattctaaccgaaccccccacagaggaccacctgttacagaacaccttgtggccggaggttcagaaactctacggacacggctatgagatattctgcgttacttgtaactcctccaagaccctcctggcttcagcctgcaaagctgccaaaaaggaacacgccgcaataatcctttggaataccacgagctggaagcaggttcagaatctagtcttccattcccttacggtgactcagatggcctttagccccaatgaaaagtttctcctcgcagtgtcacgggatcggacctggtctctctggaaaaaacaggatactatcagcccagagtttgagcctgtcttttcactgttcgcttttaccaataaaatcacgtctgttcactccagaatcatttggtcatgtgattggtctcccgattccaagtatttcttcacgggctccagggataaaaaggttgtggtttggggggagtgcgactctacagacgactgtattgagcataatattggaccctgcagttccgtgctcgacgttggcggtgccgttacagccgtgagtgtgtgccccgttctgcatccttcccagaggtacgtcgtcgccgtgggtctggagtgcggtaagatatgcttgtacacctggaagaagactgaccaagttccggagataaacgattggactcattgtgttgagacatcacagagtcagtctcacacactcgccatccgtaaactgtgctggaagaattgcagcgggaagactgaacagaaggaggccgaaggcgctgagtggctacattttgcaagttgcggggaagaccataccgttaaaattcaccgagttaataagtgtgccctatag

SEQ ID NO: 14861 - DNA, 561 bp, Artificial Sequence
  Description of Artificial Sequence: Synthetic coding sequence
atggctggcgaaaattttgcaacgcctttccatggccacgtcggccgtggtgcgttcagcgatgtttacgagccagctgaagacaccttcttattactgaatgctttggaggccgctgccgccgagctcgctggagttgagatctgtctggaagtcgggtccggaagcggcgttgtgagtgccttcctggcgtcaatgatcggtcctcaggccctctatatgtgcactgatatcaatccagaagctgctgcatgtaccctagaaacagcccgctgcaataaggttcacatccaaccagtgattaccgacctcgtggggagccacggaatagaggctgcgtgggctggtggaaaaaacggtagagaggtgatggaccggttttttcctttagttcccgatttactgtcacccaagggtctcttctatttagttactatcaaggagaacaatccagaggagatcctaaagatcatgaagaccaagggcctccagggaacgacagctctcagtcgccaagcgggccaggagactctgtcagtgctcaagtttaccaagtcttag

SEQ ID NO: 14862 - DNA, 2352 bp, Artificial Sequence
  Description of Artificial Sequence: Synthetic coding sequence
atggctaaatataacactgggggaaaccccaccgaagatgtctcagtaaatagcaggccatttcgtgtaaccgggcccaatagcagttccgggatacaggctaggaaaaacctcttcaataaccaggggaacgcttctccaccagccggccccagcaacgtgcctaagttcggcagcccaaaaccccccgtggctgttaaaccatcttcagaggagaagcccgacaaagagcctaaacctccctttctgaaaccaaccggcgccggacagcggtttgggactccggcttccctgaccaccagagacccagaggcaaaggtaggatttctgaagcctgtggggcctaaaccaattaatctcccaaaggaagattcaaagcctactttcccttggccccccggcaacaaacccagtctgcactccgtaaaccaggatcacgatctaaagcccctgggcccaaaatccggcccaaccccaccaaccagcgagaacgaacagaagcaggccttccccaagcttacaggagtgaagggcaaattcatgagtgcatcccaggacctggaaccaaaaccacttttccccaagccggcatttggccagaagccccccctgagcacagaaaacagccatgaagatgagtctccaatgaagaacgtgtcctcatctaaggggtctcctgccccactgggcgtgaggtccaaatcaggtccattaaagccagcacgcgaggactccgaaaacaaggaccatgcaggcgagatcagtagtctgccgttcccaggcgtagttttaaagccagccgcctctaggggaggacccggactatcaaagaacggggaggagaagaaagaggacagaaaaattgacgctgccaagaatactttccagtccaaaatcaaccaggaggagctagcctccggtaccccccccgctcgctttccaaaagcaccatccaagctcacagttggtgggccgtggggccagagtcaggaaaaggagaaaggggacaagaattctgcaacccctaagcaaaaacccttgcctccgctgtttacgttgggccccccaccccctaagcccaacagacccccgaacgtggacttaaccaagtttcataagacaagtagcggaaactccacaagcaagggtcagacatcctatagtacaacaagcttaccaccaccacctccatcgcacccagccagccagccacctttgccagcgtcgcacccctcccaacctccagtgccctcgctgccgccccgcaacatcaagccccctttcgatctgaaaagccctgtgaatgaggataaccaggacggcgtcacacactcagacggtgccggcaacctggacgaggagcaagacagtgagggcgaaacttacgaagatatagaagcatcaaaagagcgcgaaaagaagagggagaaggaggagaaaaaaagactggaactggaaaaaaaggagcagaaggaaaaggagaaaaaagagcaggaaattaagaagaagttcaagctgactggacctatccaagttattcatttggcgaaggcctgttgtgacgtgaaaggagggaagaatgaactatcattcaagcaaggtgaacagatcgaaatcatccggattaccgacaatcccgaaggaaagtggcttggccgcactgcccgtggttcatatggctatattaagacaacagcagtggaaattgactacgatagcctcaagctgaagaaagactcccttggagctccatcccgtcctatcgaagacgatcaagaggtttacgacgacgttgccgagcaagatgacatctcatctcacagtcagtctggctctgggggaattttcccccctccacctgacgacgacatctatgacgggattgaggaagaggacgctgatgacgggtttccggctccgccaaagcagcttgatatgggagacgaagtgtacgatgacgtggacacctccgattttcccgtgagctcagccgaaatgagtcagggcacgaatgtggggaaagctaaaacagaggagaaagatttgaaaaagttgaagaaacaggaaaaggaggagaaagatttcagaaagaaattcaagtacgatggggaaatccgagtgctttatagtacaaaggttactacatcaattacttctaaaaaatggggtacacgcgatctgcaggtaaaacctggagagtccctagaagtcattcagacaacagatgataccaaggtgctatgcagaaacgaagaagggaagtacgggtacgtgctaagaagttatctagccgacaatgatggagaaatctatgatgacattgctgatggctgtatctacgataatgactag

SEQ ID NO: 14863 - DNA, 1722 bp, Artificial Sequence
  Description of Artificial Sequence: Synthetic coding sequence
atgatccctcctcaggaggcctcagcaaggagacgggagattgaagataagttaaagcaggaagaagagacattgtcctttatccgtgacagtctcgagaaatcagatcagctcacaaaaaatatggtgtccatcttgtcctcattcgagagccgcctcatgaagttagagaattccataatccctgtacacaagcagaccgaaaacctgcaaagattgcaggagaatgtcgaaaagaccttatcttgtctggaccacgtaataagttactatcatgtgatatctggcgatgatgatctagaagcccaagaagatgtgaccctcgagcatctccctgaatctgtgctccaagatgtgattcgcatctcccggtggcttgtcgaatatgggaggaaccaggacttcatgaatgtgtattatcaaatcaggtcgagccaattggatcggagcattaaaggactcaaagagcacttccacaagtctagctcgagcagcggagtgccctactcccctgccataccgaacaagcgcaaggacacccctacaaaaaaacccgtgaagaggccaggccgcgacgatatgctggatgtcgagacagacgcatacattcattgtgtgtcagcctttgtcaagttggctcagtccgaataccagctgctggcggacatcattcctgaacaccaccaaaaaaaaacatttgattctctgattcaagacgccctcgatggactcatgctggaaggtgaaaatatagtctcagctgcccggaaagctattgtgcgtcacgacttttcgacagtgctgactgtttttccgatcctgagacacctgaagcagaccaagccagagtttgaccaggtgctacagggaacggccgccagcacgaaaaataagctaccggggttgatcactagtatggagactatcggtgcaaaggctttggaggattttgctgataatattaagaatgaccccgataaagaatacaacatgcccaaggacgggaccgtccacgagctcacctctaatgcaatattgttcctacagcagctactggactttcaagagactgctggcgccatgctggctagccaggagacaagcagtagcgccacgagttattcttccgagttcagtaaacggctgcttagcacctatatctgcaaggtgttgggaaatttgcaattgaatttactaagcaaaagcaaggtgtatgaggatcctgcactctctgcaatatttctacataataactacaattacatactcaaatccctggaaaagtcagagttgatccagctggtcgcagttactcagaagactgccgaacgcagttacagagagcatatagaacagcagatccagacctatcagagatcatggttaaaggtaacggattatatagccgaaaagaatctccccgtgtttcagcccggagtcaagttaagggataaggagaggcagattatcaaggagagattcaaggggtttaatgatggcctggaggagctttgcaagatccagaaggcatgggccataccagataccgagcagcgagatagaatccggcaggcccagaaaactattgtgaaggagacctatggggcctttctccagaagtttgggtccgtacctttcacaaagaatccagaaaaatatataaaatacggcgtagagcaggttggcgatatgattgaccgattgttcgatacttctgcctag

SEQ ID NO: 14864 - DNA, 2475 bp, Artificial Sequence
  Description of Artificial Sequence: Synthetic coding sequence
atgatgcaaaacgtccatctggctccggagaccgatgaagatgatctttatagcgggtataacgactacaatccaatctacgacatagaggaactggaaaatgacgcagctttccagcaggcagttaggacctcccacgggaggcgacctccgataactgccaaaatctcatctacagcagtgacacgcccaatagccactggctatgggtctaaaacctcacttgcatcaagcattggccgccctatgactggtgctatacaggacggggtcacaagacccatgaccgcggtcagggccgccgggtttaccaaggcagcgcttcggggctcagccttcgatcccctctcccagtctcggggccctgcgtccccgctcgaagccaaaaaaaaggactctcccgaggaaaaaatcaaacagttggagaaggaagtgaacgagctagtggaggagagctgcatagccaacagctgtggagatcttaaactggccctggaaaaagctaaggacgcaggcagaaaagagcgcgtgttggttcggcagagagaacaggtgactacccccgagaatattaacttggatctcacctattctgtgctctttaatcttgcttcacagtactcagtgaacgagatgtatgcggaagctctgaatacataccaagtgatcgtgaagaataaaatgtttagcaatgcaggcatcttaaaaatgaacatgggtaacatctatctgaagcagcgaaattactctaaggctattaagttctaccggatggccctggaccaggtgccctcagtgaacaagcagatgcgaatcaagatcatgcagaatattggtgtaactttcatccaagccggtcagtattcggatgctatcaattcctacgagcacatcatgtctatggcccccaacctgaaagccggctacaatctcacaatctgttattttgctatcggagatcgggagaaaatgaaaaaagcctttcaaaaacttatcaccgttcccttagagatcgacgaagataagtatatctccccaagcgatgatcctcacaccaatctagtaactgaagccatcaagaacgaccatctgcggcagatggagcgcgaacgcaaggctatggctgagaaatacataatgacttctgccaaattgatcgctccagtgatagaaacatccttcgctgctgggtatgactggtgcgtggaagtggtcaaggcctcacaatacgttgaactagctaacgatttagaaatcaacaaagcagtcacttacctccgccagaaagattataatcaggccgtggaaatcctgaaggttctggaaaagaaagattcaagggttaagtctgctgcagccactaatctgtcagccctctattacatgggaaaggatttcgcccaagccagctcctacgccgacatagcagtgaacagtgatcggtacaaccctgcagctttgacgaataaagggaatactgtgttcgccaacggcgattatgagaaggctgcagagttctacaaagaggcactgaggaacgactctagttgtaccgaggctttgtacaacattgggctaacatatgaaaaattgaataggctagacgaggctttggattgctttttgaagctgcacgccattcttagaaatagtgccgaggtgctgtatcaaatcgcaaatatttacgaattgatggagaacccaagtcaggccattgaatggctcatgcaggttgtgtccgtcatcccgaccgatccccaggttttgtctaaactgggcgagttgtacgatcgtgaaggggataagagccaggcttttcaatactactacgaaagctacaggtatttcccctgtaatattgaagtgattgagtggttgggagcgtactacatagacacccaattctgggagaaggcaattcaatatttcgagcgggcttcacttatccagcccacccaagtcaagtggcaactgatggtcgcttcttgttttagaaggagtggcaattaccaaaaagccctggatacatacaaagatacacatagaaagtttcctgagaatgtagaatgcttacggtttctcgtccgcctgtgtacagatttaggacttaaggacgcccaggagtatgccagaaaacttaaaagactggagaagatgaaggagatcagagagcagagaattaagtcaggacgcgacggcagcggagggtctagaggaaaaagggaggggtccgcgtcaggtgactctggacagaactacagcgctagctctaagggagaaaggctttctgccaggctcagggctctgccaggtacaaatgaaccgtacgaatcttcctccaataaggagatcgatgccagctatgttgatcctctgggccctcagattgaacgacctaagactgctgccaagaagcgaattgatgaagacgattttgccgacgaagagctgggagacgacctgcttcccgagtag

SEQ ID NO: 14865 - DNA, 2850 bp, Artificial Sequence
  Description of Artificial Sequence: Synthetic coding sequence
atgctgcgcactgcaggacgggacggcctctgcaggttgagcacttatttggaggagctggaggcagtcgaactgaaaaagtttaaactgtatctgggaacggctacagagcttggtgaagggaaaatcccgtgggggagcatggaaaaggcaggccccctcgagatggcacagttgctgatcacccatttcggacccgaggaggcatggcggcttgccttatccactttcgagaggataaatcggaaagatttgtgggagagaggccaaagggaggacctggtgcgggacactccaccaggcgggccaagctccttgggcaaccagagcacctgtctcctggaggtttcactggtcacccctaggaaagacccccaggagacgtacagagactatgtgcggcgtaagtttcgtcttatggaggaccggaatgcacgccttggcgagtgtgtcaacttgtcccatcggtacactcggttactgctcgtgaaggaacacagtaatccaatgcaggttcagcagcaactgctcgacacgggacgcggccacgctagaacggtcggccatcaagcatccccaattaagatcgaaaccctgtttgagcccgacgaggaacggcccgagccgccccggacggttgttatgcaaggggcagccggaattggtaagtccatgctcgctcacaaggtcatgctagattgggcagatggtaaattgtttcagggccgctttgattacctcttctatattaactgccgtgaaatgaaccagtccgccacagagtgcagcatgcaagacctaatcttctcctgctggccagaaccaagtgctccactgcaagagctcatacgtgttcctgaaagactgctgtttatcatcgatggcttcgatgagctgaaacccagcttccatgacccgcagggtccttggtgtctgtgttgggaagaaaaacggcccaccgagctgttactgaatagtctcattagaaagaaacttctacccgagctttccctgctaattacaacccgccctacggcgttagagaagctgcaccgcctcctcgaacaccctcgacatgtggagattcttggattttcagaagctgagcggaaggagtacttctacaagtacttccacaatgccgaacaggcaggccaagttttcaactatgtgcgagataatgagcccctcttcacgatgtgcttcgtcccactggtctgttgggttgtgtgtacctgcctacagcagcagctcgaggggggcggattgcttcgacagacgtctagaaccaccactgccgtctatatgctctacctgctgtccctgatgcaaccaaagccaggtgccccccgactccagccaccccccaatcagagggggctgtgtagcttagctgccgatggtctgtggaaccagaagatcttgttcgaagagcaggatctacgtaaacatggactagacggcgaagacgtctcagcctttctcaacatgaatatcttccagaaggatatcaattgtgagcggtattattctttcatccacctgagcttccaggagttctttgccgctatgtattacatcctggatgagggagagggcggggccggccctgatcaggacgtcacaagactgcttacggaatatgccttttctgagagaagcttcctggcccttacaagccgctttttatttggattactcaacgaagaaacacggtcacacctggaaaaatccctgtgttggaaggtctccccacatattaaaatggacttactgcagtggattcaaagcaaggcccagtcggacggcagcaccttgcaacaggggtcactcgagttctttagttgtttatatgagatacaggaagaagaattcatccagcaggccttgtcacacttccaggtaatcgtggtgtctaacattgccagtaaaatggagcacatggtctcttctttctgtctcaaaagatgccgttccgctcaggtcctacacctatatggagccacttattctgcggacggagaagaccgtgcaaggtgttctgccggcgcccacacgctcctagtgcagcttcctgaacggacggtactattagatgcctattccgagcacctggcagcagctctgtgtaccaaccctaaccttatagaactttctttataccgtaatgcgctcggaagcaggggtgtcaaactcctctgccagggtctgcgccacccaaactgcaaactccagaacctgcgcttgaaacgttgcaggataagctccagtgcgtgtgaggacttgagcgccgctctcattgctaacaagaacctaaccaggatggacctgtcaggaaatggggtaggattccctggcatgatgctgttatgcgagggcctaagacacccgcagtgccgcctgcagatgatccagctgcgcaagtgccaacttgagtctggggcctgtcaggagatggcctctgtgctgggcaccaacccccatctggtcgagctcgacctaaccgggaacgcgctggaggatctcggtctgcggctcctgtgccagggtctccgccaccccgtctgtcggctccgaacactgtggctccaactggactcctgcggactgactgccaaggcttgcgagaacctgtactttaccctgggcatcaaccagaccctgactgatctgtacctgacaaacaatgcactgggtgacaccggggtgcggctgctgtgtaagcggctctctcaccctggttgtaagctgcgcgtgctctggctgtttggcatggacctgaacaagatgactcactccaggcttgccgccctgcgggttacaaaaccatacctggacattggctgttag

SEQ ID NO: 14866 - DNA, 5796 bp, Artificial Sequence
  Description of Artificial Sequence: Synthetic coding sequence
atggccgcgcgatcagccccgagctgtcacctgcgtctggagtgggtctacggataccgcggccaccaatgccggaacaatttgtactataccgcagccaaagagatagtgtatttcgtcgccggcgtcggcgttgtctattctccccgagagcaccgtcaaaagttctacagaggccactctgatgacattataagcctggcattacatccggagcgagtgcttgtagccaccggccaggtgggcaaggagccatacatctgcatctgggactcttacaccgtccagactatttcagtattgaaggacgtgcacacacacgggatcgcttgcctcgccttcgacctcgacgggcagcgcttggttagtgtcggcctggattctaaaaatgctgtgtgcgtgtgggattggaagcgcggcaaaatgctatcaatggctcccggtcataccgataggattttcgatattagttgggatctttaccagcccaacaagcttgtcagttgcggggtcaaacatattaaattctggagcttgtgtgggaacgccctgacacccaagagaggggtgttcggaaagaccggagatctccagacaattctgtgcctggcatgcgccagggacgagctcacctactccggggccttgaacggggatatttacgtttggaaagggattaacctgatccggacaatccagggtgcgcacgcagctggtattttcagcatgaacgcatgtgaggagggcttcgccaccgggggacgagacgggtgtattagactctgggatctgacatttaagcccataacagtcatcgatctccgggaaaccgatcaaggatacaagggcctgtccgtgcgctccgtttgctggcgaggcgaccacatcctggtgggaacccaggactccgagatcttcgagatcgtcgtgcaggagcgcaataagcccttcttaatcatgcagggtcattgtgagggggagctatgggcactggccgtgcaccccacaaaacctctggctgttacaggttcggacgaccgatccgtaagaatctggagccttgtggaccatgccctcattgcaaggtgcaacatggaggagccaatccggtgcgctgcagtgaacgccgatgggatccatttagctctgggaatgaaggacgggagttttacagtcctacgggtacgagacatgacagaagttgtacacataaaagaccgcaaagaagcaattcacgaattgaaatatagtcccgatggaacttacttggctgttggctgtaacgactcaagcgtggacatttacggggtcgctcaacgatacaagaaagtcggagagtgcctgggttctctgagcttcatcacacatctcgattggtccagcgatagcagatacctacagaccaacgacggcaatggtaagcggcttttctacaggatgcccggtggaaaagaggttacatccaccgaggaaattaagggagtccactgggccagttggacttgcgtgtctggtttagaggtaaacggtatctggcctaaatacagcgacatcaacgatattaattcggtggatgggaattacatcggccaggtgctggtaacggctgacgattatgggatcatcaagctcttcagatatccgtgtttgaggaagggggccaagttccgcaagtacatcgggcactcggctcacgttacaaacgtacgttggtctcacgactaccaatgggtgatatcaatagggggcgcagatcacagtgtttttcagtggaagttcatcccagaacggaagctaaaggatgctgtgcatattgcaccacaggaaagcctggccgatagccacagcgacgaatctgacagcgacttatccgatgtcccagaactggattctgaaatcgaacaggagacgcagctgacttatagacgccaagtctacaaggaagacttgcctcagttgaaagagcagtgtaaagagaaacaaaagagtgctactagcaagcgcagagagcgggcgcctgggaactctatccgcctccacttcgtgcatggctatcgggggtatgattgccgctctaacctgttttatacccaaatcggcgagatcgtttaccatgtggctgccgtcggagttatatataaccgtcaacagaacacacagcgattttacctgggtcacgacgacgacatcctctgtttgacaattcacccattgaaagattacgttgccaccggacaggtggggagggatccatcgattcacatctgggatacggagaccattaaacctctcagtatcctcaagggccatcaccagtacggggtgagcgcagtcgatttcagcgcagacggtaagagactggcaagtgtgggcattgatgattctcacacggtcgtcctgtgggactggaaaaaaggggaaaaactgtctattgccaggggatcaaaggataaaatttttgtggttaagatgaacccctatgtgcctgataagttgataactgctgggatcaagcacatgaaattttggcgcaaggctggggacgtctgcatatggagagacattttcctcgtgaaaactgtgaaagcccatgatgggcccgtgttctcaatgcacgctctggaaaaagggtttgtgacaggaggcaaggatgggatagttgccctttgggatgacagcttcgagcgatgtttgaagacctacgctattaaaagagctgcgctggcccccggctcaaagggcctcctcctcgaagataacccatctatccgcgccatatctctgggccacgggcacatcctcgtgggtacaaaaaacggtgagatcctggaggttgataagtctgggcctattactttgttagtccagggacatatggagggagaagtgtggggcctcgcgacccacccctatttacctatctgtgcaacagtctccgacgacaaaacgctccgcatttgggacttgtccccatctcattgtatgctcgcggtgagaaagctcaagaagggcggcagatgttgttgtttcagtcctgatgggaaggcattagcagtgggcctgaatgacggatccttcctcatggctaatgctgacacactagaagacctagtgagtttccaccatagaaaggacatgatctctgatatccgcttctcacccggtagtggtaaatacctcgccgtggcgtctcatgactcatttattgacatttataatgtgatgagctctaaacgggtagggatctgcaagggggctacttcctatattacccacattgattgggacattcgaggcaaactcctgcaggtgaataccggtgccaaagagcagttgttctttgaggcaccccggggcaaaaaacagaccattccgtcagtcgaagtcgagaagattgcctgggcttcttggacatctgtcctcggcctatgctgcgagggcatttggcctgttattggggaggtgaccgatgtgaccgcctcttgcctaacatccgacaaaatggtactggccaccggcgacgacctcggcttcgtgaaactgtttaggtacccaaccaaaggaaagttcggaaagttcaagcgctacgtggcgcacagcacgcacgtgaccaatgtgaggtggacctatgacgattccatgctggtaaccctgggaggcacagatatgtcactcatggtttggactaacgagatggagggataccgcgagaaaaggccatgtgactccgaggagagtgatatcgattctgaagaagatgggggttacgatagcgacgtgactcgtgaaaatgagatcagctacacaataagagccctcagtacaaacattaggccgatgttgggcattaaaccacacctgcagcagaaagagcccagcatcgatgagagaccccctgtaagccgcgcgcctcctcagccggagaaattacaaacaaacaacgtcggcaagaagaaacgaccgatcgaggacctcgtccttgagctgatattcggctaccgaggccgtgattgcaggaacaacgtgcattatttgaatgacggggacgatatcatttaccatacagcatctgtcggaatcttgcataacgtggcgactgggtcccagagcttctaccaggaacacaatgatgatatcctatgcctcacggtgaaccagcacccaaagtttatcaacatcgtggcaaccggccaggtggtactgagctgcagcctgctgacaacagctccgtccatacacatctgggacgctatgaacaagcagaccttaagcatattgcgctgttaccactccaaaggagtgtgttccgtgtccttcagtgcaacaggcaagctgttgctgagtgtcggtcttgatccagagcatactattacaatctggaggtggcaagaaggggcaaaaatcgcttccagggctggtcacaaccagcgtatattcgtggcggaattccggcccgactcagacacgcagtttgtgtccgtcggagtgaaacatgtgaagttttggacgctcgctggcagggccctcctgtctaaaaaagggttgctgtccacactggaagatgctcgtatgcaaacaatgcttgccatcgcgtttggggccaacaacttaactttcactggaacaatttcaggcgacgtgtgcgtgtggaaggatcacattctctgcagaattgtagcacgcgctcacaacggacctgtcttcgccatgtacaccacccttcgggacggtttgatcgttactggtggcaaggagcgacccagtaaggagggaggtgccgtgaagctatgggatcaagagcttagacgttgccgggctttcaggctcgaaacaggccaggcgacggattgcgttagatctgtgtgtcgggggaaggggaagatactggttggcacaaggaacgccgagattatagaagtcggagagaagaacgcggcgtgcaatatccttgtcaacggtcatgttgacggaccaatatggggtctggccactcatccatccagagacttcttcctgtcagctgctgaggatggtacagtgcggttatgggacatcgcagacaaaaaaatgctaaataaggtgaatctgggacacgcggcccgcaccgtttgctattcgcccgaaggcgacatggtggctattggtatgaagaacggtgaattcattattctgctggtctcaagcctgaaaatctggggaaaaaaaagagatcgcaggtgcgcaattcatgatatccgtttttcccctgatagccgttatctcgccgtgggttcatcagagaatagcgtggacttttacgatctcaccttagggcccaccctgaacagaatcagctattgtaaggatatacccagcttcgtgatacagatggatttcagtgccgattccagttacctgcaggtgtcttccggttgctacaagaggcatgtgtatgaggttccctctggtaaacatctcatggaccacgccgccatcgatcgcatcacctgggctacctggacgagcatcctgggcgatgaggtcctgggcatctggagccggcatgcggaaaaggcagatgtgaactgtgcatgcgttagtcatagtgggatatctctcgtaactggggatgactttggaatggtgaagctgttcgactttccatgcccggaaaaatttgccaaacacaagcggttcctcggccatagtccacatgttactaacatccgctttacatccggggacagacacgttgtaagcgccggaggcgacgattgtagtcttttcgtatggaagtgcgtccatactccccactag

SEQ ID NO: 14867 - DNA, 429 bp, Artificial Sequence
  Description of Artificial Sequence: Synthetic coding sequence
atgagtatctctagcgacgaagtgaatttcctggtgtatcggtacctgcaagagtcagggttttctcatagcgcatttacgttcgggattgagtcacacataagccaaagtaacatcaacggagcattagtgcctccagccgcccttatctctattattcaaaagggcttacagtacgttgaagcagaggtgtccatcaacgaggatggaacactctttgatggaaggcctatcgagagcttgtccctaatagacgccgtgatgccagatgttgtacaaactcgacaacaggcctatagagataagcttgcccaacagcaggcggccgctgctgcggccgccgcagccgccgcaagccagcaggggagcgctaaaaatggggagaataccgctaatggagaggagaacggggcgcatacgatcgcctag

SEQ ID NO: 14868 - DNA, 1704 bp, Artificial Sequence
  Description of Artificial Sequence: Synthetic coding sequence
atggaattcttcacaatgccaccccggacatggttcatgcgccaactgcagcgaatgtggttcctccgtccaagcatggcaatcatggtctttcgcatgatcgaagaaaggccaacccacgcaatcactgtacgggtctcatacttagaaatatataatgaaagcctcttcgatctgctgagtacacttccttatgtgggtcccagtgtaaccccgatgacgatcgttgaaaacccccagggggtgtttattaaaggcctgagtgtccatctgacttctcaggaagaagatgcattttcactcctctttgaaggggagaccaatcgtataattgcttctcataccatgaacaaaaatagctccagatcgcactgcatattcaccatttacctggaagcccactctcggacgctgagtgaggaaaagtacattacctccaagattaacctagtggacttggctggctctgaacgcttaggaaagtctggaagcgagggccaggtcctgaaggaagccacttacatcaacaagagtctgtcttttctggagcaggctataattgctctgggcgaccagaaacgggatcacatcccatttcgtcaatgcaagctgacccacgctctcaaagactccttaggaggaaattgtaacatggtgttagtgacgaacatttatggtgaggcagcgcagctcgaggagactctcagcagtctgagatttgcgtccaggatgaagttggtcactactgaaccagccataaatgagaaatatgacgccgagaggatggttaaaaacctagagaaagagctcgctctacttaagcaggaactggctatccacgactcactaaccaaccggacattcgttacctatgacccaatggatgagatccagattgccgagatcaactcccaggtgcggagatatcttgaggggactctggacgagatcgatataatttcactgaggcaaatcaaggaagtttttaaccagttccgtgtggtcttgagccaacaggagcaggaggtcgaaagtacactgaggagaaagtatacacttatagataggaatgacttcgccgctatttctgccatccagaaggcgggtcttgttgacgtggatgggcacctcgtgggagagcccgagggacaaaatttcgggttgggtgtggcccccttctccacaaaacccggcaaaaaggcgaagtcaaaaaaaacctttaaggagccactccgtcccgacactcctccatcaaagcccgtcgcattcgaagagttcaaaaacgaacaaggaagcgaaataaatagaatctttaaggaaaataagtctatccttaatgaacgtcggaaaagggcctctgaaacaacacagcatattaatgctattaaacgggagatcgatgtgactaaggaggcacttaatttccagaaatctcttcgcgagaaacagggcaaatatgagaataaaggtctgatgattatcgatgaggaggagttcttgcttatcctgaaactgaaggacctgaagaagcaatataggagtgagtaccaggatttgcgagacctccgagccgagattcagtactgccaacacttggtggatcagtgtcggcatcgactcctgatgggagctacagtcggaaagaacctgaccagcggtacaatgtccccactctctagcttgcgtacctgccgctggcactag

SEQ ID NO: 14869 - DNA, 1428 bp, Artificial Sequence
  Description of Artificial Sequence: Synthetic coding sequence
atggcagagggcagtgtaatgtttagcgatgtgagtatcgatttctcacaggaagagtgggattgtctggatcccgtccagagggatctctaccgggacgtcatgttggaaaattacggaaaccttgtatccatgggactgtatacaccaaaaccacaggtgatttccctactggagcagggaaaggaaccctggatggtggggagagaattgacacgcggactttgtagcgatctagaatcaatgtgtgagacaaagctccttagcctaaaaaaagaagtttacgagatagagctgtgccagagagaaataatgggattaaccaagcacggacttgaatatagttctttcggggacgtattagaatatagaagccatctagctaagcagttagggtatcctaatggccacttctcccaggagatcttcacccccgagtacatgcccactttcattcagcagaccttcctgaccctgcaccagatcattaacaatgaagacaggccatatgagtgtaaaaagtgcgggaaagcctttagtcagaactctcagtttatacagcaccagaggatccacatcggcgaaaagagttacgaatgtaaagagtgcgggaagttcttttcttgcgggtctcacgtgacaaggcatctgaaaattcatactggcgagaaacctttcgagtgcaaggagtgtggcaaggccttctcttgttcatcgtatcttagtcaacatcagaggatccatacaggtaaaaagccttacgaatgtaaagagtgtggaaaggcgttcagctattgctctaacttaatagatcatcagaggattcacacgggagaaaaaccatatgaatgtaaggtgtgcggcaaagcatttactaagtcatctcaactttttcagcacgctcgaattcatacaggcgagaagccctatgagtgtaaggaatgtgggaaggcttttacacagtccagcaagttggtgcaacaccagcgtatccacaccggagaaaagccctatgaatgtaaggaatgcggaaaggcttttagcagcggatcagcactgacaaaccatcagcgaatccacacaggtgaaaaaccctatgactgcaaagaatgcggtaaggcctttacacaatcatcccaactgaggcagcatcagaggatacacgccggtgaaaagcctttcgagtgtttagaatgcggcaaagctttcacccagaatagtcagctgttccagcaccagagaattcacaccgatgagaagccttacgagtgcaacgagtgcggcaaagcattcaataaatgtagtaatttgacgagacacctgcggatccacaccggggagaagccttacaactgcaaggagtgtggcaaagccttctcaagtggcagcgacttgataagacatcagggcatacatacaaacaagtag

SEQ ID NO: 14870 - DNA, 462 bp, Artificial Sequence
  Description of Artificial Sequence: Synthetic coding sequence
atggccagaaatacattgtctagtagattccggcgcgttgacatcgatgagttcgatgagaataagtttgtggacgagcaggaggaggctgccgccgccgcagcggagcctggacccgacccatcggaagtggatggcctgctgagacagggagatatgctcagggccttccatgctgcactgcggaattcccccgtgaataccaaaaatcaggccgtcaaagaaagagcccagggagtggtgttgaaagttctaactaatttcaaatcttccgaaatcgagcaagccgtccagtctttagaccgaaacggcgtggacctactcatgaagtatatatataaagggttcgaaaagcccacagagaactcgtctgctgtgttattgcagtggcacgagaaggcactggcggtaggggggctaggcagtattatccgcgttcttactgcacgcaaaaccgtgtag

SEQ ID NO: 14871 - DNA, 2616 bp, Artificial Sequence
  Description of Artificial Sequence: Synthetic coding sequence
atgggagagggcggcttgcctcctgccttccagctgctgctcagagcatgcgaccagggcgatacagaaaccgcaaggaggctgctggaacctggggccgctgaacccgccgagcgtggagcagagcccgaagctggcgctgaacctgcaggcgccgaagtcgctggtcccggggctgccgcagcaggcgcagtaggtgcccccgtgcctgtggactgtagcgatgaagccggaaacaccgctcttcaatttgccgccgccggagggcatgaacccctcgtccgattcctgctcagacgcggagcatcagtgaactcgcgaaatcactacgggtggagtgccttgatgcaagctgcccggttcgggcacgtcagtgtcgcccacctgttactggatcatggtgcggacgtcaacgcacagaaccggcttggagctagtgtgctgacggtcgcctctcgaggagggcacctcggcgtagtgaagctgctgctggaggcgggtgctttcgttgaccaccaccatccatctggggaacaactgggcttgggaggctctcgggacgaaccccttgacatcaccgctctcatggctgccatccagcatggccacgaagctgtggtgcgtctgctcatggagtggggggcagatcccaaccatgccgcccggaccgtgggctggtcacccctgatgctggccgcgcttacgggccggcttggggtggcccagcagctcgtggaaaaaggggccaaccctgatcatttgtccgtcctggagaaaactgcctttgaggtggcactggattgtaagcatcgggacctcgtggactacctggatcccctcacaaccgtcaggccaaagactgacgaggagaaaagacgccctgacatttttcacgccctgaaaatggggaattttcagctggttaaagaaattgcagacgaagacccgagtcacgttaacctcgtgaacggggatggcgccaccccattgatgctggccgctgtgactggtcaactcgcactggtccaactgctcgtggagagacacgccgatgtggacaaacaggactccgttcatggatggacagcacttatgcaggctacctatcatgggaataaggagatcgtgaaatacctgctgaatcagggcgccgatgtgacactgagagccaagaatgggtatactgcatttgatcttgttatgctgttaaatgatccagacacagagctggtacgcctccttgcctccgtgtgtatgcaggtgaataaggacaaaggtagacccagtcatcagccgcctctgccacattcaaaagttcgacaaccttggagcatcccagtactccctgatgacaaggggggactgaaatcctggtggaatagaatgagtaatcggttccgcaaattgaaactcatgcaaaccctccctagagggctctcctctaatcagcccttgcctttttcggatgaacctgaaccggcccttgatagcactatgagggcggcaccacaggacaaaacttcccgctctgccctcccagatgctgctcccgtcaccaaagacaatggtcctggcagtacaaggggggagaaagaagacactctccttacgactatgctgagaaacggagcgcccctgacaaggctgccttccgacaagctgaaagccgtgatccctccatttctgccacccagcagctttgaactgtggagctccgaccgttcaaggactcggcataacggtaaagcagatccaatgaaaactgccctgccccagagagcttcacggggtcaccctgttggaggcggtgggacagatacgaccccggtgcggccagtgaaattcccgtccctccccagatcacccgcttcgagcgcaaattcaggcaactttaaccactcacctcactcctcaggcggatcctcaggagtaggcgtatccaggcacggaggggaactcctgaatagaagcggaggcagtattgataacgtgctgtctcagatcgcggctcagaggaaaaaagctgcaggactactagagcagaaaccatcgcaccgctcttcccccgtgggacccgcacctggatctagtccttcagaactgccagcgagtcccgcaggcgggtctgcccccgtaggaaaaaagctggaaacttcgaaacgtccccccagcggcacgtccacaacctccaagagcacctccccaactcttacaccgagtccgtccccaaagggacacaccgctgaatccagtgtcagtagtagcagctctcaccgtcaaagcaagtcatctggaggtagcagctccggcacaattacagacgaagatgagctgactggtattctgaagaaactgtctctcgagaagtaccagccgatcttcgaagaacaggaagtcgacatggaggcctttctcacacttaccgacggtgacctgaaagagctagggatcaaaacagatggctccagacaacagatccttgcagctatttctgagctgaacgctggcaagggtagagaacgtcagatattgcaggaaaccatccataatttccattctagctttgagtccagcgcctcaaacaccagggcaccaggaaacagcccatgtgcttag

SEQ ID NO: 14872 - DNA, 1359 bp, Artificial Sequence
  Description of Artificial Sequence: Synthetic coding sequence
atgtccgcaagcctaaattataagagcttctccaaggaacagcaaacaatggataatctggagaaacaactgatttgtcctatatgcttggagatgtttactaagcccgtggttatacttccttgtcagcataatctgtgccgaaaatgtgcttccgacatcttccaggcaagtaatccatacttgcccacacgaggcggaaccaccatggctagcggtgggagattcaggtgtccttcatgtagacatgaagtagtgctcgaccgacacggtgtttatggactgcagagaaacctcctcgtggaaaacatcatcgatatctacaaacaggaatctacccgtcctgaaaagaagagcgatcagccgatgtgcgaggagcacgaggaggagcgtataaatatctattgcctaaattgcgaagtgcccacatgttccctatgcaaagtgtttggcgcccacaaagattgccaagtcgctcctcttactcatgtgttccagagacagaaatctgaactcagcgatggtatcgcaattctggtcggctcgaacgacagggtccagggtgtgattagccagctggaggacacctgcaagactattgaggagtgttgccgtaagcaaaagcaggaactgtgcgaaaagtttgactatctgtatggcattctggaggagaggaagaacgagatgacacaggtgatcacacgaacccaggaagagaagctcgagcatgtccgggccctgatcaaaaagtactctgaccatctggagaatgtgagcaaacttgtagaaagtgggatccaatttatggacgaacccgaaatggcagtgtttcttcagaatgccaaaacgctgttgaaaaagatttctgaagcttctaaagcttttcagatggaaaaaatagagcacggttacgaaaacatgaaccatttcaccgtcaacttgaatcgcgaagagaagattattcgcgagatagacttctatcgtgaggacgaagacgaagaggaagaggagggaggggaaggagagaaggagggtgaaggcgaagtgggcggtgaggccgtggaggtggaagaggttgaaaacgtccagacagaattcccgggcgaagacgaaaatccagagaaggcctccgaattgtcacaggtcgaactgcaggcggctcccggggccctgcccgtctcgagccccgaaccacccccggccctccctccagcagctgacgccccggtgacccaaatcggctttgaggctcccccccttcagggccaagcggccgccccagctagcggaagtggcgccgactcagaacccgctcggcatatttttagcttcagttggctgaattcattgaatgagtag

SEQ ID NO: 14873 - DNA, 492 bp, Artificial Sequence
  Description of Artificial Sequence: Synthetic coding sequence
atgccgtcaatcaagctccagagttccgacggcgagatattcgaagtggatgtggagatcgccaagcagtcagtcaccattaagactatgttggaggacctgggcatggatgatgagggagatgacgatcccgtgcctttgcctaacgtgaatgctgccattctgaagaaggtgatccagtggtgtacccatcataaagacgaccctccacctcccgaggatgatgagaataaagagaagagaacggatgatatacccgtgtgggaccaggagtttctgaaagtggaccagggaacattattcgagctgatcctggccgctaactacctggacattaaggggctgcttgacgtcacctgcaaaactgttgccaatatgatcaagggtaaaactccggaagagatccgcaaaaccttcaacattaagaatgacttcaccgaggaggaggaggcccaggtccggaaagagaatcaatggtgtgaagagaagtag

SEQ ID NO: 14874 - DNA, 1200 bp, Artificial Sequence
  Description of Artificial Sequence: Synthetic coding sequence
atggcagcaccctctccttcaggaggaggaggctcaggaggcggctccggatccggcactcccggcccagtgggctcccctgctcctggccatcctgcagttagttctatgcagggaaaacgaaaggcactgaagctcaattttgctaaccctccattcaagtccaccgcccgattcacacttaacccaaaccctaccggtgtccaaaaccctcatatcgaacggttgaggacacacagtatcgagagctcaggcaaactcaagatctctccagagcagcactgggattttaccgcagaggacttgaaggatctgggcgaaatcggacgcggggcttatgggtccgtcaacaaaatggtgcacaaaccttccggccaaatcatggcagtgaagcgaatcaggtcaaccgtggatgaaaaggagcaaaagcagctgcttatggatctcgatgtagtgatgagatccagcgattgcccatatatcgtacagttttacggcgccctgtttcgcgaaggggattgctggatttgtatggagctaatgagcacctctttcgataaattctataagtatgtgtacagcgttctggacgacgtcatcccagaagagattctcgggaagatcacccttgccacagtgaaagcactcaatcatctgaaagagaatctcaaaatcattcatagggacatcaaaccctccaatattctcctggatcgaagcgggaacattaagctctgtgatttcggcatatcaggccagctggtagactcaatcgcaaagactcgggatgccgggtgcagaccatatatggcgcctgaacgcattgaccccagcgccagtcgtcagggctacgacgtccgctccgatgtctggtctcttgggatcaccctgtatgaactggccacagggaggtttccgtatcccaaatggaattccgtcttcgaccaactgactcaagtggtgaagggcgatccacctcagctctcgaactcagaggagagagagttctcgccctctttcattaactttgtcaacctgtgcctgactaaggacgagagcaaacgcccgaagtataaggaacttctgaaacatccctttatactcatgtacgaagaaagagccgtcgaagtcgcctgttacgtttgtaagatcctggatcagatgcctgccacaccttcatcacccatgtatgtggactag

SEQ ID NO: 14875 - DNA, 1122 bp, Artificial Sequence
  Description of Artificial Sequence: Synthetic coding sequence
atggcccaggagagccccaaaaactcagccgctgaaatccccgtgacctccaacggtgaagtggatgattcgcgcgaacacagctttaatagagatctgaagcattcactgccttcgggactgggcttgtctgagactcaaattaccagccatgggtttgacaacaccaaggagggggtgatagaggccggggcctttcagggttcccccgctcctcctctcccatcagtgatgagtccaagccgcgtggctgcctccaggttggcgcagcagggctctgatctgattgtgccagccgggggccagcgcactcaaaccaaatccggtcccgtcatcctggcagatgagataaaaaaccctgccatggagaagctcgagctagtccggaaatggtcactaaatacatacaagtgtactcgccagatcattagcgagaagcttggcagaggcagccggacagttgatctggagctcgaagcgcagatagacatattgcgcgataacaagaagaagtatgagaatatcctcaaattagctcagaccttatctacccagctcttccaaatggtgcatacacagagacagcttggggacgccttcgctgacttgagtcttaagtccttagagctccacgaagaatttggatacaatgccgatactcagaaactgcttgcaaagaacggtgagaccctccttggggctataaatttctttattgcctctgttaacactttggtaaacaaaacaatagaagacacactgatgacagtgaagcagtacgaatcagcccgcattgaatacgatgcctaccgcactgacttggaagagctgaatcttggtcctcgggacgcaaatacactccccaagattgagcaaagccagcatctgttccaggcccacaaagaaaagtacgataaaatgagaaatgatgtgtccgtcaagctgaagtttctcgaagagaacaaggtaaaggttttacacaatcaactggttctgttccataacgcaattgccgcatattttgcaggaaaccagaaacagttagagcagacactgaaacagtttcacattaaactgaaaacacctggagtagacgctccctcctggttggaagaacagtag

SEQ ID NO: 14876 - DNA, 654 bp, Artificial Sequence
  Description of Artificial Sequence: Synthetic coding sequence
atgtactctctgaaccaggagatcaaggcattcagcaggaacaatctgcgcaaacagtgcacaagggttacaacgttgacgggtaagaagatcattgaaacctggaaggacgcaagaatccatgtggtggaggaggtagagccctctagcggcggaggatgcgggtatgtgcaggatctgtcatcagatctgcaggtgggcgtgataaagccttggcttttgcttgggagccaagacgctgcccacgatttagacacattaaaaaagaataaggtgacgcatatcctgaacgtggcatacggcgttgagaatgctttcctcagcgatttcacctacaagtcaatctcaatcctggatctacctgagacaaacatactctcctactttcccgagtgtttcgagttcatcgaggaggcaaaacgcaaggacggcgttgtgctcgtgcattgcaatgccggagtttcccgtgcagctgcgatcgtcatcggtttcctcatgaactcggagcaaactagctttacctccgcattttcactcgtgaaaaatgcacgaccctcgatttgtccaaacagtgggttcatggagcaactgcgaacataccaagagggaaaggaatccaacaaatgtgaccggatccaagaaaattccagttag

SEQ ID NO: 14877 - DNA, 2679 bp, Artificial Sequence
  Description of Artificial Sequence: Synthetic coding sequence
atgctgcgcaccgccggcagggacggtctgtgtaggctgagcacttacctggaggaactggaggcagttgagttgaaaaaatttaaactgtacctcgggaccgccactgagctgggagaaggcaaaatcccttggggaagcatggaaaaggccggccccctggaaatggcccaactgctgatcacccacttcggtcctgaagaggcttggaggcttgcattgagcaccttcgagcgtattaatcgaaaagatctgtgggagagaggtcagcgagaagacctcgttcgcgatacgccccccggcggtccgtcatccttgggcaatcaaagcacctgtcttctcgaagtctccttagtcactccacgcaaagatccccaggaaacgtacagggactacgtgcggagaaagtttcgtttaatggaagatcggaacgccaggttaggcgagtgtgtgaacttgagccacagatacacaaggctcttgctggtaaaggaacacagtaaccctatgcaggtgcaacagcagctgctcgataccggtcgcggccatgccaggaccgtcggccaccaggctagccccatcaaaatcgagaccctgtttgaaccagacgaggagagacctgagcccccaagaaccgtagtgatgcagggagctgccggcatcgggaaatctatgctggcacacaaagtgatgctggattgggccgacgggaagctttttcagggccgcttcgactacctattttacatcaattgccgagagatgaatcagagcgctacagaatgcagtatgcaggatctgattttttcatgttggcctgagcccagcgcccctctgcaggagctcattagagtgccagaacggttacttttcattattgacggattcgatgaactgaagccgtcctttcacgacccacagggaccctggtgtctatgctgggaagaaaaaaggcccaccgagctcctgctgaatagcctgatccgaaaaaaactgctgccagaactgagcctgctcatcacaacaagacctacggcactggaaaagctccaccgattgcttgagcatcctagacacgtagaaattttggggttctcagaagcagagaggaaggagtatttttacaagtatttccacaatgcggagcaggcaggtcaggtgttcaactatgtacgcgataacgagccattattcaccatgtgcttcgtccctttggtgtgctgggtcgtgtgcacctgcttacaacagcagctcgaaggtgggggcctccttcggcaaaccagccgtacaaccaccgcagtgtatatgctctacctgctcagtctgatgcaaccgaaacctggtgctcccagactccagcccccaccgaaccagcgtggtctctgcagccttgcagcagatgggttatggaaccagaagattctgttcgaggaacaagacctgcggaaacatggcctagacggggaagacgtgagtgccttcttaaacatgaacatttttcagaaagacattaactgcgagaggtactacagttttatccacctcagcttccaagagttttttgccgcaatgtattatatactggatgaaggggaggggggcgccggaccagaccaggatgtgacacggcttttgaccgagtacgcattcagcgaaagatcatttctcgcacttacctctaggttcctgttcgggctgctgaatgaagaaacacgctctcacctggaaaagagcctgtgttggaaggtcagccctcacatcaagatggatctgcttcagtggatccagagcaaggcccagtccgatggatcaacgcttcagcagggaagcctcgagttcttctcctgtctatacgagattcaggaagaggaattcatccagcaggcactctctcactttcaggtgatcgtggtcagcaacatcgcaagcaaaatggaacacatggtcagtagcttctgcctgaaacgatgtaggtccgcccaggtgttgcacctatacggagccacctactcagcagacggggaggatagagcacggtgcagcgcaggtgcccataccctgctcgtgcagctgcctgaacgcacagtgctgctggacgcctattcagagcatctggcggccgccctgtgtacgaaccccaatttgatagaactgtctctctacagaaacgcgttgggaagtaggggcgtgaaattgctctgtcaagggttacgccatcccaactgcaaactacagaatctacgattgaagcgttgtaggatttcaagttcagcctgcgaagacctctccgccgcactgatcgccaataagaatcttactcgtatggacctcagtgggaacggcgtgggatttccggggatgatgctgttgtgtgaagggctaagacaccctcagtgtaggctacagatgatccagctgaggaagtgccagttggaaagtggcgcgtgtcaagaaatggcctcagtgctcgggactaatccacatcttgtagagctcgacctcacgggcaacgccttagaagaccttgggttgcggctcctgtgtcaggggctgcgtcatcccgtttgtcggctccgcactctatgctggatgctgtttggcatggatctgaacaagatgacccattcacggctcgccgcactcagggtcacaaagccctacctggatatcggctgctag

SEQ ID NO: 14878 - DNA, 945 bp, Artificial Sequence
  Description of Artificial Sequence: Synthetic coding sequence
atgcaaacatttctcaaaggcaaacgggtcggatactggctgtccgagaaaaagattaagaaactcaattttcaggccttcgcagagctatgtcgtaaacgcggtatggaggtcgtgcaactgaatctgagtagaccaatcgaggaacagggcccattggacgtcattatccacaagctgaccgatgtgatcctggaggccgatcaaaacgatagtcagtcccttgaactggttcatcggtttcaggagtatatagacgcacaccctgaaactatcgttctggaccccctgcccgccattcgcactctgctggaccgctcaaagtcgtacgagctaattcgtaaaatagaggcctatatggaagacgatcgcatctgtagtccgccttttatggaactgacttccttatgcggagacgatactatgcgactcctggagaaaaatgggctcacttttcccttcatttgtaagactagagtggcccatggcactaactctcatgaaatggctatcgtctttaaccaggagggcctgaatgctatccaaccaccatgtgtggtacagaattttatcaaccacaatgccgtgctttacaaagtgtttgtagttggcgaatcctatacggttgttcagcgcccctcgcttaaaaacttcagcgccggaacctccgacagagaaagcatcttttttaacagtcacaacgtctctaagcctgagtcctccagtgtccttactgagctggacaaaattgagggggtgttcgaaaggcccagtgacgaagttattcgcgagctctctcgggcactccgccaggccctgggagtatcgctctttggtatcgacattatcatcaacaaccaaacggggcagcacgccgtgattgacatcaacgccttccctggtgactgtcaggtgtgctttattgaagggtggaaaactgattag

SEQ ID NO: 14879 - DNA, 630 bp, Artificial Sequence
  Description of Artificial Sequence: Synthetic coding sequence
atgcctgtcgccgtgatggcggagagcgccttcagctttaagaaactcctggaccagtgtgaaaaccaggagcttgaagcccccggcggcatcgcaaccccaccagtgtatggacagcttctggctctttatcttctgcataatgacatgaataatgcccggtatttgtggaagagaattccgccagccatcaaatctgccaactccgagctcggtgggatctggtcagttgggcaacgcatttggcaaagagactttccaggcatttataccaccataaatgctcaccagtggagtgaaacagtgcagcctattatggaagccctgcgcgacgccacaaggaggcgtgccttcgccctggtttcccaggcctataccagcatcattgcagatgactttgctgcgtttgtggggctcccagtggaagaggctgtgaagggtattctcgagcaaggatggcaggcagactccacgacaagaatggtattgccgaggaaacccgtcgccggcgccctggacgtgagtttcaacaaattcattcccctgtcggagcctgcccccgttccaccgatccccaacgagcagcagctggcccgccttacggactacgtggcttttctcgagaactag

SEQ ID NO: 14880 - DNA, 4935 bp, Artificial Sequence
  Description of Artificial Sequence: Synthetic coding sequence
atgttctggtgcggcacatgctttgttacaaacaatatgaaaggcagcgaagtctctctggaaaagaagaagaagatcaagatgcctgtgaaacggctacgcgaagtggtaagccaaaatcacggagatcatttagtgctgcttaaggacgagctgccatgtgtcccacctgcactgtccgctaacaagcgcctccccgtcgggactggaacttccctgaatggtacttctagaggttccagcgatctgacctctgccaggaactgttaccagcctctgttggaaaatccaatggtctctgaatcagacttttccaaagatgtagccgtccaggtgctgcctctcgacaaaattgaagaaaacaacaaacaaaaggctaacgacattttcatctcacagtacacaatgggacagaaggatgcactaagaacagtcctgaaacaaaacgtttccctgtgcctcaccggctggagcgaccactccggtgtgatcacaacccattgtagcctgtacctgctgagacttatgcgatcctcacacttgtctctgccgtcttcctgggattaccgggcccagagcatgcccgtcttcaaagaggtgaaggtccatctccttgaggacgcggggattgagaaggacgcggtgactcaagagacgcggatctctcctagcggcatcgactcagctaccactgtcgccgccgcaaccgccgccgctatcgccactgctgccccccttatcaaggttcagtccgacctcgaagccaaagtaaactctgtgaccgagttactgagcaaacttcaggagacagataagcatctgcagagggtgaccgagcaacagacttcaatccagagaaagcaggagaagctgcactgccacgatcacgagaaacagatgaatgtcttcatggagcagcatatcaggcatctggaaaaactgcagcagcagcaaatcgatatccagactcatttcatcagcgctgctctgaaaacctcgtcattccagccagtaagtatgccatcttctagagcagtcgaaaagtattctgtgaaaccggaacaccctaacctgggatcctgcaatcctagcctgtataacactttcgctagcaaacaggcacctttgaaggaggtggaagacacctccttcgataagcagaagtcgcccctcgagacccctgcacctcgccgattcgctccagtccccgtgtccagggatgatgaactgagcaagcgcgagaacttgcttgaggaaaaggagaatatggaagtttcctgccatcgaggcaacgttcggcttctggaacagatcctgaataataacgactccttaaccagaaaaagcgaatcttctaacactacctctctgacaagaagcaagattggctggacacccgaaaagacgaaccggttcccttcctgcgaggagctggagacgaccaaagtaaccatgcagaagagcgacgatgtgttgcatgatctcggccagaaagaaaaggagaccaactccatggtccagcccaaggagagtctgtcaatgctgaaactgccggatctgccacagaatagtgttaaactgcagaccaccaataccacgcggtctgtgctgaaggatgcagagaagattctgcggggagtgcagaacaataagaaagtcctggaagagaacttggaggctattattcgagcgaaagacggagctgctatgtacagtctgattaatgccctgtctactaaccgagaaatgtccgagaagatacgcattcgcaagacggttgacgaatggataaagaccattagcgccgagatccaggatgaactatcccgcaccgattacgaacagaagcggtttgaccagaaaaatcagcgaactaaaaaggggcagaatatgacaaaggacatccgtaccaatacgcaggacaagaccgtcaataagagcgtcattcccaggaaacatagccagaagcaaattgaagagcattttagaaatctccccatgagaggcatgcccgcttcttcactgcagaaggagaggaaagaaggactgctcaaagccaccacggtcatccaggatgaagattatatgcttcaggtttatggtaagcctgtttatcagggccataggtctacccttaagaaagggccatacttgcgcttcaacagtccctctcccaagagccgcccccagcggcctaaagtcatcgagcgtgttaagggaactaaagtgaaatccattaggacacagacagacttttacgccaccaaacctaaaaaaatggactctaagatgaaacactccgtacctgtgcttcctcatggggatcagcagtacctcttttccccatctagggaaatgcctaccttcagcggtaccctcgagggccatctgattcccatggctattctgcttggccaaacgcaaagtaatagtgacaccatgccgcctgccggcgtgattgtcagcaagcctcaccctgttaccgttactacatctattccaccttcttctcgaaaagtggaaaccggcgtgaaaaaaccaaacatcgcaatcgtggagatgaaaagtgagaagaaggatcccccccagctaaccgtacaggtgttgccctccgtggacattgactcaatcagcaattcttctgccgacgtccttagccctctaagcagcccaaaagaggctagcttaccacccgtgcagacctggatcaagacacctgaaatcatgaaggtggacgaggaagaggtgaagtttccggggactaactttgacgagatcatagatgtaatccaagaggaggagaaatgtgacgagatccccgattcagagcccatcctggaattcaatcgaagcgtgaaagccgattccactaagtataacgggcccccgttccccccagtagctagtacttttcagcccactgccgacattctcgacaaggtgatcgaaagaaaggagacattagaaaacagcctcatacaatgggtggagcaggagattatgagtcgcataatcagcgggctcttccccgtccaacagcagattgcacctagcatctcagtctctgtgtccgagactagcgaacccctcacttctgacatcgtggagggtactagtagtggagctctccaattgttcgtggacgcaggcgtccctgtcaatagcaatgtgatcaaacattttgtgaacgaagctcttgccgaaacgatcgccgtgatgctgggcgaccgggaggccaagaaacaaggcccagtcgccactggcgtctccggcgacgccagtacaaacgagacctacctgcccgcgagggtgtgcacacccttacccaccccacaaccaacaccaccgtgtagtccaagcagtcctgccaaggaatgcgtattggttaagacaccagactcctctccttgtgacagtgaccacgatatggcttttcccgtgaaggaaatatgcgccgagaagggggacgacatgccagccataatgctggtgaacacaccaactgtgacgccaaccactacacccccacctgcagctgcagtgtttacacctactctgtctgatatctcgattgacaagctgaaggtctcatcacccgaattgcctaagccctggggtgacggcgacctcccgcttgaagaggagaaccctaactctccgcaggaggaattgcacccccgggccatcgtgatgagtgtggctaaggatgaagaaccagagtctatggactttcccgcccagcctccacccccagagccggttccctttatgcctttcccagcaggcacaaaggctccgagtccaagccaaatgcctgggtctgacagttcaacactggagtcaacactgtctgtaacggtaacagaaacagagactctggacaaacctatatcagaaggagagatcttgttctcatgcggccagaaactggcgcccaagatccttgaggatatcggcttgtacctgaccaatttaaatgactcgttatcctccacactccacgatgcagtcgaaatggaggatgatcctcctagcgaagggcaggtgatccgaatgtcccacaagaagttccacgccgatgccattttgtcctttgcgaaacagaatcaggagagtgctgtgtcgcagcaagctgtgtaccacagtgaagacttagagaactctgtgggggagctgtcagagggtcagcgcccccagttgaccgctgccgccgaaaatatactgatggggcattcactgtacatgcaacccccggtaactaatactcaatccctggaccagcagtgtgacccaaagccactgagtaggcagttcgataccgtttccggcagcatatacgaagatagctgcgcaagccacggacccatgtctctgggggagctggaactggaacccaatagcaaattggtgctgcctacaacactgttgacagcacaggaaaacgacgtgaatctacccgtcgcagccgaggacttctctcagtatcagctgaaacaaaaccaagacgtgaaacaggttgagcacaagcccagccagagctacctgcgcgtgcgcaacaaatccgacatcgccccatctcaacagcaggtgagccctggcgacatggaccggacccagatcgagctgaatccgtacctgacctgcgtgttttctggattgggcgtgcatgtgaaaaaggtgtcgtgcatcggaaagctcgggctttggcgctttgtgatccagattatatccagcccccggtgggagtcatccgctacccttcgattcacagatgccccctgtcaagatgtctctgatgccgccgtctctgaacccagggggctcctcagcgtgagcgagagccaacacaacgccgggggccacggggtgttcggaggaaggtatttgctcaatgggaaaaggcagccggcccaatgcttatgtcactggttttag

SEQ ID NO: 14881 - DNA, 3138 bp, Artificial Sequence
  Description of Artificial Sequence: Synthetic coding sequence
atgctcacggtgcaggtgaaaacgagtagtgcaatcgagttacctgactctttggctttcttatggatcataccaatgtggtactgcgagggaaaggagctggaaaacagccctgacatccacattgtgcaggccggcaacctccacagtttgaccatcgccgaagcctttgaagaagatacaggccgctatagctgtttcgccagtaacatatacggcacagactctacttccgctgaaatctacattgaaggcgtgagctcaagtgactccgagggtgacccaaataaggaagagatgaatagaattcagaaaccaaatgaagtgtcctcaccccccacgacttctgccgtgatccctcccgctgtaccacaggcccaacacctggtggcccagcctagagtggccaccatccagcaatgccagtcccccacaaactatctgcaagggctggacgggaagccaattatcgctgctcccgtgtttaccaaaatgctccagaatctgtccgcctcagagggacagttagtggttttcgaatgtcgtgtcaaaggcgccccaagcccaaaagttgagtggtacagagaaggcaccctgatcgaagacagcccagattttcggatcttgcagaagaaaccgcgatctatggcagagcctgaagaaatttgtactctcgtgatcgccgaagtgttcgccgaggactcaggttgttttacttgtactgcttctaataagtacggtacggtcagctcaattgcacagctgcatgtgagggggaacgaggatcttagcaataacggtagcttgcacagtgccaactcgactaccaacttggcagccattgaaccacagccttctcccccacacagcgagccaccatccgttgaacaaccacccaagcccaaattagaaggggtgttagtgaatcacaatgagccccgctcaagcagtcgcatcggtctgagggtgcacttcaatcttccagaagatgataaaggctccgaagcctcatcagaagcaggtgtcgtgacaacacgccagaccagacctgacagcttccaggaacgatttaacggacaggcgactaaaactccagagccctcaagtcccgtcaaggaacccccccctgtcctagccaaacccaaactcgacagtacccagctccagcagctccacaaccaagttctgctggaacagcaccagctgcagaacccccctccctcctcacctaaggagttccccttcagtatgacagtactcaactcgaacgctccacctgccgtgaccacaagctccaagcaggtgaaggcgccatcttcgcagacgttcagcctagccaggcccaaatatttcttcccatcaacaaacacgactgcagccaccgtcgcccctagctcttcaccagtatttactctgtcttctacccctcagactatccaacggaccgtgtcaaaagaatctctgctggtttcccatccttcagtgcagactaaatcgccaggaggactgagtatacagaatgaacccctgccacctggccctactgaacctactccacctcccttcacattctctattccctctggcaatcagttccagccacgctgcgtcagcccgatcccagtttcacctacctccaggatccagaaccccgtggcgttcctgtcaagcgtactcccttctctgcccgccataccaccaaccaatgccatgggactgccccggtccgctcccagcatgccctcacagggcctggccaaaaagaataccaaatctcctcagccagtgaacgacgataacatcagggagaccaagaacgctgtgataagagatctgggcaaaaagataaccttttccgatgtgcgtcccaaccaacaggagtataagatcagttcttttgagcagcggctcatgaacgagatagagttcaggctggagcgtacgccagtagatgaatctgatgacgaaattcaacacgacgaaatcccaactggcaaatgtattgctcctattttcgacaaacggctcaagcactttcgcgtgacagaagggtcacccgtcacttttacctgtaaaatcgtgggaatccctgttccgaaggtgtactggttcaaagacggcaagcagatctctaaacggaacgaacactgcaaaatgcgacgcgaaggtgatggtacctgttccctacatatcgaaagtaccactagtgatgatgatggcaactacaccatcatggccgctaatccccaggggcggatcagctgcagtgggcacctaatggtgcaatctttgccgattaggagccgcctgacctctgccggccagtcacaccgcggtcgcagtcgcgtccaggaaagagacaaggaaccccttcaggagcggtttttccgaccacacttcttgcaagcgccaggcgacatggtcgctcacgagggtcgactttgcagactcgattgcaaggtttcaggattgcctccgccggagctgacttggttacttaacggacagcctgtactccctgatgcatcacataaaatgctcgtgcgtgagacaggcgtgcatagcctgcttatagacccactgacgcagcgtgacgctgggacgtataagtgtatcgccactaataaaacgggacagaacagcttctcattggagctgtcagttgtcgcaaaggaggtgaagaaagcaccagtcattctggagaagcttcaaaactgcggcgtacctgagggccaccctgtccggcttgaatgtagggtcatcggaatgcctccaccagtattttattggaagaaggacaacgaaacgattccctgcactcgcgagagaatatcaatgcatcaggatactaccgggtacgcatgcctgctgatacagccggccaaaaagtcagatgccggatggtacaccctgagcgctaagaacgaggccggaattgtttcgtgcaccgcccgtctggatatttatgcccagtggcaccatcagatcccccctcctatgtcagtgcggccatcaggctcccggtacggatctctcacttccaaaggtcttgacatattttcagcattctcctcgatggaatccactatggtttactcatgttcatctcgtagcgtagtcgaatctgatgaactgtag

SEQ ID NO: 14882 - DNA, 951 bp, Artificial Sequence
  Description of Artificial Sequence: Synthetic coding sequence
atgactcccagtgagggcgcccgggccggaacaggcagagagctggaaatgctggatagccttctcgctttgggcgggctggtcttactcagagatagtgtcgaatgggagggcaggtcactgcttaaggcgcttgtaaaaaagtccgccctatgcggggaacaggttcacatcttgggctgcgaggtgagcgaggaggaatttagggaagggttcgacagcgacatcaataacagacttgtctatcatgacttttttagagatccattaaattggagcaaaactgaggaggcgtttcccggtggtccccttggagctctacgggctatgtgcaagaggaccgaccctgtgccagtgaccattgccctggacagcttgtcctggttactcctgaggctgccctgtaccaccctgtgccaggtactacacgctgtttcgcaccaggatagttgtccgggagattcctcctccgtgggaaaagttagcgtgttggggttactgcatgaagaactgcacggtccaggccccgtgggagctttgagttccttggctcagaccgaagttactctgggaggcaccatgggtcaggccagtgcccacatcttgtgcagacggccccgtcaacgccccacagaccagactcagtggttcagcatccttcccgacttctcactcgatcttcaagaaggaccctctgtcgagtcccagccctattccgatccccacattccacccgtggaccctacaacacacctgacgtttaatctgcacctgtctaagaaagagcgggaagcacgcgacagcctgatactcccttttcagttttcctcggagaagcaacaagctttgctgagacccagaccaggccaagctacaagccatatattctatgaaccagacgcatatgatgatctggaccaggaagatcccgacgatgatctggatatctag

SEQ ID NO: 14883 - DNA, 1473 bp, Artificial Sequence
  Description of Artificial Sequence: Synthetic coding sequence
atgaatggcgctctcgatcacagcgaccagcccgaccccgacgccatcaagatgttcgtgggacaaataccacgtagctggagcgaaaaagaacttaaggaattgtttgaaccctacggggcagtgtatcagatcaacgtcctccgggataggtcccagaatcccccccagtctaagggctgctgtttcgttactttctacactcgtaaagcagcactggaggcccagaatgccctccataatatcaagaccttgcccggaatgcaccaccccattcagatgaaacccgcagacagcgagaagagcaacgcagtagaagacaggaaactgttcataggtatggtatccaaaaagtgcaacgagaacgacatcagagttatgttcagccccttcgggcagatcgaagagtgcagaattttacgcgggcccgatgggcttagcagaggatgcgcattcgttacatttagcacaagagctatggctcagaatgcaatcaaggccatgcaccagtcccaaaccatggagggatgttcttcacccattgtggttaaatttgccgatacacagaaggataaagaacagcggcgcctgcaacagcaactcgcccagcagatgcagcagctcaatactgcaacctggggtaacttgacagggctgggtggcctgaccccacaatatctcgcgctcctccagcaggcaaccagctcgtcaaatcttggagcattcagcggcatccagcagatggcgggaatgaacgccttgcagctgcagaacctggctacgctggccgcggctgcagcggccgcacagacttcagctacttctaccaacgccaacccactaagtactacatccagcgccctgggcgctctcacctctcccgtggccgcgagtacccctaactcgactgccggggccgctatgaatagtctaaccagcctgggcacacttcagggacttgcaggcgctacagttgggttgaacaatattaacgcactggcagtggctcaaatgttgtcaggcatggccgcactgaacggaggcttgggcgcaacaggtttgacaaatggcactgctggtaccatggatgccttaacgcaggcctatagcggtattcaacagtacgctgcagctgcactgcctaccttatactctcagtccctcctccagcagcaatccgccgccggctcgcaaaaagagggccccgaaggggctaacctcttcatttatcacctgcctcaggagttcggcgaccaagatattttgcagatgtttatgcccttcggtaatgtgatctcggccaaggtgtttatcgacaaacagacaaacctgagcaagtgcttcggctttgttagctacgataacccggtgtccgcccaggctgccatacaggccatgaatggttttcagattgggatgaagcgcctaaaggtccagctcaaaaggtccaaaaacgattctaaaccctactag

SEQ ID NO: 14884 - DNA, 1428 bp, Artificial Sequence
  Description of Artificial Sequence: Synthetic coding sequence
atggaagcgcttctggagggaatccagaaccgcgggcacggaggaggtttcctgacatcatgtgaggctgaactgcaggagctgatgaaacaaattgatataatggtggcacataaaaagtcagagtgggaaggtagaacccatgctctcgagacctgtctgaaaatacgcgaacaagagctgaagtctctgcgtagccagctggatgtcactcataaggaagtgggcatgcttcaccaacaggtggaggagcatgagaagatcaagcaggaaatgactatggaatataaacaggaattgaagaaactccacgaggaactctgtatcctgaaaagaagctacgaaaagctgcaaaaaaaacagatgcgcgagttcaggggcaacacaaagaaccacagggaggacagaagtgagattgagcgactgacggccaaaatagaggagtttagacagaagtccctagattgggagaaacagcgcctgatatatcagcaacaggtcagcagtctggaggcccaaaggaaggcgctggctgagcagtccgaaatcatacaagcccagcttgtcaatagaaagcagaaactggagtcggtggaattaagtagccagagcgagatccaacaccttagctcaaaattagagagagcaaatgatactatctgcgcaaacgaacttgagattgaacgattgaccatgagagtgaacgatctggtggggacaagcatgacagtcctccaggaacagcaacaaaaggaagaaaagctccgagagtccgaaaaactgctggaggccttacaggaagagaaacgcgagcttaaagccgctctacaaagccaggagaacctcatacacgaagctagaatccagaaggaaaaactgcaggagaaagtgaaggccacaaacacacagcatgcggtcgaagccatcagtcttgagagcgtgtccgctacttgcaagcagctgtctcaggagctgatggagaaatacgaagaactaaagcggatggaggcacacaataacgagtataaggccgaaattaagaaactgaaagagcagattcttcagggtgaacagtcatattcctcggcacttgagggcatgaaaatggagatttctcacctgacgcaggaattgcaccaaagggatatcactatagccagtaccaaggggagctcaagtgatatggagaaaagactccgtgctgaaatgcagaaagccgaggataaagcagtcgaacataaagaaatcttggatcaactcgagagtctgaagcttgaaaatcgtcacctgtcagagatggtgatgaaattggagctggggctacacgaacggtggggcttcacaatgctcagctccctcgtcctgaactttggaatacaggccattaggcagcctcagagacctaaggtactggaactccaggtctag

SEQ ID NO: 14885 - DNA, 2340 bp, Artificial Sequence
  Description of Artificial Sequence: Synthetic coding sequence
atgcgcatcgaggagcgtaagtcacagcacctgaccggcctgacggatgagaaggtaaaggcttacctcagcctccacccacaagtgcttgacgaattcgttagcgagagcgtctccgccgagacagttgaaaaatggctcaaacgaaaaaacaataagtcagaggacgagtctgcccctaaagaggtgagtcgctaccaagacactaacatgcagggagtggtgtacgagctgaattcctacattgagcagagactggatacaggcggggataatcagctcctgctttatgagcttagtagcatcattaagattgccaccaaagctgatggttttgccctgtactttctgggtgagtgtaacaacagtctctgcatttttacccctccaggaataaaggaggggaagcctcggctgatccctgcagggccaataacccagggcaccacagtgtccgcttatgtggcgaaatcaagaaagacattactggtggaagacattctcggcgacgagcgttttcctaggggcaccgggctcgaatccgggacccgaattcagtcggtgctttgccttcccattgtaactgccatcggggatctgatcggtattctcgagttatatcggcactgggggaaagaggctttttgccttagccatcaagaggtggccaccgctaacttagcctgggcaagcgtggcgatccaccaggtgcaggtttgtcgaggtctggctaagcagactgaactcaatgactttttgctcgatgtgtctaagacatattttgacaacatcgtggctattgacagtctgctcgaacacatcatgatttacgctaaaaatctggtgaacgctgatagatgcgccctctttcaggttgatcataaaaacaaggagctgtactccgatcttttcgatattggagaggagaaagagggcaagcccgtctttaagaaaaccaaagagatacgattttccatcgagaaaggcatcgccggacaagttgcacgcacaggcgaggtcctcaacattcccgacgcatatgccgacccccggtttaacagggaggtggatctgtatactggatacaccactaggaatatcctttgcatgcccatcgtgtcgaggggttctgtgattggcgtcgtgcagatggtgaataaaatctctggcagtgccttcagtaagactgatgaaaacaacttcaaaatgttcgcagtcttctgcgccctggctcttcactgtgcaaatatgtatcacagaatccggcactcggagtgcatttacagagttaccatggagaagctaagctaccacagcatctgtacctccgaggagtggcagggtcttatgcagtttactctgcccgtgcggctatgtaaagagattgaactgtttcatttcgacataggaccatttgagaacatgtggcctggtattttcgtgtatatggtgcaccgctcctgcggcacaagttgtttcgaactggaaaagttgtgccgcttcataatgagtgtgaagaagaactaccgacgggtcccctaccacaactggaaacatgcagtgactgttgcccactgcatgtacgcaattctgcagaacaaccatacactgttcactgacctggagcgaaaaggactcctcattgcatgcctctgtcacgacctggaccatcgtggtttctctaactcgtatctgcagaaatttgaccacccactggctgctttatactcgacatccactatggagcagcatcatttctctcagaccgtgagcatccttcagctggaagggcataacatcttctcaacactgagctcttccgagtatgaacaggtgctagaaatcataagaaaggcaatcatagcaaccgacctagctctgtattttgggaaccgcaaacagctggaggaaatgtatcagaccgggtccttgaacctgaataatcagagccatagggaccgggttatcgggttgatgatgactgcctgtgatttgtgtagcgtcactaagctgtggcctgttaccaagctgacggcgaatgatatatatgctgagttttgggcagaaggggacgagatgaagaaactgggaattcagcccattcctatgatggaccgggataagaaagatgaggtcccgcagggccagttagggttctataacgccgtggctatcccatgctataccactttaacacagatcctgccccctactgagccactgctgaaggcttgtagagacaacctgagtcagtgggaaaaggtaattcgaggggaggagacggcaacatggatctcttctccctccgtggcacagaaagccgccgctagtgaggactag

SEQ ID NO: 14886 - DNA, 2112 bp, Artificial Sequence
  Description of Artificial Sequence: Synthetic coding sequence
atggccgccgccacgggagatcccggactgtccaagctccagttcgcccccttcagctctgcactggatgttggcttttggcacgaactaacacagaagaagctgaatgagtacaggctggacgaagcgccaaaagatattaagggatactattacaatggtgatagcgccggattacctgcccggctcaccctggaattttctgcatttgatatgagtgcgccaactcccgctcggtgctgtcccgcaatcggcactctctacaatactaataccctcgagtcatttaagacagccgacaaaaagctcctgctggagcaggcagccaatgagatctgggagtctattaagagcggtacggcactagagaatccagtcctgctcaacaaatttctgttactgaccttcgccgacctgaaaaagtaccacttctactactggttctgttatccggcactgtgcttgcctgaatccttgccacttattcagggacctgtgggtttggaccagcggttctctctaaagcaaattgaagccttggagtgcgcatacgataacttgtgtcagacagagggtgtgaccgcgctgccttatttccttattaaatacgacgaaaacatggtcctggtgtcgttactgaaacactatagcgacttctttcaggggcaacgcactaaaataacaattggcgtctacgacccctgcaatctggctcagtaccctggctggcccttaaggaactttctcgtgctagccgcccaccggtggtcctcttctttccagagtgtggaggtcgtgtgtttcagagaccgtaccatgcagggtgcccgcgacgttgcccactctataatttttgaagtgaaattgcccgagatggcatttagcccagattgtcctaaggccgttggttgggaaaagaatcagaagggcggaatggggccacggatggtgaacctgagtgaatgcatggaccccaagcgacttgccgaatctagtgtggatctgaatctcaagttaatgtgctggagacttgtgcccaccctggatcttgacaaggtagtgtcagtgaagtgtctgttactcggtgcaggtaccctgggctgcaatgtagccaggacgcttatgggatggggcgtcagacacatcacatttgtggataacgccaaaatctcttatagcaaccccgtgcgccagcccttatatgagttcgaggattgccttggtggcggaaagcctaaagccttagccgccgcagacagattgcagaagattttccctggagtgaatgccagaggatttaacatgtccatccctatgccaggacaccctgtgaatttttcgtcggtgaccctcgagcaggctagaagggacgttgagcagctggagcagctgatcgagtcccacgatgtcgtgttcttactgatggatactagggaatctcgttggctgcctgccgtcatcgccgccagtaagcgcaagctggtcatcaatgcggcgttaggattcgatacttttgtcgtaatgagacacggcctaaagaagccaaagcaacagggggccggcgacctatgccctaatcatcccgtcgcttccgctgacctattgggtagcagcttgtttgccaacatcccggggtacaaattagggtgttatttttgcaatgatgtggttgcaccaggagactcaactagggatcgtaccctggatcagcagtgcacagttagtagaccaggcctggcggtaatagctggggccctggcagttgagctcatggtgtcagtcctgcagcaccccgaaggaggctacgctatagccagtagttccgacgatcgcatgaatgagcctcccacatctctggggctggtgcctcaccagatccggggtttcctgagcagattcgacaacgtgctgccggtttctctcgcgtttgataaatgcacagcttgcagcagcaaagtcctcgatcagtatgagcgcgaagggttcaactttctggctaaggttttcaattcctcccatagtttcctggaagatctgaccgggcttacactgttgcatcaggaaactcaagctgcggaaatctgggatatgtcagacgacgagacgatctag

SEQ ID NO: 14887 - DNA, 3246 bp, Artificial Sequence
  Description of Artificial Sequence: Synthetic coding sequence
atggaaagtgccggactggaacaactcctcagggagctgcttctccctgacacggagcggatccgcagggcgaccgagcagctgcagatcgtgttaagggcaccagcagccctacccgccctgtgcgacctcctggctagcgcggccgacccccagataagacagtttgctgcagtcctgacgcgtagacgcctcaatactaggtggcgcagattagccgccgagcagcgtgagtctctgaaatcattaattctcacagcactccagagagaaaccgagcactgcgtgagcctgtcattagcccagctgtcagccaccatttttaggaaggaggggctcgaggcctggccacagctgttgcagctgttgcaacatagcactcacagcccacattctcccgaaagagagatgggtttgcttctgctctctgtcgttgtcacttctcgccctgaagccttccaaccacaccaccgggagctgctgcgcttactcaacgagacacttggggaagtgggcagcccaggtctccttttctatagcctcaggacacttacaaccatggccccttaccttagcaccgaggatgtcccgctcgccaggatgctggtgcccaagcttatcatggccatgcagactctgatacctattgacgaagccaaggcatgcgaagctctggaggccctggacgagctcctcgaatctgaggtgcccgttatcaccccatacctgtcagaggtgctgactttttgccttgaagttgcccgtaatgtggcactagggaatgcaatcaggattcgtatcctgtgttgccttaccttcttggtcaaagtcaagagcaaggctctactgaagaatcggctccttccccccctgctgcacacactttttcccatcgtagccgccgagccccctcccggacagctggatcccgaagaccaggattcagaggaggaagagctcgagatcgagctcatgggtgagacacctaaacatttcgctgttcaagtggtggatatgcttgcactgcatcttccgccagagaagctgtgcccccagctgatgcctatgcttgaggaggctcttagatcggaaagcccataccaacgaaaggctggccttctggttttggctgtgctctcagatggcgccggcgaccacatccgccagaggctgctgccacctctgctgcaaattgtctgcaagggcctggaggaccccagtcaagtggttagaaatgctgctctgtttgcccttggtcagttttcggagaatctccagcctcacattagtagctatagcagagaagtcatgcccctcctgctggcctacctgaagtcagtgcccctcggacacacgcaccacttagctaaggcatgttacgctctggagaatttcgttgaaaaccttggtccgaaggtgcagccatacttgccggagctcatggaatgtatgctgcagctcctgaggaaccctagttctcccagggctaaagaattggccgttagtgctctcggtgcaattgccaccgccgcacaggcatcactactgccctattttccagcgataatggaacacctgagagagtttctgcttacaggtcgggaagacttgcagccagtacagatccagagccttgagacgctaggggtcctagctagggctgttggtgagcccatgagacctctggcggaggagtgctgccaactcggactgggattatgtgatcaggtcgacgatcccgatctccggcgctgtacctactccctgtttgctgctctttccggactcatgggcgaggggcttgccccacacctagaacagataaccacgttgatgctactgtcacttcgatctacagaggggatcgtgcctcagtatgatggctccagcagtttcttactgttcgacgacgaatcggacggtgaggaggaggaagagcttatggatgaagacgtggaggaggaggacgattccgagatcagcggatatagcgtggaaaacgctttctttgacgaaaaagaagacacatgcgctgctgtcggagaaatctccgtcaatacgtcagtggcattcttgccatatatggaatcggtatttgaggaagtgttcaagttactagagtgccctcaccttaacgtgaggaaagcggcccacgaagccctgggccagttctgttgcgcgcttcacaaggcctgccaatcttgtcctagcgagcctaacacggctgccctgcaggccgcgcttgctagggtggtcccaagctatatgcaggctgtgaaccgggagcgggaacggcaagtggttatggccgtcctggaggctttaacaggtgtgcttagatcgtgcggcaccctgactcttaagcccccgggaagactcgccgagctctgcggcgtcctcaaggcagtgttacagcgaaaaaccgcatgccaggacaccgatgaggaggaagaggaagaggacgacgatcaagcggaatacgacgcaatgctcctggaacacgcaggggaagcaatcccagccctcgctgccgctgccgggggcgactcattcgccccattttttgccgggtttctccctcttctggtttgtaagacaaagcagggatgtacggttgccgagaaaagcttcgccgtgggaactctggcagagaccatccaaggcctgggagctgctagtgcgcagtttgtgtctcgcctcctgcctgtgctgctctctacggcccaggaagcggaccccgaggttaggtctaacgctatctttggtatgggagtgcttgccgaacacggcggccaccccgcccaggaacactttccaaaacttttggggctgctgtttccactgctggcaagagaaaggcacgatcgagtaagggataatatttgtggggctttagccagactgctcatggcatcacccacacggaagcccgagccacaggtactggctgccctgctccacgcactcccactcaaagaggatctggaagagtgggtcactataggacgactgttctcctttctctatcagtcctctccagatcaggtcattgacgtggcccccgagctgctgcggatctgcagcttaattctggcggataataaaattccacctgacactaaagctgctttgcttctgctcttgaccttcttggctaagcagcacaccgactcctttcaggccgcacttggttcacttccagtggacaaggcccaggaactccaagctgtgctgggtctttcctag

SEQ ID NO: 14888 - DNA, 7224 bp, Artificial Sequence
  Description of Artificial Sequence: Synthetic coding sequence
atggtgggagaacgtcatgccggcgatctgatggtgccactcgggccacgtctgcaggcttacccggaggagctaattcgccagcggccaggccatgatggacatcctgagtacctgatcagatggagcgtgttgaagtgtggcgaggtcggaaaagtcggtgtcgaagagggcaaggccgaacacattctgatgtggctatcggcacctgaggtgtatgcgaactgcccgggtttgctgggggaaagggctctgtcaaaagggcttcaacacgagcctgctggggtgagtggttcctttccacgggatccaggcggacttgacgaggtcgccatgggtgagatggaggcggatgtgcaggcgcttgtgcgccgggccgcacggcagctcgccgagtcaggcactccttccctcacagctgctgtgctgcatactatccacgttcttagtgcgtacgcctccattggtccactgactggagtgtttagagaaacaggcgctctggatctgctaatgcacatgctgtgcaaccccgagccacaaattaggagatcagcgggaaagatgctccaggccctggctgctcatgatgcaggctctagggcacatgtgctgttgtcactgagccagcaagatggaattgagcagcatatggacttcgactctaggtacaccttgctcgaactatttgccgagaccacaagctcggaggagcactgcatggccttcgagggcatccatctcccccagattccagggaaactgctgttcagtttggtaaaaagatacctgtgcgttacgagcttgcttgatcagttgaactcgtcaccggagctgggagccggggaccagagctccccttgtgcaaccagggagaaaagccgagggcagcgggaactggaattctcaatggcagttggcaacttgatcagcgagttggtgaggagtatgggctgggcaagaaacctgtccgaacagggaatgagccccccgcgtcctactcgcagcatcttccagccttacatatcgggaccttctctgttactacccaccatcgtcactacacctcggaggcaaggatgggtgtttagacagcggtctgaatttagtagcagaagcggatacggtgagtacgttcagcagacacttcaacctggaatgagggtgcgcatgctggacgactacgaagagatctccgccggcgatgagggggaatttcggcagtctaacaacggaatacctcctgtgcagacattaggtgaaaaggcccttggagaaatatcggtctctgtggagatggccgaatccctgctgcaggttctgagctctcggtttgaaggcagtacactgaatgatctactcaactcccagatctatacaaagtacgggctactgtctaatgaacccagctcgtcaagcacctctcgcaatcactcttgtacccccgacccagaagaggagtccaagtcagaggccagttttagcgaggaggagactgagtctcttaaagctaaggccgaggctcctaagactgaggctgagcccacaaagacacggaccgaaactcctatggcccagagcgacagtcaactgttcaatcagcttcttgtcactgaaggaatgacattgccgactgagatgaaggaagctgcttccgagatggcacgagcacttcgcggcccaggaccgcgatcttctctggaccagcacgttgccgctgtggtggcaaccgtgcagatctcaagcttagatacaaacctgcaactctcaggcctgtcagctctcagccaagccgtagaggaggtgaccgagcgtgaccacccactcgtgagaccagataggtcactcagagagaaactcgtaaagatgttagtcgaactgctaactaatcaggtgggtgagaaaatggtggttgtccaagcactccgccttctatatctgcttatgacgaagcacgaatggcgtccactgtttgccagagagggcgggatatacgcagtgctggtgtgtatgcaggagtataaaacgagcgtcctggtccagcaagccggcctggctgccttaaaaatgcttgccgtggccagtagctcagagattcctacctttgttacaggcagagacagcatccacagtctctttgacgctcagatgacgcgcgaaatctttgcttctattgatagtgccactagacccgggtctgaaagcctgctcctcaccgtgccagccgcagttatactgatgctcaacaccgagggttgctcttccgccgcccggaacgggctgcttctgctcaatctattgctgtgtaaccaccatacacttggcgatcagattataactcaggagcttagggacactcttttccggcacagcggaatagcgcctcggacagagcctatgccaaccacaaggactattttgatgatgttgctgaaccggtactcagagccccccgggagccctgaaagagcagcattggaaacccctatcattcagggacaggatggcagtccagagctgctcatacgctctctggtgggcgggccttctgccgagctcctactcgatcttgagagggttctttgccgcgaggggtccccagggggcgccgtgagaccgctgctgaagcgtctgcagcaggagactcagcccttcttattgctcctgagaaccctggatgcgcccggacccaataagaccctcctgctcagcgtgcttcgcgtcatcacgcggttgctggattttcctgaagccatggtcctgccctggcatgaggtgctcgagccctgtctgaactgcctcagcggcccatccagcgactctgaaatcgtccaagagctgacgtgcttcctacaccgcctcgcttctatgcataaagactatgctgttgtgctctgttgcctgggggcaaaagagatcctcagcaaggtgctggacaagcacagtgcccagctgctgctgggatgcgagctgcgggacctggttactgagtgcgagaaatatgcccagctctactccaacctgaccagcagcattctggcaggatgtattcagatggtgctagggcagatcgaggatcaccggcgcacccaccagcctattaacattcccttctttgatgtgttcttaagacatctatgtcagggctcgtccgtggaggtgaaagaggacaagtgctgggagaaagtcgaagtcagcagcaatccacatcgagcgtcaaaattgaccgaccacaacccaaagacctattgggagagcaacggatcaaccggtagccactacatcaccctacacatgcatagaggtgttttggtgagacagctcaccttgttagtagcctccgaggattcatcctacatgccagcccgtgtggtggtttttgggggggattctacctcatgcattgggaccgagctgaacactgtgaacgttatgccatctgcttctcgtgtcatactgttagagaacctcaatcgcttttggcccatcattcaaatcaggataaagagatgtcagcaaggcggcattgatactcgagtgcgcggagtggaggtgctaggtccgaaacctacattctggcccctgtttcgagaacaattgtgccggcgcacatgtttgttctacactattcgggctcaggcttggtccagagacatagctgaggatcatcggcgccttctccagctatgtccacggctgaatcgagtgctgagacatgagcagaattttgctgatcgctttttaccagacgacgaagcagctcaggctcttgggaagacttgttgggaagcactggtatccccactggtacagaacataaccagccccgacgccgagggcgttagcgcattaggatggttattggatcagtatctcgaacaaagagagactagccgcaatccactttctcgagctgcatcctttgcctcccgcgtccgacgattatgtcacctcttggttcacgtggaacctcccccgggaccatctcctgagccaagcaccaggcccttctccaagaattccaagggccgggaccggagccccgcacccagccccgtactgccaagcagcagccttcgtaatatcactcagtgttggttgagtgtcgtccaagagcaggtgagcagattcttggcagccgcatggagggcccctgactttgtcccaaggtactgtaaactgtatgagcatctccagcgtgccgggtccgagcttttcggtcctcgggccgcgtttatgctcgcgctgcgatcaggcttcagtggtgctctgctccagcaatcgtttctgaccgcagcccatatgagcgaacaatttgctcgatatatcgaccagcaaattcaaggaggccttataggtggcgctcctggggttgaaatgctgggccagctgcagcgacacctggaaccaatcatggtgttaagtggcctggagctggctaccacattcgaacatttctaccagcattatatggcagacaggctgctgagcttcgggagctcatggctggagggagccgtgctagagcagatcggtctctgtttccctaacagactgcctcagttgatgctccaatccctttctacctctgaggaattgcagagacaatttcaccttttccagctgcagcgccttgataagctctttctggagcaggaggatgaagaggagaagaggttggaggaagaagaagaggaggaagaagaggaggaggctgagaaagagctgtttatcgaggatccaagtccggccataagtatactcgtcttgagcccgagatgctggcctgtttccccgctttgttacctgtaccatcctaggaaatgcctacctacggaattctgcgatgctctggataggtttagtagcttctactctcagtcccagaatcatcccgttttggacatggggccacatagacgattgcagtggacatggttggggagagccgaactgcaattcggcaaacaaatcctgcacgtgtcaaccgtacagatgtggctcctgctgaaattcaatcagactgaagaagtgagcgtagagacgctgctgaaggactccgatctcagtccagagctgttgctccaagctctggtaccacttacatcagggaatggtccgctgactctgcacgaaggacaggattttccccatggcggcgtgttgaggctacatgaacctgggcctcagcggagtggtgaggctctgtggcttatcccacctcaagcttatctcaacgttgaaaaagacgaaggaagaacactggagcagaaacggaatttgctgagctgcttgctggtccggattctgaaggcccatggggagaaaggcctccatattgaccaactagtctgtttggtcttggaggcttggcaaaaaggtcctaacccccccggaacactcgggcatactgtggcaggaggagtcgcctgcacaagcactgacgtccttagttgcatcctgcacctgttgggccagggatacgttaagcggcgggatgatcgcccacagatcctcatgtacgcggcacctgagccaatgggcccttgtaggggccaggcagacgtgccattctgtggatcacagagcgaaacttcgaagccctcccccgaggccgtcgccactttggctagcctgcagctccctgcaggccgtactatgagccctcaggaagtagaagggcttatgaagcagaccgttaggcaggtgcaggaaaccctgaacctcgaaccagatgttgcgcagcacctgctcgcacatagtcactggggcgcagaacagctgctccaatcttatagtgaagacccggagccactactgctagcagccgggctgtgcgtgcatcaggcccaggctgtacctgtgcgcccagaccactgccccgtgtgcgtgtcgccgctgggctgcgacgacgatctcccatcactttgttgcatgcactactgttgtaaatcatgctggaacgagtacttgactacccgcatagaacaaaacctggtgctcaactgcacatgtcctatagccgattgtccagcccagcccacaggcgcctttatcagggcaatcgtgtcatctccggaggtgatcagtaagtatgagaaagccctacttcgcggttatgttgaatcctgctctaatctgacttggtgtaccaatccccaggggtgcgatcgcatactgtgtaggcaggggctgggctgtggcacaacttgttccaagtgtggctgggcatcctgtttcaactgtagcttccccgaggctcactaccctgccagttgcgggcacatgagccagtgggttgatgacggaggctactacgatgggatgtcagtggaagctcagtctaaacacctagctaagcttatcagcaagcgatgtccttcctgccaggccccaattgaaaaaaatgaaggctgccttcatatgacctgcgctaagtgtaaccacggattctgctggaggtgccttaagagttggaaaccgaatcacaaagactattataattgttcagctatggtgtcaaaggccgcccgccaagagaagcggttccaagattacaatgaacgctgtacctttcaccatcaggctcgcgagttcgcggtgaatctgcggaacagagtgtcggccatccatgaggtcccacccccgagaagttttacttttctgaatgatgcatgccagggcctagaacaggcacggaaagtgctggcctacgcctgcgtgtattccttttacagccaggatgccgagtatatggatgtggtcgagcagcagacggaaaacctcgagctccacacgaacgcgctgcagattttgcttgaggaaaccctgcttcggtgtcgggatctcgcctcatctctacggctcctccgggccgactgtctgtctaccggtatggagctcctcaggagaattcaggaacgattattggccatcctccaacacagtgctcaagattttcgagtcggtcttcagtctccatccgtggaggcttgggaagctaaaggccccaacatgcctggaagtcagccgcaggcctcatcaggccccgaagcagaggaggaggaagaggacgacgaagacgacgtgcccgagtggcaacaagatgagttcgacgaggagctggataatgacagtttctcttatgacgagagcgagaatctcgatcaggagacttttttctttggggacgaagaggaggacgaggacgaggcttacgactag

SEQ ID NO: 14889 - DNA, 672 bp, Artificial Sequence
  Description of Artificial Sequence: Synthetic coding sequence
atggaggacgtgaaacttgaatttccctcactcccacaatgtaaagaggacgcagaggagtggacctacccaatgaggagagaaatgcaggaaattcttcctggcctcttcctcggtccctactcttctgctatgaaaagcaaattacccgttttgcagaaacacggtattacacatattatttgtattcgacagaatatcgaggccaacttcattaaacctaattttcagcagctgttcaggtacctggtgctcgacatagcagataatcctgtggaaaacataatcaggttctttcccatgacaaaagagtttatcgatgggagcttacagatgggcgggaaggtgctagtgcacgggaatgctggcatttctcggtctgccgcctttgtgatcgcctacatcatggaaacatttggtatgaagtaccgcgacgctttcgcttacgtgcaggaacggcgcttctgtataaatcccaacgcagggtttgtgcaccagttgcaggagtacgaggcgatctaccttgccaagctgacaattcaaatgatgtcacccctccagatcgaacgcagtctgtcggtacattcaggtacgaccggtagccttaagaggactcacgaggaggaagatgacttcggcacaatgcaggttgctaccgctcagaatggatag

SEQ ID NO: 14890 - DNA, 1689 bp, Artificial Sequence
  Description of Artificial Sequence: Synthetic coding sequence
atggatgataagggcgatccatcaaacgaagaggcacctaaggcaattaagcctacctccaaggaatttaggaaaacctggggatttcgccgtacaacaatcgctaaacgtgagggcgccggggacgcagaggccgatcctttggaaccacccccgccgcagcaacaactcggcctctcccttcggagaagcggcagacagcctaagcgcacagagagggtggaacaattcctgaccattgcccggaggcgtgggaggaggagcatgcctgtctccctggaggattcaggggagccaactagttgtcccgcaaccgacgcagaaaccgcttctgaagggtctgtcgagtcagctagcgaaacgcgcagtggccctcaatctgcttctaccgctgtgaaggagcgccccgcttcttctgaaaaagtgaagggaggtgatgatcatgacgacacatctgactccgacagcgacggcttgactcttaaggagttgcaaaatcggttgagacggaagcgggagcaggaaccaaccgaacgaccgctgaagggtattcagtccagactgcgcaagaagaggagagaggaggggcccgcagagaccgtcggctcggaggcatccgacaccgtcgagggggtgctcccaagcaagcaggaaccagaaaatgatcagggcgtagtctctcaggcgggaaaggatgaccgagagtcaaagttagaaggcaaggctgctcaagacatcaaagacgaggaacccggggatttggggagacccaagcctgagtgcgaaggttacgacccaaacgcgctctattgcatctgtaggcagcctcataataatagatttatgatctgttgcgataggtgcgaagagtggtttcacggggattgcgtcggcatctctgaggcccgtggccgtctgctggagagaaatggagaggactacatctgtcctaattgcaccatcctacaggtgcaagacgaaacccacagcgaaacggcagatcagcaggaggccaagtggaggcctggcgacgctgacgggacagactgcacctcaataggtaccattgaacaaaaaagctctgaagatcagggaattaaagggcggatagaaaaggccgccaatccttctggtaaaaagaaactgaagatattccagcccgtgattgaagcccctggcgcctctaaatgtattgggccaggctgctgtcatgtggctcagcctgactccgtgtactgtagcaatgattgcattctgaagcatgccgcagccacaatgaaattcttgtcaagcgggaaggagcagaaaccgaagcctaaggagaagatgaaaatgaaaccagagaagccatctctgcccaagtgtggagctcaggcagggattaagatctcaagtgttcataagaggcctgccccagaaaaaaaggagaccacagtgaaaaaggcagtcgtggtcccggcccggagcgaggctctgggtaaggaggcggcttgtgagtccagtaccccatcatgggcaagcgatcacaactataacgctgtgaagcccgagaagacagctgcccccagtccatcacttttatataaatgcatgtatcatctcggcgtcggccttctcgatccctctcgctcattttggattgccataccctgggcctgtcccggtctaggggttgctgcgctgtgttag

SEQ ID NO: 14891 - DNA, 360 bp, Artificial Sequence
  Description of Artificial Sequence: Synthetic coding sequence
atgatcttgcaacagcccctccaaagaggcccacagggaggagcacagcgcctcccccgggcagctctcggggtgacgtggggactggacgctcgcgagcccttgaggaagcagttcctttccgaagagaatatggcgactcacttctctcagttgtcacttcacaatgaccatccttattgtagtcctcccatgaccttcagcccagcccttccccctctgaggagcccttgctcagaactgttactctggaggtaccccggatctctgatcccagaagcactgcgtctgctccgcctgggggatacccccagccccccatatcctgccacacccgcaggcgacatcatggagctgtag

SEQ ID NO: 14892 - DNA, 1794 bp, Artificial Sequence
  Description of Artificial Sequence: Synthetic coding sequence
atggtccccgaagaaagacgcgtgggactcagtagcgatgaaacatcatcagactcactgaagtcttggcacagtatttgtgttctggatagtaaagaacaacccctggcctgccagcagaagcagcgccagtttgtgaaacctgtgacagaaagcgaacaacccaccgtgcttgaactgctgctggctgagttgaggacgttatttagcgccgtcctgcaggactcgtccccagctgcctggagatatctgcatgccgtcttagggctgctgcccccttatcgcgaacttttggttggtcaccttgatcttctcccgttcctcgagcagttatactgctgggccccatgggtacagacacatttgcacctggacttgctgggcgctatcgtgcaggccttcccacctgatagttcacttctcgattctgcctcccatgcagattgctgtccacaaaagcggcgtcttcaccatagacccccgtgtcctgcatgtccatttgttcaggcgcaatggtcaaggcagcaggtaaaagaagagctggcaacctggctgaggcctctgacattgccagagttgcagagatgcttgggtatagtgggcgctcaggttgcactcgaagaggccgtgtggctcgacggactctctctgctgcccctggccttagctgctgacatccccgtgcgctacgagtcgagcgatacagacaacgccgaagttgagcctgtcggaaggaaagaaacgagaagccagctcgattacgaagtcccccgagaaaaggctttccaaaagtcctccactggctttagcccagaaacaagctttctggatagccaggttatgacggccctcaagatggagaggtatctgaaaaagattcactttctctatctgaacgtggctccttccaggtactttaggccttatagtttgatggtggtacctcctgataaggtaaatccagagcattatatattttcaccctttgggatactccatgtgcatcccgtggaggggtcagagaccatgaccctaggcacctggcatcaccactgtgtcctgtggcagcagttgcaatttattcccttcttcaagtactgtttgcttcggaaaagctttacatgttggaaaaagaatgttagactgcagggacttcatcgtcttcagaagttcctggaaaaccacttgctccttgccgtgcctcacttcggagctggtttgttacacattagtaggctactgcaggaactgcatagtgtgagctggctgcctcaagaactcgacagatgttacgaactgctggatttgcaaaccgcccttgccgaagaaaaacacaaggctctaagacttctccaccggtgtcttaacctgtgtacctccatcctgcgtctggtgcatgaagacacctaccacatgcagcagtgtttacaagagagggttcagaactgcgaccggatcaggaccggccagggatctatttaccttcagcgagtgcagcacaagcagctggagcaaaagctgaagcaagcagaggcctggtggctacagcttggaaagtttgcccggctagttgactatatgatttgtcagtctctcatctccgttttagaggaacagatcaccagctttgtggcaaacattctgcaagcccccagacagaagccgttcctgagctcccagctggtgtttgacgaccacggtcagttgtcccatgtcccttgtgtcgagaacatgattcagaccctgaccggtgggcttcaaagtgtcaaaaccagcgccctgcaggtattttag

SEQ ID NO: 14893 - DNA, 591 bp, Artificial Sequence
  Description of Artificial Sequence: Synthetic coding sequence
atggaggatctgtttgagacttttcaggacgagatgggcttctccaacatggaggacgatggccctgaggaggaagaaagggtcgccgaacctcaggccaacttcaacaccccccaggccctgaggttcgaagagctgctggccaatctcctcaatgaacagcaccagatcgcaaaggaactcttcgaacaactgaagatgaagaagccttctgctaaacagcagaaggaagtggagaaggtgaagccccagtgtaaagaggtgcaccagacactgatactggaccccgcccagaggaaacggcttcagcaacaaatgcaacagcacgtccagctgttgacacagatccacctcttggctacgtgtaaccccaatctcaatcccgaggccagtagcacacgcatatgcttgaaagaactaggtacttttgcccagtccagcatcgccctccaccatcagtataaccctaaattccagactctatttcagccatgcaacctgatgggcgccatgcaactgatcgaggatttcagcacacacgtgtcaattgactgtagtccgcacaaaactgtcaaaaagacagtttgctag

SEQ ID NO: 14894 - DNA, 888 bp, Artificial Sequence
  Description of Artificial Sequence: Synthetic coding sequence
atggagctcatccaggatacaagcaggccacctttagagtatgtcaagggggtgccgctcatcaaatacttcgctgaagccttaggccctttgcagtccttccaagctagacccgatgacctgcttattaatacataccccaaaagtggaaccacttgggtgtctcagatactggatatgatttaccaggggggcgacttggaaaaatgcaacagggcccccatatatgtgagggtgccattcctcgaagttaacgatcctggtgagccttccggtctagagaccctgaaggatacaccgccaccaagattgatcaaaagccatctgcctctggcgctcctgccgcagaccctgttggaccagaaagttaaggtggtctacgtcgcgagaaaccccaaggatgtagctgtgtcctactaccacttccatcgaatggagaaggcccacccagagcctggaacctgggatagtttcctggagaagttcatggcgggggaagtgagctacggctcgtggtatcagcacgtgcaagaatggtgggagctatcccgaacccaccccgtgctctatcttttttatgaagacatgaaagagaatcctaagcgggagatccagaagatactggagtttgtgggtagatctctccctgaagaaacgatggatttcatggtgcaacacacgagtttcaaagagatgaaaaaaaaccctatgacaaattacaccactgtcccacaggagttgatggatcattccatttcccccttcatgcggaaaggcatggcaggcgactggaagacgacttttaccgttgcccaaaatgagagatttgacgctgactacgcggagaagatggcaggttgctctctttcatttagatccgagctgtag

SEQ ID NO: 14895 - DNA, 915 bp, Artificial Sequence
  Description of Artificial Sequence: Synthetic coding sequence
atgaaacgggctcacccagaatactccagttccgactcggagctggacgagactattgaggtagagaaggagtctgctgacgagaatgggaatctgagtagtgcccttggtagcatgtctcccacaacttcatcccagatcctggccagaaaaaggaggaggggaataattgagaaaagacgaagggatcggatcaataacagtctgagcgaattgcggcggctcgtcccatccgccttcgagaagcagggcagcgccaagctggagaaggccgagattctacaaatgactgtagatcacctgaaaatgctccatactgcaggcggcaagggctacttcgatgcccatgctttggcgatggattatagatcgctgggcttcagagagtgtctcgcggaggtggcccgctacctaagcataatcgagggcctggatgcaagcgaccctctccgagtaaggctcgtgagccacctaaataattatgcttcccagagggaagccgccagcggcgcccacgctggactgggacacattccttggggaacagtgttcgggcaccacccccacatcgcacatcctctgctgttgcctcagaacgggcatggtaatgctggcactaccgcctcgcctacagagccgcaccatcaggggcgactgggcagcgcacacccagaggccccggccttaagggctcctccctcaggatctctaggtcctgtcctgcctgtagtcaccagcgcaagtaagctgtccccccccctgctaagctccgtcgctagcctatctgcttttccttttagctttggaagcttccatttactgagccccaacgccctgagtcccagcgctcctacacaagctgccaatctcggcaagccttatcgcccgtggggtacggagataggggcgttctag

SEQ ID NO: 14896 - DNA, 2529 bp, Artificial Sequence
  Description of Artificial Sequence: Synthetic coding sequence
atgtgtggctccgagcggatcctccaagccggaaatatcctggagatacgggtggggcaggccggagcgcgccgggttgccactatgacatcgcctgtgcttgtggatattcgtgaagaggtgacctgccctatatgcctggaactcctgaccgagcctctgtcaatagattgtgggcactccttctgccaggcttgcatcacaccaaacggcagagagagcgtgattggacaagagggcgaacgtagctgccccgtctgtcagacttcttaccaaccaggaaacctgcggccaaatcgccatctggcaaatatcgttagacgcctcagagaagtcgtgctgggcccaggtaagcagcttaaggccgtgctatgtgctgatcatggagagaaactacaactgttttgtcaagaggacggcaaagtgatctgctggctgtgtgagaggagccaagagcaccggggccatcatacattcctagtagaggaggtcgcccaagagtatcaggagaagtttcaggagagtctgaagaaacttaagaatgaggagcaggaagcagagaagcttaccgctttcattcgcgagaaaaaaactagttggaaaaatcagatggagcctgagcgctgtcgcatacagaccgaattcaaccagctgagaaacattttagacagagttgagcagagggaactaaagaagttggaacaagaagagaaaaagggactgagaataattgaggaagccgagaacgacctagtgcaccaaacccagagcctccgggagctgatctctgatctcgagcgaaggtgccagggcagtacaatggaactgctgcaggacgtttctgatgtgactgagcgaagtgagttttggaccctccgcaaaccagaagcactgcctacaaagctcaggtccatgtttagggcgcccgatctgaaacgcatgctcagagtgtgcagagagctcactgatgttcaaagttactgggccatacaggggagtcttactagaagggagcgtagggcctccggtgtacgaaccaggcgttcccaggggagttcggctatggccagtaagatcctgctcaatgtacaggaagaggtgacctgtcccatctgcctggagttgctgacggaaccattgagcctggactgcggtcactctctctgtcgcgcctgcatcactgtgtctaacaaggaagctgtgacctccatgggggggaaaagttcctgccccgtctgtggcatcagctacagcttcgaacatctgcaggctaaccaacacctggcgaatattgtcgaaagactcaaagaagtcaagctttcccccgataatgggaaaaaacgtgatttatgtgaccatcatggtgagaaactgttacttttctgcaaggaagatagaaaggttatatgctggctgtgcgaaaggtcccaggaacacaggggacatcatactgtgctgactgaggaagttttcaaagagtgccaggagaaactgcaggcggtgcttaagcggctgaaaaaggaggaagaagaagcggagaaactggaggccgatataagggaggagaagacctcatggaagtatcaggtccagaccgagagacagcgtatccagacagagttcgaccagcttcgaagcatcctcaataacgaggaacagcgggaactgcagcgcctggaggaggaggagaagaagactcttgacaagttcgctgaagcggaagacgagttagtacagcaaaagcagctagtaagggagttgatctcagacgtggagtgtcgatcacagtggagcacaatggagcttcttcaggatatgtcgggcatcatgaagtggtccgagatttggcggctgaaaaagccaaaaatggtgtccaaaaagctgaaaaccgtttttcatgccccagatctcagcagaatgttacagatgtttcgcgagctgactgccgtccgctgctattgggtcgatgtcaccctcaattccgtaaaccttaatctgaacctggtgctcagcgaggatcagagacaggtgatcagcgtgcccatctggccctttcagtgctataattatggggtgctggggtctcaatattttagctcaggtaaacattattgggaggtagatgtcagcaagaaaacagcctggattttaggagtttactgcagaacgtattcccggcatatgaaatacgtggtccggcgttgcgccaaccggcaaaatctgtacaccaaatatcgcccgctgttcggctactgggtaattggcctccagaataagtgcaagtacggtgttttcgaagaaagtctcagttctgacccagaagtgctgacgctgtcaatggcagtccctccctgccgtgtgggtgtgtttctggattatgaggcgggaattgtttctttctttaatgttactagccatggctctctgatctacaagttcagcaagtgttgtttctctcagcctgtgtatccctattttaacccctggaactgccctgcaccgatgacgctgtgtcccccctcgtcctag

SEQ ID NO: 14897 - DNA, 1497 bp, Artificial Sequence
  Description of Artificial Sequence: Synthetic coding sequence
atgaacggggcgctcgaccatagcgaccaacccgaccccgatgccatcaagatgttcgtgggccagatccccaggtcctggagcgagaaggagttgaaggaactatttgaaccttacggcgccgtatatcagattaacgtactcagagaccgtagtcagaatcccccccagtccaaggggtgttgtttcgtgaccttttacacacgcaaggcggccctcgaggcgcagaatgccttgcacaacataaaaacattgccgggtatgcaccaccccatccagatgaaacctgccgacagcgagaagagcaacgccgtcgaagatcgtaagctatttatcggaatggtaagtaagaagtgcaacgagaacgacatacgagtgatgttcagccctttcggccaaatcgaggaatgccgaatcctgaggggccctgacggactgagccggggctgtgcgtttgtcacattctccacccgggcgatggcccagaacgctattaaagctatgcaccaatcccaaactatggagggctgtagcagccccattgtagtcaagtttgccgatacccaaaaggacaaagaacaacggcggctacagcagcagctggctcagcaaatgcagcaactgaacaccgccacttggggcaacctgacgggtcttggcggtctcacaccccagtatctagcccttctccaacaggccacatctagctcgaacctaggcgcctttagtgggattcaacagatggccggtatgaatgctctgcagctccaaaacctggcaacattagccgccgctgccgcagcagcccagacctctgccactagcacgaacgctaaccctctcagtaccacgtcaagcgccctgggtgctctcactagccccgtggccgcctctacgcctaattcaacagctggcgccgccatgaactcgctgacttctctgggaacgctacaaggcctggctggggctacagttggcctgaacaacattaatgcgctcgctgcccctcggagtaagcgcttactgttgcctaaggataacaacggcatggcagcgctgaacggaggattaggggccaccgggctgaccaacggcaccgctggcaccatggacgcgctgacacaggcgtacagtgggattcagcagtatgctgctgcagcgttgcctactctgtattcacaatcactcctacagcagcagagtgcggctgggagccagaaagaaggacctgaaggagctaaccttttcatatatcacctgccccaggagttcggagatcaggatatcctgcagatgttcatgccattcgggaacgtgatatctgcaaaggtgttcatcgataaacagaccaatttgagcaaatgtttcggcttcgtgtcatatgacaatcctgtgagcgcgcaggccgccattcaggcgatgaatgggttccagatcgggatgaagcgcctcaaggtgcagctgaaaagatctaagaacgattctaaaccttactag

SEQ ID NO: 14898 - DNA, 2580 bp, Artificial Sequence
  Description of Artificial Sequence: Synthetic coding sequence
atgctagaagtcctggaagagatctggagtgtgcgagccaggagggcccatcgtccctgtccggggccgtccctggctgacgacaccgatgctaattccaacgggagttccggcaacgagagcaacgggcatgaatcccgtggagccagtcagcggagtagccatagttcttcatcaggtaacggcaaggactcagccctcctcgaaacgactgagtcaagcaagagcactaatagccagtccccctcaccgcctagctcctcaatcgcgtattctctcctgtcggctagttcagagcaggacaacccaagcactagtggatgtagttcggaacaatccgctcgagctaggacccagaaggagctgatgactgcactgagagaactgaagcttcgattacccccggagcgtcgtggtaagggtcggtcaggaacgctcgcgacactgcaatatgcacttgcctgtgtgaaacaggtgcaagccaaccaggaatattatcagcagtggtctcttgaggagggagagccatgttccatggatatgagtacttataccctggaggagctggaacacattaccagtgagtacacattacagaatcaggatactttctcagtcgccgtgtcctttctcaccgggcgtattgtctacatcagtgaacaggccgcagtccttctgcgatgtaagcgagacgtcttcagaggcacacgattttctgaactgttagccccacaggacgtcggagtgttttacgggtctactgccccctctcgcctgccaacctggggtacgggggcaagcgccggaagcggcctgcgagactttactcaagagaaatccgtgttttgtcggatccgaggtgggcctgatagagacccaggaccaaggtaccagccatttcggctgactccatatgtgacaaagatcagagtatcagatggagctcccgcccagccgtgctgtctcctgattgccgagaggattcacagtggttacgaggcccctcggataccccctgacaaacgaatatttaccacgcgacatacacctagctgtctcttccaagacgtcgacgagagagccgctccacttttgggttacctgcctcaagatcttttgggtgcaccagtgttactgttcctgcacccagaggatcgcccactcatgctggctatccacaagaaaattttacaactagcaggccagcccttcgaccatagcccgataagattttgtgcacggaacggagaatatgtgaccatggatacctcatgggcaggttttgtccacccttggtcgcgcaaggtagcgttcgttctcggccgccataaagttcgaacagccccactgaatgaggacgtgtttacacctccagcgccaagccccgccccatcactcgatactgatattcaggagctgagcgagcaaattcaccgactgctgttgcagccggtacactctccaagccctaccgggctgtgcggagtaggggccgtcacctcacccggacctctacacagccccggcagttctagtgacagcaatggcggcgacgcagaaggacctggtcctccagcccccgtcacattccagcagatctgtaaagatgtgcacctggtgaaacatcagggccagcagctgtttattgagtctagggcgcgaccccagtcacgcccccgacttcccgctactgggaccttcaaggcaaaagcacttccgtgccagtcacctgaccccgaactcgaagctggtagcgcccctgtgcaggcacctctcgccttagtaccagaggaggccgaacggaaggaagcttcgtcttgttcttaccaacagataaactgcctggatagcatccttcggtatcttgaatcgtgtaacctcccgtctaccaccaaacggaaatgtgcaagcagctcatcttacactaccagcagtgccagtgacgatgacaggcaacgtactggtcccgtgagtgtgggcactaaaaaagaccctcctagcgccgccctgagtggggaaggcgccaccccaagaaaggagcctgtagttggcgggactctatcccctctggccctggccaacaaagccgagagtgtggttagcgtgacttcacagtgttcattttcaagcactatcgtgcacgtcggcgataagaagcctccggaatcggacataatcatgatggaggatttacccggtctcgcccccggaccggccccttcacccgcacctagcccaaccgtggcaccagatcctgcacctgatgcctacaggccagtcggactcaccaaggccgtgttgagtctgcacacacagaaggaagaacaggcctttctctcacgattccgggacctgggacggctgagagggttagatagtagttcaactgcaccgagcgcactgggcgagcggggctcccaccttggacctccaggcgcctgcccacttccctctttaggtttagactgctggggcgtgggcctgaagggtggcgtgtcggcgcccggtactcaagcaggcgttgccagcaccacacgtccgtgcctcggcacaggcccttctttagcctccccgcactag

SEQ ID NO: 14899 - DNA, 1266 bp, Artificial Sequence
  Description of Artificial Sequence: Synthetic coding sequence
atggctagtagcagcgtcccacctgccactgtgtcagctgctaccgcgggccctggtcccggattcggtttcgcatcaaagactaagaagaagcatttcgttcagcagaaagtaaaagtgttcagagcggccgatccgctggtgggcgttttcttatggggagtggcccactccataaatgaattatcccaagtcccgcctcccgtaatgctgcttccggatgattttaaggcatctagcaagatcaaagtcaacaaccatttgttccaccgagagaaccttccctcacactttaaattcaaagagtattgtccacaagtgttccgcaatttgagggatcggttcggcatcgatgatcaggattacctcgtgagtctcactaggaacccaccctctgagtctgaaggctccgatggccgattcctgatatcttacgaccggaccctggtcatcaaagaggtttcaagtgaagacatcgccgacatgcattccaatctgtctaactatcatcagtatatagtgaaatgccatggcaatactctcttgcctcagtttctgggaatgtatcgcgtcagcgttgacaacgaggattcttacatgcttgttatgaggaatatgttctcccaccgactcccagtccacaggaaatatgacctgaaggggagtctggtctcgagagaggcctcggacaaggaaaaagtgaaagaactcccaaccctgaaggacatggatttcctcaacaagaaccagaaggtctacattggggaggaagagaagaaaatcttcttggaaaagcttaagcgcgatgtggaatttttggtgcagctgaaaatcatggattacagtctcctgttaggaatccatgatatcatccgaggctctgagcccgaggaggaagcccctgtgagagaagatgagagcgaagtggacggtgattgttcattaacagggccacctgcactggtcgggtcttatggcaccagccccgaaggaattgggggatatatacacagccaccggcccctgggaccaggggaatttgagagctttattgacgtctacgcaatccgatcggccgagggcgcccctcaaaaggaagtgtacttcatgggtctcatcgacattttaacacagtacgacgccaaaaaaaaagctgcacatgcagcaaaaaccgtgaagcacggcgcaggcgcagagatatctaccgttcacccggaacagtacgcaaagcgtttcctggattttattaccaacatctttgcatag

SEQ ID NO: 14900 - DNA, 2031 bp, Artificial Sequence
  Description of Artificial Sequence: Synthetic coding sequence
atggccgccgccacaggagatcccggcctaagcaagctccagtttgcacctttttcctccgcactggacgttggcttttggcatgagctcacccaaaagaaactaaacgaatatcgtctcgatgaagcacccaaggacatcaagggttactactacaatggagactccgctgggctccccgctcggctgactctggaattctctgcgttcgacatgtcagcgcctacccccgcaaggtgttgccccgccatagggactctctataataccaacactctggaatctttcaagacggccgacaagaagctgctgttggagcaggctgctaacgagatctgggagtctatcaaaagcggcaccgctctcgaaaatcctgttctgctcaataaatttcttttgctgacatttgcggatctgaagaaataccacttttactattggttttgctacccggcgctatgtttgcccgaaagcctgcccctgattcagggacctgtgggtttagatcagagattttccctcaagcaaatcgaggccctggaatgcgcatatgacaacctttgccagacagagggtgtcaccgcgctgccctattttttgatcaagtacgatgagaacatggtgcttgtaagtctcctcaaacattatagcgattttttccaaggccagaggaccaagatcactatcggcgtgtatgatccctgcaatctcgcacaataccccgggtggcccctgcgtaactttctcgtcctggccgcacaccgctggtctagtagttttcagtctgtggaagttgtctgcttccgtgaccggaccatgcagggcgcccgagatgtggctcatagcattatctttgaggttaagctgccagaaatggccttcagccctgactgccctaaagcagttggttgggaaaagaatcaaaagggtggaatgggtccacgcatggtcaatctgagtgagtgtatggacccaaaacgtttagctgagagcagcgtggacttgaatctgaagctgatgtgttggcggctcgtccccacccttgacctagacaaggttgtgagtgttaaatgcctcctgctgggcgcgggcaccctggggtgtaacgtagcacggacgctgatgggctggggagttagacacattacctttgtcgacaacgctaaaatctcatacagcaaccccgtacggcagcctctatacgagttcgaagattgcctcggcggtggcaagccaaaggctctagccgcagcagaccggctgcagaaaatcttccccggcgtgaacgcccgcggattcaatatgtctatccccatgccaggacaccccgtgaacttctccagcgtcaccctggaacaggctagacgcgacgtcgagcagcttgaacaacttattgagtcccacgacgtggtgtttctgctaatggacactcgagagagtagatggctgccagctgtgattgcggcgtccaaaaggaaattggtgatcaacgccgccctagggtttgacacttttgttgtgatgcgacacggactgaagaaaccgaaacaacagggcgcaggagacctgtgccccaatcaccccgtggccagcgccgaccttttggggagcagcctgtttgccaatattccaggctataaactaggttgctacttctgtaacgatgttgttgctcccggagatagcacccgggacagaactctggaccagcagtgtacagttagtcgcccaggactggccgtcatcgcgggagctttagccgtggagcttatggtctcagtgctccagcatcctgagggagggtatgctattgccagttcatcagacgacagaatgaacgagcctcctacaagcctgggactggtcccccaccaagtgctggatcagtacgagcgcgagggatttaacttcctggccaaagtgttcaacagttctcacagttttctagaggatctgacaggccttaccctgttgcaccaggaaactcaggccgcagagatatgggacatgtctgacgacgagacaatctag

SEQ ID NO: 14901 - DNA, 1329 bp, Artificial Sequence
  Description of Artificial Sequence: Synthetic coding sequence
atggccagtgatggtgcttcggctctacctggacccgatatgagcatgaagccgtcggctgctccaagccctagtcctgcccttccgttcctgccccccacctcagaccctccggatcaccccccacgggagcctccccctcagcccataatgccctccgtgttttcaccagacaacccactgatgctgtctgcctttcctagctctttgctggtgaccggggacggtggaccatgcctgtccggtgccggggccgggaaggtcattgtgaaggtaaaaaccgaaggtgggagcgcagaaccttcacagacccaaaacttcattctgactcagaccgccctgaacagcaccgctccgggcaccccctgcggcggcctcgagggtcccgcgcctccattcgtcaccgcttccaatgttaagactatcctgccaagcaaagctgtcggggtctctcaagagggcccccccggactgcctccccagccacccccaccagtggctcagctggtcccaatagtgccacttgagaaagcttggccaggtccccacggcacaacaggtgagggaggccccgtggctactttgagcaagccaagcctcggagatcgtagcaagatcagcaaagacgtgtatgagaactttagacagtggcagaggtacaaagcccttgcacgacgtcacctctcccagtctcccgacacagaagcagtgaaggaatacgtggatatcatggaatggcttgtgggaacacacctcgccactggagagagcgatgggaagcaggaggaagagggacagcagcaggaagaagaaggcatgtacccagaccctggcctgttgtcatatatcaatgaattatgtagtcagaaggtttttgtaagcaaggtcgaggctgtgatccacccccagttcctggccgacttgctgtctcctgaaaaacagcgggaccccctagccctgatagaggagctggagcaggaagaggggctgacactagcccaactagttcagaagcggctcatggcgctggaggaggaagaggatgccgaagccccgccctcattctcaggtgctcagctggattcatctcctagtggaagcgttgaagacgaggacggggacgggcggctgcggccttcaccgggtctgcagggagcgggaggagccgcctgcctggggaaagtcagttcttcagggaaaagagctagggaagtgcatggaggacaagaacaggctctggactcgccacgcgggatgcaccgtgacggcaatacactgccctctcccagctcatgggacctcccgacaaatggcgaaagccagtgttag

SEQ ID NO: 14902 - DNA, 666 bp, Artificial Sequence
  Description of Artificial Sequence: Synthetic coding sequence
atgcaggtccaggatgacggggtcaacctgattccctttgccaagtgctcaagggtggttagccgcagccctcccccccgcctgccaagtcaaagccttaggcctatgccccagcgctacggggacgtgttttggaagaatctgaaccagcgacccacacctacctggctggaggagcaacatattccaccgatgctgttacctcctcccgagatgctgtggcgtaggaagaagagaagaccatgcctggagggaatgcagcaacagggtctggggggtgtgcctgctcgagtgcgagctgttacctatcaccttgaagacctaaggcggaggcaatccataataaacgagctgaaaaaagctcaatggggctccagtggggctgcctcggaacctgtcgtgctcggagaggaggggtgtggctttccctcaactaatgaataccccgatctggaagaagagcgcgctacatacccgcaagaggaggatcgttttctgacacctggaagagctcagctgttgtggtctccatggtcacccctggatcaggaggaggcatgcgcttccagacagctgcattctctggcctccttttccacagtaactgcaagacgcaatccccttcataacccatggggaatggagctcgccgcttcagaggaatag

SEQ ID NO: 14903 - DNA, 480 bp, Artificial Sequence
  Description of Artificial Sequence: Synthetic coding sequence
atgcagagggtgggtaacacattctcgaatgaatcccgcgtcgcgtctcgatgcccttctgtgggattagcggagcgaaatagggttgccactatgcccgtgcggctcctgcgagactcccctgcagctcaggaggacaacgaccacgctagggacggcttccagatgaagctggatgcccacggctttgcaccagaggagctcgtggtgcaggttgacggccagtggctgatggtcactggccagcagcaactggatgtgagggacccagagcgggtaagctatagaatgtcccaaaaggtccaccggaaaatgttgccgagtaatctttctccgaccgctatgacatgttgccttacgccctcagggcagttgtgggtgagggggcagtgcgttgctttggctctgcccgaggcacagaccggtcccagcccacgactgggtagcctcggttcaaaagcatctaacctgacacgatag

SEQ ID NO: 14904 - DNA, 1782 bp, Artificial Sequence
  Description of Artificial Sequence: Synthetic coding sequence
atggagaaactgtcagccttacaggagcagaaaggggagcttcggaagcgcctgagttatacaacacacaagttggagaaactagagacagagtttgactccactcgccactatttagaaattgagctgcggcgcgcgcaggaggagctcgagaaagttacagaaaagcttcgccgaattcagagcaattacatggcactgcaacggatcaatcaggagctggaagataaactgtatagaatgggtcagcactatgaagaggagaagagggccctgtcgcatgagattgttgctctaaatagtcatctgcttgaagccaaagtaaccatcgacaagctgtcggaagataatgaactttacagaaaggactgcaatctagccgcccaactgctccagtgttctcagacctacggaagagtacacaaagtctctgagctgccatctgactttcaagagagagtgagcttacatatggagaaacacggatgctctttgccatcccctctatgtcaccccgcttatgcggacagtgtgcccacctgcgtgattgccaaggtgctcgagaagcccgatcccgctagccttagcagccgcctgtctgatgcatctgcccgtgatctggccttttgcgatggagtcgaaaagccaggccccaggcctccatacaagggcgacatctactgctcagataccgcgctgtactgtcctgaggaacgccggcgtgacagaagacccagcgtggacgcccctgtaaccgacgtgggattccttcgtgcgcaaaatagtacggattcagccgctgaagaggaggaggaggccgaggcggcagcttttccggccggttttcagcatgaagctttcccctcatacgctggatcactccccacctcctcctcatatagttcgttctccgcgacaagcgaggagaaagaacacgcacaggcatccacgctgacagcctctcaacaggccatatatctgaacagcagggacgagctgtttgatcgcaagccccctgcaacaacgtacgagggtagcccgcggtttgctaaagccaccgctgctgttgccgccccgttggaagcagaagtcgctcccggcttcggacgtaccatgtctccatatccggccgaaacatttcgcttcccagcctcccccggcccacagcaggcattgatgcctccaaacttgtggtctctacgcgccaaaccagggaccgccaggctaccaggtgaagacatgcgcgggcagtggagaccccttagcgtcgaagacattggcgcttactcctaccccgtgtccgctgctggcagagcttccccctgcagcttcagtgaacgttactatggtggggctgggggtagtcctgggaaaaaagccgacggcagagcaagcccactttacgcttcttataaggctgacagctttagcgagggggatgacctgtcacaggggcatcttgccgagccttgctttctgcgcgcaggaggggacctgagcctttctcctggtaggtctgcagatccgctgccgggctacgcccccagcgagggtggtgatggcgaccgcctcggagtccagctatgcggcacggcctcaagccccgaacccgagcagggatctagagactctctcgaaccgagcagtatggaggctagtcctgagatgcatcctgcagccaggctgtccccccagcaggctttcccacggaccggcggcagcggtttgtctaggaaggacagcttaacaaaggctcagctttatgggactcttctgaactag

SEQ ID NO: 14905 - DNA, 2610 bp, Artificial Sequence
  Description of Artificial Sequence: Synthetic coding sequence
atgggcaatcgtgagatggaggagcttattccactagtgaatcggcttcaagacgccttctctgcactggggcagagctgtctgttggagctgccgcagatcgctgtggtcggtggacagagtgcagggaaatcgtctgtgctcgagaactttgtgggcagagatttcctccctcgtggctctgggatcgtgaccaggcgcccgctagttttgcagctagtgacttctaaagctgagtacgctgagtttctgcactgcaaaggcaaaaaatttacagatttcgatgaggtacgcctagagatcgaggccgagacagaccgtgtgaccggaatgaacaagggcatctcctcaatccccatcaacttaagggtctatagtcctcacgtccttaatctgactttgatcgatctccccggtattaccaaggtgcccgtgggagatcagccccctgatatcgaatatcagattcgcgagatgattatgcagtttatcacccgagaaaactgtctgattttggcggtcacaccagctaatacagacctcgccaactcagatgcattaaagctggccaaagaggtggaccctcaaggtttacgtacgatcggcgtgattacaaagttggatttgatggatgagggtacagatgccagagatgtcctggaaaacaagctgctgccattaagacgcggctacgttggcgtggtcaatcggagtcagaaggacatagatgggaagaaggatatcaaggcggctatgctggctgaacgtaaattctttctcagtcatccagcttatcgccacatcgcggacagaatggggaccccgcacttacagaaagtgcttaaccaacagctcacaaatcatattagagatacactgcccaatttccggaataagctacagggtcaactattgtctattgaacatgaggtggaagcctacaagaattttaaacctgaagatcccaccagaaaaactaaggcactccttcaaatggttcaacagtttgcggttgatttcgaaaaaaggattgagggctctggagatcaggtcgacacccttgagttgtcaggaggggccaaaatcaatagaatttttcatgagcggttcccattcgagatcgttaaaatggagttcaacgaaaaggaactgcgcagggaaatcagctacgccatcaaaaatatccatggcatccggactggcctgttcacccctgatatggccttcgaagcaattgtcaagaaacagatcgtaaagcttaagggacctagcttaaagagcgtcgatctcgtcatccaagagcttatcaacacagtgaagaagtgtacgaagaaattggctaacttcccaagattatgcgaggagaccgaaaggatagtggccaaccatatccgcgagcgcgaaggcaagacaaaagatcaagtgcttctgctgatagatattcaggtgagctacattaatacaaaccatgaagattttatcggatttgccaacgcccaacagagatcttcgcaggtacacaaaaagaccaccgtagggaaccagggcacgaacctgccaccctctaggcagatcgtaattcgaaaaggctggttgactattagcaacattggaatcatgaagggaggcagtaagggatactggttcgtcctgactgcggaatccctgtcatggtacaaggacgatgaggagaaggagaagaaatacatgctcccgctggacaacctgaaggtgagggacgtggagaagagcttcatgtccagtaaacacatcttcgcactgttcaatactgaacagaggaatgtctacaaagactatcggttcctggagctggcttgtgatagtcaggaggatgtcgactcttggaaggccagcctgctccgcgccggggtgtatcctgacaaatccgtggctgaaaatgacgaaaatggccaggccgaaaattttagcatggaccctcagctggagcgtcaagtggagacgatacgaaatctggtcgactcttacatgtccataatcaataagtgtattcgagacctgatcccaaagacaatcatgcacctgatgatcaacaacgtcaaagattttataaattccgagttgctcgctcaactctatagttctgaagaccagaatacactgatggaggagtctgcagagcaagcacagcggcgggatgagatgctacgcatgtatcaggccctaaaggaagcgctcgggattatcggagatatcagtaccgctacagtcagcacacctgccccaccccccgtggacgactcgtggattcagcacagcaggcgcagcccgcctccatcccctacaacacagcggagaccgacgctgtcggcccctctggcgcgccccacaagcggcagaggtcctgctccggcaattccaagcccaggtcctcactctggcgcccccccagtccccttcaggccagggcccttgcccccttttccttcgtcttcagattcatttggcgcgcctcctcaagtaccctcccggccaaccagggctccccctagcgtgccttctcgtaggccccccccgtcaccaactaggccgaccattattaggccacttgagtcaagcctgctggactag

SEQ ID NO: 14906 - DNA, 1896 bp, Artificial Sequence
  Description of Artificial Sequence: Synthetic coding sequence
atgaacagctcagatgaagaaaagcagctgcagcttattacttcactgaaggaacaggcaataggagaatacgaggatctgagagccgagaaccagaaaaccaaagagaagtgcgacaaaatcagacaagagcgagatgaggctgtgaagaagctcgaggaattccagaaaataagccatatggtgatagaggaagtcaactttatgcaaaatcatctggagattgaaaaaacgtgccgcgaatccgctgaagctctggcaacaaagcttaataaagagaataagacattgaaacgtataagcatgctgtacatggcaaagctgggccctgatgttattactgaagaaataaatatagatgatgaggactcaacgactgacactgatggagcagctgagacctgtgtcagcgtgcaatgccagaaacaaattaaagagctccgggatcagatcgtgtctgtacaggaggagaagaaaattctggccatcgaactggaaaacctaaagtccaaactagtcgaggtgatagaggaggtgaataaggtgaaacaggagaagaccgtgctgaacagtgaggttctcgaacagcgtaaggtcctagaaaagtgtaatcgggtctcgatgctggccgtcgaggagtacgaggaaatgcaggtcaatctggagttggagaaagaccttagaaaaaaggcggagtcatttgcccaggagatgtttatagagcagaataaacttaaacggcagtcacacctcttactgcaaagcagcatacctgaccagcagctactcaaggcattagatgagaacgcgaaattgactcagcagctcgaggaggagcgcattcagcaccagcagaaggtgaaggagctagaggaacagctcgagaacgagactcttcacaaagaaattcacaatctcaaacagcaattggagctgctggaggaggataaaaaagagttagagctcaaatatcagaactccgaggagaaagcccggaaccttaaacatagcgtggacgagctgcagaaaagagttaaccagtcagagaactccgtaccacctccaccccctccacccccacctctgccaccgccgcctcccaatccaatccggagtctcatgagcatgatacggaagcgctcacaccccagtggcagcggggcgaaaaaagaaaaggcgacccagccggaaacgaccgaagaagtcacggacctcaagagacaggccgtggaagagatgatggatagaatcaagaagggagttcatctgcggccggttaaccagaccgccaggccaaagacaaaaccagagtcatccaagggttgcgagtcagccgtcgatgaactgaaaggaatcctggggacccttaataagagcaccagctcccgcagcctgaaatctctggaccccgagaattccgaaacagagctggagcgcattttgaggagaaggaaggttactgccgaggccgacagctcctccccaaccggaatcctcgcaacatctgaaagcaaatcaatgcccgtgctcggctcagtgtcctcagtaaccaagaccgccctgaacaaaaagactttagaagcagagttcaattcgccatccccccccacccccgagccgggagagggccctcgaaaactggagggatgcacctcctccaaggtgacttttcagcccccttctagtattggctgccggaagaagtacatcgacggagaaaagcaggctgagcccgtcgtggtccttgatccagtcagtacccacgagccccagacaaaagaccaggtggctgaaaaagatcctactcaacacaaagaagacgagggcgaaattcagcccgaaaataaagaagacagcattgagaacgtgcgggagactgactcctcaaactgttag

SEQ ID NO: 14907 - DNA, 1701 bp, Artificial Sequence
  Description of Artificial Sequence: Synthetic coding sequence
atggatctgcatcgggcagcatttaagatggagaactctagttacctcccgaaccccctcgctagcccggccctcatggtgctggcctcgaccgcggaggcttcacgggacgcctctataccctgccagcagcctcgcccctttggcgtgcccgtgtccgtggacaaagacgtgcatattccctttaccaatggctcctatacctttgcctccatgtaccataggcagggcggcgttcccggcacattcgccaatcgtgattttccaccctctctgctacacctgcacccccagttcgcccctccaaatctcgattgcactcctatctctatgttgaatcactccggagtgggggccttccgtccctttgcatccacggaggatagggaaagttatcagtcagctttcaccccagcgaagaggctcaaaaattgccacgacacagagtctccccatctgcggtttagcgacgcagatgggaaagagtatgatttcggcacccagctgccctcctccagtcccggctctctcaaggtggacgacactggaaagaagatattcgctgtcagcggattaatctcagaccgggaagcatctagcagcccagaagatcggaacgatcgatgcaaaaagaaagccgccgcgttatttgactctcaggcaccaatttgccccatctgccaggtcttattgcgaccctctgaactgcaggaacatatggaacaggagcttgaacaattggcccagctcccgtcgtctaagaacagccttttgaaagacgcaatggcgccgggcactcccaagtctctgcttcttagcgcaagtatcaagcgggagggagagtctcctaccgcttccccacactcctccgcaaccgacgatctgcaccactccgatcggtaccagaccttcttgagggtcagggccaaccggcagacaaggctcaatgcccgcatcggtaaaatgaagcggcggaagcaagacgagggtcagcgggaaggctcatgcatggccgaagatgacgccgtggacattgagcatgaaaacaataacagattcgaggaatatgagtggtgtggacagaaaagaatacgggctacaactctgctcgagggtgggttccgagggtctggattcattatgtgctccggcaaggaaaaccctgattcagacgccgacttagacgtagatggagatgataccctggagtacggcaaaccacagtataccgaagccgatgtgatcccctgtacaggggaagaacctggcgaggccaaagagcgcgaggcgctcagaggcgcagtgttgaatggcgggcccccctcaacacggatcactccagaattctcaaaatgggccagcgatgagatgccaagcacatcgaatggagaatcatcaaaacaggaagcaatgcaaaagacctgcaaaaactctgatatcgaaaaaattactgaagatagcgccgtcacaacttttgaagcccttaaagcgcgggtgagagagcttgaacgacagttgtccagaggcgaccgttataagtgcctgatttgcatggattcctacagcatgcccctgacatcgatccagtgttggcatgtgcattgtgaagagtgctggctgcgcaccctcggagccaaaaaactgtgtcctcaatgtaacacaataaccgcgccgggagacttaaggcggatttatctctag

SEQ ID NO: 14908 - DNA, 1071 bp, Artificial Sequence
  Description of Artificial Sequence: Synthetic coding sequence
atgttgtctgctatcacgaacgtggttcagaacacaggcaaatccgtcctgacaggcggtctagatgcccttgaatttattggaaagaagacaatgaatgtgctagccgaaagtgatccaggcttcaagcggactaaaactctgatggagcggaccgtcagtttgtctcagatgcttcgcgaagcaaaggagaaagagaagcagaggttagcccagcaactaaccatggagcggacagctcactatggcatgctctttgacgaatatcaggggttgtcgcatttggaagccctagaaattctgagcaatgagagcgaatccaaagtgcagagcttcctggcttcgcttgacggtgagaaactcgaattgctgaagaatgatctgattagtatcaaggatatttttgccgccaaggagctggaaaacgaggagaatcaggaggaacagggtctagaggagaaaggtgaagagtttgcaaggatgctcaccgaattactgtttgagttacatgtggctgcaacgccagacaaactcaacaaagccatgaaaagggcgcatgattgggtcgaggaagaccagactgtagtgtctgtggacgtcgccaaggttagcgaagaggaaacaaaaaaagaggaaaaagaagagaagagccaggatccccaggaggacaagaaagaagaaaagaaaactaagacgatcgaagaggtgtatatgagctcaatagagtcgctcgcggaagtcactgcccgctgcattgagcaacttcataaagtggctgagttgatcctgcatggccaagaggaagagaaaccggcacaagaccaggccaaagtgctgataaagttgaccacagccatgtgcaacgaggtggcgtccctgtccaaaaagtttacaaattctctcacaaccgtcggctccaataagaaggctgaagttctgaatcccatgatctcatcagtcttattagaggggtgcaattcgacgacttatattcaggacgctttccagctgttgctccccgtgctgcaagtgagccacattcaaacctcgtgccttaaggcccagccttag

SEQ ID NO: 14909 - DNA, 519 bp, Artificial Sequence
  Description of Artificial Sequence: Synthetic coding sequence
atgtcctacaactgctgctctggcaacttttctagtaggagctgcgggggttatttacattatcctgctagttcttgcggcttcagttatccgagcaatcaggtttatagtaccgatctgtgttccccatctacctgccagcttgggagcagcttatacagggggtgccagcagacttgctgggagcctacatcctgccagacgtcctacgtggagtcaagcccttgccagacatcctgttatcgcccacgcactagcctcttgtgctccccttgccagaccacatattccgggagcttagggttcggatcaagttcttgtcgttctctgggatacgggtcccgatcctgctactcagttggttgtggtagctccgggttccggtccttgggatacggcggctgcggcttccccagcctcggttacggggttggcttctgtcgaccaacctatctggccagtagatcctgtcagtcaagttgttataggcctacctgtggatccgggttttattactag

SEQ ID NO: 14910 - DNA, 2253 bp, Artificial Sequence
  Description of Artificial Sequence: Synthetic coding sequence
atggaagacctgttcgagaccttccaagatgagatgggcttctctaatatggaggatgacgggcctgaagaagaggagagggtggccgaaccacaggcaaactttaataccccacaggcacttaggttcgaagagctcctggcaaacctcttgaacgaacagcatcagatcgcgaaagagctgtttgaacagcttaaaatgaaaaagccttctgcaaaacaacaaaaagaagttgagaaggtgaaacctcagtgcaaagaagtccaccagactctaattcttgatccagctcagaggaaacgtttgcagcaacagatgcaacagcacgtacagttattgacccagatacaccttctggctacctgcaaccccaacctgaatcctgaagccagcagcacacggatctgtctgaaagaactcggcactttcgcacagagcagcattgccttgcaccatcaatataaccctaaatttcagaccctgttccaaccatgtaacctaatgggcgccatgcaattaattgaagacttctcaacacatgttagtatcgactgctcacctcataagacagttaagaaaaccgcgaatgaatttccatgtctgcctaaacaggtggcatggatcctcgccacctcgaaagtttttatgtaccccgagctgctacctgtctgtagcctaaaggcaaagaacccacaggataagattctgttcactaaggccgaggacaatttgttggcacttggcttgaagcactttgagggtaccgaattcctcaatcccttgatcagtaaatacctccttacttgtaaaacagcgagacaattgactgtccggataaaaaacctcaacatgaatcgggctccagacaacatcattaagttctacaaaaagacaaagcaactgccggtgctaggcaagtgttgtgaagaaattcagccacatcagtggaagcccccaattgaacgggaggagcaccggctccccttctggttaaaagcttcactcccctcaatccaagaagaacttcgccacatggcagacggcgcgcgggaagtaggaaacatgacaggcacaacggagataaactcggaccaaggactggaaaaggacaactccgaactgggaagcgaaacgaggtatcctctcctcctgcccaagggcgtcgtgctgaagctgaaacccgtcgctgatagattccctaaaaaagcctggcgccaaaagagaagtagtgtgctgaaaccgctgttaattcaaccaagcccttcgctacagccctcatttaaccctgggaagacacctgctcagtctactcatagtgaggcgcctccttcgaagatggttctgaggatcccccacccgattcagcctgctacggtgctacaaacggtcccaggcgtgccaccgctgggcgtatcaggaggcgagagttttgagagcccagcagcactcccagccatgccgccagaagctagaacaagcttccccctttcagagagccagaccctcctgagtagcgccccggtccctaaggtaatgatgcctagtccagcgtcatccatgttccgcaagccatacgtgcgacgaagacccagtaaaaggcggggggcacgggcatttaggtgcatcaagccagcgcctgtaatccatcccgcttcggtcatctttaccgtgcccgctaccaccgttaaaatcgtgagcctgggcggaggctgtaatatgatacagcccgttaatgccgctgtggctcagtctcctcagacgatacccatcgcgaccctgctggtcaatccaacaagcttcccctgtcctctgaaccaaccactggtcgccagttctgttagtcccctgatagtcagcgggaattcggtcaacctccctatcccgtctacccctgaagacaaagcacacatgaatgtggatattgcctgtgcggtggcagatggagagaacgctttccagggcctagagcccaaattggaaccccaagagctgagtccgctgtctgcgacagtgtttcctaaggtcgaacattcccctgggcctcctcccgttgataaacaatgtcaggagggcctgagcgaaaacagtgcttataggtggaccgtggtgaaaacagaggaggggagacaggctcttgaacccttgcctcagggtattcaggaatctctaaataactcttcccccggggatcttgaggaggtcgtgaaaatggagccagaggatgctactgaggaaatctcaggctttctgtag

SEQ ID NO: 14911 - DNA, 888 bp, Artificial Sequence
  Description of Artificial Sequence: Synthetic coding sequence
atggagctcattcaagacacctctcgcccaccactggaatatgttaagggcgttcccctaataaagtacttcgcagaggctctggggccacttcagagcttccaagcccgacccgacgatctgctgatcaatacatatccgaaaagtggaacaacatgggtgtcccagattttagacatgatttatcagggcggcgatctagagaagtgtaatagagccccgatctatgtgcgagtcccttttcttgaggtcaatgatcccggcgagccttcaggtctggagacccttaaagacaccccgccccccaggctgatcaagagtcacctgccgctcgcacttctcccgcaaacattgctggaccagaaagtgaaagtggtgtatgtcgctagaaacccaaaggacgtcgccgtatcttattatcattttcaccggatggagaaagcgcatccagagcccggaacatgggacagcttcctggagaagttcatggctggggaggttagttacgggagctggtatcaacacgtccaggaatggtgggagttatcgagaactcatcctgttttatacctattctacgaggacatgaaggaaaaccccaagagagagattcagaagatactcgaattcgtcggtcgctccctgccggaagaaactatggatttcatggtgcaacacactagcttcaaagagatgaaaaagaacccaatgaccaattacactactgtcccgcaggagctcatggaccactccatctctcccttcatgaggaaaggaatggctggggactggaagaccacttttacagtcgcgcaaaacgagcggttcgatgctgactacgccgaaaaaatggccgggtgtagcttgtctttcagaagcgagctatag

SEQ ID NO: 14912 - DNA, 1476 bp, Artificial Sequence
  Description of Artificial Sequence: Synthetic coding sequence
atggacaccaagggttgtaccacgacaaattcccctagtacaccctgtcaaaactgctccaggatcacgaacgtgtcaactatctcaagtaataatggatgccaccctggagggctgactgttaacaattgccaaccggctggtcacgttctgaggatcccatgggatcagggttgccaacccacaccccgcttctgccgtaagcccatctacctcatgaataatttcaatgctcgctttagtttagatgattgtagctggtatggcgaaggcattaactctaatgaaaaggaaacgatgcagatactgaacgagagactcgcgaattacctccaaaaagtcagaatgctggaaagggagaacgcggagttagaatccaaaatccaagaggagagcaataaggaactccctgttttatgtcccgattacctctcatactacaccaccatcgaagagcttcagcaaaagattctgtgtaccaaggcggagaattcacggcttgtctcccagatcgataatactaagcttaccgctgatgatctccgcgcaaaatatgaagcagaggtgagcctgcggcagctggtcgagtcagacgcaaatggtctgaaacagatattaaacgtgctcactctcggtaaggccgacttagaagcccaggtgcagagcctgaaggaagagctcctgtgcttaaaaaataatcacaaagaagagatcaattctctgcagtgccagttgggggagcgcctggacatcgaagtgacagcagctcctagtgcagatctgaatcaggtgcttcaggagatgcggtgccaatatgagccaattatggaaacgaatagaaaggatgttgagcagtggttcaatacccagatcgaggaattgaatcaacaggtagtcacttcttctcagcaacagcagtgctgtcagaaagagatcatcgagctgagaagatcagtgaacacactggaggtggagttacaggcccagcatagaatgcgggatagccaagaatgcatccttacagagacagaggcacgatacactgcgttactaacgcagatccagtccctgattgataatcttgaggcccagctggccgagatacgctgcgcactcgagcgccaaaaccaggagtacgaaattctgcttgacgtgaaatcgcgactcgaatgcgaaataaccacctatcggtctttgctcgagtccagtgacggaaagaggccatgctacccaagagcaaccaagtgcgaaccctcaccttggacatcctgcaaatctggtgctatcgaaagcactgctccagcctgtacaagcagctctccgtgctcactaaaagaacattgcagtgcgtgcggcccgctctctagaattctggtcaagatttgtactataacaaaagagatcaaagatgggaaagtgatcagctcatacgagcatgtgcagccttgctttatcatccggcctgctaaggtttag

SEQ ID NO: 14913 - DNA, 1287 bp, Artificial Sequence
  Description of Artificial Sequence: Synthetic coding sequence
atgaagcggggagggcgtgacagtgatcgcaactcaagcgaggaagggacagcggaaaagtcaaagaaactccggaccacaaacgagcactcacagacctgcgactgggggaacctacttcaggatattattctgcaggtgtttaaatacctgccgttgctggatagagcacacgcctcccaggtgtgtaggaactggaatcaggttttccacatgccagacctctggcgctgttttgagtttgagctcaatcagccagccacttcttacctgaaggctacacatcctgagttaatcaagcagattatcaaacggcattccaaccaccttcaatacgtcagtttcaaggtcgactcatctaaagagtcagcagaagccgcctgtgacatactgagccaactagtcaattgcagcctgaaaaccttaggccttatttcgaccgcgcggccgagctttatggatttgccgaaatcacattttatcagtgcacttacagtggtattcgttaacagcaaatctttatcctctctgaagatagacgacacccctgtagatgatcccagtctgaaagtactcgtcgccaataatagcgataccctgaagctgctgaagatgagctcttgtccccatgtcagtccagctggaattctgtgcgtcgcagaccagtgtcatggcttgcgtgagcttgccctcaactaccatttgctgtccgatgagctgttactggctctaagctctgagaagcatgtacgcctcgagcatctgaggatcgacgttgtctctgaaaatccagggcagacccacttccacaccatccagaagagctcctgggacgcgttcatacgccatagtccgaaggtaaatttagtgatgtacttcttcctgtatgaagaagaattcgatccgttctttcggtacgagattccagccacccacctgtatttcggtaggagtgtctccaaagatgtgttaggacgtgtcgggatgacatgccctcggttagtcgagctagtggtctgtgctaacgggcttaggcctctggatgaggaacttatcagaatcgcggaacgatgtaaaaatctctcggcaattgggttaggtgagtgcgaggtcagctgctccgcatttgttgagttcgtgaagatgtgcggcgggcggttgtcccaactgtctataatggaagaggtgttgattccagatcagaagtacagcctggagcagatccactgggaggtgtcaaagcacttgggcagagtctggtttccggatatgatgcccacttggtag

SEQ ID NO: 14914 - DNA, 3603 bp, Artificial Sequence
  Description of Artificial Sequence: Synthetic coding sequence
atgaacaccgactccggcggatgtgctaggaagagggctgcaatgagtgttaccctgacatctgtgaaacgggtacagtcaagccccaacttactggcggccgggagagatagccagagccccgactctgcatggaggtcctataacgatggcaatcaagaaacattgaacggagacgccacttactctagcctggccgcgaagggattccgatctgtccggcctaatcttcaggacaagcgaagccctactcaatcccaaattaccgtgaacggcaacagtggcggagccgtgagcccaatgtcctattatcagcgaccttttagcccttcagcttacagcttgccggcatctcttaatagcagtattgtgatgcagcatggaacttccctggattctaccgatacatacccccagcatgcacagtccctggatggcaccacttcttcaagcattccactctacaggagttctgaggaggagaagcgtgtcacggtcataaaggccccccattatcctggcataggtccagttgacgaatcagggatacctacagcaatcagaactaccgtcgaccgcccgaaagattggtataagactatgttcaagcaaattcacatggtgcacaagcctgatgacgataccgacatgtacaacacgccatacacttacaacgccgggttgtataaccctccgtactccgctcagagtcaccccgccgcaaagactcagacatataggccactgagcaagtctcacagcgacaatagtccgaacgcctttaaagacgcctcctcaccagtgcctccccctcacgtcccgccccccgtgcccccattaaggccccgcgatcggagcagtactgaaaagcatgactgggatcccccggacagaaaggtggatacacgcaagtttcgcagtgaacctaggtctattttcgagtacgagcctggtaagagcagtattttacagcacgagcgccccgctagcctgtaccagtccagcattgatcgatccctcgagcggccaatgtccagcgcatctatggcgtcagatttcagaaaacgccggaaatccgagccagcggttgggcctccaagaggcttgggcgaccaatcggccagtcggacttctcctggccgcgtcgacctccctggctcatcaacaactctcactaagtcctttacctcatcttcaccttcatcgccttctcgcgccaaaggaggagacgattccaaaatatgcccttctctgtgcagttactcgggcctcaacggcaaccctagctcagaactcgattactgtagcacatataggcaacaccttgatgtgccacgagactctccaagagcaatctctttcaagaacggttggcagatggcaaggcaaaacgcagagatttggagttccaccgaggaaacggtgagccctaagatcaaatcccgctcatgcgacgaccttttgaacgacgactgcgactcattccctgatccaaaggtgaagtctgagtctatggggtccctcctgtgcgaggaggattcaaaagaaagttgtcctatggcctgggggtctccttacgtgcccgaggtccgcagtaatggacgcagcaggatcagacaccgctctgcgaggaatgcccctggattcttgaagatgtataagaaaatgcatcgaattaatagaaaagacctcatgaactccgaggttatatgctcagtgaagagccgcattctgcagtatgaaagcgaacagcagcataaggatctcttaagggcctggtcacagtgttccactgaagaagtgcctcgagatatggtacctacgcgtatctcggagtttgaaaaactgattcagaagagtaaatctatgccgaacctgggtgacgatatgttgtctcccgtaacactcgagccgccacagaacggcctctgtcccaaacgaaggttctcgatcgagtatctgcttgaagaggagaatcagtccggcccccctgcacgcggccgcagagggtgccaatccaacgccctggttccaattcacatcgaggtcacttcagacgaacagccgagggcccacgtggagtttagtgatagcgatcaggacggagtcgtgagcgaccattccgactacatccacttggagggatcaagtttctgtagtgagagtgatttcgatcatttctcttttacttcctcagaatctttttacggcagcagccatcaccaccaccaccaccatcaccaccaccatcggcacttgatttcttcctgcaaaggtagatgccccgccagctacacgaggttcactacaatgcttaagcatgagagagcgcggcatgagaacaccgaggaacccagaaggcaggagatggaccctggactgtctaaactggcatttctggtgagtccggtcccgttcagaaggaagaagaacagcgccccgaaaaagcagaccgaaaaggctaaatgtaaagctagcgtgttcgaagccctcgatagtgccttaaaagacatctgcgatcagattaaagctgagaagaaacgcggcagtctgccagataactcaattctacaccgccttattagcgagctcctgcccgacgtgcccgagagaaattctagtctgcgagcattaaggcgctcaccacttcaccagccactgcacccgctaccacctgacggcgccatccattgccccccgtatcaaaatgattgcgggcggatgccccgaagcgcctcattccaagatgtagatactgctaattcgtcatgccaccatcaagaccgaggaggagccctgcaggacagagagtcccctcgctcttattcctctaccttgacagacatgggtcgcagtgcacccagagagagacggggaaccccagagaaggagaagctccctgctaaagccgtgtatgatttcaaagcccagacatccaaggagctgagttttaagaaaggcgacacggtgtacattctgcgtaaaattgatcagaactggtacgaaggcgagcaccacggcagggtaggtattttcccaatctcctacgttgagaagctcacaccgccagaaaaagcccagcccgctcgccctccaccccctgcgcagcctggtgagataggagaagccatagccaaatacaacttcaatgccgacacaaatgtcgagttgtctctgagaaagggggatcgagtcatacttctgaagcgcgtggaccagaactggtatgaggggaaaattcccggaactaatcgccaaggcatattcccagtcagctatgtcgaagtcgttaagaaaaataccaagggggcagaagactaccccgaccccccgattccacacagctattctagtgatcgaatccattccctcagctcgaacaagccacagaggccagtgtttacccacgaaaatatacagggcggcggggagccctttcaagcactgtataactacacaccaagaaatgaggacgagctggagctgcgagagagcgacgtgattgacgtgatggaaaagtgtgacgacggatggtttgttggaaccagtaggcgcactaagtttttcggcacctttccaggcaattatgtgaagagattgtag

SEQ ID NO: 14915 - DNA, 1470 bp, Artificial Sequence
  Description of Artificial Sequence: Synthetic coding sequence
atggaagactctgccagcgcctcattgtcaagtgcagccgcaacagggacctcaactagcacccctgccgcgccgacggcccgcaagcagcttgataaggaacaggttagaaaagccgtcgacgcccttctcacgcactgtaagagccggaagaacaactacggactgctgctgaacgaaaacgagtcactgtttctaatggtggtcctgtggaagatcccgtccaaagaacttcgagtcagactgactctgccacactctatccgatcggattcagaagatatttgcttgtttaccaaagacgagccaaactccacacccgagaagactgagcagttctatcggaagttgctgaacaaacatgggattaagacagtctctcagataatctcgttacagaccctaaagaaggaatataaaagctatgaggctaaactgagactcctgtccagctttgattttttcctcacagatgcccgcatccgccggttgctgcccagcctcattggtcgacacttctaccagcgcaagaaggtaccagtttcggtgaacctcctatccaaaaacttgagccgagaaattaacgactgtattggcggcacagttctgaacatcagcaagtcaggtagctgttccgccatcaggattggccacgtggggatgcagattgagcacataattgaaaatattgtcgctgttacaaaaggcttgagcgagaagctccctgagtgggagagcgtgaagctcctgttcgttaaaacagagaaatctgcggctctgccaatcttttcatccttcgtctccaattgggatgaggctaccaagaggtcactgctgaacaagaagaagaaggaggccagaagaaagaggagagagcgtaattttgagaagcagaaggagcgcaagaagaagcggcagcaagcccggaagacagcttccgtgctgtccaaggatgatgtggctcccgaaagcggggatactaccgtaaagaagccagagagcaagaaagaacagacccccgaacacggcaagaagaagagaggcagaggcaaagcccaggtaaaagcaacaaatgagtccgaggacgagattccccagttggtgcctatcggtaagaagaccccagctaatgaaaaagtggagatccagaagcacgctaccggaaagaagagccctgccaaaagccctaatccgtctactcctcgcggcaaaaagcgcaaagctctgccagcctctgagacacctaaggctgccgaaagcgagactccaggtaaatctcccgagaagaaacccaaaattaaggaagaggcagtaaaagagaaatcccccagcttagggaagaaagacgctcgccagaccccaaaaaagcctgaagcgaaattctttacaacgccatcaaagtcagtccgtaaggcctcccatacccccaaaaagtggcccaagaagcccaaagtgcctcagtccacctag

SEQ ID NO: 14916 - DNA, 3171 bp, Artificial Sequence
  Description of Artificial Sequence: Synthetic coding sequence
atggctggtgccttgagaaggggaagagccctggggtcacgcccatccgggcccactgtcagctcccgccgctctccccagtgccccgtggcccaggaaggcctaggggctaggtccaggccccgagtggcccccaggagcctcgcccgttgcggccccagtagtaggctgatggggtggaaaccatccgaggcccggggacagagtcagtccttccaggcctccggactgcaacccagatctctcaaagctgcccgaagggccactggacggcccgaccgctcaagggcagctcctcctaacatggatcctgatcctcaggctggagtgcaggttggtatgagggttgtgaggggcgtcgactggaaatggggtcagcaggatggtggggagggcggcgtgggcaccgtggtcgaacttggacgccacggaagcccttccacccccgacagaactgtcgtcgtccagtgggatcagggaacacgtaccaactatagagccggttaccagggagcacacgatcttctgctttacgacaatgcgcagattggggtgcggcatcctaacatcatctgtgattgctgcaaaaagcacggtttgcgaggcatgaggtggaagtgtcgagtctgcctggactacgatttgtgtacccagtgctatatgcacaacaaacacgagttggctcacgccttcgaccgctatgagaccgctcattctcgtcctgtgaccctgtccccaagacagggattacctaggatacccctgaggggaattttccagggagcaaaggtagtgcgagggccagactgggagtggggatcacaggatggtggcgagggtaagccaggaagggtcgtggacatcagaggatgggatgtcgagaccggccgctctgtggcttccgttacctgggctgacggaacaacaaacgtttaccgcgtgggtcacaaagggaaggtggacctgaagtgcgtgggtgaggccgctggaggattctactacaaagatcacttaccgcgtctgggaaagccagccgagctgcagcggcgggtttccgcagattctcaaccctttcagcatggcgataaagttaaatgtttgctggacaccgacgtgttgcgagagatgcaagagggacacggcgggtggaacccaaggatggctgaatttatcggacagaccggaaccgtgcatcgtatcactgatagaggtgatgtgcgggtgcaatttaatcacgaaaccagatggaccttccaccctggagcccttacaaaacaccactccttctgggtgggcgatgtagtccgagtgatcggagaccttgacaccgtgaaacggttacaggctgggcacggtgagtggaccgatgatatggctcccgccttgggccgggtggggaaagtggttaaagtgttcggggacggaaacctcagagttgccgtggcaggccagcggtggactttctctccttcctgcctagtggcatatcggccagaggaagatgctaacctggacgttgccgagagagcgcgtgaaaacaagtcctctctgagcgtcgctctggacaagctccgcgctcagaagtccgatccggagcaccctgggagattagtcgtagaagtcgcgctgggcaatgcagcccgagccctggacctcctcaggcgccgtccagagcaagtcgacacaaaaaaccaaggacgcactgcccttcaggtcgcggcctatctaggacaggtggaactgatccggttgctgttgcaggcacgcgcgggcgtggacctgccagacgacgagggcaatactgctctccattacgccgctctgggaaatcagcccgaagcaaccagagtactcctgagcgccggttgcagagcagatgctataaactctacccaaagtactgcactccacgtggccgtacagcgcggcttcctcgaagtggttcgagccctgtgtgagcgcggctgcgacgttaacctgcctgacgctcacagtgacacacccctccattcagccatctctgcagggacgggcgcttcaggcatcgtcgaggttttgaccgaggttccaaatatcgatgtgaccgccacaaacagtcagggttttactctgctgcatcacgctagcctcaaaggacacgcccttgccgtgcgaaaaatcctcgcccgtgccagacagctcgttgacgccaaaaaggaagacggcttcacggcactgcacctcgccgctcttaacaatcatagggaggtggcccagatcctaatcagagaaggccggtgtgacgtcaacgtgcgaaaccgcaagctgcagtctcctctgcatctcgcagttcagcaggcccatgttggcctcgtacccctgctcgtagacgccggttgttcggtaaatgccgaggacgaagagggggatacggccttgcacgtcgccctccagaggcaccagttgctgccattggtggctgacggggccggaggtgatcccggccctctgcaactgttatcacgcttgcaggcctcaggacttcccgggtccgccgagttgaccgttggcgccgccgtcgcctgcttcctcgcattggaaggcgctgacgtgtcttatactaaccataggggacgatcaccccttgacctcgcggccgaaggccgcgttctgaaggcccttcaaggatgcgcccaacggttccgcgagcgtcaagctggaggaggggccgcacccggccccaggcagaccctaggtactcccaacaccgtcactaacttacacgtgggtgctgcacccggccccgaagcggccgagtgcctggtatgcagtgagctggcgctgttggtgctgtttagcccatgtcagcatcggaccgtctgcgaggaatgtgcacgccggatgaagaagtgtatccggtgtcaagtggtggttagcaaaaagctccggcctgacggatctgaggtcgcaagcgctgcccctgcccccgggcctcccaggcaactcgtagaggagttacagagcaggtaccggcagatggaagagagaatcacgtgcccaatctgcattgactcccatattaggcttgtcttccaatgtgggcacggagcttgcgccccatgtggtagtgccttgagcgcatgcccgatctgtaggcagccaatccgcgaccgtatccagatctttgtgtag

SEQ ID NO: 14917 - DNA, 858 bp, Artificial Sequence
  Description of Artificial Sequence: Synthetic coding sequence
atgtccgaagctggagaggaacagccaatggagacgaccggcgcaactgagaatggacatgaggccgtgcccgaaggagaaagccccgcaggagcagggacaggagcagccgccggagcaggcggtgcgacagccgctccgcccagcggcaatcaaaacggggccgaaggcgatcagataaacgcaagtaaaaacgaggaggacgctggcaagatgttcgttgggggactgtcctgggatacctcaaagaaggacctcaaggattatttcaccaagtttggcgaagtggtagattgtaccatcaagatggaccctaatactggcagatctagggggtttggattcatcctgttcaaggatgccgccagtgtggaaaaagtgctggaccagaaagagcaccgattagacggccgggtcattgatcccaagaaggcgatggcaatgaaaaaagaccccgtcaaaaagatcttcgtcggaggcctgaaccccgaggcaaccgaggagaaaattcgggaatattttggtgaattcggtgagattgaagctattgagctgcctatggatccaaagttgaataaacgacgagggtttgtattcatcaccttcaaggaagaagagccagtaaaaaaggtgctggagaaaaagtttcatacagtttccggaagcaaatgcgaaatcaaggtcgcgcagcccaaggaggtctaccagcagcaacaatatgggagcgggggtagagggaaccgaaatcgaggcaaccgtggcagcggaggcggaggcggtgggggagggcagggtagcaccaactacggcaaaagccagcgaaggggcgggcatcagaataactataaaccttactag

SEQ ID NO: 14918 - DNA, 1212 bp, Artificial Sequence
  Description of Artificial Sequence: Synthetic coding sequence
atgtccgggtctgatgggggccttgaagaagaacctgaactttccatcacccttaccctgcgaatgctgatgcatggcaaggaggttggatcaatcatcgggaaaaagggcgagactgtgaaacgaattagagagcagagtagcgctagaatcactatctccgagggatcgtgcccggagcgcatcactacaatcaccggtagcactgcggctgtgtttcatgcagtgagtatgattgccttcaaacttgatgaagatttgtgtgccgctcctgccaacggaggaaatgtgtcacgaccgccagttacgctgagattagttatccctgccagccagtgtggaagtctaattgggaaagccgggacaaagatcaaggaaatacgcgaaacaacaggggcacaagtgcaggtggccggagatttactgcccaattccactgaacgtgccgtgactgtaagtggtgtaccagacgctatcattctgtgcgtgcgccagatctgtgcagtgattcttgaatctccccccaaaggcgccactattccgtaccacccgtcactatcccttggaaccgtgctgctctcagcgaatcaggggtttagcgtacagggacagtacggtgctgtcacacccgccgaggttaccaagctgcaacagcttagttcacatgcggtcccgttcgctacaccatctgttgtccctgggctggatcccggcacacagacaagtagtcaagaattccttgtgccaaatgacctgatcgggtgcgttatcggacgccagggttccaagatttcagagataagacagatgtctggcgcccatatcaaaatcggtaatcaggcggagggcgctggggagagacacgtcaccattactgggtctcctgtgtccatcgcacttgctcagtacttgatcaccgcctgtctggagaccgctaagagcactagcggcggcacccccagcagcgcacctgccgatttgccggctccattcagtccaccgttgaccgctttgcctacagcaccgccaggactgctgggtacaccttatgcaatctccctgtctaattttatcggtctgaaacccatgccttttttagcgctgcctcctgcgtctcccggccctcccccaggcttggccgcatacacagcaaaaatggccgccgccaatggatccaagaaggctgaacgacagaaatttagcccttactag

SEQ ID NO: 14919 - DNA, 1347 bp, Artificial Sequence
  Description of Artificial Sequence: Synthetic coding sequence
atggctacggatagttgggccctggcagtcgatgaacaggaagcagctgctgagtccctgtccaatttacaccttaaggaggagaaaatcaaaccagacacaaatggagccgttgtcaagactaacgctaacgcagagaagaccgacgaagaagaaaaggaagatagggcagcacagagcctgctgaataaattgattcgctcaaacctggtggataacactaaccaggtggaagtcctgcagagagatccaaattctcccctgtattccgtgaaatcattcgaggaactgaggttaccgcagaacttgattgcccaatcccagtcaggcacaggcaaaaccgccgcttttgtgcttgctatgttgagccaggtggagccagcgaataaatacccccagtgcctctgcttatcgccaacatatgagctggccctccagactggaaaggtcatcgaacaaatgggcaaattttatcccgaactaaaattagcgtacgctgtcagagggaacaagcttgagcgagggcagaagatttctgaacaaatcgtcatagggactcccggcaccgtgttagactggtgttctaagcttaaatttattgaccccaaaaaaatcaaggtctttgtgctcgatgaggccgatgtcatgatcgcaacgcaggggcaccaggatcagtctattagaatacagagaatgctgccacgaaattgccagatgttgctattctccgccaccttcgaggactccgtgtggaagttcgcacagaaggtcgtgccggacccgaatgtgattaaactcaagagagaggaggaaaccctggacaccatcaaacaatactatgtcctttgttccagccgggacgagaaattccaagctctgtgcaacctttatggtgccattaccatagctcaggctatgattttttgtcataccagaaaaacggcctcttggttagccgccgaacttagcaaagaaggtcatcaggtggcactgcttagcggcgaaatgatggttgaacagagagctgccgtgatcgaacgtttcagggaaggtaaggagaaggtgttggtcaccacaaatgtctgcgcccggggcatagacgtagagcaagtgtcagtagtgatcaacttcgatctgcccgtggataaagacggtaaccctgataacgaaacataccttcataggatagggcgcacaggacgtttcggcaaacgcggactggcagtgaacatggtcgattctaagcacagcatgaacattctcaacaggattcaggaacattttaataaaaagatcgaaagactggatactgacgacctggatgaaatcgaaaaaatcgcaaactag

SEQ ID NO: 14920 - DNA, 1248 bp, Artificial Sequence
  Description of Artificial Sequence: Synthetic coding sequence
atgatgctgggacccgaggggggcgaggggtttgttgtcaaactacggggtctaccatggtcttgctctgtggaagatgtgcagaacttcctgtccgactgcacaatccacgatggagccgccggtgtccactttatctacaccagagagggtaggcagagtggcgaagcattcgtcgagctgggcagcgaggatgatgtgaagatggcgctgaaaaaagatagggagagcatgggccaccgatacatagaggtgttcaagagtcacagaacagaaatggactgggtgttgaaacatagcgggcccaacagtgcggactctgccaatgatggattcgtgcgcctgcggggccttcctttcgggtgtacgaaagaggaaattgtccaattttttagcggcctcgaaatcgttcctaacggtataacgttaccagttgaccccgaaggcaagattacgggggaggcattcgttcaatttgcctctcaggagcttgccgaaaaagcactgggtaaacacaaagagcggattgggcaccgctacatcgaggtctttaagtctagccaggaggaggttaggtcctatagcgatccacccttaaagttcatgtccgtgcagagaccagggccatatgataggccagggacagcacgacggtatatcgggattgttaaacaggcaggcttggaaaggatgcggcccggcgcctatagtaccgggtatggcggttatgaggaatacagcggtctgtccgatggctacgggttcactactgacctattcgggcgggacctgtcgtactgtctctcagggatgtacgatcacagatatggggactctgagtttacagtgcagagcaccacaggacactgtgttcacatgcgcggacttccttacaaggccacggaaaacgacatttataacttcttcagtcccctcaacccagtcagagtgcatatcgagattgggcccgatggaagagtcacgggagaagccgatgtggaatttgcaacacatgaggaggcagttgccgccatgtccaaggatagagccaacatgcagcatagatatatagaactgtttttgaactcaaccacaggtgcatcaaatggcgcctacagcagccaggtgatgcaggggatgggggtgtcagctgcccaggccacttactccggcttggagagccagtccgtgagtgggtgttacggcgctggctactccggtcagaattctatgggtggatacgattag

SEQ ID NO: 14921 - DNA, 1026 bp, Artificial Sequence
  Description of Artificial Sequence: Synthetic coding sequence
atggcacaggagtcccctaagaatagtgccgcagaaatcccagtcacaagcaacggtgaagtggatgattcccgcgaacactcatttaacagggacttaaaacactctctgcctagcggtcttggcttgagcgaaacccaaatcacatcgcatggattcgataataccaaggagggagtcattgaggctggcgcttttcaggggggccagaggacccagacgaagtcaggccctgtaatcctcgcagacgaaatcaaaaatccggctatggagaagctggagctagtgagaaagtggagcttaaatacctataagtgcacaagacagattattagcgagaaactcggccgaggatctaggacagtcgacctagagttggaagcccagattgatatcctccgtgacaataagaagaagtacgaaaatattctgaaactcgctcagaccttaagcacgcaactgtttcagatggtgcatacacagaggcagctcggggacgccttcgctgatctgtcactcaaatctctagagctgcacgaggagtttgggtacaacgccgatactcagaagcttttagccaagaacggggaaacactgctcggcgcgattaacttttttatcgcttctgtgaacactctggttaacaagaccatcgaggacaccctcatgacagtcaagcagtacgaatccgcaaggatcgaatatgacgcttatcgaacagaccttgaggaacttaacctgggccccagagatgcgaacaccctacctaagatcgagcagtcccagcacctgttccaggcacacaaggagaagtacgacaagatgaggaacgatgtttcagttaagcttaaattcctggaggaaaacaaagtaaaagtgctgcacaatcagctggtgctgttccataatgctatcgccgcttacttcgccggcaaccagaaacagctggagcagacactcaagcaattccatatcaagctgaagacccctggagtcgacgccccttcttggttggaagaacagtag

SEQ ID NO: 14922 - DNA, 1572 bp, Artificial Sequence
  Description of Artificial Sequence: Synthetic coding sequence
atggctaacgtggggcttcaattccaagcctcggcaggggactccgaccctcaaagtaggcctctactcctcctcgggcaactgcatcatctccacagagtgccctggagtcatgtgcgcggtaagctgcagccacgcgtgactgaggagttgtggcaggccgccctgtccacgctgaatcctaaccctaccgactcctgtccgctgtatttgaactacgccactgtggccgcacttccttgcagggtgagtaggcacaacagtccttccgcggcacatttcatcacacggttagtcagaacatgtctgccacccggagctcaccggtgtattgtgatggtttgcgaacagcctgaagttttcgctagcgcatgtgcactcgcccgggcctttcctctgttcacacaccgtagcggcgccagcaggaggctggaaaaaaaaactgtgacggtggagttctttttagttggacaggacaacgggcccgttgaggtgtccacactgcaatgcctggccaacgccactgacggcgtccgcctggccgccagaatagtggacaccccctgcaatgaaatgaacactgacaccttccttgaggagataaataaagtgggaaaggagctcggcatcattcctaccattataagggatgaagagttgaaaacacgtggattcggggggatctatggcgtgggcaaagcagccctgcacccccctgccctggcggtgctgtctcacacaccagacggggccacccagaccatcgcctgggttggaaagggcatcgtgtacgatactggagggctcagtattaaaggaaaaacgactatgcctggtatgaaacgagattgcggcggcgccgctgcagtactcggagcatttcgggccgctattaagcaaggattcaaggataacctgcacgccgtcttttgtctggcagaaaacagcgtgggaccgaacgctacaagacccgacgacatccacctgctgtattccggaaaaacggtcgagatcaataatactgatgctgaaggcaggctcgtacttgccgacggggtgtcgtatgcttgtaaagaccttggggcagatatcattcttgacatggctacactgacaggcgcacaaggaatagctacagggaaatatcacgccgccgtcttaactaatagcgctgagtgggaggcagcctgcgtcaaggcgggccggaagtgtggcgatctcgttcatcccctcgtctactgtccagaactgcactttagcgaatttacgagcgccgtggcagacatgaaaaattccgtcgccgacagggacaattcccctagtagttgcgccgggctgtttatagcaagccacataggtttcgattggcccggggtgtgggtgcacctggacatcgcggcaccagtgcacgccggagagcgggccactggtttcggtgttgccctccttctggccctcttcggacgggcatcagaagaccctttgctgaacctcgtcagtcctctcgggtgcgaagttgacgtggaggagggtgacctgggaagggactcaaagaggcgccgtcttgtctag

SEQ ID NO: 14923 - DNA, 1371 bp, Artificial Sequence
  Description of Artificial Sequence: Synthetic coding sequence
atggctgacggtggctcagagcgcgcagacgggaggattgtcaagatggaggtggattacagcgccaccgtggaccaaagactacctgagtgcgccaaactggctaaggaggggcggctccaggaggttatcgagacactcctctccttggagaaacagacaaggaccgcatcagacatggtatccacaagccgaatcctggtagctgtggtgaagatgtgctatgaagcaaaggaatgggatctcttgaacgagaacattatgctcctgtctaaacgacgctcccagctcaaacaagcggtcgccaagatggtgcagcagtgttgtacatatgtggaagagatcacagacctgcccataaaactcagactaatagacaccttgcggatggttactgaggggaagatttacgttgaaattgagagggctcggctgactaagactctggccaccatcaaggagcagaatggagatgtcaaggaagccgccagcatcctgcaggaattgcaggttgaaacatatgggagtatggagaaaaaagagcgcgtggagtttatccttgagcagatgcggctatgcttagccgtaaaggactatataagaacccagataattagcaagaagattaatactaagttttttcaggaggagaacacggagaagctcaaacttaaatactacaacctaatgatccagcttgaccaacatgaaggatcgtatctctctatctgtaagcactatcgagcgatttacgatacaccatgtattcaggcagaatccgaaaaatggcagcaggctctaaagtccgtcgtgctgtatgttattctcgcccctttcgacaatgagcagtcagacctagtgcaccgcatcagtggcgacaagaagctcgaagaaatccccaaatacaaggatctgctaaaactgttcaccacgatggaactcatgcgttggagcacccttgtggaagattacggtatggagttgagaaagggaagtctagaatctcccgcaaccgacgtctttggttcaaccgaagaaggcgaaaaaaggtggaaggacctcaaaaatcgtgtcgtcgagcataatatccggataatggctaaatactatacgcgtataacaatgaagagaatggcccagctgcttgacctcagtgtcgacgagtctgaagccttcctgtcgaacttggttgtgaataaaacaatcttcgcaaaggtcgataggctcgcgggcataattaactttcagcgtcctaaagaccccaataatttgctcaatgactggagccaaaagcttaactctttgatgagcctggtgaataagactactcacctcatcgccaaggaggaaatgatccacaacttacagtag

SEQ ID NO: 14924 - DNA, 1011 bp, Artificial Sequence
  Description of Artificial Sequence: Synthetic coding sequence
atgaagatagacatccactctcatattctcccaaaggagtggcccgatctgaagaagcggttcggttacggcgggtgggtgcagctgcagcatcatagcaaaggcgaagcaaaacttttgaaagacggtaaggtttttcgggtagtgagagagaactgttgggaccccgaggttagaattagagaaatggaccagaaaggagtgactgtgcaggcactgagtacagtgcccgtaatgttctcctattgggccaagcccgaggacacgctaaatctgtgccagttacttaacaacgacttagcctcaaccgtagtgtcctacccacggagatttgttggcctcggcaccctccctatgcaggctccagagctcgctgttaaggagatggaaaggtgcgtcaaagagctcgggttcccgggagttcaaatcggaacccatgttaacgaatgggatctgaacgcccaggaacttttccctgtttacgcagcagccgagcggttgaagtgctccctgtttgtgcacccctgggacatgcaaatggacggccgcatggccaaatactggttgccctggttggtggggatgcccgcagaaaccacaatagctatttgtagtatgatcatgggcggcgttttcgaaaagttcccaaagctgaaggtgtgcttcgcccacggaggcggagcctttccattcacagtcggccggatcagtcacggatttagcatgaggcctgatctctgtgcacaagataaccccatgaaccccaagaaatatttagggagcttctacactgacgccttggtgcatgaccctttaagcttgaagctactcacagatgtaatcggcaaggataaagtcattctggggacagactacccttttccactgggagaactggagcctggcaagctcatcgagtcaatggaggaatttgatgaagaaacaaagaataaactaaaagctgggaatgccctggcctttctcggattagaaaggaagcagttcgagtag

SEQ ID NO: 14925 - DNA, 1617 bp, Artificial Sequence
  Description of Artificial Sequence: Synthetic coding sequence
atggagctgtcttaccaaactcttaaattcacacatcaggcccgggaggcttgtgaaatgcgcacagaagctcgccgaaagaacttgctaattttgatctcccattacctgacccaggaggggtacatcgatactgccaatgcgttggaacaggaaacgaagctcggacttcgcagattcgaggtctgtgacaacatagatctcgaaactatccttatggaatatgagagctactactttgtgaagttccagaaatatcccaagatcgtgaagaaaagctcagataccgccgaaaataatctaccccagaggtcacggggcaagactaggaggatgatgaacgatagctgtcagaatctgcccaaaattaatcaacaaagacccagaagcaaaacaactgccgggaaaaccggggataccaagagcctgaacaaggagcacccaaatcaggaagtggtcgataacacccggctggagagcgcaaattttgggttacatattagtaggatacggaaagatagcggggaggagaatgcccatccccggaggggtcaaatcatagacttccaagggctgctgaccgacgcgataaagggcgctacctcagaactagcgctcaatacgtttgaccacaatcccgatccttctgaaagactgctcaagccactgagcgccttcatcggcatgaacagcgaaatgcgcgagctggcagctgttgtttcacgagacatatacctccataatccaaatattaaatggaacgacattataggtctagatgccgctaagcagcttgtgaaagaggcagtggtgtacccaattcgatacccgcagctgtttaccggcatcctgtcaccatggaagggactgcttctctatggaccccccggtacagggaagaccctgctggccaaagccgtagctactgagtgtaagacaaccttcttcaatattagtgcatccactatagtctccaaatggagaggtgattctgagaagctcgtgcgggtgcttttcgagctcgcccgctatcatgcaccaagcaccattttcctagacgaactggaaagtgtgatgagccagagaggcacggccagtgggggagaacacgaaggctccctgcgcatgaaaaccgagcttctggtacagatggacggtctcgctcgcagcgaggacctggtgttcgtcctggctgcgtctaatctgccgtgggaactagattgcgctatgctgagaagattggagaagcgcattctggtggatttaccctcacgggaagctcgtcaagctatgatttatcactggctaccacctgtgtctaaatcgagagcactggagcttcacacagagttggagtactcagttctgagtcaggagaccgagggctactccggctcagatattaagcttgtgtgtcgcgaggccgctatgaggccagtgagaaagatattcgacgccttggaaaaccaccagagcgagtcctccgacctgccaagaatccaattagacatcgtgaccaccgccgacttcctggacgtgctgacacacaccaaaccctccgctaaaaacctggcccagaggtatagcgattggcagagagaatttgaatctgtctag

SEQ ID NO: 14926 - DNA, 507 bp, Artificial Sequence
  Description of Artificial Sequence: Synthetic coding sequence
atggcggagggctcgcgaataccccaagccagggcattgctccagcagtgcctccatgccagactccagattcggcccgccgatggagatgtggccgcacagtgggtcgaggtgcagagaggactggttatttacgtttgcttttttaagggagctgacaaggaactactgccaaagatggtgaatactctcctgaatgttaagctcagtgaaacagagaacgggaagcatgtatccatcctggatttaccaggtaacattttgatcattccacaggccacactaggaggcagattgaagggtcgaaacatgcagtaccatagcaatagtggcaaagaagagggcttcgaactctacagccagttcgtcacactgtgtgagaaagaagtggccgccaatagcaaatgtgccgaagcacgggtagtcgtcgaacacggaacttacggcaaccggcaagtgttgaaactcgacacaaatgggccttttactcatctcatcgagttttag

SEQ ID NO: 14927 - DNA, 1764 bp, Artificial Sequence
  Description of Artificial Sequence: Synthetic coding sequence
atggcctcggaagatatcgcgaagttggctgagaccttggcaaagactcaggtagctggcggccaattaagcttcaaagggaaatcccttaagttgaacaccgctgaggacgcaaaagatgttatcaaagaaatcgaagattttgactccctggaggcactcaggctcgaaggtaacacggtaggcgtagaagctgcaagagtgatcgccaaggcattagagaaaaaaagcgaattaaaacggtgccactggtctgatatgttcaccggtcgcctgcggaccgagatccccccagccctgatctcacttggggagggattgatcactgcaggggcacagctggtcgagctggatttgtctgataatgctttcggccctgatggggtgcaggggttcgaggctctgctgaagtcaagcgcatgttttacccttcaggaattaaagctcaacaactgcggaatgggaatcggaggcggtaaaattctggccgctgcgctaactgagtgtcatcgtaagtcttccgcacaggggaaacctctggctctgaaagtcttcgttgcaggccggaacagacttgagaacgatggggccacagcactggccgaggcgttccgcgtcatcggaaccctcgaggaggttcatatgcctcagaacggtatcaaccatccgggaatcaccgccctggcccaggcctttgctgtcaatccccttttgagagttattaacctcaacgataatactttcactgagaagggagccgtggccatggcggagaccctgaagacacttagacaagtagaggtaatcaacttcggcgactgcctcgtgcgaagcaagggtgcggtcgctatcgcggacgctatacggggtggcttgcccaagctcaaagaattgaacttgtcattttgtgagatcaagcgcgacgcagcactggccgtcgccgaggctatggctgacaaggctgagctagagaagctggatttaaacggtaacaccttaggcgaagagggctgtgagcagctccaggaagtgctagagggattcaacatggctaaggtgctcgcttccctctccgatgacgaagatgaggaggaagaagaagaaggcgaagaagaggaggaagaagctgaggaagaagaggaggaggacgaagaagaggaagaagaggaggaagaggaggaggaggaagagcctcaacagagagggcagggcgaaaagtccgccaccccctctaggaaaatccttgatccgaacacaggtgaacccgcccctgtcctgagtagtcccccccccgccgacgtgagcacctttctagccttcccgtcgcccgaaaagctgttacgcctgggccctaaaagctccgttctgattgcacagcaaactgacacatcggaccccgagaaagttgtgagtgccttccttaaagtgtcgtccgtttttaaggatgaggccacagtgaggatggccgtgcaggacgccgttgacgccctcatgcagaaggctttcaatagctcctccttcaattcgaacacattcctcaccaggctgctggtgcacatggggctgctgaaaagtgaggacaaagttaaagccatcgcaaatctctacgggcccctcatggctctgaaccacatggtgcagcaggattatttccccaaggctctcgctccactgctgttagccttcgtgacaaaacccaacagcgcgttggagagttgcagctttgcaaggcattctcttcttcagactctgtacaaggtctag

SEQ ID NO: 14928 - DNA, 2529 bp, Artificial Sequence
  Description of Artificial Sequence: Synthetic coding sequence
atggatatctctaagggactccccggtatgcaggggggactgcatatctggatctccgaaaatcggaagatggtgccagttccagaaggcgcatacggcaacttcttcgaggagcactgctacgtgattttacacgtgcctcagagccccaaagctacacagggagcttccagcgacctgcactactgggtcgggaaacaggccggcgccgaggcacagggagctgcagaggccttccagcagcgccttcaggacgaacttggcggccagaccgtcctgcacagagaggcgcaaggccatgagagtgactgcttctgctcttacttccggcccgggatcatataccgcaagggcggattggcatccgaccttaaacatgtggagacaaatctgttcaacatccagcggctgcttcacattaaaggccggaaacacgtttcagctactgaggtggagctttcttggaacagttttaataaaggggatatttttctcttggaccttgggaaaatgatgatccagtggaacggccctaagacatcaatcagcgaaaaggcgcgcggcttggctttgacgtacagcctgagggacagagaacgaggaggcggaagggctcaaattggagtcgtggatgatgaggccaaggccccagacctcatgcaaataatggaagccgtgttgggacgtagggtcggatctctgagagcagctacaccaagtaaagacataaaccaactacagaaggccaacgttcgcctatatcatgtgtacgagaagggcaaagacctgcttcaagaagaggacttctatatcctcgatcaaggcggctttaaaatttatgtgtggcaaggccgcatgagttcgctgcaggagagaaaagcagccttctctagggccgtgggatttatacaggccaagggttaccctacatacacaaatgtggaagtggttaacgacggggccgagtcggccgcatttaagcagcttttcagaacgtggtcggaaaagcggcggcgcaatcagaagctgggagggagggacaaaagtattcatgtgaaactcgatgtcggcaagctgcacacacagccaaaactggccgcccagctgaggatggtcgatgatgggagtggtaaagtggaggtctggtgtattcaagatctgcacagacaaccagttgaccccaaacgccacgggcagctgtgcgcagggaactgttatctcgtgctctacacctaccagcgccttggccgcgtgcagtatatactctatctttggcagggtcatcaggcaaccgccgatgagatcgaggcactgaactccaatgcggaggagctggatgttatgtatgggggtgtattagtacaggaacatgtgaccatgggtagcgaacccccccacttcctggccatatttcagggccaattggtcatcttccaggagagggctggacaccatggcaagggacaaagtgcctccacgacacgcctgttccaggtacagggcacggattctcacaatacaaggacaatggaggtgcctgcacgcgcttcgtcactaaatagcagtgacatctttctactggtgaccgcatccgtttgttatctctggtttggaaaaggatgcaacggagatcagcgcgaaatggctagagtggttgtgacagtgatcagccgtaaaaatgaagagaccgtgctggagggccaggagccaccacacttttgggaagctctgggcggaagagcgccttatccaagcaacaagcgcctgccggaggaagtgccctccttccaacctagactgttcgagtgctccagccacatggggtgtctggtgttagctgaagttggttttttcagtcaagaagaccttgataagtatgacattatgcttcttgatacatggcaggagattttcctttggctcggggaggccgcgtctgaatggaaggaagcagtggcttggggacaggagtacctgaagacgcaccccgcagggcgctcccctgccactcctattgtccttgttaagcaggggcacgagcccccaaccttcatcggttggttcttcacctgggatccatataaatggacttcacacccttctcacaaggaggtcgtcgatggttcacctgcggcagcttctacgatctccgagattaccgcggaggtgaacaatttaagactcagcaggtggccgggaaacgggagggcaggcgccgtcgctctccaggctcttaaagggtcccaggactcttctgaaaatgatttggtccgctcccccaagtccgcagggtctaggacatccagtagtgtcagtagcacttcagcaactataaatgggggtttgagaagggaacaactaatgcatcaggcagtggaagatctaccagagggcgttgatccagctcgacgggagttttacttgtcagattccgacttccaagacatttttggcaaatccaaggaggagttctactccatggcaacctggcgacaacggcaggaaaaaaagcaactgggtttcttttag

SEQ ID NO: 14929 - DNA, 1620 bp, Artificial Sequence
  Description of Artificial Sequence: Synthetic coding sequence
atggacgcgatggcctctcccggaaaggataactatagaatgaaatcctacaagaacaaggctctgaatccgcaggagatgaggaggaggcgcgaagaagaggggattcagctacgtaagcagaaacgagaggaacagttgttcaaacgcaggaacgtctacctgccccgtaatgatgagtctatgcttgagtccccgatccaggaccccgacatcagctcaacagttccgatccctgaggaagaagtcgttaccacagacatggtgcagatgatctttagcaataacgcggatcaacagctgacagccacccagaagttccgcaagcttctttcaaaggagccaaaccctcctattgaccaggtgattcagaagccgggcgtcgtccagagattcgtaaagtttcttgagcgcaacgaaaactgcacccttcagttcgaagcagcgtgggctttaactaacattgcgtcgggaacttttcttcacacaaaagtggtaatcgagaccggtgcagtcccaattttcataaagctgttgaattcagaacatgaggacgtgcaggaacaggccgtgtgggccttagggaacattgccggcgacaatgcagaatgtcgtgattttgtcctaaactgcgaaattcttccgcccctgcttgaattactgactaactccaataggcttactaccacacggaacgctgtgtgggcccttagcaatctttgtaggggaaagaaccccccacccaatttttccaaggtgtctccatgtctgaacgtactctctaggctgttattcagttctgaccccgatgttctggcagatgtatgctgggctctttcttatctctcagacgggcccaacgacaagattcaggccgttatcgattctggagtgtgtcgacggcttgtggagctattaatgcataacgattacaaggttgttagtcccgcactcagagccgtaggaaatatcgtgaccggggacgacatacagactcaagtcattcttaactgctccgcactgccgtgtttgctccacctgctatcctcaccgaaagaatccatcaggaaagaggcctgctggaccgtttccaatattacagctgggaatagagcacagatccaggctgttatcgatgccaatatttttccagtattgatcgaaattcttcagaaagctgagtttcggacaaggaaggaagccgcgtgggccatcactaatgcgacatccggggggacccccgagcaaatccgctacctcgtggcccttgggtgtattaaaccactgtgcgaccttctcacagtgatggattccaaaatcgtccaggtcgccctgaacggacttgagaatattctgagacttggtgagcaggagagtaagcagaacgggatcggaataaacccgtactgtgccttgattgaggaagcctacggcctggataaaatcgagtttctccagagtcatgagaaccaggaaatatatcaaaaggcgttcgatctaatcgaacattacttcggcgtcgaggaggacgacccctcaatagtgccacaagtcgacgagaatcaacaacagttcatctttcagcagcaagaggctcccatggatggttttcagctctag

SEQ ID NO: 14930 - DNA, 3735 bp, Artificial Sequence
  Description of Artificial Sequence: Synthetic coding sequence
atgctgattaaggagtatcacatcctcctgcctatgagtctcgatgaataccaagtggcccagttgtatatgatacaaaagaagagccgggaagagagcagcggggaagggtcaggagttgagattctggctaatagaccctacacagacggacctggcggttcaggtcagtacactcataaagtgtaccatgtgggtagccacatcccagggtggtttcgcgctcttttaccaaaggccgccttgcaggtggaagaagagtcatggaacgcatacccttatactaggacacgttacacttgccccttcgttgagaagttttcgatagagatcgagacctactatttgccggacggtggacagcagcccaatgtgttcaatctgagcggagccgaacggcgacagaggatcctggatactattgacatagttcgcgacgcagtggcacctggcgaatataaagctgaggaggaccccaggctctaccatagcgttaaaactggaaggggccctcttagtgacgactgggcacgcaccgcggcccagaccgggcctctcatgtgtgcctataagttatgcaaggtagagttcaggtattggggaatgcaagccaagattgagcagttcatccatgatgtgggcctgagacgggttatgctgcgcgcacacagacaggcctggtgctggcaagatgagtggacagagctatcaatggcagacattcgggcgctggaggaggagactgcgagaatgctggcgcagcgcatggctaagtgtaacaccggctccgagggatcggaggctcaaccacctgggaaaccctccacagaagcgcgctctgccgcatctaatacaggaactcctgatggacccgaagcaccccctggaccagatgcatctccggacgcttcctttgggaaacaatggtcttcctcatcccgttcctcatactcaagtcagcatggtggtgcagtcagccctcagtctctctcggaatggaggatgcaaaacatcgcccgggactccgagaattcctctgaagaggaattcttcgacgcccacgaaggattcagtgactcagaagaggtattccctaaggagatgactaaatggaattccaatgactttattgatgcctttgccagccccgtagaagcagaggggacccctgaaccaggcgcagaagctgccaagggtattgaggacggggctcaggcaccacgggattcagagggcctcgatggagcgggcgagctcggcgctgaggcctgtgccgttcatgctctgttcctgatcctccatagcggtaatatactggattctggacccggggatgccaattctaagcaggctgatgtgcagacattgagttctgccttcgaagccgtgacacggatacatttccccgaggccttgggccatgtggctctgaggctggtgccctgtccgcccatttgcgccgccgcttacgccctggtgtcaaacctcagcccttacagccacgacggcgatagcctgtcacggagccaggaccacattccattagctgccctgcctctgttggccacatcttcatcccggtaccaaggagccgtcgctaccgtgatagcacggacaaatcaggcctattctgcctttctcaggtccccggaaggcgctgggttctgtggccaggtggcactgattggggatggggtgggcggcatcttgggatttgacgcactgtgtcattccgccaacgcaggcacaggctccagaggatcttcccggcgcggtagcatgaacaacgagctccttagtcccgagttcgggccggtaagagatccactagctgatggagtcgaaggcctcggccgagggtctcccgaacctagcgcccttccccctcagagaatcccttcagatatggccagccctgaaccagagggttcccagaactcgctgcaggctgctccggccaccacatcctcctgggagccccgccgagcaagcaccgcgttttgtccaccggccgccagttctgaagccccggacggcccctccagtactgcgcgactagatttcaaggtgtcaggcttctttctatttggaagtcccctcggcctggtgctggcacttaggaagactgtgatgcccgctctggaggcagcgcagatgcgtcctgcatgtgagcaaatatacaatctgttccacgccgctgacccatgcgccagccgtctggagccattgcttgctcccaagttccaagcaatcgcacccctgacagttccgagataccagaagttccctcttggcgatggctcctccctcttgcttgcagatacactacagactcatagcagtctctttttggaggaattggagatgctagtaccatccacccctacctctacctccggagcattctggaagggctcagagctagccacagacccccccgcgcaaccagcggccccctccacaacaagcgaggtggtgaagatactagagcggtggtggggcaccaaacgtatcgattatagcctttactgtccagaggcactgacagcctttcctactgtgacccttccccatctgtttcatgccagctactgggagagtgctgacgtggtggcattcatcctcagacaggttatcgaaaaagagcgaccacagctggccgagtgtgaggaaccaagtatttatagtcccgcgttccctagggagaagtggcagcgcaagaggacccaggtaaagattagaaatgtgacatctaaccacagagctagcgatacagtggtatgtgagggtcgaccccaggttctctccggtcgatttatgtacggacctctggatgtagtaaccctgaccggtgaaaaagtggatgtttatattatgacacagccactttcagggaaatggatccacttcggaacggaggttactaactcaagtggcagactcactttccccgtacctcccgagcgggcgttgggaattggggtgtacccagtgcgcatggttgttcgaggcgaccacacatacgctgagtgttgtctgacagtggtcgcaagagggaccgaggcggttgtgttttccatagacgggtcctttaccgcctcagtatctataatgggatccgatcccaaagtgcgcgcaggagccgtcgacgtggtgaggcactggcaagattccggatatctcattgtgtacgtaacggggagaccggacatgcagaagcatcgcgtagtggcctggctttcccagcacaactttccccacggcgtggtctccttttgcgacggactgacccatgacccactgcgccagaaagccatgttcctgcagtcactagttcaggaagttgagctgaatatagtagccggttacggctcaccaaaggacgtggccgtgtatgccgcactcggactgagcccctcccagacctatattgtaggtcgggccgtgagaaaattacaggcccagtgccagttcctaagcgacggttacgtggcccacttaggccaactagaggcaggcagtcactcccacgcatcaagcgggcccccaagggctgcgttgggaaagtcatcctatggcgtggcagcacctgtggacttcttacgtaagcagagccagctgttgaggagtcgtggaccaagccaggcagagcgcgaaggccctgggacacctcctaccactctcgctcggggaaaagccagatccatatctttgaaattagatagcgaagagtag

SEQ ID NO: 14931 - DNA, 882 bp, Artificial Sequence
  Description of Artificial Sequence: Synthetic coding sequence
atgaccgaagactcccaacgcaatttccgaagcgtgtactatgagaaggtgggctttaggggtgtggaggaaaagaaatccctggaaatcttactcaaggacgataggctggacactgaaaagttgtgtactttctcccagcggttccctctgccctcaatgtatagggccctggtgtggaaagtcctcctgggcattttgcctccgcatcacgaaagccacgcaaaggtcatgatgtatcgcaaggagcagtacttggatgtgttgcacgctcttaaagttgtgcgtttcgtctcagacgcgacaccgcaagcagaagtctatctccgaatgtaccagctggagagtggaaaattgccaagaagcccttccttccctcttgagcccgacgatgaggttttcctggcgatcgcgaaagcaatggaggagatggtcgaggacagtgtggactgttattggataacgaggcgctttgtcaatcaattaaacaccaaataccgagattccctaccccagttgcccaaagcttttgagcaatacctaaatctagaagatgggcgactgttaacccacctgcgaatgtgcagcgcagccccgaaacttccctacgatctgtggtttaagaggtgcttcgccggctgtctccctgaatcctccctgcagagggtttgggacaaagtcgtttccgggtcctgtaaaatcctggtgttcgtagccgtggagatattactgacttttaaaataaaggtcatggccctgaattccgccgagaagatcactaagtttctggagaatatcccacaagactccagcgatgccattgtctcaaaagcaatcgatctgtggcacaagcattgtggcaccccagtgcactcctcatag

SEQ ID NO: 14932 - DNA, 249 bp, Artificial Sequence
  Description of Artificial Sequence: Synthetic coding sequence
atgagcgagggggagtcccagaccgttctctcatccgggtctgatccaaaggtcgaaagcagctcatccgctccggggttgaccagtgtaagtccacccgtcacttcaaccacttctgccgctagtccagaggaagaggaggaaagcgaggatgagtctgagattctggaggaatccccatgcggtcggtggcagaaaagaagggaggaggtgaatcaacggaacgtgcctgggatcgactccgcctag

SEQ ID NO: 14933 - DNA, 5058 bp, Artificial Sequence
  Description of Artificial Sequence: Synthetic coding sequence
atgtccttgccattttaccaacgttgtcaccagcactatgatctgagttatagaaacaaggatgtcagatcaacagtttcacactaccagcgtgaaaagaaaaggtcagctgtctatacccagggatccacagcctattcgtcacgttctagcgcagctcaccggagggagagcgaggcgtttagacgtgctagcgccagttccagccagcagcaggcgtctcagcatgcactgtcctccgaggttagccgaaaagctgcaagcgcatatgattacggtagtagccacggactgacagatagctctttgctgctcgacgattattcctccaaactctcacccaaacccaagagagccaagcatagcctgttgtccggcgaggagaaagagaatctcccttcagattatatggtgcccatcttctcaggccgacagaagcatgtaagtggcattaccgatactgaggaggaaaggatcaaagaagcagcagcttatattgcccagagaaacctcttagcttccgaagagggaataactaccagcaagcagtccaccgcctccaagcagaccacagcctctaagcagtcaaccgcctccaaacagtctacagccagcaaacaatctactgcctcaaggcagtctacggctagcaggcaaagtgttgtaagcaagcaagcgacctcagccctgcagcaggaggagacgagtgagaagaagtcaaggaaggtcgtcataagagaaaaggccgaaaggctgagcctccgcaaaacgttggaagagacggaaacatatcatgccaagctgaatgaggaccatcttttgcacgctccagagtttatcatcaagccgcgctcacacactgtctgggaaaaggaaaacgtcaaactccactgtagtatcgccggctggcctgaaccgagggtgacctggtacaaaaatcaggtacctatcaacgttcacgccaaccctggcaaatacattatcgaatctcgatacgggatgcataccctcgagattaacggatgcgacttcgaggatactgctcaatatagggcctctgccatgaatgtgaagggagaactgtccgcatacgctagcgtggtggtgaaaagatataaaggtgagttcgacgagactcggtttcacgcaggtgcatcaaccatgcctctgtcttttggtgtaacgccttacggctatgcctcccggttcgagattcacttcgacgacaagtttgatgtttccttcgggagggaaggggagactatgtctctcgggtgtcgagtcgtgataaccccagaaattaagcacttccagcccgagatccagtggtaccgaaacggcgtacctctgtcgccttccaaatgggtgcagacgttgtggagtggggagcgcgctaccctcactttctcccacctgaacaaagaggatgaagggctctacacaatcagagttcggatgggggaatactatgagcaatattcagcttacgtctttgtacgtgatgcagatgccgaaatcgaaggggccccagcagcacctctggatgttaaatgcttggaagctaataaggactacatcattatatcgtggaagcagcctgcagtcgacggcggctctccaattcttgggtatttcatcgacaagtgcgaagtaggcacagattcatggtcacagtgcaacgatactcctgtgaagtttgcacggttcccagtgaccgggctgatcgagggccgtagctatatattccgagtacgtgccgttaacaagatgggtatcgggttcccttcccgagtttctgaaccggtggccgccttggatccagctgagaaagcccgcctcaagtctagacccagtgcgccttggactggacagattattgtaactgaagaagaacccagtgaaggcattgtgcccggacctccaactgacttgtccgtgactgaggccacgaggtcctacgtggttctatcatggaagccccccggacagaggggccatgagggcatcatgtattttgtcgaaaaatgtgaagcggggaccgagaactggcagcgcgtgaacacagagctgccagtgaaaagccctaggtttgcgttattcgatttagccgaaggaaagagttattgcttccgggtgagatgttctaattccgccggcgtgggagaaccaagcgaggctaccgaggtgacggtcgttggagacaagcttgatattccaaaggccccgggtaaaattattccttccaggaacactgacaccagcgtagtcgttagctgggaggagtctaaagacgccaaggaactagtgggctattatatcgaagcctcagttgcaggatctggcaagtgggagccgtgcaataataacccagtcaaaggcagtcgatttacttgccatggacttgtcaccggacagagttatattttccgggttcgggccgtgaacgccgccggccttagcgagtacagccaggactccgaagccatagaagtgaaagccgcgatcggcggcggcgtgagtccagatgtgtgtcctgcccttagtgatgagcctggcgggttaacggccagtaggggtcgagttcatgaggccagcccacccacattccagaaggacgcactgctcggctccaagccgaacaagccctcactaccaagctcatcgcaaaacttgggacagaccgaggtgtccaaggtttctgaaactgtgcaggaagagctgaccccacccccgcagaaagctgcaccccaaggtaagtctaaatcagaccccctgaagaagaaaactgatcgggcccctccttctcctccatgtgacatcacatgtttggaatcgtttcgcgatagcatggttctaggttggaagcagcctgacaagatcggtggcgccgaaattacaggctactatgttaactacagggaagtaatcgatggcgttcctgggaagtggagagaagctaatgtgaaggcagtctccgaggaggcctataagattagcaatctgaaggagaatatggtgtaccagttccaggtggcagctatgaatatggcgggtttaggggcaccgagtgccgtctctgagtgctttaagtgtgaggagtggactatcgcggtcccaggacctcctcactcccttaagtgctccgaggttcgcaaagattcgctcgtactccagtggaagccccccgttcacagcggtcgtacccctgtgacggggtacttcgtcgaccttaaagaagccaaagccaaagaggatcagtggcgcggcctcaatgaggctgccattaagaacgtttatttgaaggttcgtggccttaaagagggcgtgtcctacgtgtttcgcgtcagggccatcaaccaggctggcgtaggcaagccatctgatttggcgggtccggtagtagccgaaacaaggcctggcactaaagaagtggtcgtgaacgtggacgatgacggtgtgatctccctgaactttgagtgtgataagatgacacctaagtccgagttctcatggtcaaaagattacgtttcaacagaagatagccccaggcttgaggtggaatccaaagggaacaagacgaaaatgacctttaaggacctgggaatggatgaccttggcatttattcgtgcgatgtgacagataccgacggcatcgcaagctcatatctaattgatgaagaggagttaaagcgcttacttgcgctttcccacgaacataaattcccaacggtccccgtcaaatctgagctagccgtcgaaattttggaaaagggacaggtgcggttttggatgcaggccgagaaactgagtggaaatgccaaggtgaactatattttcaacgagaaagagatatttgaaggccctaagtataaaatgcacatcgataggaacacagggataatcgagatgtttatggagaaactccaggatgaggacgaggggacttatacctttcagcttcaggacggaaaggctacaaatcattccacagttgtactggtcggcgatgtcttcaaaaaactgcagaaagaggcggagtttcagaggcaagaatggatccggaagcagggcccccatttcgtagaatacctctcgtgggaagttacaggtgagtgcaatgtactcctgaaatgtaaggtcgctaacattaagaaggagactcacatagtctggtataaagatgagagagaaatttcagtggacgagaaacatgactttaaagatggaatctgtactctgctgatcacggagttcagtaaaaaggacgctggaatttacgaagtgatactgaaagacgatcgaggaaaagacaagagtcgccttaagctggtagatgaagcattcaaagagctgatgatggaagtgtgcaaaaagattgctctgtcagctacagacctgaaaatccagtctactgccgaggggatacagctctattctttcgttacttattatgtagaggacctgaaggtgaattggagtcacaatggaagtgctatccgctacagtgatcgggtgaagacaggcgtaacgggggagcagatttggctacagattaatgagcccacacctaacgacaagggtaaatacgtgatggaactcttcgatgggaaaaccgggcaccagaagactgtcgacctatccggccaggcgtatgacgaagcctatgccgagttccagagactgaaacaggccgccatcgccgaaaaaaaccgtgccagggtgttgggcggtttacccgacgtagtgaccatacaggaggggaaagctctcaatctgacatgtaatgtgtggggtgatccaccccctgaagtctcttggctgaagaatgagaaagcactggccagcgacgatcactgcaacttgaaattcgaggcaggacggactgcatatttcactatcaacggggtgagtactgctgactctggtaaatatgggctggtggtgaaaaacaagtatggctctgaaaccagcgatttcaccgtttcagtctttatccccgaagaggaagcacggatggccgccttagagtctttgaagggcggaaagaaagcaaagtag

SEQ ID NO: 14934 - DNA, 5877 bp, Artificial Sequence
  Description of Artificial Sequence: Synthetic coding sequence
atggctgaccggactgcgccccgttgccagctgagattggaatgggtgtatggatacagagggcaccaatgcaggaataatctttactacacagccgggaaagaggtagtgtacttcgttgccggggtgggtgtggtttacaatacaagagagcatagtcaaaaattctttctgggccataacgacgacattatcagcctggccctacaccccgacaagaccctggtggctacagggcaagtgggtaaggagccatacatctgcatttgggattcctacaacgttcagacagtttctctgctcaaagacgtccatacacacggggtggcttgcctggcctttgactccgacggccagcgcctggcctctgtgggtctggacgccaagaacaccgtctgtatatgggactggagaaaaggaaagttgctggcaagtgccacagggcacagcgatcgaattttcgatatttcatgggacccttaccagcccaatagggttgtgagctgtggtgtaaagcatatcaaattctggacactctgtggcaacgcattgactgctaaaagaggtatcttcgggaaaaccggtgatcttcagaccatcctgtgtttggcctgtgccaaagaggacatcacctactcaggcgcgctgaacggagatatttatgtgtggaaggggctgaaccttgtgaggacaatccagggtgcccactctgctggcatcttttccatgtacgcatgtgaggagggattcgctactggagggcgtgacggctgcatcagactgtgggataccgattttaagccaattacaaagatcgacctgcgtgagacagagcagggctacaagggcctgtccatccgttccgtgtgctggaaggcagacaggttgctagctggcacgcaggattcagaaattttcgaagtgatcgtccgagagcgggataaaccaatgctgatactacaggggcattgcgaaggggagctgtgggccctggcgttacaccctaagaagccacttgccgtgacaggcagcgatgacagatccgtacgactatggagcctggcagatcacgcactgatagcgaggtgcaacatggaggaggctgtgagatcagtcgccttttcccctgatggctctcagctcgctctcggcatgaaagacggaagttttatcgttttgcgagtgagggacatgactgaggtcgtccacatcaaggacaggaaggaggtcatccacgagatgaaattttcccccgatgggagttacctggctgttggcagcaatgatggacccgtcgacgtctatgcagtcgcccaaaggtataaaaagatcggtgaatgttcgaagtccttgagtttcattactcacatagattggtctctcgactctaaatatcttcagactaacgacggcgcaggagagagactgttttatcggatgccttccggaaagcctctgacctccaaggaggagatcaaaggaataccctgggctagttggacctgcgtaaaggggccagaggtgtcagggatctggccgaaatataccgaagtgacggatatcaactccgtggatgctaattacaactcaagcgtcctggtgtctggggatgacttcggtctggttaaactttttaagttcccttgcctgaaacgcggggctaagttcaggaaatacgtcggacatagcgctcatgtgactaacgtcaggtggtctcacgactttcaatgggtgctatcaacgggtggcgcagaccattccgttttccaatggaggttcatccccgagggcgtcagtaacgggatgttagaaactgcccctcaggagggcggggcagattcctactccgaagagtcagactccgatctgtcagacgtacccgagttggacagcgatatcgagcaggaggcccaaataaactacgacaggcaggtctataaggaggatctcccacaactgaagcagcagagcaaagagaagaatcacgctgtgcctttcctgaaaagggagaaggcccctgaagattcacttaagctgcaatttatccatggataccgcgggtacgattgccgtaacaacctcttctatacgcaggctggagaagtggtttatcacattgctgccgtggctgtcgtttacaaccgccagcagcacagtcagcgcttatacttaggccacgacgatgacatcctgtccctcaccattcaccccgtaaaagactacgtagcgaccggtcaagttggaagggacgccgccattcatgtttgggatacccagaccctgaagtgtctaagcctcctgaaggggcagcatcagcggggcgtgtgtgctctggacttctcagccgacggcaaatgcctcgtctcagtgggcctggatgacttccattcaattgtgttctgggactggaaaaaaggtgagaagatagctactactaggggtcataaagataagattttcgtggttaagtgcaatccccaccacgtagacaaacttgtgacggtaggaattaagcatatcaagttctggcagcaggccggaggcggttttacaagtaagagggggacattcgggtccgtgggcaagctggaaactatgatgtgtgtttcctatgggcgaatggaggatttggtgttcagtggcgcggctaccggggatatattcatctggaaggatattctccttctgaaaacagtgaaggcacacgatggtccagtctttgcaatgtatgcccttgataagggatttgtaaccggaggcaaggatggcatcgtggagctgtgggacgatatgttcgagcgctgcctcaaaacttacgctataaagcggtccgcactatctaccagtagtaagggcctccttttggaggacaacccatcgattagagctatcacattgggtcacggccatatcttagttgggaccaaaaacggagaaatcctagagatcgacaaatcagggccaatgacgcttttggtccaagggcacatggaaggagaagtttgggggcttgccgcacacccgttgttgcctatctgtgcaacagtaagtgatgacaaaaccctgagaatctgggagctcagcgcccagcaccggatgctggccgtgagaaaacttaaaaagggcggtcggtgttgcgctttttcaccggacgggaaggctcttgctgtggggcttaatgatggctccttcctggttgtaaacgcagatacagtggaggacatggtgtcatttcatcaccggaaggagatgatatcagatatcaagttctctaaggatactggcaagtacctggctgtggcctcacatgataactttgttgatatctacaacgtgctgacaagcaagcgggtgggcatttgtaaaggcgcctcatcctacatcacccatatagattgggacagcagaggcaagctgctccaggtcaattccggggctcgcgaacagctcttcttcgaagcccctagagggaagcgacacattatcaggccatctgagatcgagaagatagagtgggacacatggacatgcgtgctagggcctacctgtgagggaatctggccagcccatagcgatatcacagatgtcaatgcggccagcctcacgaaagactgcagtctcttagccacgggggacgacttcggcttcgtgaagttgttttcttatcccgtgaaaggtcaacatgccagattcaagaagtatgtgggccactcagcccatgttactaacgtccgttggctgcacaatgactccgtacttttgaccgtgggtggagcagacaccgctctcatgatatggactcgggagttcgtaggaacgcaggagtctaaattggtggattcagaggagtcagatactgacgtcgaggaagatggcggctatgattctgatgtggcccgtgaaaaggccattgattacaccaccaagatttacgctgtgtcaattagggaaatggagggcaccaagcctcatcagcaactcaaagaggtatccgtcgaagagaggccacctgtctcacgggcagccccgcagccagaaaagctgcagaagaataatattacaaaaaagaaaaaactggtcgaggaactggccctggaccacgtttttgggtaccgcgggttcgattgccgcaataacctgcattacctcaacgacggtgccgatatcatttttcataccgctgcggcaggaatcgtgcagaatctaagcactgggagccagtctttctatcttgaacatacagacgacattctgtgtctcaccgtgaaccaacatcctaagtaccgtaatgtagttgcaacttcccagattggcactacccccagcattcatatttgggatgcgatgactaagcacacgctgagcatgctgcgttgcttccattccaaaggcgtgaactatattaatttcagcgctacgggcaagttgctcgtttctgtgggcgtggacccagaacacactataacagtttggcggtggcaggagggcgcaaaagtcgcttcaagaggggggcacctggagaggatcttcgtggttgaattccggccagactcagatacacagtttgtctctgtcggcgtaaagcatatgaagttctggacactggccggctctgccttgttgtataaaaagggggtcattgggtcactcggcgcggcgaaaatgcagacaatgctgtctgtcgcctttggagccaacaacctgacattcacaggagctattaacggcgacgtgtatgtttggaaggatcacttcctaatccgtttagtcgcgaaagcccacactggccctgtgtttaccatgtataccacactcagagatggcctaattgtgactggcggcaaagagcgccctaccaaggaaggtggtgcagttaagctatgggatcaggaaatgaaaaggtgccgggcattccaacttgaaaccgggcaactggttgaatgcgtgcgttctgtgtgtcgaggcaagggcaagatcctagtcggcaccaaggacggagaaattatagaagtcggcgagaagaatgctgcgagcaacattctgattgacgggcatatggagggggaaatctgggggctagccacgcaccctagcaaggacctcttcattagcgcttctaacgacggaacagctcggatctgggacctcgccgacaaaaaactcctgaataaggtgtcacttggccacgcagctaggtgcgctgcctatagccccgacggggaaatggtcgctatagggatgaagaacggtgagtttgtgatccttctagtcaattccctaaaggtttggggtaagaagcgcgacagaaagtctgccatccaggatattagaatctctcccgacaaccgctttctagcggtaggaagctctgaacacacagtcgacttttacgatctcacacaggggactaacctgaacagaatcggatactgcaaggacatacctagctttgtgatacagatggatttcagcgccgatgggaagtacattcaagtatccacaggtgcctataagagacaggtgcatgaggttcctctgggcaagcaagttaccgaagccgttgtcatcgagaaaatcacctgggctagttggacctcagtccttggtgatgaagtgatcggcatttggcctcgaaacgccgataaagcagacgtgaactgcgcttgtgtcacgcatgctgggttaaacatagtgacgggggatgatttcggactcgtgaagctgttcgactttccatgtaccgagaagttcgccaagcataaacgttattttgggcacagtgcccatgtcacaaatatccgcttttcgtatgatgacaagtacgtggtttccaccgggggagatgactgcagtgtgtttgtgtggaggtgcctgtag

SEQ ID NO: 14935 - DNA, 630 bp, Artificial Sequence
  Description of Artificial Sequence: Synthetic coding sequence
atgaacccatctatgaaacagaaacaggaggaaattaaggagaatattaaaaactcttccgtaccccgacgcacactgaaaatgattcagcccagcgcatccggcagcctggttggccgggagaatgagttatctgcaggattgagcaaaagaaagcaccgtaatgaccaccttacgtcaacaactagctcgcctggtgtaatcgtccccgaatccagcgaaaacaagaacctgggaggagtcactcaggaaagcttcgatttgatgattaaggagaacccatcctctcagtattggaaggaggtcgcagagaagcgcagaaaagccttgtacgaggcactaaaggagaacgaaaagctgcacaaggagatcgaacagaaggataacgagatcgcccgtcttaaaaaagagaataaggagctcgcagaggtggctgagcatgtgcagtacatggccgaactgatagagcgactcaacggtgagcccctggataacttcgaatcattggacaaccaggagtttgactctgaagaggagaccgtcgaggacagccttgtggaggatagcgagatcggcacttgtgctgaaggcactgtgagctctagcaccgacgccaaaccttgtatttag

SEQ ID NO: 14936 - DNA, 1635 bp, Artificial Sequence
  Description of Artificial Sequence: Synthetic coding sequence
atgaacacaagcatcccataccagcagaacccctacaaccctaggggtagcagcaatgtgatacagtgttataggtgcggtgacacttgtaaaggggaagtcgtccgcgtgcacaataaccatttccatatcaggtgttttacctgtcaggtgtgtggatgcggcctggcccagagcggtttctttttcaaaaaccaggagtatatctgtactcaagactaccagcagttgtatgggacaaggtgcgattcatgtcgagactttattacaggtgaagtcattagcgcactgggcaggacctaccaccctaagtgttttgtttgtagtttgtgcaggaagccctttccaattggcgacaaagttacgtttagtgggaaggagtgtgtgtgccagacttgctcccagtcaatggcgtcttccaagccaattaagattagggggccatcacactgtgccggatgtaaggaagaaataaaacatggtcagagcctgctcgccttagacaaacaatggcacgttagttgcttcaaatgccagacatgctccgttattttaacaggagaatatataagcaaagatggggtgccttattgcgagtcagattatcacgctcagtttgggattaagtgcgagacctgtgaccggtatatttccggaagagtgctcgaggctggcggaaagcactaccatcctacttgcgctcgctgcgtacgatgtcaccaaatgtttacagagggagaagaaatgtacctgaccggttcagaggtatggcatcctatttgcaagcaggcagcccgtgcagaaaaaaagctgaaacacaggcggacatctgaaacttctataagtcctccgggcagtagtattggaagcccgaaccgcgtcatttgcgacatttacgagaatctagatctcaggcagaggcgggcgagtagcccaggatacatcgacagccccacatacagtcgccagggtatgagccccacctttagccggagcccacatcattactaccgctccggggacctatctacggcaactaaaagtaaaactagcgaggacatctcccagacctcaaagtatagcccaatatatagtcccgacccatactacgcatctgaaagcgagtattggacttaccatggatctccgaaagtgccacgtgcacgacggttcagttctggcggtgaagaagatgactttgatcgttcaatgcataaactccagagcgggattgggaggctcatcttgaaggaagagatgaaagcccgcagctcctcttacgcggatccatggaccccccccagatcatccacatcgtcccgggaggccctacataccgctgggtatgagatgtcgctgaacggttccccaagaagccactacctagcagacagtgatcccttaatttcaaaatctgcaagtctgcccgcctatcgacggaacgggcttcatcgaactccttctgctgacctgtttcactatgacagtatgaacgctgtaaactgggggatgcgagagtacaaaatttacccttacgagctactcctggttactacccgtgggcgcaatcgcttgcccaaggatgtagatcggacgcgtctcgaagggaacttctggaaatcggggtgtctctag

SEQ ID NO: 14937 - DNA, 840 bp, Artificial Sequence
  Description of Artificial Sequence: Synthetic coding sequence
atgaccccctccgaaggagccagggccgggacaggaagggagctcgagatgctggacagcctcttagccttaggaggccttgtgctacttcgcgatagcgtcgaatgggaaggccgcagtctgctgaaggcactggttaaaaaatctgccctgtgcggtgagcaggttcatatcctcgggtgtgaagttagtgaggaggagttcagagagggattcgattctgacatcaacaaccgcctagtttaccacgatttcttccgggatccacttaactggagtaagacggaggaggcctttccaggtggtcccctcggcgctctgcgtgctatgtgcaagaggaccgacccggtgcccgtcaccatcgctttagattccctgagctggttgcttttacgcctcccatgcacgaccctttgtcaggtcctccatgcagtctcacaccaggacagctgccccggcgattcatcatccgtcggtaaagtatctgtactcgggctgctgcacgaggaactgcatggcccgggcccagtgggagctctatcgagcctggcacagacggaggtcactctgggaggcaccatgggtcaggcttccgcacacatactgtgcagacggccacgccagaggccaacggatcagactcaatggtttagcatcctgccagatttctcactggacttgcaggagggaccctccgtagagagccagccctacagcgaccctcacattcccccagtcagcaagaatgctaaagcgagaacgcgaaagtgcagcctggtctctggccatgggcgcgagaacaagtcttgcaggggctggggctggggacagggcttttag

SEQ ID NO: 14938 - DNA, 405 bp, Artificial Sequence
  Description of Artificial Sequence: Synthetic coding sequence
atgagcgagaatgccgcacccggattatgcggggagctcctgttgcagcggggcaccacaaaggtagccaccggactggttctcaacagagatcagcggctggcatgggccgagaattcaatcgacttcatctcccgggaactctgtgcccatagcatccggaaactccaggcacacgtgctgctcattaaggcagtccatgggtactttgactcccggcagaactactctgagaaagagtcattatctttcatgattgacacaatgaagagtactctgaaagagcagtttcagttcgttgaggtgcccgggaaccactgtgtgcatatgagtgaacctcaacatgtggccagcattataagcagtttcctgcaatgtactcacatgctgccagcccagttgtag

SEQ ID NO: 14939 - DNA, 1350 bp, Artificial Sequence
  Description of Artificial Sequence: Synthetic coding sequence
atgatgttgggtactgaaggaggggagggcttcgttgtcaaggttaggggcctcccatggtcctgctcagctgacgaagtccagagatttttcagtgactgtaagattcagaacggggcccagggaattagattcatatacacaagagagggtagaccttctggggaggcctttgtcgagctggagtctgaggatgaggtgaaattggcattaaaaaaggaccgcgagacgatggggcaccggtatgtggaggttttcaaaagcaataacgtggaaatggactgggtactgaaacacacaggccccaactctcccgacacagctaacgacgggtttgtgagactccgcggactgccgttcgggtgtagcaaagaggaaatcgtgcagttcttcagtgggctggaaatcgtgcccaacgggatcacattgcccgtggacttccaggggagatccacaggagaggcttttgttcaatttgcctcacaggagattgcagaaaaagccctaaagaagcataaggaacgaattgggcaccggtacattgaaatattcaagtcctccagagcggaagtccggacccactatgatccaccacggaagctcatggctatgcagaggcctgggccttacgataggcctggagctggccgagggtacaacagtatcggaaggggcgccggctttgagcgaatgcggcggggggcttatggtggcggatatgggggttatgacgactataatggctacaacgacggctacggatttggatccgatagatttggcagagacctgaactattgcttctctgggatgtccgatcatcggtatggcgatgggggatcaactttccagtcaacaactggccactgcgtacacatgaggggactaccctaccgggccaccgagaatgacatctataattttttctcccctcttaatcccgtgagagtacatattgaaatcggccctgatgggcgggtcaccggcgaggccgatgtcgagtttgccacccacgaagatgcagtggcagccatgagtaaggacaaggccaatatgcagcacaggtacgtggagctctttttaaacagcacggcaggcgcatctgggggagcatatgagcaccgctatgtggaactttttctgaactccacagccggagcaagcggcggagcttacggatctcagatgatgggcggcatggggctcagcaatcagagcagttacggggggccggcatcccagcagctgagcggcggatacggtggaggttacggagggcagtctagtatgtcaggctacgaccaggtacttcaggagaacagctctgactttcagtcaaatatcgcctag

SEQ ID NO: 14940 - DNA, 4077 bp, Artificial Sequence
  Description of Artificial Sequence: Synthetic coding sequence
atgggcaaccagctcgcgggaattgcaccctcccaaattctttccgtcgaatcctatttttccgacatccacgacttcgagtacgataaaagccttggcagtactaggttctttaaagtggcccgggctaagcatcgggaggggctcgtggtggtaaaggtgtttgccatccaagatccgaccctccccctgaccagctataaacaagagctggaggagctgaagatcagactgaattctgcccaaaattgcttgcccttccaaaaggcttctgagaaagcatccgaaaaagccgcaatgctatttcgccagtacgtgcgggacaacctgtatgaccgcataagcactcgcccatttctgaacaatattgaaaaacgctggattgccttccagattctgaccgccgtcgaccaggcccacaaatccggcgtccgtcacggggacatcaagactgaaaacgtgatggtcacatcatggaactgggttctattgaccgacttcgcctcttttaaacccacttacctgcccgaggacaaccctgccgactttaactatttcttcgatacttctcgcagacggacatgctacatcgcccctgagaggtttgttgatggcggcatgtttgctaccgagttggagtatatgagagaccctagcacaccactggtggacctgaacagtaaccagaggaccaggggggagctcaaacgcgctatggacattttttccgctggatgtgtcatagcggagctgttcacagagggggtacccttgtttgatctgtcgcagctcctggcctataggaacggccatttttttcctgagcaggttctgaataagattgaggaccacagcatccgcgaactcgttacccagatgatccaccgcgaaccagacaagagactggaggctgaagattacttgaaacaacagagagggaatgcctttcccgaaattttttatacattcctccagccatacatggcccagtttgcgaaagagacattcctctccgccgacgagagaatcttggtcatcaggaaggacttggggaacatcattcacaatctctgtggccatgacctacctgaaaaggccgagggcgaaccgaaggagaacggtctggttatcctcgtcagtgtgattacgagctgcctgcagacacttaagtactgtgatagtaagctggccgccctggagcttatactgcacctggctccgcgattgtccgtggagatccttctggaccggattacgccttaccttctccatttttcgaatgattcagtgccgcgggttcgcgccgaagctctgagaactctcactaaggtattagctctcgtcaaagaagtaccacgtaatgatatcaatatttacccggaatatatactgcccggcatcgcccacttagcacaggatgatgctaccattgtacgattagcatatgccgaaaatatcgccttgctggccgagaccgccctccgcttcctcgaactggtgcagttgaagaacttgaacatggaaaacgaccccaacaatgaagaaatcgatgaggttacccaccccaacggaaattacgatacagagctccaggccctgcacgagatggtccagcagaaggtcgtaacattattatcagacccggagaatatcgtcaagcaaaccctgatggaaaacggtatcactcgtttgtgtgtctttttcgggagacagaaagccaacgacgtgttgctatctcatatgattactttccttaacgataagaacgactggcatctcagaggagcattcttcgatagtattgtgggggtcgccgcgtacgtgggctggcagtcttccagtatcttgaagcccctcctgcagcaaggcttatccgacgccgaggagttcgtgatagtgaaagcgttgtacgctctgacgtgcatgtgtcagctggggctcttgcaaaagccacatgtgtacgaattcgctagcgacatcgccccctttctttgccacccaaatctctggataagatatggggctgtaggattcattacagtcgttgcccgacaaatcagcacagctgatgtttactgcaagctgatgccttacctcgatccctacataacacagcctatcatccagatcgaacgaaaactggtcttactgagcgttcttaaagagcctgtctcccggtcaatcttcgactacgcactgagatcaaaggatataaccagtctgtttcgtcacctccatatgaggcagaagaagcgtaacggctcgcttccagattgccccccaccagaagatcctgccattgcccagctcctcaaaaaacttctgtcccagggaatgacggaagaggaggaagacaagttgcttgcactcaaagattttatgatgaagagcaataaagcgaaggcgaatatcgtcgaccagtcccacctgcacgattcttcccagaagggggtgatcgacctcgctgctttgggcatcaccggccgccaggtggacctggtcaagactaagcaagaacccgacgacaagcgcgcccgcaagcatgtgaagcaagacagcaacgtcaatgaagaatggaagagtatgttcggttccttggaccccccaaacatgccccaggccctcccaaaagggagcgatcaggaagtgattcaaaccgggaaaccaccccgaagtgaaagttctgctggaatttgcgtgccacttagcacctcatcacaagtgcccgaagtgacgaccgttcagaataaaaagccagttatcccagttcttagttcaacgatccttccctcgacataccagattcgcatcacgacctgcaagactgagctacagcagctcattcagcagaaaagggagcagtgtaatgctgaacgaatagcgaaacagatgatggagaacgctgagtgggagagtaagccacccccgcccggctggagacctaaaggcctcttagtagctcacctgcatgagcacaagtccgcagtcaaccgcattcgcgtctctgacgagcatagcttatttgccacatgctcgaacgatggtacagttaagatttggaattctcagaagatggagggcaagactacaactaccagaagcatcctcacctactctcgcatcggaggccgagtgaaaactctaaccttctgtcagggcagtcattacctggccattgcatccgacaacggagctgtgcagttactgggcatcgaggcatctaagctgcccaagtcccctaagatccaccccctccagagccggattctcgaccaaaaggaggacggctgtgttgtggacatgcatcatttcaacagcggcgcccagtccgtgctggcatacgcaactgtcaatggctcactggtgggatgggatttgaggtcttcatccaatgcctggaccctgaagcacgacctgaaatcagggctgataacaagctttgcagtggatatccaccagtgttggctctgcatcggaacaagctctgggacaatggcctgctgggacatgagattccagctacctatatcctcccactgccatccaagcagggcgcgaattcggcgattgagtatgcacccactctaccagtcctgggttatcgccgccgtgcagggtaataacgaggtgtccatgtgggatatggaaactggtgatagacggtttacactgtgggcctcttcggcgccccccctgtccgagcttcagccctcaccccatagtgtgcatgggatctactgtagccccgcggatggcaatcccattcttctcacagctggatctgatatgaagatccgcttctgggacctcgcctaccctgaacggtcatacgtcgtcgctggaagcacctcgtccccgagcgtgtcatattacagaaagattattgaaggtacagaggtggtgcaggagatccagaataagcagaaggtcgggcccagcgacgatactccgaggaggggtcccgagtccctacccgtcggtcaccacgatatcatcacagatgtggccacatttcaaaccacgcagggctttatagtaactgcatctcgcgatgggattgtgaaggtatggaaatag

SEQ ID NO: 14941 - DNA, 993 bp, Artificial Sequence
  Description of Artificial Sequence: Synthetic coding sequence
atgccggtcgtaaccaccgacgcagagagtgaaactggcattcctaagagtctgtctaacgaacccccatccgagaccatggaggaaattgagcacacatgccctcagcctcgactcaccctgacagcgcctgcccctttcgccgatgagaccaattgccaatgccaggccccgcatgaaaagcttacaatcgcacaggcacggctcggaacccctgctgacaggcctgtccgcgtgtacgctgacgggatattcgacctctttcacagcggacatgccagggccctgatgcaggctaaaactttgtttccaaattcatatctactcgttggggtctgcagcgatgatctgactcacaaattcaagggctttaccgttatgaacgaagctgagcggtacgaggcgctcaggcattgccggtacgtcgacgaagttataagggatgcaccctggacattgactcccgagttcttggagaaacacaagattgacttcgtggcccatgacgatattccctattcctccgctggtagcgacgatgtgtacaaacatatcaaggaggctggaatgtttgttcccacccaaaggaccgagggcatcagcaccagcgacatcattacacgaatcgtgagagattacgatgtgtacgctcggaggaatctccaacgcggatataccgccaaagaattgaatgtctccttcattaacgaaaaacgctacagattccagaaccaagtagacaagatgaaggagaaggttaaaaatgtagaggagaggagtaaggagtttgtgaaccgagtggaggagaagtcacacgacctcattcagaagtgggaggaaaagtctcgcgaatttatcggcaactttctcgagctgttcggcccagacggcgcttggaaacagatgtttcaagagcggtcctctcgaatgctgcaggccctgtcccctaaacagtcacccttaaagagctgggccagatgcagggatttttag

SEQ ID NO: 14942 - DNA, 2025 bp, Artificial Sequence
  Description of Artificial Sequence: Synthetic coding sequence
atgcagacaagctccagcagatccgtgcatctgagcgaatggcagaaaaattacttcgcgataacttcaggaatttgtaccggaccgaaggcagacgcttacagggcacagatcttgcgaatacagtatgcctgggctaactctgagatatcccaggtttgcgctaccaagttattcaagaaatacgccgagaaatacagcgccattattgactccgacaacgtcgaaagtgggctcaacaattacgcagaaaatattctgacgcttgcagggtcacaacagacggactccgacaaatggcagagcgggctgtccatcaacaatgtgttcaaaatgagcagcgtgcagaaaatgatgcaggcgggaaaaaagtttaaggattcactcctggagccagctctggcttccgtagttatacataaagaggccaccgtgttcgaccttcccaagttcagcgtctgtgggtcttcccaggagagcgattcgctccccaactcagctcacgatcgtgaccggacgcaggattttcccgaatcaaacagattgaagctcctgcagaatgcacaacctcctatggtcacaaacactgcgagaacttgccccaccttcagcgcacctgtaggtgaatctgcgactgccaagttccatgtgacacccttatttgggaacgttaaaaaggaaaaccattcctccgccaaagaaaatatcggtctcaacgtgttcctgtcaaaccaatcttgtttccctgctgcgtgcgagaaccctcagcgtaagtctttctacgggagcggtacaatagatgctcttagcaaccccatcctaaataaagcgtgcagcaagacagaagataacgggcccaaggaggatagcagcctgcctaccttcaaaactgccaaagaacagctatgggtggaccagcagaagaagtaccaccagccacagcgcgcttccggttcctcctacggcggggttaaaaagagtcttggagcgtctcgatctaggggtatcctgggtaagttcgtgcccccaataccaaagcaggatggaggcgaacagaatggcggtatgcagtgcaagccttatggagctggcccgacagaaccagcccaccctgtcgatgagcgattaaagaatcttgagcccaagatgattgaattaatcatgaatgaaattatggaccatggcccaccggtgaattgggaggacatcgctggagtagagtttgccaaggccaccattaaggaaattgtggtctggcctatgctgagacccgacatttttaccggcctgcgaggaccccctaaaggcatcctgctgtttggcccacccggaacaggcaaaactttgattggcaaatgtatagccagccagtcgggggccacatttttctccatcagtgccagttctctaacatctaagtgggtgggtgaaggggagaagatggtgagagcccttttcgccgtcgctaggtgccagcagcctgccgtcatcttcatcgatgaaatcgattccctgctctcgcagcgcggcgacggagaacatgaatcctcccgccgcatcaagactgaatttctcgtgcagctggatggcgctaccacaagctcagaagataggatcctggtggtcggcgccacaaaccgcccccaagagattgacgaggcagcccgtaggaggctagtcaagcgcctttatattcctctgcctgaggcctccgcgcggaaacagatcgtgatcaacctcatgtctaaagagcagtgctgtctttctgaagaagaaatagaacagattgtgcaacaatccgatgctttctctggtgctgacatgacccagctgtgtagggaagcgtccctaggaccaattcgttcactacaaactgccgacattgcgacaatcactccagaccaggtacgcccaatcgcatacatcgattttgaaaacgcttttaggacggtgagaccgagtgtttctcccaaagacctggagctgtatgaaaattggaacaaaaccttcggttgcggaaagtag

SEQ ID NO: 14943 - DNA, 1143 bp, Artificial Sequence
  Description of Artificial Sequence: Synthetic coding sequence
atgctccggaggaaacccagtaatgcctccgaaaaagaaccaacacagaaaaagaaactgagcctccaaaggtcttcctcatttaaggattttgctaaatcaaagccctccagccctgtcgtgtctgagaaagaatttaacctcgacgataacattccagaagacgatagcggcgtaccgacccctgaagatgctgggaaaagcggcaaaaaactggggaagaagtggagggcggttatcagcagaacaatgaatagaaagatgggcaaaatgatggtcaaggccctgagcgaggagatggccgacactctcgaggaagggtcggccagcccaacaagccccgactatagtttggactcaccagggcctgagaaaatggccctggccttcagtgagcaagaagagcacgagctcccagtattgtccaggcaggcatctaccggctccgaactgtgttctccttcacctggaagtgggtcttttggcgaggagccccctgctccccagtacacagggccattttgtggtagggctcgcgttcacactgattttactccaagcccctatgatcatgatagcctgaaactccagaaaggcgacgtaatccagatcatagaaaagccgcctgtcggcacctggctcgggctcttgaatgggaaggtgggttccttcaaattcatctacgtggacgttctgccggaggaagcggtgggccacgcccgacccagtcgaaggcagtctaagggcaagcggcctaagcctaagaccctgcatgagttactcgagaggattggcctggaggagcacacgtctactcttcttctcaacggataccagacgctagaggatttcaaggagcttcgagagactcacttaaacgagctgaatatcatggatcctcagcaccgcgccaaactactaactgctgccgagctactgttagactacgacacaggctcagaggaggccgaggagggggctgaaagcagccaggagccggttgcccacaccgtctccgaaccaaaagtggacattccgagggactccggctgctttgaagggtcagaaagcggacgcgacgacgctgagctggctggcacggaagaacagctgcagggtctgtccctggccggagcaccatag

SEQ ID NO: 14944 - DNA, 1692 bp, Artificial Sequence
  Description of Artificial Sequence: Synthetic coding sequence
atgaacccactatttgggccgaatctctttctcttgcaacaggagcagcaggggctggcagggcccctgggcgactcattgggcggagatcacttcgctggcggcggagatctgcctcccgctccgttgagtccagccggaccggcagcatattctccaccagggcctggcccagccccccccgctgccatggccctccgcaacgacttgggatctaatattaatgtcctgaagacccttaatctgcggtttcggtgttttctggcaaaagtccacgaactggaacgcaggaatcgactgctggaaaagcaactacagcaggcactagaggaggggaaacagggccgccgagggctcggacggcgagaccaggccgtgcagaccgggtttgtcagccccatcagacccttaggtctccagcttggggccagaccagcagctgtctgtagtcccagcgccagggtgctgggaagccctgctagatctcctgccggccctttagccccttcagccgcgtcgctctccagctcctccactagcacgtccacaacctacagttcaagtgctcgctttatgcctgggacgatctggtctttttctcacgcccggaggctgggtcctggcctcgaaccgacactggtccagggaccgggactctcctgggtgcaccctgacggtgtgggcgtccagattgacactattacacccgagatccgagctttgtataacgttttggccaaagtgaaaagagaaagagatgaatacaaacgccgatgggaggaagagtataccgtgagaattcagctccaagatagagtgaatgaactgcaagaagaggcccaagaggctgacgcctgccaagaagaactggccctaaaagtagagcagttgaaggctgaacttgtggtgttcaaaggattaatgtccaacaacctgagcgaactcgacacaaagattcaggagaaagccatgaaagtggacatggatatttgtcggaggatcgatattacggctaagctatgcgatgtggcgcagcagaggaactgcgaagacatgatccagatgttccagaagaagctggtgccgtccatgggagggcggaagagagagcgaaaagcggccgtggaagaggacactagtctgtctgaaagtgagggcccacggcagcctgacggagatgaggaggaatccaccgctctgagtatcaatgaggagatgcagcggatgctcaatcaactcagagaatacgatttcgaagacgattgcgactcgctcacttgggaggagaccgaggaaacactgctgttgtgggaggatttcagcgggtacgcaatggcggctgccgaagcgcagggtgaacagcaagaggacagcttggagaaagtcattaaggataccgagtccttgttcaaaacacgtgaaaaggagtaccaagagaccatcgaccaaatcgagctggagctggccacagcaaagaatgatatgaaccgccacctgcacgagtacatggagatgtgttcaatgaagcggggtcttgatgtgcagatggagacgtgtcggaggcttatcacccagtctggagatagaaagtcccctgcttttacagccgtaccactatccgatcctccgccgccccccagtgaagctgaggacagtgaccgagatgtcagttccgacagtagtatgagatag

SEQ ID NO: 14945 - DNA, 1893 bp, Artificial Sequence
  Description of Artificial Sequence: Synthetic coding sequence
atgctgttcctggcgattccccagtctatcgacgaagagaccgaagtctggagtgaccacattattttccctcggataccacgtggccctgttcaacagccgctggaggatagaattttcactcccgctgtgagcgccgtgtactccaccgtgacccaggtggctaggcaaccaggtacccccacaccctctccgtattctgcgcacgagattaacaagggtcaccccaacctagctgcaaccccccccggacacgccagtagtccaggcctgtctcaaaccccttacccctccggccaaaacgcagggccaactaccctggtgtacccacagactcctcagaccatgaactcgcagccccagacaagaagcccatttgctgcaggaccaaggcccccacatcaccagtttttccagcggcctcagatacagcctcctagagccacgatccccaactcctccccctccataaggccgggggcgcagacgccgacggccgtctatcaggccaatcagcatattatgatggttaatcatctccccatgccctatcctgttccccagggaccacagtactgcattccacaatacagacacagcggtcctccctacgtggggcctccccaacagtacccagtgcagccccctggcccgggcccattttacccagggcctggtcctggcgacttccccaatgcctacggcaccccgttctatccgagccaaccggtctatcagtcagcacctatcatcgtccctacacagcagcagccaccaccggctaagagggaaaaaaagactatccgcatcagagaccctaaccaggggggaaaagatatcacagaggaaataatgtcaggcggcggcagccgcaatcctactcccccaatcgggcggcctactagcactcccactcccccccagcagttacccagccaggtccctgagcacagccctgtagtgtatggcaccgtagagtctgctcacctggccgcgtctaccccggttaccgcagcgtccgaccagaagcaagaggaaaaaccaaaacctgacccagtccttaagtccccttcacccgtactgcggctcgtgctgtccggtgaaaagaaagaacaggaggggcagacaagcgagaccaccgcaattgtaagcatagccgagctccccctgcctccttctccaacaaccgtcagcagcgtagcccggtccacaattgccgcccccacctcctctgctctgtcaagccagcccatcttcaccaccgccattgacgaccggtgtgaactgagctcacccagagaagatacgatccccattccgtccttgacctcttgcaccgagacaagcgatcctctacctacaaacgaaaatgacgatgacatctgtaaaaagccatgcagcgtagccccaaacgacattcccctggtaagtagtacaaatctcattaatgaaattaatggcgtatctgaaaaattatctgccacagagtcaattgtcgaaatagtgaagcaggaggtgctgcccctgacgctcgagctggagatactcgagaacccccccgaggaaatgaagctcgagtgcatacccgctccaatcactccttccaccgttccatcctttccccctaccccaccgactcctccggcctctcctccgcatacacctgtcatagttccagctgccgcaactactgtctcctccccctccgcagcaattaccgtgcagagggttctggaggaggacgagtcaatcagaacttgcctgtctgaggacgcaaaagagattcagaataaaatcgaggtggaggccgacggacaaactgaagagattctggattcccagaatctcaactcccgcagaagtccagtccctgagacctctaatgagtgctag

SEQ ID NO: 14946 - DNA, 414 bp, Artificial Sequence
  Description of Artificial Sequence: Synthetic coding sequence
atgatattgccaacaaaagcgatggcaacccaggagctgacagtgaagaggaaactctccgggaacactctgcaggtgcaggcatcttcaccagtggccctgggcgtgcgcatacctaccgttgcccttcacatgatggagttgttcgacactaccgttgaacagctgtactcaatcttcaccgtcaaagaactgaccaacaagaagatcattatgaaatggcggtgcgggaactggccggaggaacactacgccatggtggcactaaactttgtgcccactctgggacaaacagagctgcagctgaaggaatttctgtccatttgtaaggaagaaaatatgaaattctgctggcaaaaacagcacttcgaggaaatcaaaggctcactgcaattgacccctttgaatggttag

SEQ ID NO: 14947 - DNA, 1248 bp, Artificial Sequence
  Description of Artificial Sequence: Synthetic coding sequence
atgatgctgggccccgagggcggagaagggttcgtagtgaagcttcggggcctcccatggtcttgctctgtggaggatgttcagaacttcctgagcgattgtacgatccatgacggagcagctggcgtgcatttcatctatacacgcgagggcaggcagtcgggagaggcttttgtggaacttggaagcgaagacgacgtgaagatggccttgaagaaagacagagaaagcatgggacaccgatacattgaggtgtttaaaagccatcggaccgagatggactgggtcctcaaacactcaggcccaaattcagccgattctgccaacgacggcttcgtcaggctgcggggactgccttttgggtgtacaaaggaggaaatcgtccagttttttagcggcctggagattgttccaaacggaatcacattgccggtggacccggagggaaaaataaccggagaggccttcgtgcagttcgcttcacaggaactggctgagaaagcactcgggaagcacaaggagcgaataggccaccgctacattgaagtattcaagtcctctcaagaagaggtgagaagctatagtgacccacccctgaaattcatgtctgtgcagcgccccggcccctacgaccgccctggcaccgccagaagatatatcggcattgtgaaacaggcagggcttgagcgaatgcgtcctggagcctattctaccggatatggggggtatgaggaatattccggcctgagcgacggctatggatttacgaccgacctctttgggcgggacttgtcctattgcctcagtgggatgtacgaccaccgttacggtgattctgagtttacagtccaatcaacgaccggacactgtgtccatatgagaggccttccttataaggctacggagaacgacatctataatttcttttcgcccctgaaccctgtgagagtgcatattgaaatcggaccagacggtcgagtgacaggcgaggctgatgtagagttcgccactcatgaggaggctgtcgccgccatgagcaaagatcgcgctaacatgcaacacaggtacatcgaacttttcctgaactccaccacaggcgcctcaaatggggcctattcaagtcaagttatgcagggcatgggggtgagtgcagcgcaggctacttattctggtctggaatcccagagtgtctcaggctgctatggggctggctactccgggcagaatagtatgggcggttatgattag

SEQ ID NO: 14948 - DNA, 1464 bp, Artificial Sequence
  Description of Artificial Sequence: Synthetic coding sequence
atgtccagccctctcgcctcgctttccaagactaggaaggtcccattaccctccgaacccatgaacccgggaaggcgtggcatcaggatctatggggacgtgccagccagccacgatagtgagttaatggcctttatgaccagaaagctgtgggacctggagcagcaggttaaggctcaaacagacgaaatcttgagcaaagaccaaaagattgccgcactggaagacctggttcagactttgaggccgcacccagcagaggcaaccctgcagcggcaagaggagctggagactatgtgcgtgcaattgcagagacaagtacgtgaaatggaacgctttcttagtgactatggccttcagtgggttggagaaccgatggaccaagaggacagtgagtctaaaactgtgagtgaacacggagaacgcgactggatgacagccaagaaattctggaagcccggcgattcactggccccaccagaggtggattttgatcggctccttgcatccctgcaggacttatctgagctggtcgtcgaaggcgatacccaggtcacgcccgtgcccggcggcgccagattgcgtaccctggaacctattccgctcaagttatacagaaacggaatcatgatgttcgacggcccgttccaaccgttttatgacccttctacccagcgatgcttaagggatatactcgatgggtttttccctagtgagctccaacgtctgtaccctaacggggtacctttcaaagtgtcggatttaaggaatcaggtatacctggaagatggacttgatccattcccgggggaagggcgcgtcgttggccgccaactaatgcataaggccttggatcgtgtagaggaacatccaggctctcgcatgaccgctgaaaaattcctgaatagattacccaagtttgtgatacgccagggggaagttattgatattcgcgggcccatcagagacaccctgcagaattgttgccctctccccgcacgaatccaagagatcgttgtggaaactcctactctcgcggcagaaagagagcgctcacaggagagcccaaatactccggcccctcccctgtccatgctgcgcataaagtccgagaacggagagcaggcattcctgctaatgatgcagcccgacaataccataggtgatgtacgcgcgctgctagcacaggcaagagtgatggatgcatccgcttttgagattttctctacgttcccaccaaccctgtatcaggatgacacccttaccctccaggcagccggactggttcccaaagccgcactcctgctgcgcgcaagacgcgctcccaaaagctcgttgaaatttagtcctggcccctgtcctggtcccggccctggccccagcccaggacctgggcctggtccctcaccaggccctggcccgggcccgtctccatgccctgggccaagtccctcgcctcagtag

SEQ ID NO: 14949 - DNA, 1467 bp, Artificial Sequence
  Description of Artificial Sequence: Synthetic coding sequence
atgagtgcgttttgcctgggattggtggggagagcctcagctcccgctgagcctgacagcgcatgttgtatggagttgccagcagccgcaggcgatgctgtaagatctccagccgcagccgctgccctcatcttccctggcggctcaggcgaactggaactcgcacttgaggaagagctggccctactggcagccggcgaacggccttctgatcctggcgaacatcctcaggcagaattactgtctgtgatacggcaaaaggaaaaggacttggtgctggctgcaagactaggaaaggctcttctggagagaaatcaggacatgagcaggcagtatgagcagatgcacaaagaactgaccgataaactggagcacctggagcaggagaagcacgagctcaggcggcgtttcgaaaaccgcgaaggtgaatgggagggacgtgtgagtgaattagagagtgacgtgaagcagctgcaggatgaacttgagaggcagcaaatccacctgagagaggccgacagggagaagtctcgggccgtccaggagctgtctgagcaaaaccagcgcttactagatcagcttagccgggccagcgaagtggagcggcagttatcaatgcaagtgcacgccctcagggaagacttccgtgagaaaaactcctccaccaatcaacatataatccgcttggagtccctacaagcggaaatcaagatgctgtctgatagaaagcgggagcttgaacatcgccttagtgccactttggaagagaatgacttgctgcaaggaaccgtggaggagctccaggatcgagttcttatactcgaacggcaagggcacgataaagacctgcagcttcaccagagccagctggaactacaggaggttaggctaagctgcaggcagttacaggtcaaagtggaggagctcacggaagaacgctccctgcagtctagcgctgctactagcacctctctgctcagtgagatcgaacagtccatggaagccgaggagttagagcaggaacgggagcagttacgtctccagctgtgggaggcttactgccaggtaagatatctgtgcagtcacctgcgagggaacgacagtgctgacagcgctgtgagcaccgacagttcgatggacgagtccagtgaaacttcatccgccaaggacgtgcccgcgggctctctgcgtacggccctgaatgaactgaagcgactgattcagtccatagttgacggcatggaaccaaccggctctcgcaggctggacgacgacagtctcgaggagcagatcagacagacaagcgaggacagtcgcgccctacgcgagctgatggagggcgagcgcgggaggctgccggaggccagcagatgctgcttgcccgcttgttcccagcccattcaaagtccaagcctccctcatgtcggaaaagcacagcagggttgcgccgcccgcatgtacctatag

SEQ ID NO: 14950 - DNA, 1428 bp, Artificial Sequence
  Description of Artificial Sequence: Synthetic coding sequence
atgacaaggggcaccggaggcaccgcccagcgagggcgctccggcccggacagccaggggctgttagatagctctctaatggcttcaggtacagccagcagatccgaggatgaggaaagcttggccggtcaaaaaagggctagctcccaggcgctcggcacaattccgaagaggcggagcagttcacggttcataaagcggaaaaaatttgacgacgagctggttgaatcctccctggccaagtctagcacacgggccaaaggcgcgtcaggtgtcgagccagggaggtgcagtggcagtgagccgtcaagtagcgaaaagaaaaaagtctccaaggctccgtccacaccagtgcctccatctccagcgcctgcacctggtctgacgaaaagagtgaagaagtcaaagcagcccttacaagtaaccaaggaccttggaagatggaagcccgctgacgacctgctgcttatcaacgctgtccttcaaacaaatgaccttacaagcgtccatttaggcgtgaagttctcctgccggtttaccttgcgggaagtgcaggaaagatggtatgctctgctctatgatcctgtcattagcaaactcgcctgtcaggccatgcgccagcttcaccccgaggcaatcgcggccatccagtccaaggccctcttcagcaaggccgaggagcagctgctgtccaaggtcgggtccacttcccagcctacccttgagacatttcaggacctgctgcaccggcatccggacgccttctacctggcccgtacggctaaggcactacaggcccactggcagctcatgaaacagtattatctgcttgaggaccaaacagtgcagccacttcccaaaggggatcaggtcctcaattttagtgacgccgaagatctgattgatgactctaagctgaaagatatgcgcgatgaggtgctggaacatgaacttatggtggctgataggcggcaaaagcgagagatccggcagttggaacaggagttgcacaagtggcaggtgttggtcgacagcatcaccgggatgtcctctcctgattttgataatcaaaccctggctgtgcttcgggggcggatggttaggtatctgatgagaagtagagagataactctcgggagggccaccaaggataaccagattgacgtagaccttagtttggaaggccccgcctggaaaatcagtagaaaacaaggagtgataaaactgaaaaacaatggcgatttctttatcgctaatgaaggccggagacctatttacatagacgggcgaccagtactttgcgggtcgaaatggcgtctttcgaacaatagtgtggtggagatagccagtcttagattcgtttttctcattaaccaggatttgatcgccctgattcgcgctgaggcggctaagatcaccccacaatag

SEQ ID NO: 14951 - DNA, 1311 bp, Artificial Sequence
  Description of Artificial Sequence: Synthetic coding sequence
atggctgacggcgggtccgagcgggctgatggtcgcatcgtaaagatggaggtcgattatagtgcgacagttgaccagcgcctcccagagtgcgccaagcttgcaaaagcctctgatatggtgagcacttcccggatccttgttgctgtcgtgaagatgtgctacgaagctaaggaatgggacctgcttaacgagaacatcatgctgctgagtaaacgacggagccagttgaagcaggccgtggcgaagatggtacagcagtgttgcacctacgtggaggagattacggatctgccgattaagttaaggcttatcgataccctgcggatggttacagaagggaagatatatgtggagattgagcgcgcccggctgactaaaacccttgccacaatcaaggaacagaacggcgacgtcaaggaggctgcaagtattctgcaggagctgcaggtggaaacgtacggctccatggaaaaaaaggaacgggtggagttcatattggagcaaatgagactgtgcctcgctgtcaaagactacatacgaacccagattatctccaaaaagatcaacactaagttttttcaggaggaaaacacagagaagctgaaattgaaatactataaccttatgatccagctggaccaacatgagggctcttatctatcaatctgtaagcactatcgcgccatatatgacaccccatgtattcaagccgaatcagagaagtggcagcaggccctcaagtccgtagttctttacgtgattttagcaccatttgacaatgaacagagcgatctcgtgcataggatcagcggggacaaaaaactggaggagattcctaaatataaggatctgctgaaactgttcacaacgatggagctaatgaggtggtcaactctggttgaggactacggcatggagcttaggaaaggcagcttggagtcccccgccacagatgtcttcggttctacagaagaaggcgaaaaaagatggaaagacctgaagaatcgagtcgtcgagcacaacattaggataatggctaagtattatactaggatcaccatgaagcggatggcacagctcctggacctatccgtcgacgagtccgaggcttttttgtccaatctggtggtgaacaaaacaatttttgctaaggtggaccgacttgcgggcattataaatttccagcgcccaaaggacccaaacaatctgcttaacgactggagccagaaactcaatagtttaatgtccctagtgaacaagacgactcatctgatagcgaaagaggaaatgattcataatctgcaatag

SEQ ID NO: 14952 - DNA, 1974 bp, Artificial Sequence
  Description of Artificial Sequence: Synthetic coding sequence
atggacgacccggactgcgacagcacttgggaggaagatgaggaggatgccgaagacgctgaggatgaggattgcgaagacggagaagctgccggagcaagggacgccgacgccggcgacgaggacgaggaaagtgaggagccacgcgctgccagaccatcctcctttcagtctaggatgaccgggtcaagaaactggagggccactcgtgatatgtgccggtatcggcataattacccagacctggtggaaagagactgcaacggcgatacccccaacctgagcttttatcggaatgagattcggtttttgcccaacggatgctttatagaagatatactgcaaaactggacagacaactacgacctgctggaggacaaccatagctatattcagtggctgttccctttacgggagcccggagtcaattggcacgcaaaaccccttacactgagagaggtcgaggttttcaagagttctcaggagatccaggaacgcctcgttagggcgtatgagctgatgttaggtttttacggaataagattggaagatagagggacgggtacagttggccgggcacagaattaccagaaaagatttcagaacttgaactggaggagccacaataacctgcggataactagaatactaaagagtttaggagagctggggctcgagcacttccaggcacccctcgtgagatttttcttggaagagaccctcgtgcggagggagctgcccggtgtgagacagtccgctttggactatttcatgtttgccgtgagatgccggcaccagcgtaggcagctggtccattttgcatgggagcacttccgccccagatgtaagttcgtgtggggtcctcaggacaaattaaggcggttcaaaccctctagtctgcctcacccgctcgaaggcagcagaaaagtcgaagaggaggggtcacctggcgacccagaccatgaagcttccacccaggggagaacgtgcgggccagaacattcaaagggcggcggacgggtcgacgagggaccccaaccgcgcagtgtggagccccaggacgctgggcctcttgagcgctcccagggcgacgaggctgggggtcatggagaggacagacccgagcccttgagtccgaaggagtcaaaaaagaggaaattagagctctcccgccgagagcagccgcccacagagccaggtccacagtcagctagcgaggtcgagaaaattgcacttaacctggagggctgtgccctctcacagggttccctgcgcactggcacgcaagaggttgggggccaggaccccggcgaggccgtgcagccgtgccggcaaccattaggcgcccgagtagccgacaaggtaagaaagaggcgtaaagtcgacgaaggagccggcgatagcgccgcagttgcctctggaggcgctcagactcttgccctggcgggctcgccagctccctcgggccaccccaaggccggtcatagcgaaaacggagttgaagaggacacagaaggcagaacaggcccgaaggaaggaactccagggagtccatccgagacgcctggcccctcacccgctggacctgccggcgacgaacccgccgaaagtcccagtgaaactcccggccccagaccagccggaccggctggcgatgagccagctgagagtccatccgaaactccgggcccaagtcctgcaggcccaacccgcgatgaacctgcagaatctcctagcgagacgcccgggccccgtcctgccggtccagctggcgatgagcctgctgaaagtccatctgagacacccggtcctagacccgccggacctgcaggcgacgagcctgcagagagcccgtcggagactccaggaccttctcctgcaggtcctaccagagacgagccagccaaagcgggtgaggcggcagaactgcaggacgccgaagtggagagttccgctaagtccgggaaaccctag

SEQ ID NO: 14953 - DNA, 615 bp, Artificial Sequence
  Description of Artificial Sequence: Synthetic coding sequence
atggatcccaaggatcgaaagaaaattcagttcagcgtacctgcgcctccctcccagctggacccacgccaggttgaaatgatcagaagacgaaggcctactccagcaatgctcttccgattgtccgagcacagctcaccagaggaggaggcctctcctcaccagcgggcgtcaggcgaggggcatcacctgaagtcaaagcgtcctaatccctgcgcctacacgccaccgagtctgaaggccgtgcagagaattgctgaatctcatttgcaaagcatctcaaacttgaatgagaaccaggcaagtgaggaggaggacgaactgggggagctgcgggagctggggtaccctcgtgaagaggacgaagaggaagaggaggacgatgaggaagaagaagaggaggaggactcccaggccgaggtcttgaaggttattcgccagagcgccgggcagaaaacaacctgtggccaggggctcgagggaccatgggaacgacccccgcccctcgatgagagcgagagagacggcgggtcagaggaccaagtagaagaccccgctctatctgaacctggagaagagccccaaagacctagccctagtgagcctggtacctag

SEQ ID NO: 14954 - DNA, 3042 bp, Artificial Sequence
  Description of Artificial Sequence: Synthetic coding sequence
atggggtggaagccaagcgaagccagaggacagagccagtcctttcaagcatcaggattacagccaagatctctcaaggctgccaggagggccactggccggcctgaccggagcagagccgcacgtcccaccatggacccatccgctcaccggagcagggctgccccgcccaatatggacccagaccctcaggctggtgttcaagtcggaatgagagtcgtgcgcggggttgactggaaatggggtcaacaggacggcggggaagggggcgtgggtactgttgtcgagctgggacggcacggaagccccagcactcccgaccgaacagtggtagtccagtgggaccagggcacacggacaaattaccgggcaggataccagggggcccacgatctcttgttatacgacaatgcccagattggggtgcgacaccccaatatcatttgcgactgctgcaaaaagcatggactgcgaggaatgagatggaagtgtagggtgtgtttggactacgacctgtgcacacagtgctacatgcacaacaaacacgagctggctcacgcttttgatcggtatgagacggctcactcacgtccagtcacattgtcacccagacagggactcccccgcatccccctccgagggattttccagggtgccaaggtggttcgcggccccgactgggagtggggctcccaggacgggggtgagggaaagcccgggcgggtggtggacattcgcgggtgggatgtggaaactgggcgctctgttgcttcggtcacctgggccgatggcacaacgaatgtatatcgcgtaggccacaaaggtaaggtggatttaaagtgtgtgggagaagctgccgggggtttttattacaaggaccacctgccacgactcggtaagcctgcagaactgcagcggagagttagcgcagacagtcaaccttttcagcacggcgacaaagttaagtgtttactggatacagatgtcctgcgcgagatgcaggaagggcatggtggatggaatcccagaatggctgagtttattgggcagacaggcacggtccaccggatcaccgacagaggggatgtcagggtgcagttcaaccatgagacccgctggaccttccacccgggagccctgacgaaacatcacagcttctgggtgggggatgttgtgcgagtcataggtgacctggacacggtgaaaagattgcaggctggacatggcgagtggactgatgatatggccccagcgcttggccgtgtcggcaaagttgtgaaagtgtttggcgacggcaatctcagggtggcagtcgctggccagaggtggacattttcaccatcttgcctcgttgcctacagacctgaggaggatgctaatttagacgtggccgagcgggccagagaaaacaagagcagccttagcgttgccctggacaagcttagagcacaaaagtctgatcccgagcaccctggccgcctcgtggttgaagtggcactcggcaacgcggcccgtgccctggacttactgcggcggaggcccgaacaggttgacactaagaaccagggacgcactgctctgcaagtggcagcctatctggggcaggttgagttgatccgccttctgctgcaggctagggcaggtgtcgacctcccggacgacgaaggcaatactgccttgcactatgcggcactcgggaatcagccagaagctaccagagtgctgcttagcgccggctgccgggctgatgccattaattctacacagtcaactgccctacatgtggctgttcagcgaggatttttagaggtggttcgcgcgctgtgcgaacgcggatgtgatgtgaatttgcccgatgcccactcagacacccccctgcattctgccatttctgcgggaaccggggcgagtggtatagtggaggtactgaccgaggtcccgaacatcgatgtaacagcaaccaattctcaggggttcaccttacttcaccacgcatccctgaaagggcatgcactggctgtccggaagatcctggctcgcgctcggcagttggtggacgccaagaaggaagatgggttcacggctctgcatctggccgcgttaaataaccatagagaggtggcccagattttgatcagagagggacgctgtgatgtaaatgtgaggaaccggaagttacagtctcctttacacctcgccgttcagcaagcccacgtagggctggttccactccttgtggatgctggctgctccgtcaatgcagaggacgaggagggcgacactgcgcttcatgtggctctccagcgtcaccagctattgcccctcgtggctgatggcgccggaggggatcctgggcctctccagctgctttcccgcctgcaggccagtggattaccgggctctgcagagctaaccgtcggcgctgccgttgcctgcttcctggccctcgaaggtgctgatgtctcctatactaatcaccgtggacggtccccgttggacctggccgccgaaggccgtgtgttaaaggccttgcagggatgcgcgcagagatttagagagcgtcaggcaggaggcggcgccgcccccgggccacgacaaacattgggcacaccaaacacagtaacgaatctccacgtcggtgctgcacccggaccagaagccgcggaatgtctcgtatgcagcgagctggctctgctggtgctgttcagcccttgccaacaccggaccgtatgcgaagagtgtgcaaggaggatgaagaaatgtatcaggtgtcaagtcgtcgtgtccaagaagcttaggccagatggctccgaggtggcttctgccgctcctgcaccaggccccccccgccaactggtagaggaactgcagtccaggtaccgccaaatggaggagagaatcacatgtcctatctgtattgactcacacattcgtctggtgtttcagtgcggacacggcgcctgtgccccttgtggcagcgccttatcggcgtgcccaatttgtagacagcccattcgcgaccggatccagattttcgtctag

SEQ ID NO: 14955 - DNA, 2055 bp, Artificial Sequence
  Description of Artificial Sequence: Synthetic coding sequence
atgattccgccgcaggaggcctcagctcggaggcgtgaaatcgaggacaagctgaaacaagaagaagagacccttagttttattagggattccctcgaaaaatctgatcagttgacaaaaaacatggtgtctatcttatcaagctttgaatcaaggctcatgaaacttgagaactctattatacccgtgcataagcagaccgaaaacctgcaaaggttgcaagagaatgtggagaaaaccttatcttgtctggaccacgtcatcagctattaccacgttgctagcgacacggaaaaaatcatccgggaggggcctaccggaaggctcgaggaatacctgggctctatggccaagatccagaaggcagtcgagtatttccaagacaatagccccgactcacctgagctgaataaggtgaagctactctttgaacgaggcaaggaggccctcgagtccgaatttaggagcctcatgaccagacactcaaaggtcgtctcaccggtgctcatactggatctcatttcgggcgacgacgaccttgaggcacaggaggatgttacacttgaacatctccctgaaagcgtgcttcaggatgtgattagaatatcccgctggctggtggagtacggacgaaatcaggactttatgaacgtgtattaccagattcgctcctctcagctggataggtctattaagggccttaaagagcactttcacaagagttcatctagcagcggagtgccctacagtcccgccattcccaacaaacgtaaagacactcctaccaagaagccagttaagcgaccaggaaccatcagaaaggctcagaatcttctgaaacaatactctcagcacggcctggacggtaaaaagggtggcagcaacctcatccccttggaaggacgggatgacatgttggatgtagaaactgacgcatacatacactgtgtctctgcctttgtgaagctggcgcagtcagaatatcagttgctcgccgatattattcccgagcatcatcagaaaaaaacattcgattccttgatccaggatgctctggacggtctcatgttggagggggaaaacatagtgtcagcagccaggaaagccatcgtcagacacgatttttctacggtattgacagtttttccgatccttcggcatctcaagcaaactaagcccgagtttgatcaggtcctgcagggcacggctgccagtaccaaaaataaactgcccggcctcataaccagtatggagactatcggtgcgaaagcactggaagactttgctgataatattaagaacgatcctgacaaggaatacaatatgcccaaggacggcacagtgcacgaactcacctctaatgccattctcttcctgcagcagctgttggacttccaagagacagccggcgctatgctggcttcgcaggaaaccagcagctctgctactagttactcatccgaattctccaagcgactgctcagcacatacatttgtaaggtcctcggaaatttacagttgaatttgttgagtaaatctaaggtctacgaagatccagccctgtctgcaatcttcctgcataacaactataactatattctcaagtctcttgaaaagagtgaactgattcagttagtggctgtcacacaaaagacagctgaaagaagttatcgtgaacatattgaacagcagatacagacctatcagagaagttggctaaaggtcaccgattacattgccgaaaagaatctgccagtctttcagccgggggtgaagctgcgcgacaaagagcgtcagataattaaggagagattcaaaggtttcaacgatggcctggaggaactgtgtaagattcagaaggcttgggcgattccagacactgagcagagagataggatacgccaggcccagaagacaatcgtcaaagaaacctacggcgcatttttacagaagtttggaagtgtcccatttactaagaatccagaaaaatatatcaaatacggggtagagcaggtgggagatatgatcgatagattgtttgacacttctgcttag

SEQ ID NO: 14956 - DNA, 3576 bp, Artificial Sequence
  Description of Artificial Sequence: Synthetic coding sequence
atgcccgtccaggctgctcaatggacagagtttctgtcctgtcctatttgctacaatgagttcgatgaaaacgtgcacaaacctatcagtttgggttgcagccatactgtatgtaagacgtgcctgaacaaactgcaccggaaggcatgtccattcgatcagactgctataaataccgacatcgacgtcctgcccgttaactttgctcttctgcagcttgtcggagctcaggtaccagatcatcaatccatcaagctcagtaacctgggagaaaacaaacactatgaggttgcgaagaagtgcgtcgaagacctggccctctatctgaagcctctatcaggggggaaaggtgtggcatctctgaaccaatccgcgctgtcgcgccctatgcagcgcaagctggtgacactggtgaattgtcagttggttgaagaggaaggccgggtgcgggcaatgcgtgccgcgaggtcgctgggggaaaggactgttaccgaactgattttacaacatcagaatccccagcagctgtcagctaatctctgggcagccgtccgggctcggggctgccaattcctggggccagctatgcaggaagaagccctgaagctggttctattggcccttgaggacggttcagccctgagtaggaaggttctggttttatttgtcgtgcagcgcctcgaacccagatttcctcaggcctcaaagacaagcatagggcatgtcgtccagctgctataccgggccagttgttttaaggtcaccaagagagacgaagatagctctctgatgcagctgaaggaagagttcagaagctatgaggccctgagacgagaacatgacgcacaaatcgttcatattgcgatggaggccggactgcgaatctcccctgagcagtggtcctctctcctgtacggcgacctggcgcacaagagccatatgcagtctatcatcgataaactgcagtcacctgaatctttcgctaaatctgtccaggagcttactatcgtcttgcaacgcacgggggaccctgccaatctgaacagactgcgaccacatctggagctgctggcaaacatagatcccaatcctgacgccgtaagccccacctgggagcagttggagaacgcaatggtggccgtaaaaacggttgtgcatggcttagtggacttcattcagaactactccaggaaggggcacgaaactccacaacctcagcctaattctaagtacaagactagcatgtgcagagacctgcggcagcaaggcggatgccccagagggacaaattgcacttttgcacactcacaagaagaactggaaaagtatcgtctgcgtaacaaaaagatcaacgcaaccgtcaggaccttcccattgctaaataaggtgggagtgaacaacacagtgacaactaccgcgggaaacgtcattagcgttattggatccactgagacgaccggcaaaatcgtgccctccaccaatggcatttcaaatgcagagaacagcgtgagtcagttgatttctcgctctaccgacagcacgctgcgggccctggaaactgtgaagaaggtgggcaaggttggcgccaacggacagaatgccgctggcccgtcggccgactcagtgactgaaaataaaatagggtcgcctccgaagacccctgtgtcgaatgtagctgcaacaagcgccggccccagcaatgttggtactgagcttaactctgtgccacaaaaatcctccccatttcttacgcgcgtcccagtctaccctccccactccgagaatattcaatatttccaagatccgcggacacagataccattcgaagtccctcagtatcctcagactgggtactatccccctccgccgaccgttcccgccggagtggcaccctgcgtccctcgattcgtgcggagcaataacgtgccagaaagctcgctaccgcctgccagcatgccttacgcggatcactacagcactttttccccaagagatcgcatgaatagcagtccataccagccccctccgccccagccgtatgggcctgttcctcccgttccctccgggatgtacgcccccgtctacgattctcgtcggatctggcggccccctatgtatcaaagagacgacatcattcgtagtaattctctaccccccatggatgtaatgcattccagcgtgtaccagacttcactgagagaacgctacaactccctggatggatattacagcgtagcttgccagccaccttccgagcccagaacgacagtgcctctcccccgagagccctgcggccacctcaagactagttgtgaagagcaaatacggagaaaacctgaccaatgggcacagtaccacacacaaaaggcccctctcgtgagttccactctaccagttgcgacacagagtcccactccccctagtcctctcttcagtgtcgactttcgagctgacttctctgagagtgtgagtggaactaaatttgaagaggatcacctgagtcactatagtccctggtcctgtggaaccatcggctcctgcatcaacgctatcgatagcgaaccaaaggatgtaatcgccaactcaaatgccgtgttgatggacttggattccggtgacgtcaagagaagggttcacctgtttgagacacagcgacggaccaaggaggaagatccaataataccctttagtgatggccctatcatatccaagtggggagccatctctcgctcaagtcgcacaggctaccacacaacagatcccgtgcaggctacagcctcacagggcagcgcaaccaagccgatttccgtttcagactacgttccttacgtgaatgccgtggatagcagatggtcatcatacgggaacgaggccacgagcagtgcccactatgtggaacgggatcgcttcattgtaaccgacctgagcggccaccgcaaacattcctccacaggcgacttgttaagtctggagctgcagcaagccaagtcgaatagccttctcctgcagagggaagcaaatgctctggccatgcagcagaagtggaactcgctggacgagggtcgccacttgacattgaatcttcttagcaaagagatcgaactccgaaacggagagctccaaagcgactatactgaagacgccaccgacactaaaccagatagggacatagagctggagctgagtgctctggacaccgatgagcccgacggccagtcagaaccaatcgaagaaatcctcgatattcagttggggatttctagccagaacgatcaacttctgaacggaatggcagtcgagaatgggcaccctgtgcaacagcaccaaaaggaaccccccaagcaaaagaaacagtcactcggcgaggaccatgttattctggaggagcaaaagactatcttgcccgtgacatcatgttttagccagccccttccggtgagcataagcaacgcatcatgcctgcctattacaacctccgtctctgccggtaacctgattcttaagacacacgtcatgtctgaagacaaaaacgattttctgaagccagttgcaaatgggaagatggtgaatagctag

SEQ ID NO: 14957 - DNA, 2100 bp, Artificial Sequence
  Description of Artificial Sequence: Synthetic coding sequence
atgtgcggaatttttgcttatcttaactatcatgtcccacgtacccgcagggaaatattggaaacactgattaaagggttacaaagactggaatacaggggttacgactcagctggggtgggtttcgacgggggtaacgataaggactgggaggccaacgcatgcaaaattcagctcattaaaaaaaagggcaaggtaaaagcgctggacgaggaggtgcataagcagcaggacatggacctcgacatcgagtttgatgttcacctgggtattgcccacacgcggtgggccacgcacggagaaccctcccccgttaattctcatccgcagcgttctgacaagaataacgagtttatcgtgatccacaatggaattataaccaattacaaggacctcaagaagttcctagagagtaaggggtatgacttcgagagcgaaaccgataccgagaccattgctaagttggtcaagtatatgtatgacaatcgtgaaagccaggatacaagttttactaccttggtagagcgggtgatacagcaactcgagggcgcgttcgcccttgtcttcaagtccgtccactttcctggccaggcagttggcactagacgtggatcgcccttgctgatcggcgtccgatcagaacataagctcagtaccgatcacatcccaattctgtatagaaccgcccggacacagatcggctctaaatttacaaggtggggttcacagggggagagagggaaggataagaagggatcctgtaacctatcgcgagtggactctactacttgcctattcccagttgaagaaaaggcagtcgaatattatttcgcctcagacgcaagcgctgtgatcgagcacacgaacagagtaatcttccttgaggacgatgacgtggctgctgtcgtggacgggcggttatccattcacaggatcaaacgcacggctggggaccacccagggcgcgctgtacaaaccctccagatggagctgcagcaaatcatgaaaggtaacttttcgtctttcatgcagaaggaaatctttgagcagccggagtccgttgtgaataccatgcgcgggcgagttaacttcgacgactataccgtaaaccttgggggtctgaaggatcatataaaggaaattcaacggtgcaggcgcctgatcctgatcgcctgtggcacgtcctatcatgccggggtcgcaaccaggcaggtcttggaagaactgactgaactccctgttatggttgagctcgcctctgactttctggatcggaacacccccgtctttcgggatgatgtgtgctttttcttgagtcaatctggagagaccgccgacaccttgatgggccttcgatactgcaaggagcgaggcgctctcacagtcggtattaccaacacagtcggctcttccatcagcagggagactgactgcggcgtccacatcaacgccggcccggaaattggagtggcatccacgaaagcctatacgtcccagttcgtatccttggtcatgttcgccctgatgatgtgcgatgaccggatcagtatgcaagagaggcggaaggagatcatgctcggactgaagcggctcccagatctgatcaaggaagtactctcgatggacgacgagatacagaaactcgcaactgaactctaccaccagaagtcggtcctcattatgggtcgcggataccactatgccacatgcctcgagggggccttgaagataaaggagatcacttatatgcactcagaaggtatcctcgcaggtgagctcaagcatggacctctggctctggtagacaaattgatgccggtgatcatgatcattatgcgcgaccacacttacgcaaaatgccagaacgctcttcagcaggtggtagcacgccaggggcgcccagtggtaatctgcgacaaagaggataccgaaaccatcaaaaacaccaaaagaaccatcaaggtgccacactccgtggactgcctccaaggcatattatctgttataccgctgcagcttctcgcttttcatttggccgtacttcggggatatgatgtggacttcccacggaatctcgctaagtccgttactgtcgagtag

SEQ ID NO: 14958 - DNA, 2067 bp, Artificial Sequence
  Description of Artificial Sequence: Synthetic coding sequence
atgagcgtgaacagtgaaaaatccagctcctccgaacgccccgagccacagcagaaggctcctctggttcccccgcccccacccccacctccacctcctcctccccctttgcccgaccctaccccacctgaaccagaggaggagatcctggggagcgacgacgaggaacaggaagaccctgctgactactgcaaggggggctatcatccggtgaagattggcgacctctttaatggtcgataccatgtgattaggaaactggggtgggggcacttcagcactgtttggctgtgttgggatatgcagggtaaacgtttcgtggcaatgaaagtcgtcaagtcagctcagcactatacggaaacggcgcttgacgagataaagctgctgaaatgcgtgcgcgaaagcgacccatctgatcccaacaaggacatggtcgtgcagctgattgatgattttaaaatcagcggcatgaatggcatacacgtctgtatggttttcgaggttttggggcatcacctgctaaaatggattatcaagtctaattatcaagggctgcccgttcgttgcgtgaagtccattatccgccaggttcttcagggtctggactaccttcattccaaatgcaagataatacataccgacatcaagcctgagaacatcttgatgtgtgtagacgacgcgtacgtgcggcggatggccgccgaggcaactgagtggcagaaggcgggcgccccccctcccagtggcagtgcggtgagcaccgcaccacagcaaaaacctatcggcaaaatctccaaaaacaaaaagaagaagctgaaaaagaaacagaaacgccaagccgaactactcgagaagcgcctgcaggaaatcgaggaactggagagagaggcagaacggaagataattgaggaaaatatcacttcggccgctccctcgaacgatcaggacggtgagtactgcccagaggttaagctgaagacaaccggccttgaagaggctgccgaagcagagactgccaaagataacggcgaggccgaggaccaggaggagaaagaggacgcagagaaagagaacattgaaaaggacgaggacgatgtggaccaggagttagcgaatatcgacccgacgtggattgagagtccgaaaaccaacggacatatagagaacggtccattctcgctggaacagcagctcgacgatgaggacgacgatgaggaagattgtcctaacccagaggaatacaatcttgacgagccaaacgcagagtcagattatacttactcatccagctacgagcaattcaatggcgagctaccaaacggcaggcacaagatccccgagtcccagtttcccgagttctctacctcactcttcagcgggtctttggaaccggttgcttgcggatcggtgctgtctgaagggtctcctttaaccgagcaggaagagagctctccatcgcacgaccggagtaggaccgtctctgcctctagcacaggcgatctgcctaaggctaagactcgggccgcagacctattagttaacccactcgatccaaggaacgctgacaagattcgcgttaaaattgccgacctgggtaacgcctgttgggtacacaagcatttcaccgaggatatacaaactcggcagtatagatctattgaggtcctgattggggctggatatagcacacccgcagatatttggtcaactgcatgcatggccttcgagcttgctacgggtgattacctgtttgaacctcatagcggcgaggactattcgcgggacgaggatcacatcgcccacatcattgagctgctggggtctatccctcgccattttgctttatcaggtaagtacagccgcgaattcttcaacagacgcggagaattgagacacataactaagttgaagccttggagcttgttcgatgtcttggtggagaagtatggttggccccatgaggacgccgcccagtttactgatttcctgatccccatgctggaaatggtacctgagaaacgtgctagtgcgggggagtgcctgaggcacccatggctgaattcttag

SEQ ID NO: 14959 - DNA, 1308 bp, Artificial Sequence
  Description of Artificial Sequence: Synthetic coding sequence
atgtccggctatcagagaagacctggcgccacaccgctgtcccgagctcgctcattggcgatccccgacgcccccgctttttatgagaggcggagttgcctgccccagctgaattgcgagcgtccgcatggacgcgacttggatagcccatttttcggtattcggcccgcctttatgtgttacgtgcccagccctgtcctagcatctgtgggcgacactgatttcggatacggcaaaggcaaatgctccaagcagtctccatccggtgcacacggaacccatttcggcgatgatagattcgaagatttggaggaggcgaaccctttcagtttccgagaatttctgaagaccaaaaacctcggactgtctaaagaggatcctgcaagccggatctacgcaaaagaggcaagccggcacagcctcggcctggaccataattcgcccccttcacagaccgggggttacggcctggaatatcagcaaccttttttcgaagaccccacaggcgccggggacctgctagacgaggaggaagatgaagacacgggctggagcggggcttacctaccgagcgcaattgagcagactcacccagagagagtccccgcagggacatccccctgttcaacctatctatcctttttctccacaccctcagaattggcgggaccagagtcactcccttcctgggctctctcagatactgatagtagagtgtcaccggcttcccccgcagggtccccctccgctgacttcgctgtgcacggggagagtcttggggacaggcatctgagaaccctccagatctcatatgatgctctgaaggacgagaatagcaagctgagaaggaaactgaacgaagtacagagtttctccgaggcccaaaccgaaatggttaggacactggagaggaagctggaagccaagatgattaaagaagagtctgactaccatgacttggagtccgtagtgcagcaggttgagcagaacctggaactaatgacaaagcgcgccgtaaaagccgaaaaccacgtggtcaagttaaaacaggaaatatcacttcttcaggctcaggtgtctaacttccaacgggagaatgaagcactgagatgtgggcagggcgccagcctcaccgttgttaaacagaatgccgatgttgccctccaaaacctgagagttgtgatgaatagcgcacaggctagcattaaacaactggtgagcggcgccgagacactcaacctagtggccgagattcttaaatccatcgatcgcatcagtgaggtcaaagatgaagaggaggattcctag

SEQ ID NO: 14960 - DNA, 591 bp, Artificial Sequence
  Description of Artificial Sequence: Synthetic coding sequence
atgaaggtgaaaattaagtgttggaacggcgtggcgacctggttgtgggtggcaaacgacgagaactgcggcatttgtagaatggcttttaatggctgttgccctgactgcccactacatggcgaatccatctcaagatgcctggggtggtgtcctcaacccgtgccagtcctcggagggcgtgctcacccgcaggtgccaattaacactgcctctcctacacccggccaacatactggctctctgatgagtcgggaagaatcctcgaggtctcctgatcccacgccgcccgccctggatcaggagacttcatccttgctgcggtgcacttccccctggtgtctcgaccactcttgtgacctcttcggcattacagatcaggtttctgcggacggacccagggcatgccgccagggagcccgaagacgcctgcccgccggtgtgggacccgttctccccctgctcccccatgccttacatccccaggtggcagcacgtacagctggcgcagcagccctgccacacgtgccgcctggcatggaggtgcaaggcgtgagacctgacctggctctggcgggtggggcatcttag

SEQ ID NO: 14961 - DNA, 5127 bp, Artificial Sequence
  Description of Artificial Sequence: Synthetic coding sequence
atggcggccatcggccgggggagaagccttaagaatctgcgtgttaggggacgaaacgatagcggtgaggaaaatgtaccactggatctcacaagggagccgagtgataaccttcgcgaaatcttacagaatgttgcccgtctgcagggggtctccaacatgcggaaactggggcacctaaacaatttcacgaagctcctgtgcgatatcggccacagcgaggagaagctcgggttccattacgaagacatcataatttgtcttagactcgcccttttgaatgaagctaaagaggtacgcgccgccggactcagagcgctgcggtatctgatacaggattcctctattctgcagaaagttctaaaactgaaggtagactacctgatagctaggtgcattgatatccaacaaagtaacgaggttgaacgtactcaggctctccgccttgtacgcaagatgatcactgtgaacgccagtctgtttccaagttcagttaccaactcactcatcgccgtgggcaacgacgggctgcaggagcgcgaccgtatggtccgggcctgcatcgctattatctgtgaacttgctctgcagaaccctgaagtggtggcccttagaggaggtctgaacacaatcctgaagaacgttatagattgtcagttatctaggatcaacgaggcattgattactacaatcctgcacttgctgaatcaccctaagacccgtcagtacgtgcgcgccgatgtcgagctcgaacggattctagcaccttacactgatttccactaccgacatagcccagacaccgccgagggccagctcaaagaggatcgtgaggccagatttttagcctccaagatgggcatcattgcgacttttcggagttgggccggcattattaatttgtgcaaaccaggaaactccggaatccagtctctgatcggtgtgctctgcatccctaacatggaaatacgcagaggtttactggaagttctgtacgacatcttccgactgcccttgccggtggtgacggaagaatttatagaggccctgctctcagttgatccgggccgctttcaggactcgtggagactctccgatggctttgtggccgcggaggctaaaacaattttgccacatcgtgctaggtccaggccagacctgatggataattacctggcactgatcctcagtgcattcatccggaatggactccttgaggggctggtggaggttatcaccaactctgacgatcacatctccgtcagagctaccattctcttaggagagttacttcacatggccaatacaattctaccccacagccattcgcaccacctgcattgtctgcccactctgatgaacatggccgcctcgttcgacattcctaaggagaagcggctgcgggcttcagccgccctgaattgcttaaaacgattccacgagatgaagaagcgtggccccaagccatactctctgcacttggaccacatcattcaaaaagccatcgcaacacatcagaagcgagaccaatatttgcgcgtgcagaaggatatttttattctcaaagacactgaggaggcactgctcattaatctgcgggattcccaggttttgcagcacaaagagaatctggagtggaactggaaccttataggcacaatactcaagtggcccaatgttaacctcagaaattacaaagacgagcaactgcaccggtttgtgcgccggctactctatttttataaaccttcatcaaagctctatgccaacctggatctagatttcgcaaaggccaaacagctgactgtggtggggtgccagtttaccgaatttctccttgaaagtgaggaagacgggcaggggtacctggaggatttagtgaaggacattgtccagtggctgaatgcttcctctggcatgaagccagaacgaagcttacagaataatggtctgctaacgactctgagccagcattattttttgttcatcgggactctatcttgccatccccacggtgttaaaatgctggaaaagtgctctgtgttccagtgccttctgaacctttgttcattaaaaaaccaggatcatctcttgaagttaacagttagcagcctcgattacagtagggacggtttggcgcgcgtcattcttagcaagatcctgacggccgccaccgatgcctgtcgcctgtatgccaccaagcaccttagagtgctcctccgtgccaatgtggagttcttcaataactggggcatcgaattactggtcacacaattgcacgataagaataagacaatttcaagcgaggccctggacatcctggacgaggcctgtgaggataaggccaatctgcatgccttaatacagatgaaaccagccttgtcccatctcggagacaagggcctccttctgctcctacgcttcctctccatacctaaaggattcagctacctgaacgagagaggctatgtcgccaagcagttagaaaaatggcatagagagtacaatagcaagtacgtcgacctgatagaggaacaacttaatgaagccctaactacttatcgcaaacccgtcgacggcgataattacgtgcgcaggtctaaccagagattacagaggcctcacgtctatttgcctatccacctgtatggacagctcgttcaccataagaccggatgtcacctcctcgaggtgcaaaacataattactgaactgtgcagaaatgtgcgcactccagacctcgacaagtgggaagagattaagaagctcaaagcatcactctgggcgctggggaacatcgggtcgtctaattggggactcaacctgctgcaggaagagaatgtcatcccagatattctcaaactggcaaagcaatgcgaggtgttgagtatcagagggacctgtgtctacgtgctgggactgatcgccaagacaaagcagggatgcgacattctgaagtgtcacaactgggatgctgtcagacatagccgtaagcacttatggcctgtcgtgcctgatgatgtggagcaactgtgtaatgaactgtctagcatcccaagtaccctttctttaaactctgaaagcactagctctcgccacaactccgaatctgagagcgtccccagttccatgtttatactcgaggatgatagatttggttcgagcagcacatctacatttttccttgatataaatgaagatacagagccaaccttctatgataggtccggccccattaaagataagaactcctttcctttttttgcctcttccaagctggtgaaaaatagaattctcaatagcttaacccttcccaataagaagcaccgttccagtagcgacccaaagggcgggaaactctcctcggaaagtaagactagcaatcggaggatcagaacacttacagagccgagtgtggattttaaccattctgacgactttacccctatctccactgtacaaaagacattgcaactcgagacatcctttatgggcaacaagcacattgaggataccggctccacgccgtcaataggtgaaaacgatctgaagttcacgaaaaattttggaaccgagaatcaccgggaaaacacatccagggaacgcttggtcgttgagtctagtacttccagccatatgaaaatccgcagtcagagctttaatactgataccaccacgagcggcatttcttctatgtctagctctccatctagagagacggtcggcgtcgacgctaccaccatggacacagactgtgggtccatgagtaccgtcgtatccacgaagacgatcaaaacatctcactacctgacacctcagagtaatcatctctcattgagcaaaagcaactctgtctctctggtgcctcccggctcatctcacacgctgcctcgaagggctcagagtctgaaagcccccagtatcgcaactattaagtctctggcagattgtaatttctcgtataccagttctcgagatgcctttggctatgccaccctcaagcgactacagcagcagcgcatgcatccgtctctcagccacagcgaggcactagcctctcctgccaaggatgtgctgttcaccgacacaataacgatgaaggcaaactccttcgagtcccggcttacacccagcagatttatgaaggccctgtcctatgcttccctcgacaaagaggaccttctgtctccaattaatcagaatactctccagagaagcagttctgttaggagtatggtcagtagtgcaacatacggaggcagtgacgactacatcgggcttgccctccctgtcgacatcaatgacatcttccaggtgaaggatatcccttattttcagaccaagaatataccaccacatgatgatcggggagcccgggcattcgcccacgatgccggcggattgcccagcggaacgggagggctcgtgaagaattcatttcacctcctgagacagcagatgtcattgacggagattatgaattctatacacagtgatgcgagcttatttctcgagtctactgaagacactggcttgcaagaacacacggatgacaactgtctgtattgcgtctgtatcgaaattctcgggttccagccttccaaccagctctctgctatctgctcccattcagatttccaggacatcccctacagcgattggtgcgagcagaccatccataacccactggaggtcgtgccatccaagttctcaggaataagcggctgctctgacggtgtttcccaggagggcagcgcctcctccaccaagtctactgagcttttgttgggagtgaaaacaatccctgatgatacaccgatgtgtcggatactgttgaggaaagaggtgcttcggcttgtgatcaacctgtctagttcagtttctacaaagtgccatgagactggactgctgacgattaaggagaagtacccacagacctttgatgatatttgtctgtactccgaagtgagccacctgctgtctcactgtacctttcggttaccttgcaggcgcttcattcaggaactctttcaggacgtgcaatttctgcagatgcacgaagaagcagaagccgtgctcgccacgcccccaaaacagcctattgtagataccagcgcggaaagctag

SEQ ID NO: 14962 - DNA, 3867 bp, Artificial Sequence
  Description of Artificial Sequence: Synthetic coding sequence
atgccacgcaagggcacccaaccctctacagcaagaagaagggaagaagggcctccgcctccttcccccgatggggccagctctgatgccgagcctgaaccgccttcggggcgaactgaatccccagcaacagcagccgaaacggcaagcgaggagcttgataataggtccctagaggaaattttgaattctatccctccacccccaccacccgctatgaccaacgaggctggcgctccgcgactgatgatcacccatatagtgaatcaaaactttaagagttacgccggcgaaaagattctcgggccctttcataaaaggttcagttgtattataggtcctaacggatcaggtaaaagtaatgtcatcgactcaatgctgtttgttttcgggtacagggcacaaaagatcagatctaaaaagctctccgtccttatccataatagcgacgagcacaaagacatccagagctgtaccgtggaggttcatttccagaaaatcatagataaggagggtgatgactacgaggtgatccccaattctaacttttatgtgtctaggaccgcatgccgcgataacacaagcgtctaccatatttccggaaaaaagaaaactttcaaggatgtcggcaatctgttgaggtcccatgggatcgatctagatcataacagatttctgattctgcagggcgaggtcgagcagatcgccatgatgaagcccaaaggacagactgaacacgacgaggggatgttggaatatctcgaagatataatcggttgtggtagacttaacgagcctatcaaggttctttgtcggcgagtggaaattctcaatgagcaccgtggcgaaaagttgaatagggtcaagatggtcgaaaaggagaaagatgctcttgagggggagaaaaacattgccattgaattcttgacactcgaaaacgaaatttttcggaaaaaaaatcacgtgtgtcagtattacatttacgagctgcagaaaagaatcgcagagatggaaacacagaaggaaaagatccacgaagatactaaagaaatcaatgaaaagtcaaacatcctctccaacgaaatgaaggcaaaaaataaggatgtaaaagacactgagaagaaactgaataagattacgaagttcatcgaagaaaacaaagaaaagttcacacagcttgatctcgaggatgtgcaggtaagggagaaacttaaacacgccacaagcaaagcgaaaaaactggaaaagcagctgcagaaagataaagaaaaggtcgaagaattcaaatccatcccagccaagtctaacaacatcatcaacgaaaccacaacacgaaacaatgcacttgagaaggagaaagagaaggaagaaaagaagcttaaagaggtgatggattcactgaaacaggaaactcaggggttacagaaagagaaagagagccgcgaaaaggaacttatgggtttctcaaaatctgtcaatgaagcccgatcgaaaatggacgttgcccagagtgagctcgatatttacctgtcccgtcataacaccgccgtttcccagttaacaaaggcaaaggaggcactaatcgccgcctctgaaactctaaaagagcggaaagctgccatcagggacatcgagggcaaattgcctcagaccgagcaagaacttaaagaaaaggaaaaggagctccagaagctcacgcaggaagagacaaatttcaaatccttggtccatgacttatttcagaaggtggaggaggctaagagctctctagctatgaacagatcccgggggaaggtactcgacgccatcattcaagagaagaagtctggcagaattcccggcatctatgggcggctaggagatctcggggcaatagacgaaaagtacgatgtggcaatatccagttgctgccatgccttggactacattgtcgtggactcaatcgacatagcccaagagtgtgtcaattttctgaaacgtcagaatatcggcgtagctacattcataggccttgataagatggccgtctgggctaaaaaaatgaccgagatacaaacacctgagaatacaccccgcctctttgacttagtaaaggtgaaggacgaaaagatccgtcaggctttttacttcgctctgcgcgacactctagttgcagataacctcgatcaagcaaccagagtagcttaccagaaggatcgtagatggcgggtggtaaccctgcagggccagattatcgagcaaagcggcaccatgacgggcggggggtccaaggtcatgaaggggcgcatggggagttctcttgtgatagaaatttcagaggaggaggtgaacaagatggaatcccagttacagaacgattcaaaaaaggcgatgcagatccaagagcaaaaagttcagttggaagagcgggtggtcaagctacgtcattctgaacgggaaatgagaaacactctggagaagttcactgcatctattcagaggctgatcgaacaggaggaatatctaaatgtgcaggtgaaggagttggaggccaatgtgctggccaccgctcctgacaaaaagaaacagaagttgcttgaggagaacgtttctgcattcaagaccgagtatgacgccgtcgccgaaaaagcagggaaagtagaggcagaagttaagcgcctacacaacacaatcgtggaaattaataaccataagcttaaggcacagcaggataaactggacaagattaataagcaactcgacgagtgcgccagtgccataactaaagcccaggtcgctatcaaaaccgcagataggaatttgcagaaagcccaggatagtgtattaaggactgagaaagagattaaggatacagaaaaggaagtggacgatctgacagctgaattaaagtctcttgaagataaggctgccgaagtcgtgaaaaatactaatgctgccgaagagtcccttcccgaaatacagaaggagcacaggaatttgctacaagagctgaaggtcattcaggagaacgagcacgcactgcaaaaagatgccctgtcaatcaaactgaaactagagcaaatcgatgggcacatcgcagagcataattctaagatcaagtactggcacaaagagatctcgaaaatatctctgcaccctattgaggacaatcccatcgaagagatctccgtgctcagccccgaggaccttgaagccatcaagaatcccgattcaatcactaatcagattgcattactggaggctcgatgtcatgagatgaagcctaatctgggcgctatcgcggagtataagaagaaagaggaactgtacctacagagggtagccgagttggataagatcacttacgagcgggattcctttcgacaggcttacgaggatcttaggaagcaacggctgaacgagtttatggccgggttctacatcatcacgaataagctcaaggagaactaccagatgctcactctaggcggagatgccgagctggaactggtggatagtcttgatcctttcagcgaaggaattatgttcagcgtgcggccccctaagaagtcatggaagaagatctttaatctctcagggggtgagaagaccttatcaagcctggcactcgtctttgctctccaccattacaagccaacccccttgtacttcatggacgaaatcgatgccgcccttgatttcaaaaatgtttcaatagtggcattctacatttatgaacagacgaaaaatgcacagtttatcatcatctcgctgagaaataacatgtttgagatttccgacagactgattggtatatacaagacttataatataacgaaatcagtcgccgtcaatcccaaggagatcgctagcaaggggctgtgctag

SEQ ID NO: 14963 - DNA, 2829 bp, Artificial Sequence
  Description of Artificial Sequence: Synthetic coding sequence
atgacaggatcaaatagtcacatcacaattctcacactaaaggtgctccctcactttgaaagcctcggaaaacaggaaaaaattcctaacaaaatgtctgctttccgcaatcactgtccccaccttgatagcgtcggtgaaatcacgaaggaagacctgatccagaagtctctgggtacctgtcaagattgcaaggttcaagggccgaatctgtgggcctgcctcgagaatagatgctcctacgttggttgcggtgagagccaggttgatcatagcacaatccactcccaggaaaccaaacactacctgactgttaacctgactactttaagagtgtggtgttatgcgtgctctaaagaagtgttcctcgatcggaagttgggcacccaacccagcctgcctcatgtccgccaacctcatcagatccaggagaatagcgtccaggatttcaagatcccctccaacaccaccctgaaaacacctttagttgcggtgttcgacgacctggacattgaggcggacgaggaggatgagcttcgggcacgtggcctgacggggttaaagaacatcgggaatacatgctacatgaacgccgcattgcaggcgctgtcaaactgtccccctcttacacaattctttctggattgcgggggcctggctcgaacagacaaaaaacctgccatctgtaagtcctacctgaagcttatgactgaactttggcacaaaagccggcccggatctgtagtccctaccactctgtttcagggcattaaaaccgtgaatcccacctttagaggttactcccagcaagacgcccaggaatttttgaggtgtcttatggacctgttgcacgaagagctgaaggagcaggtcatggaagtcgaagaagacccccagacaattacaacggaggagaccatggaggaggacaaatcccagagcgatgtggattttcagtcttgcgaaagctgtagtaattcggaccgcgctgaaaacgagaatggatccagatgcttttctgaggataacaacgaaaccacaatgttaatccaagacgacgaaaataattccgaaatgagcaaggattggcagaaggaaaaaatgtgtaacaagatcaacaaggtcaattctgaaggcgaattcgacaaggatagggatagcatttctgagacagtggacctgaataaccaggagaccgtcaaggtccagatccactctcgggcctccgagtacatcaccgacgtgcacagtaatgacctatctaccccacagattctccccagcaatgagggcgtgaatccacgactgtcggcctctcctcctaaaagtggaaacttgtggcccggcctggctcctccacacaaaaaggctcagtcggcctcccccaaacgaaaaaagcaacataaaaaatatagatcagttatctcggacatctttgatggtacaataattagctccgtgcagtgtctgacttgcgaccgagtaagcgtgactctcgaaacattccaggatctgtctttgcccattccaggaaaagaagatctcgctaagctgcattctagcagtcacccgacttcaattgtcaaggctggcagctgcggtgaggcatacgctcctcaggggtggatcgcctttttcatggaatacgtcaaacggtttgtggttagctgcgtgccatcctggttctggggacccgtggtaacactgcaggattgtctggctgcttttttcgcaagagacgaactcaaaggcgacaacatgtactcttgtgaaaaatgtaaaaagctccgtaacggggttaagttctgcaaagtgcagaactttcctgagattctgtgcatacatctgaagaggtttcgccacgagcttatgttctccaccaagatttcgactcatgtctccttccctctggaaggtctagatctccagccgttccttgccaaggactcacctgctcaaattgtcacatacgacctcctgtccgtcatctgccatcatgggaccgcatccagcggccattatatagcttattgtaggaacaatctcaataacttgtggtacgagttcgatgaccaaagcgtgacggaagttagtgagagcaccgtgcagaatgcggaggcatatgttctgttttatcgaaaaagcagcgaggaggcccagaaggaacgcagaagaatcagcaacctgctgaacataatggagccctcactgctgcagttctatatttcacgacaatggttgaataaatttaagacgtttgctgagccggggcctatctcaaacaacgatttcctttgtatacacgggggggtgccacctcgcaaagctgggtacatcgaagatttagtcctcatgcttccccagaacatctgggacaatctgtattcacggtatgggggcggcccggctgttaatcatctgtatatctgccatacgtgccagattgaagccgaaaagatcgagaaacggaggaaaaccgaactcgagattttcattaggttaaaccgggctttccaaaaagaagattcaccggcaactttttactgtatcagcatgcagtggtttagagagtgggagtcattcgttaagggcaaggacggtgaccctccaggaccaattgataacacaaagatcgccgtgaccaaatgtggtaacgttatgctgagacaaggagccgatagtgggcagattagcgaagagacttggaatttcctccagtccatatatggcgggggccccgaggttattctgagaccgcctgtggtccacgtcgacccagatatccttcaggcggaggaaaaaatcgaggtagagacccgctctctgtag

SEQ ID NO: 14964 - DNA, 2106 bp, Artificial Sequence
  Description of Artificial Sequence: Synthetic coding sequence
atgatgaagcgccagctccatcgcatgcgacagttagcccagacgggtagcctggggcggacgcctgagactgccgagttcctcggggaggacctcttacaggtggagcagcgactcgaacccgcgaagagagcggcccataatatccacaaacgtctgcaggcttgcctgcagggccagagcggggcagatatggataagcgcgtcaaaaagctgcctctgatggccctctcaacaactatggcggaatccttcaaggaactggacccagattcttccatgggcaaagccttagagatgagttgcgctattcaaaatcaattggccagaatcctagcagagttcgagatgaccttggagcgggacgtcctccaacccctatctcgcctctctgaggaggagctgcctgccattctgaaacacaagaagtctttacagaagttagtgagcgattggaatacccttaaatcgcggctgtcgcaagccacaaagaattcaggctcatcccagggattaggtgggagccccggctcacacagtcacacaaccatggcgaataaggttgagaccctgaaggaggaagaagaggagctgaagaggaaggtagagcagtgccgggatgaatatttagccgacttatatcattttgtcacaaaggaagattcgtacgccaattacttcattagattgctggaaatccaggctgactaccataggaggagtctcagcagtctcgacactgccttagccgaattgagagagaatcacggccaggccgaccatagtccgtctatgacagctacacatttcccccgggtgtatggagtgagtctggcaacacatttgcaagagttggggagggagattgcgttacccattgaggcctgtgtaatgatgcttctctcagaagggatgaaagaggagggcctgttcagactggcagctggagcttccgttcttaaacgtcttaagcagaccatggctagtgacccgcattccctggaggaattctgttctgaccctcatgctgtggccggggccctcaagtcctatcttagagaacttcccgagccactcatgaccttcgacctgtatgacgactggatgagagcagcctccttgaaggagcccggcgcccggctccaggctctgcaggaagtgtgttcacgtctcccgcccgagaatctgtcaaatctgcgctatctcatgaagtttctagcccgtctggctgaagagcaggaggtgaataagatgactccaagtaatatcgccattgtcctgggacctaatctgctgtggccaccagagaaggagggagatcaagctcagctggacgccgccagtgtctccagcatccaagtggtaggggtcgttgaggccctgatacagagcgcagacacactgtttcctggcgatatcaatttcaacgtgtctggccttttttccgctgtgaccctccaagatacagtctcagacagacttgcttccgaggagcttccctccactgccgtcccaacgccagcaactaccccggcaccggcccctgcccccgccccagccccggccccggctctggcctccgctgccacgaaggaacggaccgagagcgaggtgccaccaagacccgcatccccaaaggtgacacgatctcctccggaaaccgccgcccctgtggaggatatggcccgcagaaccaaaagacccgcgcctgcgcggcctacaatgccaccccctcaggtgtctggtagtcggtctagcccacccgccccgccactcccacccgggtctggctctcccggaacccctcaggccctgcccagaaggctagtggggtcttcactgcgcgcaccaactgtgccaccccccctgcctccaacccctccccagccggctagaagacagtcccggagaagccctgcatcgccgagccctgccagccctggcccggcctcccccagccccgtgtcattaagcaaccccgctcaggtggacctgggcgccgccacggcggaaggaggcgcaccagaggccatctctggagtccccaccccaccggcaattcctccccagccacgaccaagatctctggcttcggagactaactag

SEQ ID NO: 14965 - DNA, 1818 bp, Artificial Sequence
  Description of Artificial Sequence: Synthetic coding sequence
atggaggtccgtgcctctctccagaaaatcgtgagcaacggagacgagcagctggagaaggcaatggaggagatcctgcgcgactcagagaagcgtccttcctcccttctcgtggattgccaatctagtagcgaaatcagcgatcacagcttcggtgacatacctgcgagccagaccaacaaaccaagcctccagctgattctggatcctagcaatactgaaatctcaaccccccggccctccagccctggcggattacctgaagaggactcggtactctttaataaactgacgtatctgggatgcatgaaggtgtcctccccacgcaacgaagtagaagctcttagagccatggcaacaatgaagtcctccagtcaatatccattcccagtgaccctgtatgtcccaaatgtacccgagggtagcgttagaatcattgatcagtctagcaatgtggaaatcgccagctttccgatctacaaagttctgttctgcgcccgcgggcacgacggaactactgagtctaactgcttcgcctttacagaaagcagtcacggatcggaggaatttcaaattcatgtgtttagttgcgagattaaggaggcagtaagccgtattctgtactcgttctgtaccgccttcaagagaagttccaggcaggtgtctgacgtgaaggatagtgtgattccaacacccgacagcgatgtgtttacattctctgtaagtttggaagtgaaagaagatgatgggaaggggaactttagccctgttcccaaagatagagataaattttactttaaacttaagcagggcattgaaaaaaaggtggtcattaccgtccagcagcttagcaacaaagaactcgcaatcgagagatgttttggcatgctgctgagcccaggccgcaacgtgaaaaactccgatatgcatcttcttgatatggagagtatgggcaaatcttatgatggcagagcttatgttattacaggcatgtggaatcctaatgcgcccgtgttcctcgcactgaacgaagagacaccaaaagacaagcaggtctatatgaccgtagccgtcgacatggtcgtcacagaagtcgttgagcctgtgagattcctactagaaacagtggtgcgggtgtacccagctaacgaacggttctggtatttttctcgaaagacgtttactgagacctttttcatgaggctaaagcagtctgagggcaaaggccacacgaacgcaggcgatgccatctacgaggtggtatctctgcagagggagagcgataaggaggaacccgtgacgccaaccagcggcggaggccctatgtctcctcaggatgacgaggctgaagaagagtccgacaacgagctatcgtcggggactggtgatgtgagtaaggattgccccgagaaaatcctgtattcatggggcgaactgctggggaagtggcattcaaacctcggagctagacctaagggactgagtacactggtgaagagtggggttcccgaagccctgagagcagaagtgtggcagcttcttgccgggtgccatgataaccaggcaatgttggatagatatcgcatattgataaccaagcagcagatgaaattctccctgacgccgcgacaaacaattcacctggtgaaatacgagggttccatgaaagtgtccatgacaccctgcaatcaacttcagtttgacatacggctcgacgtgcttatcacctacactttctgcttttccagcttcccagagcccgagctgtacaaatacgtccttaagcatcagctgataaagcgtctgaatgcctgttag

SEQ ID NO: 14966 - DNA, 3120 bp, Artificial Sequence
  Description of Artificial Sequence: Synthetic coding sequence
atggcagtgcaacttgtgcctgatagtgccctaggcctgctcatgatgactgagggaagacgatgccaggttcacctgttagacgacaggaaattggaactgctagtccagcctaagctcctcgccaaggaactcctggatctcgtggctagccacttcaatctgaaagagaaggaatacttcggcattgcttttacagatgaaacaggacatctgaattggctgcagctggatagaagagtgctggagcacgatttccctaagaaatcaggacccgtggtgctgtacttctgtgtgcggttttatatcgaatccatcagctatctaaaggacaacgcaaccattgaactgtttttcttgaacgccaagtcttgcatctataaggaactgattgacgtggattcagaggtagtgtttgagctagcttcctacatattacaagaagctaaaggggacttctcatctaacgaggtggtgagatcggacctcaagaagctgccagctcttcccacccaggctctgaaggaacacccttctctggcctactgtgaagatcgagtgatcgaacattataaaaagctgaatgggcagaccagaggacaggccatcgtaaactacatgagcatcgtggagtcactccctacctacggggtgcactactacgcggtcaaggacaaacagggcataccatggtggctcggactttcatacaaggggatcttccaatacgactatcacgacaaggtgaaaccacggaaaatattccagtggcggcagcttgagaacctctactttagagagaagaagtttagtgtggaagtgcacgacccaaggagagcttctgtgaccagacgtaccttcgggcacagcgggatcgctgtacacacctggtacgcttgccctgcactgataaaaagcatctgggccatggccatatcccagcaccagttctacttagatagaaagcaaagcaagtccaagatccatgccgctcgctccctttctgagatagctattgacctgacggagactggcaccctgaaaactagcaaactagccaatatgggcagcaaaggtaaaataattagcggaagctcaggctcattgctgtcatccggcagtcaagaaagtgattcatcgcagtcggcaaagaaagacatgcttgcagctctgaagagtagacaggaagccctcgaggagacgttgcggcagagacttgaggagcttaaaaagctttgtctgcgggaagccgagttgacgggaaagctgccggtggaatatccactcgatcccggggaagagccgcccatagttcgccggcggattggcactgctttcaaactggatgagcaaaaaattcttcccaagggtgaggaggccgagcttgaacggctggagcgcgagtttgctatccagtcccaaattactgaggccgcccggaggttagccagtgaccctaatgtgagtaagaaactcaagaaacagagaaagacgtcctatcttaacgccttgaagaagctccaggaaattgaaaatgccattaacgagaatcgtattaaaagcggcaaaaagccaacccaaagggcttcattgatcatagacgacgggaacatcgcttcagaggattcttcactttctgacgccttggtgctagaggacgaagactctcaggtcacatctactatcagtcccttgcactctcctcacaagggtctccccccaaggccgccatcccataacaggcctccccctccgcagtccctggaaggactgcgccaaatgcattatcacaggaatgattatgacaagtcacctatcaaacctaaaatgtggagcgaatctagtctggatgagccctacgaaaaagtaaagaaaagaagctcacatagccatagcagttcacacaagaggtttccatcaacgggctcatgtgcagaggccgggggcggcagcaattctcttcagaacagtcccatccgcggcctaccacattggaattcacaaagctccatgccttcaacgccggacctacgggtacggtcaccccattatgttcactcaacacgttcagtggatataagccctacacgcctacacagtctggcgttgcacttccgacacagaagctcctcgctggagagccaaggtaaactgctaggctccgaaaacgacaccggctctccggatttttatactccaaggacaaggtcaagtaacggctccgaccccatggatgattgtagttcttgtactagccacagtagtagcgaacactactacccggcccagatgaacgccaactatagtacgttggccgaggatagccccagtaaagcccggcagagacaacgtcaaaggcaaagggccgcaggtgcactcggtagcgcctcgagcggtagtatgcccaatcttgccgctcgggggggcgccgggggcgctggtggggccggcggtggcgtttatcttcatagccagagtcagccctccagtcagtaccgaatcaaggagtatcccttgtacattgaaggcggggccacccctgtcgtggtgcggtctctggaatcggatcaggagggacactactcagtgaaggctcagtttaagaccagcaattcgtatactgccgggggactgtttaaggaatcatggcgcggcggcggcggcgacgagggcgatactggccgtctgaccccaagccgcagccagattctgaggaccccttcgttagggcgggagggcgcacacgataaaggagccgggagagcagccgtgagcgatgagcttcgtcaatggtatcagaggagtacggctagccacaaggagcactcccgactgagccacacctcgagtacctcctccgactctgggagtcagtattctacctctagccagtccacttttgttgctcactctcgggtaactcgcatgcctcagatgtgtaaggccactagtgccgccctacctcagtctcagcggtctagcacaccttcatctgaaattggtgcgacacccccatcctcaccacaccacatcctgacctggcagacaggcgaagccactgagaacagcccaatactcgatggatcagagagccctcctcaccagtccacagatgagtag

SEQ ID NO: 14967 - DNA, 3228 bp, Artificial Sequence
  Description of Artificial Sequence: Synthetic coding sequence
atggtggtagaagtagactctatgccagctgccagcagtgtgaagaagcccttcggactccgctccaagatgggcaagtggtgctgccgatgtttcccttgctgtcgtgaatcaggcaagagcaacgttggcacttctggcgaccatgatgacagtgcaatgaagactctgagaagtaagatggggaaatggtgtcggcattgttttccctgctgccgtgggagtggcaagtctaacgtcggtgctagtggcgaccacgacgattctgctatgaagaccttgcgaaataaaatgggtaaatggtgttgtcactgcttcccttgctgcagaggatcaagcaagtcgaaagttggggcttggggcgactatgatgactctgccttcatggagccacgctatcacgttcgaggcgaggatctggataagcttcaccgcgcagcgtggtgggggaaggtgccccgcaaggatctcatagtgatgctgcgggacaccgacgtcaacaaacaagacaaacagaaaagaacagcccttcatctggcctccgcaaacggcaattcggaggtggtcaagctgctgcttgaccggcgctgtcaacttaacgtactcgacaataaaaaacgtactgcattaataaaggcggtgcaatgccaggaggatgaatgtgcgctgatgctgttggaacatggtacagaccccaatatccctgacgaatacgggaatacgacactccattatgccatatacaatgaggacaaacttatggctaaggctctcctgctgtacggggccgacattgagtctaagaacaaacacgggctcaccccattactgctgggggtccatgagcaaaaacagcaggtcgttaagtttctgatcaagaaaaaagccaatctcaacgccctggaccgctacggcaggactgcgctcatcctggctgtatgttgcgggtcagctagcattgtatcactcctgctggagcagaatatcgacgttagtagccaggacctgtcggggcagaccgcgcgcgagtacgccgtgtccagccatcatcatgttatttgtcagctcttgtcggactataaggagaagcaaatgttaaaaatctcctctgagaatagtaaccccgagcaggacttgaaactgacaagtgaagaggaaagtcagcgttttaaggggtcagaaaattcacaacccgaaaaaatgagtcaggagcctgaaattaataaggatggcgatcgggaggtcgaggaagagatgaaaaaacacgaaagtaacaatgtgggcctactcgagaatcttaccaacggtgtcactgccggcaatggcgataatggtctcatccctcagcgaaagagtcggacacccgagaaccagcagtttcccgataatgaatctgaggaatatcaccgtatctgcgaactgctctctgactacaaggagaaacagatgccaaagtattcatctgagaactctaaccctgaacaagacttgaaacttacctccgaggaggagagtcagcgcctaaaaggctccgaaaatggacagcctgagaaacgtagtcaggagcctgagataaataaggatggagaccgtgagctcgaaaacttcatggctatcgaggagatgaaaaagcatcggagtacacatgtagggttccctgaaaacttgactaatggcgctactgccgggaacggggacgatggcttaatacctcctagaaaatccagaacccctgagtcccagcagttcccggacactgagaacgaagagtaccactcagatgagcaaaacgacacccagaagcagttttgtgaggaacagaatacgggcatcctgcacgatgaaattctgattcatgaagagaagcagatcgaagtcgtcgagaaaatgaattcagaactgtcactgtcatgcaagaaagaaaaggatatcctgcacgaaaatagtactttaagggaggaaatcgctatgctgcggctggaattggacacaatgaaacaccaatcacagctccgggagaaaaagtatctggaagatatcgagtctgtcaaaaaaaggaatgacaatctgctaaaggctctacagctgaatgaactcaccatggatgatgatactgcagtcctcgttatcgataatggttctggaatgtgcaaggcaggcttcgccggtgacgatgctcctagggccgtgttcccatccattgtcggacggccgcgtcaacagggtatgatgggcggcatgcaccaaaaggaatcctatgttggtaaagaagcccaaagcaagcgtggcatcctgactctaaaataccccatggagcatggcataattaccaattgggatgacatggagaagatttggcaccatacgttctacaacgaactgagagttgccccagaggagcaccctgtgctcctgacagaggccactctgaatcccaaggcaaatcgtgagaaaatgactcaaatcatgttcgagacctttaatacccccgccatgtatgtggccatccaagccgtgctgagtctgtatacaagtgggaggactaccggtatcgtgatggattcgggagatggcgtgacccatactgttcccatctacgaaggcaacgctctgccccacgccacactccgcttggaccttgccggcagggagctaccggattatttgatgaaaattctcactgagcacgggtaccgcttcactaccatggctgaacgtgagatcgtgagagatatcaaagagaagctttgttacgtcgcacttgatttcgagcaggagatggctacagtcgcctcaagtagcagtctggagaaatcttatgaattaccagatggtcaagtcattaccatcggcaatgagcgcttccggtgccccgaggcgctgtttcaaccatgctttcttggtatggagtcatgcgggatccacgagaccactttcaacagcataatgaagtccgatgtcgatatccgcaaggacctctacaccaacacagtgctctctggcgggacaactatgtatcctggcatggcacaccggatgcaaaaggaaattgccgctcttgctccttccatgatgaagatccgaattattgcaccacccaaacgcaagtattctgtttgggtgggtggcagcatcctggcctcactcagtacatttcagcagatgtggataagtaaacaggaatacgatgaatctggcccatccattgtgcatagaaagtgtttatag

SEQ ID NO: 14968 - DNA, 1752 bp, Artificial Sequence
  Description of Artificial Sequence: Synthetic coding sequence
atgttgtcagagtccaaggagggagaggagaaggaggaggtgaccatggatacgtctgagaatagacccgagaatgacgtacctgagccgccgatgcccattgctgatcaggtctccaatgacgatagaccggaaggcagcgtggaggacgaggaaaagaaagaatccagcttgccgaaaagtttcaagaggaaaatctctgtggtatccgcaacgaaaggtgtccctgcaggcaatagtgacacagaaggcggccaaccaggtcggaagagaaggtggggggccagtacggccaccacccagaagaaaccctcaatttctataaccactgagtctttgaagtctctgattcctgatataaagccgctagccggccaagaggcagttgttgacctacatgctgacgattctcgcatcagcgaagatgaaacggagcggaacggagacgatgggacccacgacaagggccttaaaatctgtcggacggtcacacaggtggtgcctgccgagggccaagaaaatggccagagagaggaggaggaggaggaaaaggagcccgaggctgagcctcctgtaccaccacaggtcagcgttgaggttgccctacctccacctgccgaacatgaggtcaaaaaggtcacacttggagacactcttacgaggcggagtatctcacagcaaaaaagtggcgtctccatcacaatagacgatccagttcgaaccgctcaggtgccatcaccccctcgcggaaagatcagcaacatcgtgcacataagcaatctcgttcgtccattcacactgggacagttaaaagagctgctgggacgtacaggtactctggtggaagaagccttctggattgacaagattaaatctcactgtttcgtaacatacagtacagtggaggaagccgttgcgacgaggacagccctgcacggcgtcaagtggccgcagtccaaccctaaattcttatgcgctgactacgccgagcaagacgagctggattatcaccgcggtctcctagtggatcgcccctccgaaaccaaaacagaggaacagggaatcccgaggcctcttcatcctcctcctccacccccagtccagcctccacagcaccctagggccgaacagcgggagcaggaaagagctgtgagagagcagtgggccgaaagagaaagagaaatggagaggagggaacggaccaggtcggaacgagagtgggatcgcgataaagtacgggaagggcctcgatcgagatccagaagccgcgatcgacgtcggaaggagagagccaagtctaaggaaaaaaagtctgaaaagaaagagaaggcccaggaggaaccaccagcaaaactgctagatgatctttttagaaaaacaaaagctgccccctgtatctattggctccccttaacagatagtcaaatagtgcaaaaggaagctgaacgggcagaacgagccaaagaacgggagaaacggaggaaggagcaggaggaagaagagcagaaagaaagggagaaggaagccgagagagaaaggaaccgccagctcgagcgggagaagcggcgtgagcattccagagaacgggaccgcgagagagaaagggaaagggaaagggatagaggcgaccgggacagggatcgggagagagatagggagcgcggccgggagcgagacaggagagatacaaagaggcacagcaggtctcgatctcgttctaccccggtaagagacagagggggcaggcgctag

SEQ ID NO: 14969 - DNA, 963 bp, Artificial Sequence
  Description of Artificial Sequence: Synthetic coding sequence
atgtccaagtcagctagtccaaaggagccggagcagctgcgaaagctgtttatcggcggactgtctttcgagactacagacgagagcctcaggtcccacttcgagcagtgggggactctgactgactgcgttgtgatgcgcgacccaaatactaaaaggagccggggcttcggcttcgtgacttatgctactgtcgaggaggttgacgccgcaatgaatactaccccacacaaagtggatggacgcgttgtggagcctaaaagggctgtgtctagggaggactctcagcgaccaggggctcacctgaccgtcaagaaaatcttcgtcggcggcattaaggaagacactgaggaacaccacttgagggactacttcgagcaatatggcaaaattgaggttatcgaaattatgaccgacaggggatccggaaagaaaagaggttttgccttcgtgacatttgacgaccacgatagtgtggacaagattgtaattcagaagtatcacacagtaaaggggcacaactgcgaagtgaggaaggctttgccaaagcaggagatggcaagcgcgagctcatcccaacgaggccgacgtggaagcggcaatttcggtggcggtcggggagacggatttgggggtaacgacaactttggcaggggagggaacttctctggtagagggggtttcgggggatcctgtggaggtgggggctatgggggcagtggagatggatataacggatttggcaatgacggcagcaattttggtggtggaggatcctataacgatttcggcaattacaacaaccaaagctccaatttcgggcctatgaaagggggaaatttcggtggtcgcagttctggaccatacggcggggggggacagtacttcgccaagccccagaatcagggtgggtacggagtatcctcctcttcatcctcctatgggtccggcagaaggttctag

SEQ ID NO: 14970 - DNA, 3294 bp, Artificial Sequence
  Description of Artificial Sequence: Synthetic coding sequence
atggctgccgctgctgctgagcaacagcagttctatcttctgctgggtaacctactgtctccagacaatgtggtgcgaaaacaggcagaagaaacgtatgagaacattcccggacaatccaagattacttttcttctgcaggccatcaggaacacaacagcagcagaggaagctagacagatggccgctgttctcctgcgcaggttgctgtctagcgcctttgacgaggtgtatccggccctgccctccgacgtgcagaccgctattaagtctgaattactcatgattatccagatggaaactcagagttcaatgagaaagaaggtatgtgatatagccgcagaattggccagaaacctcattgacgaggatggcaataatcagtggcctgagggtctgaaatttctattcgattcagtgtcatcccagaatgttggcttaagggaagccgcattacacatcttctggaactttccaggaatcttcggtaaccaacaacaacattatctggatgtcattaagcgaatgctggtccagtgcatgcaggatcaggaacaccctagcattcggaccctgtctgctagggcaaccgctgctttcatattagcaaacgagcacaacgttgctctgttcaaacatttcgccgatctactgcctggcttcttgcaggccgtgaatgattcgtgctatcagaacgatgattcggtgctgaagagcttagtggaaatcgcagatactgtgcccaagtatcttcgcccccatctagaagccaccctgcagctatctctcaaactttgcggggacacatcacttaacaatatgcagcggcagcttgctctcgaagtgatagttacgctctccgagaccgctgcagcgatgctccgcaagcacacaaacatcgtagcccagaccattcctcaaatgctcgcaatgatggttgaccttgaggaggacgaggactgggctaacgcagacgagctggaagacgacgacttcgactctaacgccgtcgcaggcgagtccgcccttgaccgcatggcctgtggcctgggtggtaagttggtgctgcccatgattaaggaacatataatgcagatgctgcagaatccagattggaagtatcgacatgccggtctcatggctctctctgccattggtgagggctgccaccagcaaatggagggcattctgaacgaaatagtcaattttgttttgctctttctccaggacccgcaccctagggtgcggtacgctgcatgcaacgccgtgggccagatggccacagactttgctccgggattccaaaagaagtttcacgagaaggtcattgcggccctcctgcagactatggaggaccagggcaatcagcgcgtccaggcacatgccgccgccgctctgataaactttactgaagactgcccaaagtctttacttatcccctatcttgacaatctggtcaaacacctgcattccatcatggtgctgaagctccaggaacttattcagaaggggacgaaactagtgctcgagcaagtcgtgacatcaattgccagcgtggcagatactgcagaggagaagtttgtcccttactacgacttatttatgccgtcattgaaacatatagttgaaaatgctgtgcagaaagagctaagactgctgcgcgggaaaaccatcgagtgcatctccttaatcgggctcgcagtgggcaaagagaaattcatgcaggacgcaagcgacgtaatgcagctgctgctcaagactcaaacggacttcaatgacatggaggacgatgatccacagatatcttacatgatctcagcttgggctcgcatgtgtaaaattctggggaaagaatttcaacagtatctgcccgtcgtgatgggtccccttatgaagacagccagcatcaagccggaagtggcccttctcgatactcaagatatggagaatatgtccgatgacgatggctgggagtttgtcaatctcggagatcagcagtcctttggcatcaagacagccgggctggaagaaaagtccaccgcatgtcagatgctggtgtgttacgccaaggaactgaaggaggggttcgtcgagtacacagagcaggttgttaagctgatggtgcctcttttgaaattttacttccacgacggggttagggtggccgccgccgagagtatgcccctcttgctggagtgcgctagagtaagggggcccgaatacctcacccagatgtggcacttcatgtgcgacgccctcattaaagccatcgggacagaacccgactctgacgtcttgtccgagatcatgcattcctttgcaaagtgtattgaggtaatgggagatggatgcctgaacaatgagcatttcgaggagctgggcggtatcctaaaggctaagttagaggagcactttaagaaccaggaactcaggcaagtgaagcgccaggacgaggattacgatgagcaggtagaggagtcactgcaggacgaggacgacaatgacgtgtacattctcaccaaggtctccgacattctccactccatcttcagcagttataaggaaaaagtgctcccatggttcgaacagctactccccctaattgttaacctgatttgcccgcaccggccctggcctgaccggcagtggggattgtgcatctttgacgacgtgatcgaacactgcagccctgccagctttaagtatgcagagtatttcctgcgcccaatgctacagtatgtgtgcgacaacagccctgaagttagacaggccgctgcctacggcctcggggtcatggcgcagtatggaggcgacaattacaggccgttttgcactgaagccctgcccctgcttgtgcgggtgattcaatccgcagacagcaagaccaaagaaaacgttaacgcaacggagaattgcattagcgccgttggaaagattatgaaattcaagcctgactgcgttaatgtagaagaagtgttaccacattggctgtcctggcttcctctgcacgaagacaaggaggaggccgtccaaaccttcaattatttatgcgacttgattgagagcaatcatccgatcgttctggggcctaacaacaccaatctgccgaagatcttctcgatcattgccgaaggagagatgcacgaggcaattaagcacgaagacccatgcgctaagaggcttgcaaacgtcgttcgtcaggtgcagacctctggcggcctctggacagagtgtatagcacagctgagccccgagcagcaggctgccattcaagaactgctgaactcagcctag

SEQ ID NO: 14971 - DNA, 2715 bp, Artificial Sequence
  Description of Artificial Sequence: Synthetic coding sequence
atgttccctgcactagaaactcacctgaaacagaccatccccgacccttatgaagattttatgtatcgacacctccagtactatggctatttcaaagctcagagaggctctttacctaactctgctacgcaccaacatgtgaggaaaaataatccccaatgcctgctcaatggttcccttggcgaaaaagatgacctgatacccgacacactgcagaaggaaaaactgttgtggcctatttcattatcctccgccgtccatcgccagatagaagctattaatcgtgacttccatagctgcctgggttggatgcaatggagaggattaagtagcctgcaacctcctccgcccaggttcaaggacagccccgcgagtgcttttcgggtcgccggcataaccgattctcacatgctgagccttccacacttgagaagcagacagcttttatacgatgaattggatgaagtaaatccacgtctccgggagccccaggagctcttcagtatactgagcaccaaaaggccactgcaagcaccccgttggcctatcgagtgcgaagttattaaggagaatattcatcacatcgagtgggcgccccctcagcccgaatacttctaccaacccaagggcaatgaaaaagtcccggaaatcgtgggcgagaaaaaaggcaccgtagtgtaccagctggactctgtgccgatagagggttcctattttacatcttccagggtaggcgggaaacgggggatagtcaaggaactggctgttacccttcaaggtccagaagacaacacgctcctgttcgaatcccggtttgagagcgggaacctgcagaaggcggtgagggtggacacatacgaatacgagctcaccctgcgaactgacctttatacaaataaacacacacagtggttctactttagggtgcagaacacaaggaaagacgctacatatcgtttcactatcgtgaatttgttgaagcctaagtccttgtacaccgtcggcatgaagcctttgctatactcacagctggatgctaacactagaaatatcgggtggcgccgagaaggtaatgagatcaagtactataagaataataccgatgacggccagcagccattttattgtctgacgtggaccatccaattcccatatgatcaggacacgtgcttctttgctcatttctatccctatacttacacagatctccagtgctacttactgagtgtcgctaacaacccgatccagtcccagttttgcaagcttcagacactgtgtcgtagcctggccggcaacaccgtttatttgctcaccattacaaatcccagccagaccccccaggaggctgctgcaaagaaagccgtggtgttaagtgctagagtgcatcctggcgagtctaacgggagctgggtaatgaaaggctttctagatttcatcttgtctaattcccctgacgcacagttgctgcgggatatctttgtgtttaaggtcttaccaatgcttaatcctgacggggttattgtcggaaactaccgatgctcactggctggacgagacctgaacaggcactacaaaaccatattaaaggaaagtttcccttgtatttggtatacacgcaatatgatcaaacggctgctggaggagagagaggttttgctgtattgcgactttcatggacactcccgtaagaacaacatctttctgtatggctgcaataataacaacagaaaatattggttgcacgagagagtcttcccactgatgctatgtaagaacgctccggacaagttctcattccattcctgcaacttcaaggtgcaaaaatgcaaggaggggacagggagagtggtaatgtggaggatgggcatcctcaattcgtataccatggagtccacctttggcggatccacacttgggaacaagagagatacacatttcactattgaagacctgaagtctcttggttaccacgtgtgcgatacactacttgatttctgcgatcctgatcagatgaagtttacacaatgcctggctgaactgaaggaactcctgcgacaggaaattcacaaaaaattccacgaactggggcaagacgtggacctggaaggcagttggagcgacatcagcctttcagatattgagagcaggaattctacgtctggttccgacagcagtttgtcagacggcctccctgttcacctcgccaacattgcggatgagctcacacagaaaaagaagatgttcaaaaagaagaaaaagaagtcccttcagacccgaaaacagagaaacgagcagtaccaaaagaaaaatctcatgcagaaacttaaacttaccgaggatacctcggaaaaagccggctttgccagcacactgcagaagcaaccgactttttttaagaactccgaaaatagttccttcctgcccatgaagaacgagaatccgcggcttaacgagacaaatctgaatcgccgtgacaaggacacacctctggatcctagcatggccacgctgatcctgcctaagaataagggccggatgcaaaacaagaaacccggcttcacagtatcgtgcagcccaaaacgcacaatcaattccagtcaggaaccagctccagggatgaaacccaattggccccgctcccgatacccagcgaccaaaagagggtgtgctgcgatggcggcctatcccagccttcacatctatacatatccgtag

SEQ ID NO: 14972 - DNA, 789 bp, Artificial Sequence
  Description of Artificial Sequence: Synthetic coding sequence
atggccctatccctggggtggaaggcgcacaggaatcactgtggccttctgctccaggcattgcgctcatcgggactattactgtttccttgtggccagtgcccatggcgcggtgcggggtccttcttggacccagagatcaaagcttttcttgaagagaataccgaagttacttcttccggcagcctgactcccgaaattcaacttcggctcttgacccctcgatgcaaattttggtgggagcgagccgatctgtggcctcactccgacccttactgggccatttactggccggggggccaggccctctctcggtacttgctggacaacccagatgtcgtgcgtggaaagagcgtgctcgatctgggatctggttgtggagctacagcaatcgccgcgaaaatgagcggggcatcgcgcatcttggccaacgacatcgaccctatagctgggatggctatcacactaaactgtgaattgaacagactgaaccctttcccgattttgatccagaacatcctgaaccttgagcaggataagtgggacctggtagtcctgggcgatatgttctacgacgaggacctggcagactccctccaccaatggctgaagaaatgcttctggacctatcggactcgggtcctgatcggggatcccggaaggccccaattttccggccacagcatccagcatcacctgcataaagttgttgaatattccctgctggaaagcaccagacaggaaaactctggactgaccacctcaactgtttgggggtttcagccatag

SEQ ID NO: 14973 - DNA, 2619 bp, Artificial Sequence
  Description of Artificial Sequence: Synthetic coding sequence
atgaactacccgggaaggggatcacccagatctccagaacataatggtcgtggcgggggaggcggcgcatgggaactgggcagcgatgctagaccagcctttggtggcggggtgtgttgcttcgagcacttgccagggggtgatcccgacgacggggatgttccactggctttgctgaggggggagccgggcctgcacttggcccctggcacggatgatcacaaccatcatcttgcactggatccttgtctgtccgatgaaaattatgatttttctagtgctgagtcagggtcgtcgctccggtattacagcgagggcgagtctggaggcggcgggagctctctatcactgcatccccctcaacaacctccactcgtgcctaccaatagcggcggtgggggcgcaacaggcggatcgcccggcgagcgaaagcgcacgaggttggggggcccagccgcgagacaccgttacgaggtcgtcactgagcttggaccagaggaagtccggtggttttataaagaagataagaagacttggaaaccattcattgggtatgattcactgagaatagagctggccttcagaacactgctgcagacaacaggagccaggccccaggggggtgatcgcgacggtgaccacgtctgtagcccaacgggcccagcttccagctccggcgaggacgacgacgaggatcgggcatgtggcttttgtcagtccactacgggccacgagcctgaaatggtggagctggtgaacattgaacctgtctgtgtgcgcggaggactgtatgaggtagatgtaactcagggggagtgctatcctgtctattggaaccaggctgacaagatacctgtgatgaggggacagtggttcatcgatggaacatggcagccactggaagaagaagagagcaatctgatcgagcaagagcacctaaactgtttccgtggccagcagatgcaggaaaatttcgacatcgaggtgtctaaaagtatagacggtaaagatgcagtccactcatttaagctgagtagaaaccacgtggactggcactcagttgatgaagtttatttatattcagacgccactacgtccaaaattgcacggacagtcactcagaaactgggcttcagcaaggcctcaagcagcggtacacggttacataggggatacgtggaggaggccaccctggaggataagccatcccaaacaacgcatattgtatttgttgtgcacgggatcggacaaaaaatggatcaaggaagaatcatcaaaaacaccgcgatgatgagggaagctgccaggaagatcgaagagaggcactttagcaatcacgctacacacgtggaattcttgcccgtcgagtggcgatctaagcttactctggacggggataccgtcgacagcattacaccagataaggttaggggattgagggacatgctcaactcttctgcgatggacattatgtactacactagtccactgtatagggatgagctggtgaaggggctccagcaggagctcaatcgcttgtactctcttttctgcagccgtaaccccgacttcgaagagaaggggggcaaggtttctatagtgtcccacagcctggggtgcgttattacatatgacattatgacagggtggaaccctgtgcgactttatgagcaactgctgcagaaggaggaagagcttcccgatgaacggtggatgtcatatgaggaacgtcacttgctagatgagctatacattaccaaacgcaggctgaaggaaatcgaagagagactccatggcctcaaggcttcctctatgacccaaacacctgccctgaagtttaaggtcgaaaatttcttctgcatgggaagcccattggctgtgttcctggctctgcgcggaatcaggccgggtaacacaggatcccaggaccacattctaccgcgggaaatttgcaacagacttcttaacatctttcatcccactgaccccgtggcataccggcttgagccgctgatccttaaacattactccaacatcagccccgtccagatccactggtataatacaagcaatcctctgccgtatgagcacatgaaaccatcctttcttaaccccgccaaggaacccacttctgtttctgaaaacgagggaataagcacgattccgtcacctgtgacctcaccagtcctgagccggagacactatggagagtccatcaccaatattggcaaggcatcaatactcggggcagctagcataggaaaaggcctcggcggaatgctcttttctcgctttggtagaagctcaacgacgcagtcttctgagacctcgaaggacagcatggaggacgagaagaaacccgtggcctcaccttccgcaaccacagtgggcacacagactctgccacattctagcagcgggttcctcgactctgcactggagctggaccaccgtattgacttcgaattgagagaggggctggtcgagtccagatactggtctgctgtgacgtcacacacggcatactggtcttctctggatgtcgcgctgtttctgcttacattcatgtataaacatgagcatgacgatgacgcaaagccaaatctcgatcccatctag

SEQ ID NO: 14974 - DNA, 1461 bp, Artificial Sequence
  Description of Artificial Sequence: Synthetic coding sequence
atggtgagccataccttccacatgagaactgaggagtccgacgcaagccaggagggagacgatttacctaaatccagtgccaatacgagccatccgaaacaggatgatagcccaaagtcatcagaggagaccatccagcccaaggaaggggatatccccaaagccccagaagagactatacagtcaaaaaaagaagatctgcccaaatcatcagagaaggcaatccagcccaaggaatcgaacatccccaaaagcagcgccaagccgatccagcctaaattgggaaacatacccaaagcctccgttaaaccttctcagcccaaggaaggggacatccccaaagcccccgaggaaaccattcagtccaaaaaggaggacctccccaaaagctcagaggaggccattcagcccaaggagggcgacattcctaagtcttccgcgaagcccattcagcccaagctcggcaatatagcaaagacgagtgtcaagcctagccagcctaaagaatccgacattcccaaaagtcccgaagagactattcaacctaaggaaggagatatccctaaatcctccgccaagccaattcagcctaaattgggtaatatcccaaaggccagcgttaaacctagccagcccaaagaaggcgacatctcaaaatcacccgaggaggctatacagcccaaagaaggagacctgcctaagtcactcgaggaggcaatccagcccaaagaaggcgatatcccgaaatccccagaagaagctattcagcccaaagagggcgatatcccaaaatctctggaggaggctattcagccaaaagaaggagacatccccaagtctcctgaggaaaccatccaaccgaagaagggcgacatcccgaaatccccggaagaggccatacagcccaaagagggggatattccaaagtcacccaagcaagccatccagccaaaagaaggggacatcccaaagtcactagaggaggctattcccccgaaggagattgacatccccaagtctccagaagaaaccatccagcccaaggaagacgactctcctaagagcctcgaggaggccacaccaagcaaggaaggcgacatactgaaaccagaagaggaaacaatggagtttcctgagggggataaggtcaaggtaatcctctctaaggaggattttgaagcgagtcttaaggaggccggtgaacgcttagtggcggttgatttttcagctacctggtgcggtccttgcaggacgatccgccctttcttccacgctctgtcggtgaagcacgaagatgtcgtgttcttagaagttgacgccgacaactgcgaggaggtggtgcgcgagtgtgccatcatgtgtgtccctaccttccaattctataaaaaggaggagaaggtggatgagctctgcggtgccctgaaggagaaattagaagccgttatcgctgagcttaagtag

SEQ ID NO: 14975 - DNA, 1005 bp, Artificial Sequence
  Description of Artificial Sequence: Synthetic coding sequence
atggctgcaagtggcagcgggatggcccagaagacgtgggaattagcaaacaatatgcaagaggctcaatcaattgatgagatttataagtacgacaagaaacagcagcaggaaattctagccgcgaaaccctggaccaaagaccaccactacttcaagtattgcaagatatcggcccttgccctgctaaagatggtgatgcacgcccgaagcggtggtaacttagaagttatgggccttatgctcgggaaagtcgatggcgagacaatgattatcatggattcctttgccctgcccgtagaggggacagagacccgcgttaacgctcaggctgctgcctacgaatatatggctgcatacatcgaaaatgcaaagcaggtcggacggctggagaacgcaatcggatggtaccactcccaccccggatatggatgctggttaagcggaatcgacgtgtcaacacagatgcttaaccagcagttccaggaaccatttgtagccgtggtgatcgaccctacacgaacaatatccgctggcaaggtgaatctgggcgcttttcggacttatccaaagggctataaacccccagatgagggcccatctgagtatcagaccattcccctgaacaagatcgaagattttggcgtgcactgcaagcagtactatgctctggaggtatcatattttaagtcgagtcttgacagaaagttgctcgagctactatggaataaatattgggtaaacaccttgagctcgagcagcctgctgacaaacgccgattacaccaccggacaggtgtttgatctgagtgagaagctggagcagtccgaagcccagttgggcaggggctcattcatgctgggcctagaaacgcatgaccgcaaaagcgaggataaactggctaaggctacacgagactcctgcaagactactattgaggccatccacggccttatgtcccaagtgataaaggacaaactcttcaaccaaataaatatctcatag

SEQ ID NO: 14976 - DNA, 1350 bp, Artificial Sequence
  Description of Artificial Sequence: Synthetic coding sequence
atggtgatggagaaacccagtcctttgctggtggggagggagttcgtacggcagtactataccctgctgaataaggctcccgaatacctgcaccgcttctacggccgcaattcatcatacgtccatggcggcgtggatgcaagcggcaaaccacaggaggcggtctacgggcagaacgacatccaccataaagtccttagtctgaatttctctgagtgccatactaaaatccgccatgtcgacgcacatgccacgctgagtgacggcgtcgttgtccaggttatggggctcctgtcgaactcaggccagcctgagcgcaagttcatgcagactttcgtgctggcacctgagggatctgtgccaaataagttctacgtgcacaacgacatgttcagatacgaggacgaggtttttggtgactcagagccggagctggatgaggaaagcgaggacgaggttgaggaggaacaggaggagaggcagccttctcctgagccagtccaggaaaacgccaatagtggatactatgaggcacacccagtaaccaacggcattgaagaaccactggaggagtcatctcacgaaccagagccagaacccgagagcgagacaaagacagaggagttaaagcctcaggtggaggagaaaaacttggaggaactggaggagaaatcaacaacgccacccccggccgagccagtgtctttgcctcaggaacccccaaaacccagggtcgaagctaagccagaggtgcagagtcaacccccccgcgtgcgtgaacagcggcctcgggagcgaccagggttccccccacgaggtccacggcccggtcggggtgatatggaacagaacgacagcgacaacagaaggatcattcggtatccagactctcatcagctgtttgtcggcaatttaccccatgatatcgatgagaatgaattaaaggaattctttatgtctttcggcaacgtcgtcgagctgcggattaacacaaagggagtaggcggcaaactgcctaactttggcttcgtcgtattcgatgatagtgagcctgtgcagaggattctcatcgcgaaaccaataatgttccggggggaggtgagactgaatgtggaagagaaaaagaccagagcggctcgagagagagagacgcgcggagggggcgatgatcgccgggacatacgccgaaacgacagagggccagggggccctcggggcattgtggggggcgggatgatgcgcgacagagatgggcgaggcccaccccctcgcggggggatggcacaaaagctgggctccggaagggggaccgggcagatggaaggtaggtttaccggccagcggagatag

SEQ ID NO: 14977 - DNA, 333 bp, Artificial Sequence
  Description of Artificial Sequence: Synthetic coding sequence
atggaggaaattccagcgcaggaggccgcgggaagcccacgtgtgcagtttcaaagcctggaaactcaaagtgagtgtctgtccccggaaccacagtttgtgcaggacactgatatggaacagggactgacaggcgggatattgctgaggcttcccaccaccagaatccacagcgtgaattcttgccctgccttatcccacacccaggcttccgctttttccggcgaaacattggctgtgctgacagcaggaatcagcaaaaggtggcccaagtaccggctccctatcgacatcgcccggccctgtagcgaaaccccatttcctcgactatag

SEQ ID NO: 14978 - DNA, 822 bp, Artificial Sequence
  Description of Artificial Sequence: Synthetic coding sequence
atgggtcagaaggtgaccggcggaattaaaacagtggacatgcgggacccaacttatcggcccttgaagcaggagcttcaagggctggattattgcaagcccactaggctggacctcctgttggacatgccacccgtgagttacgatgtacagctgcttcattcttggaacaacaatgacagatccttgaacgtgttcgtcaaagaggacgacaagttgatcttccataggcaccccgtagcccagagcactgatgcgatccgaggaaaagtgggctatacgagaggactgcatgtgtggcaaattacctgggcgatgaggcagcgggggacgcatgccgtcgttggggtcgctacagctgacgctccactgcacagcgtcgggtacaccactcttgttggcaataaccacgagtcctgggggtgggatctgggccggaaccggctgtaccacgatggcaaaaatcagccaagcaagacctaccctgcattcctggagccggatgaaacgtttatcgtccccgactcattcctggttgctctcgacatggacgatggcactctcagcttcatcgttgacggccaatatatgggcgtcgcctttcggggcctgaaagggaagaagctgtaccccgtcgtgtcagccgtatggggccactgtgaaattcgcatgcgatatctcaacggtctggaccctgaaccactgcccctgatggatctgtgtcggaggtccgtaagattggctttgggcagagaacgcctgggagagattcacacattgccgcttccagcatccctgaaggcctatctgctctatcagtag

SEQ ID NO: 14979 - DNA, 2916 bp, Artificial Sequence
  Description of Artificial Sequence: Synthetic coding sequence
ctgagccgccgggtgccatgcgtgcgacgcggctgtcgccccccccttcctcctctgccaggctcccagtcaagggcgtggtccagggacagagaagcaccgctggatcccgggagaccagcgcagagcggtcgacgtcccacatccagaagcgtttcccacgcctgctcatggaatggtggaagccttgaccctctggagggcacacccgcgctcctcaggtctgccgagcggctcatgaggaaggtcaaaaagctgaggctcgacaaagagaacaccggtagttggcgtagcttctctcttaatagcgagggtgccgaaaggatggcgaccaccggtacgccaaccgctgataggggcgacgccgccgctaccgacgaccccgctgccagatttcaagtgcagaagcattcctgggacggattgagatctatcattcatgggtccaggaagtactctggactgattgtcaataaagcgccacacgattttcagttcgtccaaaagaccgacgagagcggcccacactcacatcgtttatactacctcggcatgccatacgggtcacgtgaaaattctctcctgtattccgagatccccaaaaaggtgaggaaggaagccttgctcctgttgtcatggaaacagatgcttgaccacttccaggcaactccacaccacggagtctactctcgcgaagaagagctattgagggagcgaaaaaggcttggagtttttggcataacgtcatatgatttccacagtgagtccggccttttcctgttccaagccagtaattcactgttccactgtcgcgatggcggcaagaacgggtttatggtttctccaatgaagccgttagagataaaaacgcagtgcagcggaccacggatggaccccaagatttgtccagccgacccagccttcttttctttcatcaataactccgacctgtgggtggccaatatcgagactggagaggagcgacgtttgacattctgccatcaggggcttagtaatgtgctggacgaccctaaaagtgcaggcgtggctactttcgtcattcaagaggagtttgaccgcttcacaggatactggtggtgtcccaccgctagttgggaaggctccgagggcctgaagaccctgcggattttatatgaggaggtggatgagagtgaggttgaggtgatccacgtaccctcacccgccctcgaggagagaaagacagacagttaccggtacccacggaccggctctaaaaatccaaagatagccttgaagttggctgagttccagacagattcacagggcaaaattgtgtcaactcaagagaaagagctcgtgcagcccttcagctctctcttcccaaaagtggagtatatagccagggctgggtggacacgagacgggaagtatgcttgggctatgttcctggatagacctcagcaatggctgcagctggttctgttgccccctgccttgttcataccctcaactgaaaacgaggagcagaggctggcctccgcaagagccgttccaaggaatgtccagccctatgtggtgtatgaagaggttaccaatgtttggatcaacgttcatgacattttctatcctttcccccagagtgaaggcgaagatgagctgtgtttcctgagagctaacgagtgtaagactgggttttgccatctctataaagttacggctgtgctcaaatctcagggctacgattggtcggaaccctttagccccggagaagacgagttcaaatgtcccataaaagaagagatagcactgacaagcggcgagtgggaggtgctggcgcggcacggctcaaagatttgggtgaatgaggaaaccaaactggtatactttcagggaaccaaagatactcccctggaacaccacctctacgtggtcagctatgaagcagccggggagattgtgaggctgaccacccccggattctcccatagttgctccatgtctcagaatttcgacatgttcgtaagtcattacagttccgtgtcaacaccaccatgtgttcacgtgtacaagctgtcgggtcccgacgacgacccactgcacaagcagcctcggttctgggcctcgatgatggaagcagcgtcatgccctcctgactatgtgccgcctgaaatttttcatttccacaccagaagcgatgtgcgactgtacggaatgatctacaagccacatgcactccagccagggaaaaagcaccctacggttctgtttgtgtatggtggcccacaggttcaattggtcaataacagctttaaggggatcaaatatcttagattaaacacactagcatcccttggatacgccgtggtggtgatagacgggcgtggtagctgccaaagggggctgaggttcgagggtgccttaaagaaccagatgggtcaggtggaaatagaggatcaagtggaagggcttcagtttgtggctgagaaatatggctttatcgacttgagcagggtcgccatacatgggtggtcctatggtggttttctttccctgatgggattgattcataaaccacaggtgtttaaagtggcgatcgccggcgctcctgtgactgtatggatggcatacgatacaggttacaccgaacggtatatggatgtgcctgaaaacaaccaacacggctacgaggcagggtcagtcgcacttcacgtggagaaactgcccaacgaaccgaaccggttgttaatcttacatgggttcctggatgaaaatgtccacttttttcacactaactttcttgtttctcaactgataagagctggaaagccatatcagttacagatctaccctaacgaaagacatagcataaggtgccctgaatctggtgaacattacgaggtaaccctgctgcactttctccaggagtacttgtag

SEQ ID NO: 14980 - DNA, 2592 bp, Artificial Sequence
  Description of Artificial Sequence: Synthetic coding sequence
atgggaaaccgagaaatggaggaactgatccctctggtcaataggttgcaagatgcattctctgctttgggccagtcctgcctcctagagcttccacaaattgctgtcgtgggcggacaaagcgcagggaaatcatccgtcctggaaaatttcgtggggagagacttcttgccaaggggttcgggcatcgtgacacgtagaccactggtgcttcagttagtcacctccaaggcggagtacgccgagttcctgcactgcaagggcaagaagttcaccgatttcgacgaggtcagactggagatcgaggcggagactgatcgcgtcactgggatgaacaaaggcatcagttcaatccctatcaatctgcgggtctacagtccacacgttcttaacttgacacttatcgacctaccgggcatcaccaaggtgccggtcggtgatcaacctcccgacatcgagtatcagatccgggagatgatcatgcagtttatcacccgggagaattgtctcatcctagctgtgacccctgccaacacagacctcgccaattcagatgctctgaagctcgccaaagaagttgaccctcaaggcttgcgcacgatcggagtcattaccaagctcgacttgatggatgagggaaccgatgcaagagacgttcttgagaataaattgttacctctacgtaggggctacgtgggtgttgttaaccgtagccaaaaggacattgacgggaagaaggacattaaagccgccatgctggccgaacggaagttttttctcagtcaccccgcataccgccacatagctgatcggatggggacacctcatctccagaaggtgctgaaccagcagctgacaaatcatatacgcgacacccttcctaactttcgaaataagcttcagggccagctgttatccattgagcatgaagtggaggcttacaaaaacttcaagccggaggatccaacgcgaaaaactaaggcccttctccagatggttcaacagtttgccgtagactttgagaaacggatcgaaggcagtggagatcaggtggatacccttgagttatctggcggggccaaaattaatcgaatctttcacgaacggtttcccttcgagattgtgaagatggaatttaacgaaaaggagctcaggcgggaaatctcctacgcaatcaagaacatccacggaatccgtactgggctatttacaccagacatggcattcgaggcaattgtgaagaaacagatcgtgaagctgaagggcccaagcctgaagtctgttgatctcgtgatacaggagttaataaacacagtaaagaagtgcaccaaaaagctagccaactttccgagactgtgtgaagagacagagaggatagtggctaatcatattagggaacgagaaggtaaaacgaaggaccaggtcctgttactcatcgacatacaggtgtcatacattaacaccaaccatgaggacttcattggatttgccaatgctcagcaaaggtcctcacaggtgcacaagaagacaactgtcggcaaccaagtgattcgcaagggatggttgacgatcagtaatatcggcattatgaagggtggctccaaggggtactggttcgtgctgaccgcagagtctctgtcgtggtacaaggacgatgaagagaaggagaaaaaatatatgctccctctggataacctgaaagtcagggatgtagagaagtcgttcatgtcttccaagcacatattcgcactgttcaacaccgagcagaggaacgtgtacaaagactaccgcttcctggagctcgcctgcgattcccaggaggatgtggactcttggaaggcatcacttctgcgcgccggcgtctacccagacaaaagcgttgggaacaataaggcggaaaacgatgaaaatgggcaagccgaaaacttttccatggacccacagcttgaacgccaagtcgagacaattcggaaccttgttgacagctatatgtccatcattaataagtgtatcagagacctaatacccaaaactatcatgcacctaatgatcaataacgtgaaggattttattaattcagaactgctagcccagttatattcgagcgaagaccaaaatacactcatggaagagagtgcagagcaagcccagcgacgggacgaaatgttgcgaatgtaccaggctttaaaggaagctttaggcattatcggcgatattagtacggctacagttagtacccccgcgcccccgccggtagacgacagctggatccagcattccagacgatcccctcccccctctcctactacacagcgccgccctacactgagcgctcctctcgccaggcccacaagcgggcgcggacctgcaccagctatcccttctcctgggccacatagtggtgcaccacccgtgccgtttagacccgggccactgcctccatttccgagtagcagcgacagctttggcgccccacctcaggtgcctagtcgtcccacgcgcgcccctcctagtgtcccttctaggagacctcccccttctccgacgagacccacaatcattcgcccgctggaatcttccttgttggactag

SEQ ID NO: 14981 - DNA, 1263 bp, Artificial Sequence
  Description of Artificial Sequence: Synthetic coding sequence
atgttgaaggccgtgatactcattggcggtccccagaagggcaccagatttcgccctctgagtttcgaggtccccaagccactgttccctgttgctggcgtgcccatgattcagcatcatatagaggcttgcgcccaggtccctggcatgcaagagatactactcataggtttttatcagccagatgagccgcttacacagttcctggaagccgcacagcaggaattcaatttaccggtcaggtacttgcaagagtttgcacctcttgggacaggtggtgggctctatcactttagagaccaaattcttgccggctcccctgaggcatttttcgtgttgaatgccgacgtgtgcagcgattttccactgtctgcgatgttggaggcccatcgccggcaacgccacccgtttcttctcctgggaactactgcaaaccgaacccagtctctgaactatggctgtatcgttgagaacccgcagacgcacgaggtgctccactacgtcgagaagcccagcaccttcatctccgacataattaattgcggcatttaccttttctctccagaggccctgaagcccctcagggacgtcttccagcggaatcaacaggacggacaactcgaggactcacccggcctgtggcctggcgccggcacgatcaggttagaacaagacgtgttcagcgccctcgccggacagggccagatttacgtgcacttgactgacgggatctggtcccaaatcaagtccgctggatccgccctctacgcatcaagattatacttgtcgcgctatcaggatacacacccagagagactagctaaacatacaccgggtgggccatggattagaggtaacgtgtacatccacccgacagccaaagtcgctccttctgcagtactgggtccaaacgtctccattgggaagggcgttactgtaggagaaggagtgcgactgcgcgagagcattgttttgcacggcgcaaccttacaggaacacacatgcgttctgcacagtatagtggggtggggtagcaccgtgggacgttgggcacgagtcgaaggaaccccttcagatccgaaccccaatgatccaagagctagaatggattccgagagtcttttcaaggacgggaagctgctgcctgccatcactatcctcggctgtagggttagaatccctgccgaggtgctgattcttaattctatcgtgctacctcacaaagagctctctcgttcatttaccaaccagattatactctag

SEQ ID NO: 14982 - DNA, 2481 bp, Artificial Sequence
  Description of Artificial Sequence: Synthetic coding sequence
atggtcgcgccagtccttgagacatcgcacgttttttgttgtcccaaccgtgtgagaggtgtgctgaattggtcgagtggtccgcgcggcctgttggcctttggaacttcatgctctgtcgtactctacgaccctctgaagagagtggtagtgactaacctgaatggccacactgcgcgcgtgaattgtatccagtggatatgcaaacaagatggcagcccgtccaccgaattggtgtcagggggtagcgataaccaagtaatccattgggagatcgaagataatcagctcctcaaagcggtgcacctacaggggcacgagggccctgtgtatgccgttcacgcagtctaccagcggaggaccagcgacccagccttgtgcacgctcatcgtctctgctgcagctgactctgcggtgagactgtggagcaaaaagggcccagaggtcatgtgcttgcaaacactgaattttgggaatggctttgcactagctctatgccttagctttcttcccaatacagatgtgccgatcctggcatgcggaaacgatgactgccgaattcatatcttcgctcaacagaatgaccagttccaaaaagtgctgtctctttgtggccatgaggattggattcgcggggtcgagtgggcagcctttggccgcgacctgtttctggcttcctgctcacaggactgtctcattaggatctggaagctctatatcaaatctacgtctctggagacccaagatgatgataacattaggctaaaagagaacacatttaccatcgagaatgagagcgtaaaaatcgccttcgccgtgacacttgagactgtgctggccggccacgagaactgggtcaatgcggtgcactggcagccagtgttctataaagacggcgtgcttcagcaacccgttaggctgctgagtgcgagcatggacaagacaatgattttatgggccccggatgaggagtccggcgtgtggcttgaacaggtaagggttggcgaagtgggcggaaacaccctggggttctatgattgtcagtttaatgaggatggcagcatgataattgcccatgcctttcacggtgctctacacctgtggaagcagaatactgtcaatcccagagaatggacaccggagattgttatcagtggacattttgacggggtccaagacctcgtgtgggatccagaaggggaattcatcattacagttgggacagaccaaaccacccgccttttcgccccttggaagcggaaagatcagtcccaggtgacatggcacgagattgcccggccgcagattcacggatacgacctcaagtgtctggctatgatcaatcgatttcagttcgtctcaggggcggacgagaaggtgctcagagtgttcagtgcaccgcgcaatttcgtcgaaaacttctgtgcaataacaggccagtccctaaatcatgtactgtgcaaccaagattctgacctgccagaaggtgccacagtgccggcactgggactgtccaataaggcagtgttccagggcgacatcgccagccaacctagtgatgaggaagagctcctgacaagcactgggtttgagtatcagcaagtggctttccagccctccattttaactgagcccccaactgaagaccatctcttacagaataccctatggcccgaagtgcagaaactgtatggacacggctatgaaatcttctgcgtcacttgcaactcgagcaaaactttactggcatccgcctgcaaggccgcaaagaaggaacatgcagccatcatactatggaatacgacaagctggaaacaggtccagaatctggtgtttcatagcctcacagtcactcagatggcatttagcccaaatgaaaaatttctgctcgctgtaagtagagatcgaacttggtctctctggaaaaaacaggatacaatctcccccgaattcgagccagtgttttcattattcgcatttaccaataagataaccagtgttcacagccggatcatctggtcttgcgactggagcccagactcgaaatacttcttcaccgggtctagggataaaaaagtcgtcgtgtggggcgaatgcgactccacagacgactgcattgaacacaatattggtccttgttcctcggtcttggacgtcggtggagccgtgacagcggtgagcgtgtgcccggtgctgcatccatcccagcgctacgttgtggctgtgggactggaatgcgggaagatttgcttgtatacctggaaaaaaaccgaccaggtcccggagattaatgattggactcactgcgtcgagacgtcccagagtcagtcacacaccctggcaatccgaaagctgtgttggaaaaattgttctggaaaaactgagcaaaaggaagccgaaggagcagagtggttgcatttcgcatcttgcggagaggatcatacggtaaagatccatcgcgtcaataagtgcgccctgtag

SEQ ID NO: 14983 - DNA, 1152 bp, Artificial Sequence
  Description of Artificial Sequence: Synthetic coding sequence
atggaccgcacatgcgaggagagaccggctgaagatggcagtgacgaagaagaccccgactccatggaggcaccgaccagaatccgggacacccctgaggacatcgtgctcgaggctcccgcttccgggctggcattccaccccgcaagagatctcttggcggcgggagatgtggatggcgacgtcttcgtgttttcttactcttgccaagagggagagaccaaagaactctggtcctcaggacatcacttgaaagcctgtagggcggtagccttctccgaggacggccagaaattgatcactgtgtctaaggacaaagccatccatgtgttagacgtagagcaggggcagttggagagacgagtatcaaaggcccacggcgccccaatcaattcccttctgttggttgacgagaacgttcttgccacaggggacgatacaggcggcatttgtctgtgggatcagcgaaaagagggacccctgatggatatgcgccaacatgaggagtacattgccgacatggcactggaccctgccaaaaagcttttgttaacggcaagtggggatggctgtctggggatattcaacatcaaaagaagaagattcgagctattgagtgaaccccaatccggcgacctgacatcagtgacactgatgaagtgggggaagaaagtagcgtgcggatccagtgagggaactatatacctcttcaactggaatggctttggagctacaagtgacaggtttgcattgcgcgcagagtccatcgattgcatggtccctgtgactgaatccttactctgtactggctccaccgatggagtcataagagccgtgaatattctgcctaaccgggtggtgggttcagtaggacagcacactggcgaacctgtcgaggaactcgcactgtctcattgcggtcgctttttagccagttcagggcatgaccaacgtctcaagttttgggatatggcccagctcagggcggtagtcgtggacgactacagaagacggaaaaagaaaggtgggcccctcagggctctgtccagcaaaacctggagcacagacgacttcttcgctgggctgcgggaagagggggaggactcaatggcacaggaggagaaagaagagacaggggacgatagcgattag

SEQ ID NO: 14984 - DNA, 999 bp, Artificial Sequence
  Description of Artificial Sequence: Synthetic coding sequence
atgtcggaggctggggaagagcagccgatggaaacgacaggcgcaacggagaacggacacgaagcggttcctgagggcgagtctcccgccggagcagggactggggccgcagccggcgctggcggtgcaacagcggccccaccatccgggaatcagaatggcgctgagggtgatcaaatcaatgcctccaaaaacgaggaggacgcagggaagatgtttgtcggcggactctcatgggataccagcaagaaggacctcaaggactacttcacaaagttcggtgaagtggtcgattgtaccattaagatggatcccaacacagggagaagccgcggatttgggttcattctgtttaaggacgctgcctctgtcgagaaggtcctggatcaaaaagagcaccggctggatggtagagtgatcgacccaaagaaggccatggcgatgaaaaaggatcctgtaaaaaagatcttcgtgggaggactgaacccagaagccactgaggagaaaatcagggaatacttcggggagttcggggagatcgaggccattgagctccctatggacccaaagctcaacaaacgccggggcttcgtgtttattacgtttaaagaagaagaacctgtgaagaaggtcctagaaaagaaatttcatacagtctcgggctccaagtgtgagatcaaagtcgcccagcctaaagaagtctaccaacagcagcagtacggcagcgggggaagaggaaatcgcaacagaggcaaccgcggatctggcgggggaggtggaggcggcggtcagtcacagtcttggaaccaaggttacgggaactactggaaccagggatatggttatcaacagggctacgggcctggttacggtggttatgactatagtccctatggttattacgggtacggacccggttatgactattcccaggggtccacaaattacggtaaatctcagaggcggggaggacaccagaataattacaagccatattag

SEQ ID NO: 14985 - DNA, 2745 bp, Artificial Sequence
  Description of Artificial Sequence: Synthetic coding sequence
atgggcgactctcgagacctttgcccccacctggactccattggcgaggtgacgaaggaagatttgcttctaaaatccaagggaacctgccaaagttgcggtgtgaccgggcccaatttatgggcatgccttcaggtggcctgcccctacgtgggctgtggcgaatcattcgctgatcattccacaatacacgcacaggctaagaaacacaaccttaccgtcaacctgaccacatttcgcctgtggtgctatgcatgcgaaaaagaggtctttctggagcagaggctggcggctcccctgctgggctcttcctctaagtttagcgaacaggattccccccccccgtctcatcctctgaaagcagtccccatcgctgtggccgacgagggcgaatctgagtccgaagacgatgacctgaaaccccgagggcttaccggaatgaaaaacctcgggaactcttgttacatgaacgccgccctgcaggccttaagcaactgccctcccttaacccaattttttctggagtgcggtggattagtgcggacggacaagaagccagccctctgcaagagctatcagaaactggtcagtgaagtctggcataaaaagcggcctagttacgtggttcctacaagcctatcccacggcattaagctggtgaatcctatgttccggggctacgcccaacaggacactcaggagttccttaggtgtctgatggatcaactgcacgaggaacttaaagagccagtcgtggccacggttgccctgactgaagctcgcgacagcgatagctccgacacagatgaaaagcgggagggtgatcgtagtccgagcgaggatgagttcttgagctgcgattcatcaagcgaccgcggcgaaggagacggacaagggcgagggggtggctcatctcaagccgagacagaactcctaatccccgacgaagcgggacgggcgatttccgaaaaagagcgcatgaaggataggaaattcagctggggtcaacagagaacaaactctgagcaggttgacgaggatgcagatgtggacacggctatggccgctctggatgatcagcccgcagaggcccagcctccctcacctcggtcatcttctccatgtcggacgcctgaaccagataatgatgcacaccttagaagctcatctcgcccatgctcccccgtccatcatcatgaaggacacgccaaattgagttccagcccacccagggcctctcctgtacgcatggccccctcttacgttctgaaaaaggcccaggtcctttcagccggaagccgcaggaggaaagaacagaggtataggtcggtcattagtgacattttcgacgggtcaatcctgtccctggtacagtgcctgacctgcgacagggtgtccaccacggtcgagactttccaagacctctcactccccatccccggaaaagaagatctggcaaagctgcactctgccatttatcagaatgtgccggcaaagccaggggcctgcggagactcatacgctgcccaaggttggctagcctttattgtcgaatacatccgaaggtttgttgtctcatgcacaccctcttggttctggggtcccgtggtgaccctggaggattgtctggccgcttttttcgctgccgatgagcttaagggggataatatgtactcatgtgagcgatgtaaaaaacttcggaatggcgtgaagtattgcaaagtactcaggctccccgagatcctgtgtattcacctaaaaagattcagacatgaggtgatgtacagtttcaagatcaattcacacgtttcgttcccactagaaggtctggatctccgtcccttcttggccaaggaatgcactagccaaattacaacctacgacttgctgtctgtgatctgccaccacggaacggcaggatccggccattatattgcctactgccagaacgtaattaacggacagtggtacgagtttgacgaccagtatgtcactgaagtgcacgagaccgtcgtgcaaaatgccgagggttacgtgctgttttaccgcaagtcttcagaggaggccatgcgagaacgacagcaggtggtaagcctggcagctatgagagagccctctctgcttcgattctatgtgtccagggagtggttaaataagttcaatacgtttgccgagcccgggccaataaccaaccagactttcctgtgtagccacgggggcattcctccccacaaataccactatatagatgatcttgtggtcatccttccacagaatgtatgggaacatttgtacaacagatttggggggggtccagctgtgaatcacttatacgtgtgcagtatttgtcaggtcgagattgaagccttggcgaagcggaggcgtatagagattgataccttcatcaaactgaataaggcattccaggcggaggaaagccctggggtcatttactgcatctctatgcaatggttccgtgagtgggaagcctttgtaaaaggaaaggacaacgagccgcctgggcctatcgacaattccaggatcgcgcaggtcaagggcagcgggcatgtgcagcttaaacagggcgccgactatggacagatcagtgaagaaacttggacttacctaaatagtctctatggcggcggacccgagattgcaattagacagagtgttgctcagccgctgggcccagaaaatctgcacggcgaacagaaaatagaggcggaaacacgggcagtttag

SEQ ID NO: 14986 - DNA, 2772 bp, Artificial Sequence
  Description of Artificial Sequence: Synthetic coding sequence
atggccgcctccaccgggtatgttcggctatggggtgccgcgcggtgttgggtactgaggaggcccatgctggcagcagcaggcggtcgggtcccaacagccgccggtgcttggttgctgagggggcaaagaacttgcgatgcaagccccccatgggctctgtgggggaggggccctgccatcggaggctccgctggcgccggggagggccccgtgatcaccgctctgacccccatgaccatccccgacgtcttcccacatcttcccctgattgcaatcacacggaatccagtcttcccccgattcatcaagatcatcgaggtgaagaataagaaactcgtggagctgctccggcggaaggttaggctggcgcaaccctacgtgggagtatttttgaaacgcgatgatagcaacgagtctgacgttgtggaaagtctcgacgaaatataccacaccggtacgttcgcacaaattcatgaaatgcaggatctcggcgacaaactgcgcatgatcgtgatgggacaccggcgggttcacatatccaggcagctagaagtggagccggaggaacccgaagccgaaaacaaacacaaaccaaggcgaaaatctaagcgaggtaagaaagaggccgaggacgagctcagcgctaggcatccagctgaacttgctatggagccgaccccagagctgcccgcggaggtgctgatggtggaagttgaaaatgtcgtgcacgaggatttccaagtcaccgaagaggtcaaggctctgaccgccgaaatcgtgaagactattagagacatcatcgccttgaaccctctctacagggaatctgttctgcaaatgatgcaggcaggccaaagagtggtcgacaatcctatctacctgagcgatatgggggccgctctcactggagctgaatcacatgagctccaagatgtgttggaggagacaaatatccccaaaaggctctataaagctctgagcctcctgaaaaaagaattcgaactgtcgaagctacagcagagactaggacgtgaagttgaggaaaaaataaagcagacacacaggaaatatctactgcaggaacagctcaaaataattaagaaagaattaggcctagagaaagacgacaaagacgccatagaagaaaagttcagagaacgcttgaaagaactcgttgtgccgaaacatgtcatggatgtggtggatgaagagcttagcaaacttggcctcctggataatcatagcagcgagtttaatgttacccgcaactaccttgactggctgactagtattccatggggaaaatactcaaacgagaatctggacttagcaagagctcaggccgtcctcgaggaggatcactacggcatggaggatgtcaaaaaaaggatcttggagtttatagcagtgtcccagctgaggggatcaactcaggggaagatcctgtgtttttatggcccccccggggttgggaaaacgtctatagctaggtccatagcacgagctctgaatagggagtatttccgattttcagtggggggcatgaccgacgtggccgaaataaagggacatcggagaacatatgtgggtgccatgcctggcaagattattcaatgcctaaaaaaaactaaaacagagaatccactgattttgatagacgaggtagataaaatcgggagggggtaccaaggcgacccttcaagcgccctgctggaactcctggatcctgaacagaacgcgaactttctggaccattacctggacgtgcccgtggacttatctaaggtgctgtttatttgcacagctaatgtgaccgatacaatcccggaaccgcttcgtgacaggatggaaatgattaacgtttccggttacgtggcccaagagaaactagcgatcgccgagcgctatctagttccccaggcacgggcactgtgcggactggatgagtctaaagcaaagctgagcagcgacgtgctgacgctgctcatcaagcagtattgtcgggaaagcggcgtgaggaatctgcaaaagcaagtggaaaaggtgctgagaaagagcgcctacaaaatcgtctcaggggaagcagagagtgtagaagtaaccccagagaacctgcaagactttgtgggcaaacctgtctttacagttgagcggatgtatgacgttacgccccccggtgtggtgatggggttagcatggaccgcaatgggaggatccactctcttcgtagaaacttcgttgagaagaccacaggataaggatgcaaagggagacaaggatggtagtctggaagtgaccggccaactcggtgaggtcatgaaggaaagcgcacgcatcgcttatacattcgccagagctttcctgatgcagcatgctccagccaacgactatttggtgactagccatatccacttgcatgtgccagaaggggctacaccaaaggacgggccctctgccggctgtactattgtgacagcactgctgagcctggctatggggagacccgtgaggcagaacctggctatgactggagaggtctctcttaccggcaaaatactgcccgtgggcggtatcaaggagaagactattgctgccaagcgcgcgggggtcacttgcatcgttcttccagctgaaaataagaaagacttctatgacctcgccgcctttatcacagaaggcctggaagtgcacttcgtcgagcactatcgcgagatttttgatattgcgtttccagacgaacaggctgaggccctagctgtcgagcggtag

SEQ ID NO: 14987 - DNA, 681 bp, Artificial Sequence
  Description of Artificial Sequence: Synthetic coding sequence
atgggaccacttccccgcacagtcgagctgttctacgacgtgctgtccccatacagctggctgggttttgaaatcctctgtaggtaccagaatatttggaacatcaacctgcagctgagacccagccttatcacaggcataatgaaggactccggaaataagcctcctgggcttctcccaagaaaaggcctttacatggctaatgatcttaagctgctccgacatcatttacagattcccattcattttccaaaagattttctgtctgtcatgctggagaaaggttccctctccgctatgcgattcctgacggccgtaaacttggagcatccagagatgctggaaaaagcatcccgtgaattgtggatgcgagtgtggagtcggaacgaggacattacagaaccgcaatctattctagctgccgccgaaaaggccggtatgtcagctgagcaggctcaggggctgctggaaaaaatcgcgacccctaaagttaaaaaccaactgaaggagactaccgaggcagcctgtaggtatggcgcattcggcctcccaatcacagtggcccacgttgatggacagactcacatgctgtttgggtcagatcgcatggagctcctggcacacctacttggggagaaatggatgggacctataccacccgctgtcaacgcaaggctctag

SEQ ID NO: 14988 - DNA, 2055 bp, Artificial Sequence
  Description of Artificial Sequence: Synthetic coding sequence
atggaagccaatcacagcgaacaactgagcgccgaacgccaatctactccccccggtgatagttcatctctgccaagccacaacggattagaaaaggaggatggccaggattcaccaacaccggtgcagccccccgaaaaagaagcttccgtccaccccgatatttcggaagagctaaatcgacaactggaggacattatcaatacctacgggtctgcagctagtaccgcaggcaaggagggaagtgcgcgcgcctctgagcagccagaaaacgccgaatcaccggacaatgaggacggagattgtgaggagactaccgaggaggccggcagggagcctgtcgctagtggtgagcctccaactgtgaaagaacctgtgtccaacaaagagcagaagctggaaaagaagatcttgaagggactgggaaaagaagccaacttgctaatgcagaatctgaacaagctccagactccagaggagaaattcgatttccttttcaaaaagtatgcagagctactggatgagcaccgcacagagcagaaaaaattgaagttacttcaaaaaaaacaggtccagattcagaaagaaaaggaccagcttcagggtgaacactcccgcgctatactcgcccgaagcaagctggaatccctatgccgggagcttcagcgccataataagacacttaaagaagaagccctccaaagagctcgagaagaagaggagaaaaggaaggagattacttcacacttccagtctacactgaccgatatccagggacagattgagcagcagagtgagcgcaacatgaagttgtgtcaggagaataccgaactggcagaaaaactaaagtctatcatcgaccagtacgaactccgagaggaacatctggataagattttcaagcatcgcgagctgcagcagaaacttgttgacgccaaactggaacaggcacaggagatgatgaaagaagccgaagagcgccacaaaagagagaaagaatatctcctgaaccaggcagccgagtggaagttgcaagccaaagtgctcaaggaacaggaaacagtcctgcaagcacagttgacgctttacagcggacgcttcgaagagttccagtccaccctgacaaagtcaaatgaagtgttcgccacgttcaagcaggaaatggacaagacaactaaaaaaatgaaaaaactggagaaggacacagccacctggaaggcccggtttgagaattgtaacaaagcactccttgacatgattgaagagaaagccctcagggccaaggaatatgagtgctttgttatgaaaattgggcgcctagagaacctctgtcgggctcttcaggaagaaagaaatgagctccacaaaaaaattagggacgcggagatctccgaaaaggacgaccagtctcagcataacagcgatgaagagcctgagtcaaacgtatctgtggatcaggaaatcgatgccgaggaggtaaactccgtccagacggcggtgaaaaaccttgcaacagcttttatgatcattcatcacccagagtccacgccacatcagagcaaggagactcaaccagaaattgggagtagccaggagtctgcggatgccgccttaaaggaacctgagcagcccccattaattccctcccgagacagcgagagcccattacctcctctcaccccccaggctgaggctgagggcgggagcgatgctgaacccccttcgaaggcctctaacagcccagcaggcctcggagctgaaactcagtgcgaggggctgcccgtgggagcacaggccgaccaagcctcttggaagcctgaggctgaagcttccggacaggccccccaggctccaacagaggcctctcttcagaagatggaagcagatgtgcctgccccagcctgcgccgccgaggagcacgtggccgctatggtgcccgcctgtgaaccgtcacgacagccaccccgggctgctgctgaggagctgccagtgggagcttcggcagggccacagccaagaaacgtggccgataccaaccttgaaggagtggattag

SEQ ID NO: 14989 - DNA, 1461 bp, Artificial Sequence
  Description of Artificial Sequence: Synthetic coding sequence
atgaacggcaccttggaccaccctgaccagcctgatttggatgccattaaaatgtttgtggggcaagtgccccgtacctggagcgagaaggacctgagggagctgtttgagcagtacggcgccgtgtacgaaataaacgtgctgcgagaccggtcgcagaacccgcctcagtcaaagggctgctgctttgtcactttctacaccagaaaagctgcactggaggctcagaacgccctacataatatgaaagttctacctggcatgcatcaccccatccagatgaagcccgctgattcggaaaaaaacaacgccgtagaggatcggaagctctttatcggcatgatctccaagaagtgcacagagaatgatatccgggttatgttcagctcatttggccaaatagaagagtgcaggatcctgcgcggcccagatgggttgagtcgcggctgcgcgttcgtcacgtttacgaccagggcaatggctcagaccgccattaaggccatgcaccaggctcagaccatggaggggtgtagtagtcctatggtggtgaaatttgctgacacccaaaaagataaggagcagaaacgcatggcacagcagctacaacagcagatgcagcagatttcggcagcgtctgtctggggcaatctcgcagggctcaataccctggggccacaatacctggctctgtatctgcagttgctgcagcaaacggcatcttctggtaatcttaacacgctgagttcgcttcatcccatggggggactgaatgcaatgcagttgcaaaatctggccgctttagctgctgctgccagtgcagcgcagaacacgccaagtggaacaaacgctctgactacaagctccagccccctcagcgttctgacgtcgtccggtagcagccccagcagcagtagttcaaactcggttaatcccatcgcttccctcggggccctacaaacattggccggcgccactgccggtctgaacgtcggtagcttggccggaatggctgctttgaacggtggactgggatcctctggattgtctaacgggacgggatccacaatggaagccctgacccaggcttattctggcatacagcaatacgccgccgcggctttgcccacactctacaatcagaatctccttactcaacagagtattggggctgccggaagccaaaaagagggccctgagggagccaatctgttcatctaccacctcccacaggagttcggtgatcaagatctgcttcagatgtttatgccatttgggaatgtggtgtccgccaaagtgttcatagacaagcagacgaacctgagcaaatgcttcggttttgtttcgtacgacaaccccgtgtctgcccaggcagccattcaaagtatgaatggctttcagataggtatgaaaagactgaaggttcaactcaaacgatctaaaaatgactcaaagccatactag

SEQ ID NO: 14990 - DNA, 7812 bp, Artificial Sequence
  Description of Artificial Sequence: Synthetic coding sequence
atggagaaagcaacagtccccgtagcagcggcaactgccgcagaaggcgagggctctccacctgctgtagcagcagttgctggacccccagcggccgctgaggtaggcggtggagtgggaggaagttctagggcccgctccgcatcctccccccggggtatggttcgggtatgcgacctccttctgaaaaaaaagcccccacagcagcagcaccacaaagccaaacggaaccgaacctgccggcctccttcttccagcgaatcctccagcgacagcgacaattccggtggcggcggcggtggaggcggaggcggaggaggtggaggcggcacctcctctaataatagcgaggaggaggaagacgatgacgatgaggaagaagaagtctcagaggtggaaagcttcattttagatcaggacgatctggagaatccaatgctggagacagcctcaaaactgcttctttcgggaacagccgatggcgctgacttgcggactgtagatccggagactcaggctcggctggaggcactgctggaggccgccggaatcggcaaactatctacggctgatggcaaagctttcgcagacccagaggttctccggagacttaccagcagcgtgtcatgtgccctagatgaagccgctgcggccctcactcgcatgcgggcagagagcactgccaatgcggggcaatcagacaatcggtccctcgcagaggcctgttctgagggtgacgtgaacgctgtacgcaagctgcttattgagggccgctccgtaaatgaacacaccgaggaaggggagtcactgctgtgtctagcctgctcagccggatattacgaattggcccaagtccttctggctatgcatgccaacgttgaagatcgggggattaaaggagatataacacctctgatggcagccgccaacggcggccacgtcaaaatagtgaagcttttacttgcccacaaggctgacgtgaacgcccaaagctctacgggaaacaccgccctaacttacgcatgcgctgggggctacgtcgatgtggtgaaagttctgttggaatccggcgccagtattgaggatcacaatgagaacggccatactcccctgatggaagcaggctctgccggacacgttgaagtggctaggctccttctggaaaacggggcaggaatcaacacccattccaacgaattcaaggagtccgcactgaccctggcttgctacaaaggacacctagaaatggtgaggttcctgctcgaagcaggagcagaccaggaacataagacagacgagatgcacaccgccttgatggaagcctgtatggacgggcatgtggaggtggccagactcctactggattctggggctcaggtaaacatgcccgcggatagcttcgagtcacctctgaccttggccgcgtgcgggggtcatgtcgagcttgctgctctgctgatcgagcgcggcgccagcctggaggaggtgaacgatgagggctacacacccctgatggaggcagctagggaaggtcatgaggaaatggtggccttgttgcttgggcagggagctaacatcaatgcccagaccgaggaaacacaggagacggccctcacactcgcctgttgcggcggattcttagaagtggctgattttctgatcaaggctggcgccgatatagagttagggtgtagcactccactgatggaagctgcgcaggaaggccacctcgagctggttaagtacctgctcgctgcgggggccaatgtccatgccacaacagccacaggagacactgcgctcacatatgcctgtgaaaatggtcacactgacgtggccgatgtgctgttgcaggccggggctgaccttgagcacgagagcgaaggcgggcggacacccctcatgaaagcagctcgcgccggtcatgtttgtaccgtacaatttctcatatcgaaaggggctaacgttaaccgtacaacggctaataatgatcacactgtcctatctctggcatgcgccggcggccacttagccgtggttgagcttcttcttgcccacggtgctgacccgactcatcggctgaaggacggatcaaccatgttgattgaagcagcaaaaggaggccatacaagtgtggtgtgttatctgctcgactaccccaataacctgctgagcgccccaccaccagatgtgacccagctgacacctccctctcacgatcttaaccgcgccccgagagtccctgtgcaggcccttccaatggtggtgccaccccaggagccggacaagccgccggccaatgtagcaactaccttgcccatccggaacaaggcagccagtaagcagaagtcttcctcacacttgccagcaaactcgcaggatgttcagggttacattacaaaccagtctcccgagagcatcgtggaggaggcacaggggaagctcacagaactggagcagagaattaaagaagcgatcgagaagaacgcgcagttgcagtcacttgaactggcacacgcagaccagcttactaaggaaaagatcgaagaactgaataagactagagaggaacaaatccagaaaaagcagaagattctggaggagcttcagaaggtagaaagggagttacaactgaaaacgcagcagcagctcaagaagcagtatctggaggtcaaggcacagagaatccaattgcagcagcagcagcagcagtcatgtcaacacctgggccttttaacccctgtcggagtgggagaacagctgagtgagggggattacgctcgactgcagcaggttgacccagtgctcctgaaggacgaaccccaacagaccgcggcccaaatgggatttgctcccatccagcccctcgctatgccccaggccctacccttagccgcaggaccattaccccctgggtctatagctaacctaacagagctgcaaggcgtgatcgtcggtcagcctgtactgggacaggcgcagctcgctggtctgggccaaggtattctcactgagacacagcaaggccttatggtcgcgtcacccgcccaaacactaaatgacacactggacgacatcatggccgcagtttccggacgcgcgtctgccatgagcaatactcccacacattcgattgccgcctcgattagtcaacctcagacccccactccaagccccatcatatctcctagtgccatgctcccaatctatcccgcaatcgatatcgacgcccagacggagtcaaatcacgatacagcgctcacactggcttgtgccgggggccacgaagagcttgtccagaccctgcttgagagaggcgcctcaatagaacacagggacaagaaggggttcactcccctcatcctcgccgccacagccgggcacgtcggcgttgtcgagattcttctggataacggggctgacattgaggcacagagcgagagaactaaggacacgcccttatctctggcctgtagtggaggccggcaggaagtagtagaactcctgttggcccggggtgctaacaaggagcataggaacgtgagcgactacactcccctgtccttggcagcgtcgggaggatacgttaatatcatcaagattcttctgaacgctggtgcggagatcaactctagaaccggaagtaagctgggtatcagtcctctgatgcttgccgccatgaacggccacaccgctgcagtaaagctgttattagacatgggcagtgacattaacgcccagatcgaaacaaaccgcaataccgccttgactctggcttgctttcaaggtagaaccgaggtggtatctctgctcctggaccgtaaagcgaatgtagagcaccgagcaaaaacgggtctgactcctttaatggaagctgcctcaggtggatacgctgaggtgggaagagtactgttggacaagggcgccgatgttaacgcccccccggtgccctcatctcgagacacagctttgaccatagcagcagacaaaggtcattataaattttgcgaactgttaattggtcgaggggctcatattgacgtgcgcaacaagaaaggcaatacccctctctggcttgcggcgaatggaggacacttagatgtggtgcagttgctggtgcaggccggcgccgatgtcgacgctgccgacaatcggaagataaccccactgatggccgcctttaggaaggggcacgtgaaggtggtgcggtacttggtgaaagaagtgaatcagtttccatccgattctgagtgtatgaggtacatcgccaccataacagataaagaaatgttgaagaagtgccacttatgcatggaatctatcgtgcaggccaaggatcgacaggctgcagaggcaaataagaacgccagtattctgctggaggagctcgacttagaaaagctgagagaagagtcccgccgtctggccctggcagccaagagagagaaacgtaaggaaaagcggcgaaaaaagaaagaagagcaacgaagaaaactggaggaaattgaggccaaaaataaggagaatttcgagctgcaagcagcacaggagaaggagaaactaaaagtggaggatgagccggaagtcctgactgaaccaccctccgccacaacgactacaacaattggcatatcagccacatggacaacattggccgggtcccacgggaagaggaacaacacgattaccaccacgtcatctaaacggaagaaccgcaaaaataagattacaccggaaaacgtgcagattatctttgacgatcctctccctatcagctatagccagcccgaaaaggtgaatggagagagcaaatccagctcaacaagcgagtccggtgacagcgataatatgaggatatccagctgctcagacgagagctccaactccaactcttcacggaaatcagacaatcactctcctgccgttgtgactacaacagtttctagcaagaaacagccatcagtgttggtaacgtttccgaaggaagagcgtaagtctgtgtctgggaaggcatcaatcaaactatctgagactattagtgaggggacatctaactctttgtctacttgtactaagtctggcccatctccgctgagctcaccaaatgggaaactcacagtagccagtcccaaaaggggacagaagagagaagagggctggaaagaagtggttcgtcgcagtaaaaaggtaagtgtaccttctaccgtgatcagtcgggtaataggacgggggggctgcaacataaacgcaatccgggagttcaccggcgcccatattgacatcgacaaacaaaaagacaagaccggtgacagaatcattacgatcaggggggggaccgagtcaaccaggcaggcgacccagcttattaatgccctgataaaggaccctgataaggaaattgacgagctcattccgaaaaatagactaaaatcttcctcagctaactcaaaaatcggcagtagtgctcctacaacgactgccgcgaataccagtctgatgggtataaagatgacaacggtggctctgagttcaactagtcagaccgccactgccctgactgtcccagccatttctagtgcaagcacgcataagacaattaaaaatcccgtgaataacgtccggccaggctttccagtgtcgctgcctttagcatacccacctccacaattcgcccatgctctgctggccgcccagacatttcagcagatccgacccccccgcctacctatgacgcatttcgggggcacgtttccgccagcgcagagcacctggggcccgttcccggttcgtccactgagccctgctagagctacaaactctccaaagccacacatggttcccagacattccaaccaaaatagttcaggtagccaggttaacagtgcgggctccctaacttcatctcctacgaccacaacctcctccagcgcatccacagtccccggcacctcaaccaatggcagtccttcctcgccgtcagtgaggcgccaactgttcgtcactgtagtgaagaccagcaacgctaccaccactactgtgaccaccactgcctcaaacaacaacaccgcgccaacaaacgctacctatcccatgccaactgccaaggagcattacccagtgtcttctccatcttcccctagtcccccagcccaacctgggggtgtgagcagaaattcgccattggattgcggatcagcaagcccaaataaagtggcctcatcttccgaacaggaagcgggctcccctcccgttgtggagactaccaacaccagaccgcctaacagctcttcatcctcagggagcagctcagcccatagtaaccagcaacagccccctggctccgttagccaggaaccgagaccccccctccaacagagccaggtccccccccccgaagttagaatgactgttccacccctagctacttcttccgcccctgtcgcagttcccagcacggcacctgtgacctacccgatgcctcagacaccaatggggtgcccccagcccacccccaagatggagaccccagccattcgccccccaccccatggaaccacagctccacacaaaaactccgcatctgtccagaactccagcgtcgcagtcctgagtgtcaaccacataaagagaccacatagtgtgccctccagtgtgcaactgcccagcactttgagcacgcagagcgcatgtcagaacagtgtgcaccctgccaataaacccatcgcacccaatttttcagctcctctgcctttcggcccattttcaaccctcttcgaaaattctccgacttccgcccatgctttttggggtggcagtgtggtttctagccagtccactcccgagtcaatgctttccggcaagtcctcttaccttcctaactcagacccgctgcatcagtccgacacaagcaaagctcccggttttagaccgcccctgcagcgacctgccccttcacccagcggaatcgttaacatggactccccttacggaagcgtgactccgagcagtacccatctcgggaatttcgcctctaatatctccggaggtcagatgtacggccctggcgcaccccttgggggagcaccagctgctgcaaactttaatcgccagcactttagcccattgagccttctgacaccctgttctagtgcttccaacgattcctcagctcagagtgttagttccggggtgagggccccctcccctgcgcctagttcagtgcccctgggaagtgagaagccatccaatgtatcacaagaccgaaaggtgccagtgcccattggaaccgagaggtccgctcgcattcgccagaccggtacctctgcaccaagcgtcatcggcagcaatttaagcacctccgtggggcacagtggcatttggtctttcgagggaatcggaggcaatcaggataaagtcgattggtgcaatcctgggatgggaaaccctatgattcatagacccatgtctgatccaggcgtattttcgcagcaccaggccatggagagggatagtaccggaatcgtaacgcccagcggcacttttcatcagcacgtgccagctgggtacatggattttcccaaggtgggggggatgcccttttccgtctatggtaacgcgatgatccccccagtagcccctatacctgatggtgctggaggcccaatcttcaatggacctcatgcagctgacccgtcttggaattctttgattaagatggtctcctcatcaacagagaataatggtccacaaaccgtgtggacgggtccttgggccccccacatgaactccgtacacatgaaccagttaggatag

SEQ ID NO: 14991 - DNA, 3075 bp, Artificial Sequence
  Description of Artificial Sequence: Synthetic coding sequence
atgacagagggtaggaggtgtcaggtgcacctgctggacgacagaaagctcgaacttctggttcagcccaagcttctggctaaggaacttctggacttagtagcttctcacttcaatttaaaagagaaggaatactttggtatagcctttacagacgaaacaggccacctgaactggcttcagttagatagaagagtcttagaacacgatttcccaaaaaagagcggccccgtagtgctctatttctgtgttcgtttttatatcgaatctattagctacctgaaagacaatgccaccattgagctgttctttttgaatgctaagagttgtatttataaagagctgattgatgttgactccgaggtggtttttgagcttgcaagctatatcttgcaggaggccaaaggagatttctcaagcaacgaagtcgtccgctctgacttaaagaagctgcctgccctgcccacacaagccctcaaagaacatccatcacttgcttactgtgaagatcgtgttattgaacattataagaagttgaacggacaaacccggggacaagcgattgtgaactatatgagcattgtggaaagcctccccacctacggcgtccattactacgccgtgaaagacaagcaaggaatcccctggtggctggggctatcgtataagggaatttttcagtacgattaccacgacaaggtaaaaccacgcaagatcttccagtggaggcaattggaaaatctctattttcgcgaaaagaaattctctgtagaggtccacgatccacggagagcttccgtgaccaggcggacttttggacatagtggcatagccgtccacacctggtatgcttgtccagcgttgattaagagcatatgggcaatggccatttcccaacatcagttttaccttgaccggaagcagagtaagtctaagattcacgccgcacgctctctgagtgaaatcgctatcgatttaacagagaccggaaccctcaagacaagcaagctggctaacatgggtagcaaaggcaaaataattagtggctcttcaggatcgcttctctcctctggcagtcaggaatccgactcttcacagtctgcaaagaaggatatgcttgcggccctgaagtcacgccaggaggccctggaagaaactttacgccagcgcctggaggagctgaagaagctgtgcctaagggaggcagagttgaccggcaagcttccagtagagtaccctctggaccctggcgaggaacctccaatcgttaggcgccgcatcgggactgcattcaagctggatgaacagaagatcctgccgaaaggtgaggaggccgaacttgaacggttggaaagagagtttgccattcagtcccagattaccgaggctgctcgtcgcttggctagcgaccctaatgtgtccaagaagctcaagaagcagcgcaaaacaagctacctgaatgccctgaaaaagttacaagagatcgagaatgctatcaacgaaaatcggatcaagtcaggcaagaagccaacccagagagcttcgttgattattgacgatggaaacattgcttccgaggattcctccctcagcgacgctctcgttctggaagatgaggatagtcaggttaccagtactatatcacctctgcacagcccccacaaggggctgccacctaggcctccgtctcataaccggccgcccccaccgcagagcttagagggtctccgacagatgcactaccatcgtaacgactacgacaagtctcctattaagcctaagatgtggagcgaatctagcctggacgagccatatgaaaaggttaaaaagagaagttcccattcacatagtagctcacataagagatttccctccaccggcagctgcgccgaggcaggaggcggctccaacagcctccagaactctcctatcaggggtctgcctcactggaactcccagagttcaatgccttccacccccgatttgcgcgtccgaagcccacactacgtccattctaccagaagcgtagacatttcaccgactcggctccactccctggccctgcatttccgccacaggtctagcagtctcgagtcccagggaaagctgctcgggtctgagaatgacactgggtcccccgatttttacacaccaagaactcggagcagcaatggttccgatccaatggacgactgcagttcctgtaccagtcattcctcctctgaacactattaccccgctcaaatgaacgctaactattcgacccttgctgaggattctccctctaaggcgaggcagcgacagaggcagcggcagagggcagctggagcactgggttctgcttcgtcaggatccatgcccaacttggctgcgcgtggcggagctggaggcgccggtggggcgggcggcggcgtgtatctgcattcccagagtcagccaagctctcagtatcgcatcaaggagtatccactttatattgaaggtggagcaacccctgtggtagtgaggagtttggagagcgatcaggagggacactacagtgtgaaggctcagttcaaaacaagtaacagttatacggcgggcggacttttcaaggagtcctggcgaggcggcgggggcgatgagggagacaccggccggctaaccccatctaggagtcagatcctacgaacgcccagcttgggccgtgaaggagcgcacgacaagggtgctgggcgggcagccgtctccgacgagttgcggcagtggtatcagaggtcgaccgcttcacataaggaacattcaagacttagtcacaccagctcgacatcttcagattccggcagtcaatacagtacatcaagccaaagcacctttgttgcgcattcccgagtgactcgaatgccccaaatgtgcaaggccacttcggctgcgctaccccagagtcagaggtcatcaacaccctcttctgagattggcgccacaccgcccagctcaccacatcacattctgacctggcagacaggtgaggctaccgagaatagcccaatcctagacggttccgagagccctccccaccagtctacggacgagtag

SEQ ID NO: 14992 - DNA, 864 bp, Artificial Sequence
  Description of Artificial Sequence: Synthetic coding sequence
atgagccaagcctggtggcatacaagtgtaagccccgccactcaggaagccaaagcgggcggactcttgcagccaaggcggcaaagactgtggctcaagaggtgccgcatttcttcgagcgcctgcgaagatctgtctgctgccctgattgccaataagaacctgacacgaatggatctgagcggcaacggcgtcgggttccctggaatgatgctgttgtgcgaggggctcaggcacccccagtgcaggctgcagatgatccaactacgaaaatgtcaactagagagcggggcttgccaggagatggcttccgtgctggggaccaatcctcaccttgtcgagttagatcttacggggaatgctctggaggatcttggtcttagactcctgtgccaaggacttaggcaccctgtatgcagactgcgaaccttgtggctaaaaatttgcaggcttaccgccgctgcctgtgatgaactggcctccacgctgtccgtgaaccaaagcttgcgagaattagacttatcactgaatgagctgggggatttgggggtactcctgctatgtgaggggctcagacaccctacatgcaagctgcagactctgagactggattcatgcggactcacagcaaaagcctgcgagaacctgtactttactctgggcataaaccagactctcaccgatctctacctgacaaataacgctttgggcgacacaggggtgagattattgtgcaaacggcttagccatcctggctgcaaactgcgcgtgttgtggctgtttgggatggacctcaacaaaatgacgcactcaaggctagccgcgctgagggtgaccaagccatacttagatattgggtgctag

SEQ ID NO: 14993 - DNA, 615 bp, Artificial Sequence
  Description of Artificial Sequence: Synthetic coding sequence
atggctggctacttaagtgagtccgactttgtgatggtcgaagaagggttttctactagagatctccttaaagagttgacgctgggagcttcccaggcaacgacagatgaagtcgcagccttcttcgttgctgatcttggcgcaatcgtgagaaagcacttttgctttctgaagtgtctccctcgcgtgcgtccgttctatgccgtcaagtgcaatagcagccccggtgtgctaaaggtgctggcccaactgggacttggcttcagttgtgcaaataaaatcgcctccgttatcaacagcgccctggatttgtatttccccgaggggtgtggcgtggatattttcgccgagctcggtagatactatgtcactagtgcattcactgtcgccgttagcatcatagccaagaaggaagtgctgctggatcagcctggtcgagaagaggaaaatggcagtacatcaaagacgattgtatatcatttagacgaaggagtgtacggtattttcaactcagtgctgttcgacaatatctgcccaactcccatcttacagaagtctaaaaatcatagtccgtgttacatgagtctggaatcgattcattttatcgccgtatag

SEQ ID NO: 14994 - DNA, 519 bp, Artificial Sequence
  Description of Artificial Sequence: Synthetic coding sequence
atgatgaaattgaagagtaaccagacacggacatacgacggagacggatacaagaaacgggccgcatgtctgtgtttcaggagcgagtccgaagaggaggttcttctcgtgtccagctctagacaccccgatcgttggatagttcccggcggaggaatggagccagaggaggaacccagcgtcgccgcagtgcgagaagtctgtgaagaagccggggtgaaaggaacccttggaagactcgtcgggatctttgagaaccaggagagaaagcacaggacatatgtctatgtactgattgtcacagaggtacttgaggactgggaggatagcgtgaatatcggacgaaaaagggagtggttcaaaattgaggacgctataaaagttttacaatatcacaaaccagttcaggcatcatatttcgaaacgctgcggcagggctattccgcaaacaatgggacgccagtcgtggccacgacttactcagtctcagcccagtcttcaatgagcggcattcgttag

SEQ ID NO: 14995 - DNA, 4284 bp, Artificial Sequence
  Description of Artificial Sequence: Synthetic coding sequence
atgtcgatgcttaaaccatcaggactcaaggcccccacaaagatcttaaagcctggctcaactgccctgaagacccccacagctgtagtggcgccagtcgagaaaactattagcagtgagaaggcgtcttccactcccagttccgagacacaagaggagttcgtagacgacttccgcgtgggcgaacgggtttgggtaaatggcaataaacctggatttattcagttcctcggggagacacaatttgctcctggccagtgggcaggcatcgtcctagatgagcctattgggaaaaacgatggctctgtggctggggtaagatacttccagtgcgagccgctgaaaggcatcttcactaggccaagtaaacttacaagaaaagtccaggcagaggacgaagcaaacggtctgcagaccacaccagctagccgggcaaccagtcccttgtgcacttccactgcctctatggtaagttcatccccgtccacaccctctaacatcccgcagaagcccagccagcccgcagccaaggaaccgagtgcaaccccaccgatctccaacctgactaagaccgccagtgaatcaatatcaaatctgtccgaagctgggagcatcaagaagggggagagagagctaaaaattggggaccgcgtacttgtggggggcaccaaggccggcgttgtcaggtttctcggagaaacagatttcgctaaaggtgagtggtgcggggtcgagctggacgagccgctgggcaaaaacgatggagcagtggcggggacgcgctactttcagtgtcagcccaaatacgggctctttgccccggtgcacaaagtgacaaagatcggtttcccatccactactccagctaaagccaaggcaaacgctgtaaggcgggtcatggccactaccagtgcctctttaaaacgtagcccttctgcttccagccttagctcaatgtcctccgtggcctcatcggtgagtagccgcccctcaaggaccggactgctcacagagacctcctcacgatacgcccggaagatttccgggacaacggcgctgcaggaggccctcaaagagaagcagcagcacatcgaacagctgttagctgaacgagatcttgaacgggctgaggtggctaaggccacctcgcatgtcggcgaaatcgagcaggagctcgcattggcaagggacggacacgatcagcacgttctcgagctggaagctaagatggatcagctgaggaccatggtggaggcagccgaccgagagaaggttgagctacttaatcagctggaggaggaaaaaagaaaggtggaggaccttcaatttagagtggaagaagaatcaattacaaaaggagatttagaaactcagaccaagctcgagcacgctcggattaaagaacttgaacaatctctactgttcgagaagactaaggccgacaaactccagcgcgaactggaggacacccgagtggccacggtgtctgaaaaaagtcggatcatggaactagaaaaagacttggccctgagggttcaggaggttgcagagttgagacggagacttgaaagtaataaaccggccggagacgtagatatgtccctgagcctcctgcaggagattagctcactccaagagaaactagaggttacaagaacggaccatcaaagggagattacaagcttgaaggaacactttggcgcccgggaggagacacatcaaaaagagatcaaggccttatatactgctactgagaagctcagcaaggagaacgagagtctcaagtccaaactcgagcacgcaaataaggagaattccgacgtcatcgccctctggaagtccaaactggaaaccgccattgcatcacaccagcaggctatggaagagttgaaggtgagcttctcaaaagggctcggaacagagaccgccgaattcgccgagctgaagacacaaattgagaagatgaggctagactaccagcacgagatcgagaacctccagaaccagcaggattccgaacgcgcagcccacgcgaaggagatggaggcactccgcgccaaattgatgaaagtcatcaaagagaaagagaactcactcgaagctattcggtctaaactggataaagccgaggatcagcatctggtagagatggaagatacactgaataaattgcaggaggctgagatcaaagtgaaggagctggaggtcctgcaggctaagtgtaatgaacagacgaaagtcatcgataacttcacgtcccaactgaaggctaccgaggaaaaactgctggacttagacgccttacgcaaggctagcagtgaagggaaaagtgagatgaagaagcttcgacagcaactggaagccgctgagaaacagattaagcacctggaaattgagaaaaacgccgaatcgagcaaggcttcaagcataacccgcgagctccaggggcgagagctcaaactgacaaacctgcaggaaaacttgagtgaggtctctcaggtgaaggagacccttgagaaagagctgcaaattctcaaggagaagtttgcagaggcatctgaggaggctgtctcagttcagcgttcgatgcaggagacggtgaataaactgcaccagaaggaggagcaattcaacatgctgtctagtgatctcgagaaattgcgcgaaaacctggccgatatggaagccaaattccgggaaaaggacgagcgagaagagcagcttattaaagctaaagaaaaactggaaaacgacatcgcagaaattatgaaaatgtccggggataacagcagccagttaaccaagatgaacgatgagcttagactcaaggagagggacgtggaggaacttcaactcaagttgactaaggccaatgagaacgcttccttcttacagaaatccattgaggacatgacagtgaaagctgaacagtcccagcaggaagctgccaaaaagcatgaggaggagaaaaaggaactggagagaaaattaagtgatttagaaaaaaaaatggagacctctcataatcagtgtcaggagctcaaggcccggtatgaacgcgccacaagtgaaaccaaaacaaaacatgaggaaatccttcaaaatctgcagaagacactgttggacacagaagataagctgaaaggggcacgggaagaaaattctggcctattgcaagagctcgaggagctgagaaaacaggctgataaggccaaagctgctcagacagccgaagatgctatgcagatcatggaacagatgacaaaagagaaaacagagaccctcgcatcactcgaggacaccaagcagactaacgccaaactccagaacgagctcgacacacttaaagaaaataacctcaaaaatgtggaagagctcaacaaatccaaggaactgctcacagtagagaatcagaagatggaggaattccggaaggagattgaaactttgaagcaggcggcggcccagaaaagtcagcagctatccgcactccaggaagagaacgtaaagttggcagaggagttgggacggagtcgtgatgaggtaaccagccaccaaaaactggaggaggaaagatctgtccttaataatcaactccttgagatgaagaaaagggagagcaagttcataaaggacgcggacgaagagaaggcaagccttcagaaatctataagcataacatcagccctactgactgagaaagatgccgaactggaaaaactcagaaacgaggtaacggtactgcgcggtgagaacgctagcgcaaagtctcttcacagcgtcgtccagactctggagtctgacaaggtgaagctggagctaaaggttaaaaatcttgaactgcagcttaaagaaaacaaacgccagttgagcagttccagcggcaacactgacacccaggccgacgaggacgagagggcacaagagtctcagattgactttctcaatagcgtaatagtggacctgcagaggaagaatcaggaccttaaaatgaaagtggaaatgatgtccgaggcagccctgaatggcaacggggatgacttgaataactacgattccgatgaccaggaaaagcagagtaaaaagaagccaagattgttttgtgacatctgtgactgtttcgatctgcatgacaccgaggactgcccaacacaagcccagatgagcgaagatccaccccattcgacacatcacggttcgcgcggagaggagcgcccctattgtgagatatgcgaaatgttcggacattgggctaccaactgcaatgatgatgagaccttttag

SEQ ID NO: 14996 - DNA, 1179 bp, Artificial Sequence
  Description of Artificial Sequence: Synthetic coding sequence
atgggagatagttgtccagcagtgacatttaggtctcagaaagaaaaccgcgccggcctccaagaaaaactgagatacctgcagcaacaactgcaagatgaaaccccacggagacaggaagctgagttacaagagccggaggaaaagcaagaacccgaagaaaaacaggagcctgaagaaaaacaaaagccagaggcgggcctttcctggaactcactgggaccagcagcgacatctcaggggtgtccagggccacctgggtctccagataaaccatccagaccccacggcttggttcccgccgggtggggcatgggccctcgggccggagaaggtccttatgtcagtgagcaagaattacagaagctcttcacagggatcgaggagctgagaagggaagtgagtagccttacagcgcgctggcatcaggaggaaggggctgttcaagaagctcttcggttgctgggtggcctggggggccgcgtagacgggtttctcgggcagtgggagcgagcgcagagggaacaggctcagaccgccagagatttgcaggaattacggggcagggccgatgaattgtgtactatggtagaaagatcagccgtttccgtggctagcctgagaagtgagctggaaggactcggccctctaaagcctatcctggaagagttcggtcgccagttccaaaactccagaaggggacctgacctgtccatgaatctagatcggagtcaccaaggaaactgtgccaggtgtgcatcccagggctcccagttaagcacggagtccctgcagcagctcctggaccgggctctaacttccctggtagacgaggtgaaacagcgtggactcaccccggcttgccctagttgccagcggctccacaaaaagattctagaacttgagcggcaggcgcttgcgaaacatgtgcgcgctgaggccctctcctctacgcttaggttagcccaggacgaggcgctgcgggccaaaaatctgcttttgacggacaaaatgaagcccgaggaaaagatggctaccctagatcatctccatttgaagatgtgctcgttacacgaccatctgtccaatctccctttggaaggatcaactggaaccatgggcggcggcagctccgcaggtaccccccccaagcagggcgggtcagcccctgaacaatag

SEQ ID NO: 14997 - DNA, 1692 bp, Artificial Sequence
  Description of Artificial Sequence: Synthetic coding sequence
atgtctgatgatgctggggatactctggcaactggcgacaaggctgaggtaactgagatgcctaactctgattccttacctgaggatgcggaggtccattgcgactctgccgcagttagccacgaacctactcccgcagacccccggggagaggggcacgaaaacgccgccgtccagggcgctggtgctgcagccatcggccccccggtgcagccacaggacgccaatgctcttgagccccccctcaacggggatgtgaccgaagatacattggcagaatgtatcgactcggtctctctcgaagcagaaccacgctccgaaatccctctccaggaacagaactacctcgccgtcgactccccaccctcaggagggggctgggctggctggggcagttggggtaaatccctgctgtcctccgcgagcgcaacggttgggcatggcctcactgcggtaaaagaaaaagccggcgctacactccggatacacggagtcaactcaggctcaagtgagggagcccagccaaacacggagaatggggtacccgagatcactgatgctgctaccgaccaggggccagctgagagcccaccgacctcaccatcttccgcctcacgcgggatgctgtcagccataactaatgtcgtgcagaacaccggaaagagtgtgctaactggcgggctcgacgcactggaattcatcgggaagaagaccatgaacgttctggccgagtcagaccccggctttaagcgcaccaagaccttaatggaacggactgtgagtctgtcccagatgctgcgggaggccaaggaaaaagagaagcagcgactggctcagcagctcaccatggagagaaccgctcactatggaatgctgtttgacgagtaccagggtcttagccatttggaggctctggagatcctgtctaacgaatctgagtcgaaggtccagagtttcctggcttccctggatggcgagaaactggagctgctgaagaacgatttgataagtatcaaagatattttcgcagcgaaggaactcgagaatgaggaaaaccaggaagaacaggggctagaggagaaaggcgaagagtttgcccgcatgttaacagagctgctgttcgagctgcacgttgccgccactcccgacaaactcaacaaggctatgaagcgggcacacgattgggtggaagaagatcaaacagttgtctcagtcgacgttgccaaggtcagtgaggaggaaactaagaaagaagagaaagaggagaagtcccaggatccccaagaggacaaaaaagaagaaaagaaaacgaagaccatcgaagaggtctatatgagtagcattgaatctttagccgaggtcactgccagatgtatcgagcagctccataaggtggccgagcttatcctccacggtcaagaggaagaaaagccggctcaggaccaggctaaggtgcttataaaactgactaccgctatgtgcaacgaagtggcctcgctctcaaagaagtttacgaatagcctcacgacagtggggtccaacaagaaggccgaggtgcttaacccaatgattagctccgtgttgttagagggttgcaatagcacgacttacatacaggatgcttttcaactcctgctgcctgtgctgcaggtgtcccatattcagaccagttgtttgaaagctcagccctag

SEQ ID NO: 14998 - DNA, 1257 bp, Artificial Sequence
  Description of Artificial Sequence: Synthetic coding sequence
atgttctcacccgaccaggagaatcatccctcgaaagccccagttaagtacggggaactgatagtgctcggctacaatggaagcctgcctaatggggaccgggggcgacgcaaaagcaggtttgccctgtttaaacgccctaaagcgaatggggtcaagccctccacagtgcacatcgcctgcacgccccaggctgccaaagctatcagcaataaagaccagcactccattagctataccctcagccgcgcacaaacagtagtcgtggagtacacgcacgactcaaacactgatatgtttcagattggcagaagcacagaatcccctatcgactttgtggtgacagataccgtgccgggtagtcagagcaattcggacacgcagtcggtgcagtctaccatctccagattcgcttgtaggattatttgcgagcggaacccgccattcacagctaggatctatgctgccggttttgacagcagcaaaaatattttcctgggcgagaaggccgcaaaatggaagaccagcgatggtcagatggatggtcttacgacaaacggagtgctcgtcatgcatccaagaaatggcttcacagaggactccaaacctggcatatggcgcgaaatttctgtgtgtgggaacgtcttctccttgcgggagacgcgctccgcacagcagagagggaaaatggtggaaatcgaaacaaaccagctccaggatgggagtctgatcgacctgtgcggggctacactgctgtggcgtacagctgaaggattgtctcatacacctacggtgaaacacctggaagccctcagacaagaaatcaacgccgctcgcccccagtgcccagtcggcttcaatacactggcgtttccaagtatgaagaggaaggacgttgtggatgaaaagcagccatgggtgtatttaaactgtggccacgtgcacggttatcataactgggggaacaaagaagaacgggacggcaaggatagggagtgccccatgtgcaggtcagtcggtccctacgtgcctctttggctggggtgtgaggccggattttatgtggacgctggtccccctacccatgctttttcgccatgtggacatgtctgcagtgagaagacgactgcctattggtctcagatcccgctgccccacggcacccatacgttccacgccgcctgtcccttctgtgcgcaccagctggccggcgaacagggatacattaggctgatttttcagggccccttagactag

SEQ ID NO: 14999 - DNA, 3963 bp, Artificial Sequence
  Description of Artificial Sequence: Synthetic coding sequence
atgcaagacgactctatagaagcttcaacctctataagccaattacttagagaaagctacctggccgaaaccaggcatcgaggtaataatgagcgctcccgggcggagccatcatccaatccgtgtcattttggctcaccgtctggcgctgctgaaggagggggcggtcaggacgacttgcccgacctatctgcttttttatcgcaagaggagttggacgagtccgtgaatctggctcgcttggccataaattacgaccctctggagaaagcggatgaaacacaggcccggaaacggctgagtcccgaccagatgaagcactccccaaacctgtccttcgagcctaatttctgccaggataatccaaggtcccccactagcagcaaggagtccccccaagaagcgaagcggccacagtactgttcagagacacagtctaaaaaggtgtttttgaataaggccgctgacttcattgaagaactgagttcgctgttcaaatctcactcctctaaacgcattcggccccgcgcatgcaagaatcacaaatctaaactcgagtcccagaataaagtaatgcaggagaatagctcttctttttcagatctcagcgagaggagggagcgctccagcgttcctatcccaattccagccgataccagggacaatgaggtcaatcacgccctggagcagcaggaagctaaaaggcgggaggccgaacaagccgcctcagaagccgctggtggggacacaactcctggatcttccccatcttcactttactacgaagagccattgggccaacctccaaggttcacccagaagctccggtccagggaagttcccgagggcacccgggtgcagttggactgtattgtggtcggcatcccccctccgcaagtacgctggtattgcgagggaaaagagctggagaattcaccggatattcatatcgtccaggctggcaacctgcactccttgacaattgcagaggccttcgaagaggacactgggcggtacagctgcttcgcctccaacatttacggaaccgacagcacctctgctgagatctatatagaaggggtttcatcttccgattcggagggcgaccctaacaaggaggagatgaaccgaatccagaagcctaacgaagtcagttcccctcctacaacaagcgccgtgatccccccagcggtcccacaggcacaacacctggtcgcccagccgcgagtggccactattcagcaatgtcagtcgcccaccaattacttgcagggcctggatggtaagccaattatcgcggctcccgtctttaccaaaatgctccaaaatctttcagcgagcgaggggcagcttgtggttttcgagtgtagagtgaagggagccccatctcctaaagttgagtggtacagggagggaaccctgatcgaagacagccccgacttcagaatcctgcaaaagaagccgcggtccatggcagaacctgaggagatctgtacattagtgatagcagaagtgttcgctgaagacagcggctgtttcacatgcacggccagcaataaatacggcaccgtttcatctattgcacagctgcacgtaagaggtaatgaggatttgagcaacaatggatctctccacagcgcgaactccaccacaaacctagccgccatcgagcctcagccgtcaccccctcattccgaaccacctagtgtagagcagcccccaaagcctaagttggagggggtgcttgtgaatcacaacgagccaaggtcatcttcccgtattgggttaagagtgcatttcaatttgcctgaggacgataagggcagcgaggcaagctccgaagccggtgttgttactactagacagacgcgcccggatagctttcaggagcgttttaatgggcaggcaaccaaaacccctgagccaagctctcccgtgaaggagccaccccctgtgcttgcaaaaccaaagctagactctactcagctgcaacaactgcacaaccaagtgctgctggagcagcatcagctgcaaaatccccctccctcgtcgcccaaggaatttccctttagtatgactgtgctaaactcaaacgcgccacctgcagttacaactagctctaaacaagtaaaggctccgagctcccagaccttcagcctcgccagacccaagtacttttttccatccacaaacaccactgcagcaacggtcgcaccgtccagctccccagtgttcacgctctcttctaccccacagaccattcagcgaactgtgtcaaaggaatctttacttgtatctcacccgagtgtgcagactaaatcccccggggggctgtctatccagaacgaacctttgcctcctgggcccacagaacctacccctccaccatttacattctccatcccttccggaaaccagttccaacccaggtgtgttagtcctattcccgtctccccaacaagccgcatccagaaccccgttgcttttctgagtagcgtcctcccatctcttcctgctatcccccccaccaatgcaatgggcttgccgaggtcagccccatctatgccatcccaaggactggcgaagaagaatactaaatcacctcagccggtgaatgacgacaacatccgagagactaagaatgcagtgattcgggacctcgggaagaagattacattcagcgatgtgaggcccaatcagcaagaatataagatcagttcctttgaacagcggctcatgaacgagattgagttcagattggaaagaacccctgtggatgagtccgacgatgaaattcagcatgacgagatacccactggtaagtgtatcgcaccgatcttcgacaaacggctgaagcatttccgcgtgacagaggggtctcctgtgacgtttacctgtaagattgtcggcatcccagtgccaaaggtgtattggtttaaagatgggaagcagattagcaaaagaaatgaacactgcaaaatgcgacgcgaaggagatggaacttgtagtctccatattgaaagtaccacctccgacgacgatgggaattacacaattatggccgctaatccgcaaggacggatctcgtgctccggccatctcatggtccagagccttccgattcggtccaggcttacatcggctggccaatcccatcggggacgtagcagggttcaagagagagacaaagagcccctgcaggagaggttttttcgccctcactttctgcaagctccaggagatatggtcgcacacgaaggcagactctgtcgcctggactgcaaggtttccggactccccccacctgagctgacttggctgctgaacgggcagccagttcttcctgatgcttcccacaagatgcttgtgcgggagactggcgtgcacagtcttcttatcgacccactgacccagcgagatgccggcacttacaagtgtatcgcgacaaacaaaactgggcaaaacagtttcagcttagaactgagcgtcgtcgctaaggaagttaaaaaggcccccgttatcctggaaaagctgcagaactgtggagtgcctgaaggacatccagtacgcctggagtgcagagtcattggcatgccaccaccagtcttctactggaagaaggataacgaaacaatcccttgtacgagagagcggatttccatgcatcaggacacgactggctacgcatgtttgctcatccagccggccaaaaagtctgatgctgggtggtacacgctgtcagcgaagaacgaagccggcatagtgtcttgtaccgcccgcctggatatctacgcgcagtggcaccatcagatcccaccgcctatgtcggtgagaccttcaggctctcgctatggatctctgactagtaagggactcgatatttttagcgctttcagcagtatggaaagtacaatggtttatagctgctcctcccgctccgtggtggaaagtgacgaattgtag

SEQ ID NO: 15000 - DNA, 4206 bp, Artificial Sequence
  Description of Artificial Sequence: Synthetic coding sequence
atggccagctgcgcctcaatcgacatagaggatgcaacccagcacctccgggacatcctgaagctggatcgccccgccggcggacccagcgctgaatcaccccggccgtctagcgcatacaacggcgatctgaacggcctcctggtgcccgatccactgtgtagcggggactctacaagcgccaataagaccgggctgaggaccatgcctcccatcaaccttcaagagaagcaggtgatctgcttaagcggtgatgacagctccacgtgcatcgggattctggcaaaggaagttgaaatcgtcgccagtagcgatagttccatcagctctaaagctcggggttcaaataaggttaaaattcagcccgtggcaaaatacgattgggagcagaaatattactacgggaacctcatcgcagtcagtaactctttcctcgcctatgcaataagagcagccaacaacggaagcgccatggtgagagtcatcagcgtttcaaccagcgagcgtacccttctcaagggtttcactgggagtgttgcagacctggcgtttgcacacctgaactctccccagctcgcttgcctggacgaagctggcaacctcttcgtgtggcgattagcactggtgaacggaaaaatacaagaagagattctggtccatatcaggcagcccgaagggacaccactgaaccattttcgcagaatcatttggtgtcccttcattccagaggaatctgaggattgctgcgaggagagctctcctaccgtggccctcctgcatgaggatcgggccgaagtttgggacttggacatgttgcggtcttcacatagcacttggccggttgatgtgagtcagatcaagcagggctttatagtcgtgaaaggtcactccacgtgcctcagtgaaggggcactctcccccgatggcactgttctagctaccgcgtcgcatgatggctatgtgaaattctggcagatatacatcgagggccaagacgaaccacgctgcctgcatgagtggaagccgcacgacggcagaccactgtcatgccttctgttttgcgacaatcataaaaagcaagatccagatgtgcccttttggcggtttctcatcaccggtgcagatcagaatagagaactcaagatgtggtgtaccgtgtcttggacctgcctgcagacaataaggttctccccagacatcttctcttccgtctccgtgccaccatcccttaaagtatgcttggacctgtctgctgagtatctgattctgtcggatgtgcagagaaaggtgctgtatgtcatggaactactgcagaaccaagaagaaggccacgcatgctttagctccatctccgaattccttttgacgcaccctgtcctctcctttggaattcaggtggtctctcggtgccgcttgcgtcacacggaggtcctccccgctgaggaagagaacgacagcctaggagcagacggtacacacggcgcaggagctatggaaagcgccgctggggttctgatcaaactgttctgcgtgcatactaaggctctccaggacgtccagattcgattccaaccccagctgaaccccgacgttgtggcacccctgccaacccatacagcgcacgaggactttacgttcggcgagtcgcggcctgaactgggcagcgagggactgggatcagcggctcacggatctcagcccgatctcagacgcattgtggagctgcctgccccagcagactttctgtccctgtccagcgagaccaagccaaaactgatgacccccgacgcgttcatgactccaagcgcaagtctgcagcagatcactgctagtcccagctcatcgagtagcggcagttctagttcttcaagcagtagttcatcgagtctcacggcggtgtccgcaatgtcaagcacgtcggcggtagacccatctctgacgagacctcccgaagaactgaccctaagtccaaagctccagctggacggatcattgaccatgtcttcctcaggatcattgcaggcatcacctaggggcctcttacccggattactgccagctccagcggataagctcacccccaagggaccaggacaggtgcctacggctacttctgcattgtcactggagctacaggaggtcgaaccattaggcctaccccaagccagccccagtcggacacgctccccagacgtgatttcaagtgcgagtaccgcccttagtcaagacattcccgagatcgcctcggaggcactgtccagaggattcggatctagtgcccccgaaggattagagcccgattccatggcaagtgcggccagtgcacttcatctcctctccccaagaccgcgtccgggacccgagctgggaccgcagctgggcctggacggaggcccgggcgacggtgaccggcataataccccttctctactagaggccgctcttacgcaggaagcctctaccccagattcccaggtgtggccaactgcacctgacattactagggagacctgcagtacactggctgaaagtcctagaaacggactgcaggagaaacacaaatcactggccttccatcggcccccctatcacttactgcaacagagagattctcaggacgcttctgccgagcagtctgaccatgacgacgaggtcgccagtcttgctagcgcatctggaggctttggtaccaaagtgcctgccccacgcttgccagctaaggactggaaaacaaaaggcagtcccagaacatctcctaagttaaagcggaaatccaaaaaagatgatggcgacgcagccatgggctcaaggctgacagaacatcaagtcgccgaaccacccgaagattggcccgcactgatctggcagcagcagagagagcttgccgagctgaggcatagtcaggaggagttgttgcagcgcctctgcacccagctcgaagggctgcagtctaccgtaactggtcacgtggagagagcattagagacacgacatgagcaagagcagagaaggctcgagcgcgctctggcagagggacaacaaagaggaggccagctgcaggagcagttgacacagcaactgagccaagctctgtcctccgccgtagctgggcggctggaacggagcatccgagacgaaatcaaaaagactgtccccccatgtgttagccgatcactcgagcctatggccggacaactgtctaactcagtggcaacaaaactgactgccgtggaagggtctatgaaggagaatatttccaagttgctgaaaagcaaaaacctgactgacgccatcgcaagagccgctgctgacacacttcagggccctatgcaggcggcctaccgggaggcctttcaaagcgtcgtcctgcctgcctttgagaagagctgtcaggccatgttccagcaaattaacgattcattcaggctgggtacgcaggagtatctccagcagctggaaagccatatgaaatcccggaaggcccgcgagcaagaagctcgggagcctgtgctcgcccagttgcgaggactcgtgtcgacattacagtccgccacagagcagatggctgccactgtcgctggaagtgtgagggccgaagtacagcaccagctgcatgtggcagtaggctcacttcaggagtctatactggctcaggtccaacgcatcgtgaaaggcgaagtgagtgttgctcttaaggagcagcaggccgcagtgacgtcttcaattatgcaggccatgcgaagtgcagccgggaccccagtcccgagcgctcacctggactgtcaagcccaacaggcacacatccttcagctgctgcagcagggacacttaaatcaagcattccagcaagctcttaccgcggctgatctgaatcttgtgctgtacgtctgtgagaccgtggacccagcacaggtctttggacagcctccctgccccttgagtcagccagtgctactatctttgatccagcaactggcgtccgatcttggcacacggaccgatctaaagttgtcatatctggaggaggcggtgatgcacctcgatcacagcgacccaatcactagggatcatatgggatcagtgatggctcaggtcagacagaagctctttcagtttctccaggctgagccccataattctctaggcaaagctgcccggaggctgtcgctgatgctgcacggcctggtgaccccgtctcttccctag

SEQ ID NO: 15001 - DNA, 576 bp, Artificial Sequence
  Description of Artificial Sequence: Synthetic coding sequence
atgtcctctggcgccgacggcggcggtggcgccgccgtagccgccagatctgacaagggcagcccgggcgaagatgggtttgtcccatctgccttaggtacaagggaacattgggacgctgtgtacgagcgcgaactccagaccttcagagaatacggcgacaccggggagatctggttcggggaggagtctatgaaccggctgattcgctggatgcagaaacacaagattccactggacgccagtgttttggacatcggtactggcaacggggtcttcctggtggaactggccaagttcggatttagcaacatcactggtattgactactcgccatctgccattcaattatccgggtcgattattgagaaagaggggctatcgaacatcaagctgaaggtggaagatttcctcaatttgagtacgcagttaagcgggttccacatctgtattgacaagggaacgttcgacgccatcagtctcaatccagataacgcaatcgagaaacgtaagcagtacgtgaaatcactgtcccgcgtgctgaaagtcaaagggtttttcaacaacgttatgtag

SEQ ID NO: 15002 - DNA, 2622 bp, Artificial Sequence
  Description of Artificial Sequence: Synthetic coding sequence
atgggtaatagagaaatggaagagctgatccctctggtgaacagactccaagacgcctttagcgccctcgggcagtcttgcctgcttgagctaccccagatcgcggtcgtcggcgggcagagtgctggaaagagtagcgtgttagagaatttcgttgggagggattttctcccccggggtagcggtatagttaccagaaggcctctggttctgcaacttgtgacctccaaggccgagtacgctgagttcctgcactgtaagggcaaaaagttcacagatttcgacgaggtgagattggagatcgaagcagaaaccgatcgcgtgaccggtatgaacaagggcatctcctcgatcccaattaaccttcgggtttacagtccacacgtgctcaacctaacactgattgatctcccaggaataacaaaggtgcccgtgggtgatcaacctccagacatcgaatatcagatacgggaaatgatcatgcaattcattactcgagagaattgccttatattagctgttacacccgcgaatacagacctcgcaaatagcgatgctttgaaattagccaaagaggtagacccacaaggcctacgaactattggagttattactaaactggacctgatggatgaaggcacggatgcccgggacgtccttgagaataaactgttgcctctgaggcgggggtatgtaggcgtagtcaaccgctcacaaaaagacatcgatggtaagaaggatataaaggccgctatgttggctgaacgtaagttcttcctgtcccatcctgcatatagacatatcgcggaccggatgggcacaccccacctgcagaaggtcttaaaccagcagctgacgaaccacatacgagacaccttacccaacttcagaaacaaactgcagggccagctactctctatcgagcatgaggtggaggcatacaagaatttcaagcctgaggacccaacaaggaagaccaaagcattactgcagatggtccaacagtttgccgtggatttcgaaaaaagaatcgaaggttcaggagaccaggtggataccctggaactgtccggcggggccaaaattaatagaatttttcatgagagattcccctttgagatcgtcaagatggagttcaatgagaaggagctgaggcgagagatctcttacgccattaagaacattcacggtattcggactgggctgtttacacctgacatggcgtttgaggccatagtgaaaaagcaaatcgttaagttgaagggaccgagcctgaagagtgtggacttagtgatccaggagttaattaacacagtcaagaaatgcacgaaaaagttagctaactttcctcggctatgcgaagaaaccgaacgcattgttgccaaccacattcgggaacgggagggaaaaacgaaagatcaggtgcttttacttatcgatattcaggtgtcatacattaataccaatcacgaggactttatcgggtttgctaatgcacagcagcgtagttcccaagtgcacaaaaagactactgtagggaaccagggcactaacctccccccttctcgacagatagttattagaaagggatggctcaccatcagcaacattggaattatgaagggtggctctaagggctactggtttgtgcttacagccgaaagcctgtcctggtacaaggacgatgaggaaaaggagaagaaatacatgctaccactcgacaatctgaaagttagggacgtagagaagtcattcatgtcctccaagcacatcttcgccctgttcaataccgaacagaggaacgtctataaggattatagatttctggagttggcatgcgactctcaggaagatgtggactcctggaaagccagcttgctgagggccggcgtctatccggacaagtccgttatgaacaaaaaggccgaaaacgacgaaaacggtcaagctgagaatttcagcatggatccccagctggagcgacaggtcgagaccataagaaatctggtggacagctatatgtcgattataaacaaatgcatcagagatctgatccccaagaccattatgcatcttatgatcaataatgtgaaagacttcattaattccgaactgctagctcagctgtactccagtgaagaccagaatactttgatggaggagagcgcggaacaagctcagcggagggatgagatgctgaggatgtaccaggccctgaaagaagctctcgggattattggcgatatctcaactgccaccgtgtcgaccccagcccctccacccgtcgatgatagctggatacagcacagtagaaggagccctcccccaagccccaccacacaaaggaggcccactctgagcgcccctctggcaaggccaacaagtggccgcggacctgcaccggccatcccaagccctgggccccactctggggctccccccgttcctttccggcccgggccactgcctcctttcccctcgagttccgacagctttggcgccccgccgcaagtgccctctcgaccaactagggcccctccaagcgtgccttccagacggccacccccctcgcccacacgtcccacgataatccgacctcttgagtcatccctactagattag

SEQ ID NO: 15003 - DNA, 3111 bp, Artificial Sequence
  Description of Artificial Sequence: Synthetic coding sequence
atgaggaagcaggaggtgcgaaccggacgagaagccgggcaggggcatggcacaggctctcccgccgagcaggtgaaggcacttatggatctgctggcgggcaaaggctcccaaggttcccaagctccgcaagccctcgataggacacctgacgccccactgggaccttgttccaatgacagccgtatccagagacatagaaaggcgctccttagcaaggtaggtggaggtccagaattgggcggtccatggcatcggctagccagccttttgctagtggaagggctcactgacctgcagctccgtgaacatgacttcactcaggtggaagccacacgcggcggagggcaccccgctcgtacggtggccttggaccggctttttctgcccctgtctagggtgtctgtgccgccacgcgtgagtataaccataggggtggcaggcatgggcaaaacaacgctcgtgcggcattttgtccggctgtgggcacatggccaagtcggcaaggatttcagcttagtgctcccactaacctttcgggacttaaatacccacgaaaaactttgcgccgaccgattgatttgtagcgttttcccccacgtcggcgagccctccctggcagtcgccgtccctgctagagcattgctgatacttgatggattagatgaatgccgaacgcctctggacttttccaatacagtggcatgcacagaccccaagaaggaaatcccggtagatcaccttatcaccaatattatcagaggaaatctcttcccagaagtgagcatttggatcaccagtcgcccaagtgcgtcaggccaaatccctggggggttggttgatcggatgacggagatacgtggattcaatgaagaagaaataaaggtttgcttggaacagatgttccccgaagatcaggctctgctgggatggatgctttcacaggtgcaggctgatagggctctctatttaatgtgtacagtccctgccttttgcaggttgactgggatggccctgggccatctctggaggtccaggactggcccacaggatgctgagctctggccacccagaaccttgtgtgagctctacagctggtattttcggatggctctttcaggcgagggccaggaaaaaggcaaggcatcgcccaggatcgaacaggtggcacacggtggtaggaagatggtaggcacgctgggccgtctcgcgttccacgggttgctgaaaaagaagtacgtgttctacgagcaggatatgaaagccttcggtgtggatttagcccttcttcagggagcaccatgctcctgttttctgcagcgtgaggagacactcgcttcctcggttgcctactgttttacccacctgtcccttcaggaattcgtcgcggcagcctactattacggggcctctcgacgcgccatttttgacttgttcacagaaagtggtgtctcctggcctcggctaggctttctgactcattttcgaagtgccgcccagcgtgcgatgcaggccgaagatgggcggctggacgtgtttctaagattcctgagtggtctgctctcgccacgtgtcaacgcgctcttggcgggtagtctacttgctcaaggagagcaccaagcttaccggacacaggtggctgagctcctccagggctgtttgcggcctgatgccgcggtctgcgctcgtgctatcaacgtgttgcattgcttacatgagctccagcatactgaactggcgcgaagcgtggaggaagccatggaatcgggtgctcttgctaggctcaccggcccagcgcaccgagctgcgttagcgtacctgctgcaggtgtcggacgcatgcgcccaagaggccaacctgagccttagtctgtcacaaggcgtcctacaatcactcttaccacaactgctctattgtcgcaagctgcgtcttgacactaaccagtttcaggatcccgtcatggagctgctgggatcagtgctcagtggcaaggactgtcgaatccaaaaaatctccctggctgagaaccagatctcgaataaaggcgctaaggctctggcccgctccctcctcgtgaatcgtagcctcaccagcctcgacctcagaggaaattcaatcggaccacagggcgctaaggccctggcagacgccctgaagattaaccgcacactcacctcattgtctctacaaggcaacacagtcagagacgacggtgccagaagcatggcagaggctctggcttccaaccggacattaagcatgttgcatctgcagaaaaatagtattggccccatgggtgctcagcgtatggctgatctcaagcaaaatcgctccctgaaggagcttatgttctcctcaaactctataggggacggtggcgccaaggcattagccgaggccctgaaagttaaccaaggccttgagtccctggacctgcagtctaactccatcagtgacgcaggggtggctgccctcatgggtgcactttgtaccaaccagacccttctcagcttgagtctgagggagaactcaatttcgccggaaggtgctcaagctatagcccatgccctctgcgctaacagtaccctaaagaacctcgatctgcagtggaattttatccaagctggggccgcacaggcattaggacaagcactgcaattaaaccggagccttacctccctcgatctgcaagaaaacgccatcggagacgatggggcttgtgccgtggcgagggctttgaaggtcaacactgccctcacggcgttatacttacaggttgcctcaattggggcctcaggcgcccaggttcttggagaagccctggcagttaaccgcactctggagatccttgatttgaggggcaacgctattggcgtggcgggcgcaaaagctctcgccaatgcactcaaggtgaactctagcctgagacgactcaatctgcaggagaactccctggggatggacggcgcaatttgcattgccactgccctgtctggcaatcacaggcttcagcacatcaacctgcagggaaatcatatcggggactccggggcccggatgatttccgaagccatcaagaccaatgccccaacttgtaccgtggagatgtag

SEQ ID NO: 15004 - DNA, 2784 bp, Artificial Sequence
  Description of Artificial Sequence: Synthetic coding sequence
atgttctggaagtttgatttaaatacgacgagccatgtagacaaactcctggataaggagcacgtgacactgcaggagttgatggacgaagacgacattctacaggaatgcaaggcccagaatcagaaattactggattttctgtgccgccagcaatgtatggaagagttggttagtctgatcacccaagacccacccctggacatggaggaaaaggtccgattcaaataccctaacaccgcatgtgagctcctgacctgtgacgtgccccagatttcggatcggcttggtggtgacgagagtctcctgagcctcctttatgactttctggatcacgagccacctctgaaccctctgctggcaagtttcttttctaaaactatcgggaacctgatcgcccgcaaaactgagcaggttataacatttctcaagaagaaggacaaatttatctcactcgtcctcaaacatatcggtacgtccgcacttatggatctcttactgcgactggtgagctgcgtcgagcccgccggactgcgtcaggacgttttgcactggctgaacgaggagaaggttatacaaagattggtggaattgattcaccctagccaggatgaggaccggcagtccaacgcttctcagacgttgtgcgatatcgtacggctcggcagagatcaggggtcccaactgcaggaggccctagaacctgatccattactgacagctttagagagccaggactgcgtagaacagttattaaaaaacatgtttgacggtgataggacagagagttgcttggtttcagggacccaagttttattaactctactcgagacgagacgggtgggcactgaaggtctggtggatagcttttcccagggcttagaacggtcctacgcggtctcatcgagtgtcctgcacggcatcgaacccagactgaaagactttcaccaactgctactgaatcctcctaagaagaaggcaattcttacgactattggtgtgctagaggagcctctcggcaacgcacgcttacacggcgcacgcttaatggccgccctgctgcataccaatacaccttcgataaatcaggaattgtgtagactgaatactatggacctactgctggatctttttttcaagtacacctggaacaatttccttcatttccaggtggagctctgtatcgcagctattctctcgcatgcggcccgcgaggagcgcacggaagccagtggtagcgaaagccgcgttgagccaccacacgagaacgggaatagatctcttgagacaccacaaccagcggcaagtctccccgataacacaatggtgacccacttgtttcagaagtgctgcttagtgcagcggatattggaggcgtgggaggccaatgatcatacacaagccgccggaggcatgcgacggggcaacatggggcatctgacaaggattgccaatgccgtagttcagaatctggagaggggacccgtgcagacacatatttcagaagtgataagagggctgccagcagactgtagaggtcgatgggagtcttttgtggaagaaacgctgactgagacaaaccggcggaacacggtggaccttgccttttctgactaccagattcagcagatgaccgcgaacttcgtggatcagtttggttttaacgatgaggagtttgcagatcaagacgacaacatcaatgcacccttcgaccgtattgccgagatcaatttcaatattgacgctgatgaggattcaccgtcagccgctcttttcgaagcgtgttgctctgatcggattcaaccgttcgatgatgacgaggatgaggatatctgggaggatagtgacactcggtgcgccgctcgagtgatggcccgccctcgctttggagccccgcacgcaagcgagagttgctccaaaaatggtcctgaacggggcggacaggatgggaaggcctctctcgaggcccaccgagacgctcctggtgccggagctccgccagcgcccggaaagaaagaggccccccccgtagagggtgacagtgaagctggagccatgtggactgccgtgttcgacgaacccgccaattctactccgaccgcgccaggtgtcgtccgagacgtgggcagctccgtgtgggcagcaggaacatccgcccctgaagagaaaggctgggccaagttcacagacttccagcccttctgttgctccgaaagtggcccccgctgttcttcaccagtagataccgagtgctcccatgccgaaggctccagatcccaaggtccagaaaaggcgttcagccccgcttccccctgtgcctggaacgtttgtgtaactcgcaaggcccctctgctggccagcgatagttcaagttcaggcggaagtcactcagaggacggagatcagaaggccgcttccgccatggatgcagtgtcgcgcggcccgggtcgagaagcaccccctctgccaacagttgcgaggacagaagaggcagttggtcgcgtgggctgcgctgacagccggctgctctcccccgcatgtccagctcccaaagaggtgactgcagctcccgctgtagccgtcccccctgaggccacggtggccatcaccaccgccctgtctaaggcaggtcctgcaatccccacaccagcagtgagttctgctctcgcagtggccgtacccttggggccgatcatggccgtgactgcagcacctgctatggttgcaacactggggaccgtcactaaggacggccaaatgcctcggcagaaggagcttccttag

SEQ ID NO: 15005 - DNA, 2220 bp, Artificial Sequence
  Description of Artificial Sequence: Synthetic coding sequence
atgggcttctccaatatggaggatgatggcccagaggaggaggagagggtggccgagccccaagcaaacttcaatactcctcaggccttgcgctttgaagagctgctggctaatctgttaaacgagcaacaccagatcgccaaggaattgttcgaacaattaaagatgaagaagccttctgctaagcagcagaaagaggtcgaaaaggtcaagccccagtgcaaggaagtgcaccagaccttgattctggaccccgcacagcgtaaacggctccaacagcagatgcaacagcacgttcagctgctgacccagattcatcttcttgcgacctgcaaccctaatttaaaccctgaagctagttcgactcgcatttgtctgaaggagctgggcaccttcgcccaaagcagcatagcgttacaccaccagtataacccgaagttccagaccttatttcagccttgcaacctgatgggagctatgcagctcatcgaggacttcagcacacacgtgtctattgattgttctccccataagacagtgaagaaaacagctaatgagttcccctgtttgcccaagcaggtggcctggattctggctacgtcaaaggtttttatgtaccccgaactgttgccagtctgcagtttgaaggcgaaaaatccgcaagataaaatcctattcactaaagcagaagacaacctgctagcgctgggactcaagcactttgagggaaccgaattcctcaatcccctcatctccaaatacctgttgacttgtaagaccgccagacaacttacagtgagaatcaagaacttgaatatgaacagggcacctgacaacattataaagttttataagaaaaccaaacagctgcccgtactgggcaagtgctgcgaggaaatccagcctcatcagtggaagccgccaatagaaagagaagagcatcgcttgccattctggcttaaggcaagcctgccaagtatccaggaggaactgagacacatggctgatggggcgagagaggtgggcaatatgacgggtacgaccgagattaactcggatcagggccttgagaaagacaattctgaactggggtccgaaactcgctaccctctccttctgccaaagggggtcgtcctgaagctgaaaccagtggcggaccggttccccaagaaggcatggcgtcagaagaggagttctgtgttgaagccccttcttatccagcctagccccagtctccagcccagtttcaaccctggcaaaacccccgcccagtccacacattctgaagctccgcctagcaagatggtgcttcgtatcccgcacccaattcaacccgcaacggtgctccagactgtgcctggcgtgccccccttgggagtgagcggcggagagagtttcgaaagtccagccgcattgcctgccatgcctccagaagccagaactagttttcctctctctgagtcacagactctccttagctccgcccctgtccctaaagtgatgatgcccagccctgcgtctagcatgttccggaagccgtacgtcaggaggaggccttcaaagcggaggggtgctcgggcttttcggtgcatcaagcctgcaccggttatccatcctgccagtgtcatattcacagtacctgccacaacagttaagatagtctctcttggcggtgggtgtaacatgattcagcctgtcaacgctgcagtcgcacagtcccctcagacgattcccattgcgacactattagtgaatcctaccagcttcccttgccccctgaaccagcctcttgttgcctcctcagtgtcccccctaatagtcagcgggaacagcgtgaatcttcccattccctccacgccagaagacaaggcccacatgaatgtagatattgcttgtgcggtcgcagacggcgaaaatgcatttcagggcctggagccgaagctcgagcctcaggagctctctcctctgtctgcaacagtgttcccaaaggtggagcatagccccggacccccgccagtggataaacagtgtcaagagggcctctcagagaactcagcctaccggtggaccgttgtgaaaactgaagagggaaggcaggctctggagcccctgcctcagggtatacaggaatcgctcaataacagctcccccggggatctggaggaggtggtaaaaatggaacctgaggatgcgaccgaggagatctcaggattcctctag

SEQ ID NO: 15006 - DNA, 1911 bp, Artificial Sequence
  Description of Artificial Sequence: Synthetic coding sequence
atggagaaggccgttaacgacgggagccacagcgaggaacttttctgtcatctaaagacgatcagcgaaaaagaagaccttccccgctgtacctccgaatctcatctctcctgcctgaagcaggacatactgaacgagaaaactgagctagaggccaccttaaaggaggcagaactagttactcatagcgtggagcttttgctgccgcttttcaaggacaccattgagaaaatcaattttgaaaacgcaaatttgtctgccctcaatcttaaaatctctgaacagaaggaaattctgatcaaggaactggatacattcaagtctgtcaagctcgccctggagcacctcctacgcaaacgtgattataagcaaacaggcgataacctcagtagcatgctgctggaaaatctgacggataacgagtctgaaaacactaatttgaagaagaaagtatttgaaaaggaggcacacatacaagagctgtcttgcctatttcaaagcgaaaaggccaataccttaaaggcaaatcggttctcacagtccgttaaggttgttcatgaacgattgcaaatccagatacacaagcgggaggccgagaacgacaagctcaaggagtatgtaaagtctctcgagaccaaaattgcaaaatggaacctgcaaagtagaatgaacaagaatgaggccatcgtgatgaaggaagcttccagacaaaaaaccgttgccttgaagaaggcctcgaaagtgtataaacagaggcttgaccattttaccggcgcaattgaaaaacttacttctcagattcgagatcaagaggcaaaattgtccgaaaccatctctgcgagcaacgcatggaagtcccattatgaaaagattgtcatcgagaagaccgaactggaggtgcagatagagactatgaaaaagcagatcatcaacctcctagaggacctcaagaagatggaggaccatggcaagaactcttgtgaagaaattttaagaaaagtgcactccatcgagtatgagaacgagactctgaacttggaaaatacaaaactgaaactccgctttccatgtagaataacagaaagcaaaaatatgaacatactgattgtgctagatatgctctgctacatttcgtctgagaaaacaacactggctgcgctcaaggatgaggtggtgtctgtggaaaacgaattatctgagctacaagaggtggaaaaaaagcagaagactttaatcgaaatgtataaaacccaggtgcagaagcttcaagaagccgccgagattgtgaagtccagatgtgaaaacttattacataagaacaatcaaattactaaaacgaagaataaaaatgtggagaagatgagggggcaaatggagagtcacctgaaagaattagagcgcgtttgtgactccttgacagcagccgagcggaggctgcatgagtgccaggagtcccttcaatgctgtaagggcaagtgcgcggatcaggagcatactatcagagagctgcaaggccaagtggatggaaaccacaacctgttaaccaagttgtcccttgaagaggagaactgccttatccaattgaaatgtgaaaacctccagcagaaactcgaacagatggatgctgagaataaggagctagaaaaaaagctcgccaatcaggaggaatgcttgaagcattcgaacctaaagttcaaggaaaagagcgccgagtatactgccctagcacggcagctggaagcagcactggaagagggacgccagaaggtggcagaggaaattgaaaaaatgagctctcgagagtcggccttacagattaaaatattggacttggagacagaactgagaaagaagaacgaagagcagaatcagctcgtgtgcaaaatgaactctgaccccgagaccccttag

SEQ ID NO: 15007 - DNA, 873 bp, Artificial Sequence
  Description of Artificial Sequence: Synthetic coding sequence
atggctgccgttgagaagcgtcggcaagcagtgcctcccccagcaggcttcacagatagtggacgacaatctgtgagtagagccgccggggcagcagaaagtgaggaggatttcctgagacaggtcggcgtgacggagatgcttagagctgccttgttgaaagtgttagaggcaaggcccgaggaaccgatcgcatttcttgcacactacttcgagaacatgggtcttcgctcacccgtcaatgggggggccggagagcctccgggccagttactgttacagcaacagcggttggggagggccctttggcacctgcggctggctcatcactcccaaagggccgctttcaataataatgtttcagtagcttatgagtgcctgtccgccggaggacggagaaaaagaccagggttagacggtcgaacgtattcggagctattacgacgaatctgccgtgatgggcaggctccagaagaagtggtggcccctctgctgcggaaggtgcagtgtagggatcacgaggcagtccctctctctgtgtttagagcagggaccctaacctgtttcgtgctgctggaatttgtcgcccgtgctggcgctctgtttcagcttttggaagatagcgccgccgccgtggctgatagacgcgtcggacaagcagtgctggacaccctggagggagccctgcaggcctcagacgctgctgctcccgcgcgctttctcgaggctgggtcacggctaggtcctgactccctcgctctcgctttggatcgggcggttggcggtcgccggccttcagcgcctatgacaagagaagaatttctggaaagagccgcggcattatttattgcgaaggtcaagccagtgggctag

SEQ ID NO: 15008 - DNA, 1221 bp, Artificial Sequence
  Description of Artificial Sequence: Synthetic coding sequence
atggccgattcccagctgttctgtgtcgccgaagaacgctcagggcactgcgcagtggtagacgggaattttctctacgtgtggggcggatatgtaagtatcgaagacaacgaagtgtacctccccaacgacgaaatttggacttatgacattgattccgggctgtggaggatgcatctgatggaaggcgagctgccagctagtatgtctggcagctgcggcgcttgtattaacggaaaactatatatatttggtggttacgacgacaagggctactccaatcggctgtattttgtaaacttgaggacccgcgatgagacctacatttgggaaaaaattacagacttcgaaggccagccaccgaccccccgtgataagttaagctgctgggtgtataaagatcgattaatttattttgggggttatggatgccggagacacagcgagctgcaggattgttttgatgtgcacgatgcaagttgggaggagcaaatattctgggggtggcacaacgacgtccatatctttgacacaaagacccagacctggtttcagcctgagataaaggggggagtgcccccccagccgcgtgcagcacacacatgtgcggtgcttggaaacaagggctatatttttggcggtcgcgtcttacagacacgcatgaacgacctgcattatctgaatctcgacacctggacttggtccggtaggatcaccattaacggagagtccccaaagcataggtcctggcacacactaactccaattgcagatgataagctctttttatgcggggggctgtctgccgacaacatccccttgagtgatggctggattcataacgttactacaaactgctggaagcagttaactcatcttcctaaaactagaccccgcttgtggcacaccgcatgcttgggaaaagagaacgagattatggtttttggagggtctaaggacgatctgctagcactagataccggtcattgtaacgacctcctgatatttcaaacccagccctacagtttgctgcgcagctgtctggattgtattggcaaaaattccataatgttagaatcccagataagcctgctgcctcctaagctgttgcagcaggtgttgaagaagatcacattctgggccgccgccaatcatagagaggagcagcgggtgcagaaggaggaaaccgagaacaagtaccagtggatcagcagtaattag

SEQ ID NO: 15009 - DNA, 1113 bp, Artificial Sequence
  Description of Artificial Sequence: Synthetic coding sequence
atggttcaaccatttacaaccatccctttccctccacctccgcagaatggcattcctaccgagtacggagtcccccatacgcaggattatgctggccagactggcgagcataatctgactctctatgggagcacccaggcacacggcgaacaaagctccaattctccatcaacgcagaatggctccttaactactgagggcggcgcccagaccgacgggcagcagtcacagactcagtcatcggaaaactccgagtctaaaagtacgcccaaacgtctgcatgtttctaacatcccttttaggtttagagacccagatctccgtcagatgtttgggcagttcggtaaaatcctggatgtggagattatatttaacgagagagggagtaaagggtttggttttgttaccttcgagaattctgccgatgccgaccgggccagggagaagctgcacggtacggtggtggaggggcggaagatcgaggtgaacaatgccaccgcccgggtgatgactaacaagaagatggtgacaccttacgccaacggctggaaactgagccccgtcgtgggagccgtctacggaccagagctgtacgccgcatctagcttccaggcagatgtaagcctcggaaatgatgccgcagtgccactgtccgggcggggcggaattaacacttacattcccctcatcattcctggttttccatatcctaccgcagcgactacagccgcagcctttcggggcgcccacctgcgaggacgcgggcgcactgtgtacggggccgtgcgggccgtgcccccaaccgctattccggcctaccccggcgttgtctatcaggatggattttatggcgccgacctgtacatcgaaagtgctaattgtttcaggagcaaccgggtggatatgcagccaactgacatgcactctttgctgctgcagcctcagccgccattactgcagcctctgcagccgctcactgtgacagtcatggctggctgtacccagcccacccctacgatgcctttgccacttcccctcgccatggagttagccctttggagggtgtacacggaagtagcaaccgccgatctaccacctaccgaagtgacatag

SEQ ID NO: 15010 - DNA, 534 bp, Artificial Sequence
  Description of Artificial Sequence: Synthetic coding sequence
atgtctgaagattcagagaaggaggattacagcgaccgcacgatttccgacgaggacgagagcgatgaagacatgttcatgaaatttgtcagcgaagatctgcacagatgcgcattactgacagcggactcatttggcgatcccttctttccccgcacaactcagattctccttgagtatcagttgggacgttgggtgcccagactccgcgagcccagggatctttatggcgtgtcatcctccggcccattgtctccaacaaggtggccttaccattgcgaagtgatcgatgaaaaggtccagcacatcgatggggtatcatgctggagtgagagccaccaagccggagcacaatggtgcgacctcggatcgctccagccccctccaccgcgattcaaaagattcgcttgcttcagtctgctctcgtcacgagattataggcgtgtacctccgaggtcagcaaacttcgttttcttggtggagaccggctttcatcatgtgggccaagacgggctgcgccttctcacaagttag

SEQ ID NO: 15011 - DNA, 1827 bp, Artificial Sequence
  Description of Artificial Sequence: Synthetic coding sequence
atgtcagacaagagcgatctgaaggctgaactcgaaagaaaaaagcagcgcctggctcagataagggaggagaagaaacgaaaagaggaagagcggaaaaagaaggaagctgatatgcagcagaaaaaggagccggtccaagatgacagtgatctggatagaaaacgcagagaaacggaggctctgcttcagtccataggcatcagcccagagccacccttggtgcctacgcctatgagcccatccagtaagagtgtgtcgacaccgagtgaagccggttcccaagactcaggcgacctcggtccgctgacgagaaggcgtctgcacaaattgggtgtgagcaaagtgactcaggtcgactttttgccccgggaagtggtgtcctatagtaaggaaacccagactcctctagctacacaccagagcgaagaagatgaggaagacgaggagatggtcgagtctaaagtcggtcaggattccgagcttgaaaatcaagataaaaagcaggaagtgaaggaagccccgcctcgtgagttgaccgaagaagagaagcagcagatactccactcggaagaatttctaattttttttgaccgaactatcagggttatcgaacgggccctcgccgaggacagtgatatcttctttgactatagcggtcgcgaattggaggaaaaggacggcgatgtgcaggccggtgcgaatttgtcatttaataggcagttctacgatgaacattggagcaagcatcgcgtcgtgacctgcatggattggagcttgcagtaccctgagctcatggtcgccagttataacaacaatgaagacgctcctcacgagccagatggcgtagcgctggtttggaacatgaaatttaaaaaaacaacccctgaatatgttttccactgccagagttctgtgatgagcgtctgctttgcccgcttccacccgaatctcgtggtagggggtacgtatagcgggcagatcgtgttatgggataaccgatcgcaccgcaggactcccgtacagcgtacaccactctctgccgctgcccatacccaccccgtgtattgcgtaaacgtggttgggacgcaaaatgcgcataatctaatcaccgtgtcgactgatggcaaaatgtgctcctggagtctggatatgctgtccactccacaggaatctatggagctggtgtacaacaagtcaaagcccgttgccgtcaccgggatggcctttccaaccggcgatgtcaacaactttgttgttgggagcgaagagggcacggtttacactgcttgccgccatggctccaaggccggaataggagaggtgttcgagggacatcagggcccagtgactggtattaattgccatatggccgttggacctatcgacttcagccatctcttcgtgaccagctcattcgactggaccgtcaagctatggacaaccaaacacaacaagccactgtatagcttcgaggataacgccgactacgtgtacgacgtcatgtggtctcctgtgcaccccgccctgttcgcttgtgtagatgggatgggaaggctcgatctttggaatctgaataacgatacagaggtcccaacagcctctgtggctatagaaggcgcctcggccctaaaccgggtccggtgggctcaagctggcaaagaagtggctgtcggggatagcgaaggacgcatttgggtttacgacgtcggtgagctggccgtacctcacaatgatgagtggacccgattcgcaaggaccttagtcgaaatcagggctaaccgggccgactctgaggaggaggggacagtcgagctgagcgcttag

SEQ ID NO: 15012 - DNA, 627 bp, Artificial Sequence
  Description of Artificial Sequence: Synthetic coding sequence
atggagggggctgctgccccagtggctggggacagacccgatctggggctgggcgcgcccggttctccccgagaggccgtcgctggcgcaactgctgctctggagcctaggaaaccgcacggcgtcaagagacaccaccacaaacacaacttgaaacatcgctacgaattacaggaaactctgggcaagggcacatacggtaaagtgaagcgcgcgacagaacggttttccgggcgggttgtggctatcaaatcaatcaggaaggataagatcaaagatgagcaggacatggtgcacatcaggcgggagattgagatcatgagttcattgaatcatcctcacattatatccatttacgaagtgtttgagaataaggacaaaattgtgataattatggagtatgcaagtaaaggcgaattgtacgattacatttccgagcgcaggcgactgtctgaaagggaaactcgccactttttccggcaaatcgtgagcgcggtgcactactgtcataaaaatggtgttgtgcaccgagatctgaaattgaaaagaccgtcaagggagaaccaagtgaccacactgccacaatcagcagtctctctgaggagttgctggactgtgatgatgtag

SEQ ID NO: 15013 - DNA, 990 bp, Artificial Sequence
  Description of Artificial Sequence: Synthetic coding sequence
atggaagtggctgagccatcgagccccaccgaggaagaagaggaggaggaagaacactcggcagagccacggcctcggacccggagtaaccctgaaggggcagaggatcgggccgttggcgcgcaggccagcgtgggatcccgaagtgagggagagggtgaggctgcgtcagcagacgatgggtcactgaatacatccggcgctggccccaaaagctggcaggtgccaccacctgcgccagaggtgcagattcgcactccacgggtgaattgccctgaaaaggtcatcatatgcttggacctgagcgaagaaatgtctctgcctaaactcgagtccttcaatggtagcaagactaatgcactgaacgtgtcccaaaaaatgatcgagatgtttgttcgcaccaaacacaaaattgacaaatcgcatgagtttgctctcgttgtggtgaatgatgatacagcctggctatccggcctcactagtgaccctcgcgagttatgctcatgtctttacgatctggaaaccgcgagttgttctacatttaacctggagggcttattctcccttatccagcagaaaaccgaattgcccgtaaccgaaaatgtgcagaccattccccctccttatgtggttagaaccattctagtatacagcaggccaccctgtcagccacagttctctctgaccgagcctatgaaaaagatgttccagtgtccttatttcttcttcgatgtggtgtatatccataatggaaccgaagagaaggaggaggaaatgtcatggaaggatatgttcgcctttatggggtcactggacacaaaagggacctcctacaaatacgaggtggccctcgccggacccgccctcgaactgcataactgtatggcaaagctgcttgcccacccccttcagagaccttgccagagtcacgcctcctattcccttctcgaggaggaagatgaggcaattgaggtggaagccacagtgtag

SEQ ID NO: 15014 - DNA, 885 bp, Artificial Sequence
  Description of Artificial Sequence: Synthetic coding sequence
atgtcccaaccagccggagggagaagaaagccccggactttggggccccccgtgtgttccatcaggccttttaagtcttcagaacagtacctggaggcaatgaaggaggacctcgccgaatggttaagagatttatatgggcttgacattgacgccgcaaacttcctgcaggtcctcgagaccggcctggtcctttgccaacacgccaatgtcgtgaccgatgccgccttggcgtttctggccgaagccccagctcaagcacaaaagattccaatgccaagagtgggcgttagctgtaatggagccgcacagccagggacgtttcaggcacgggataacgtgtctaactttattcagtggtgcaggaaagaaatgggaatccaggaggtgcttatgtttgaaacagaagatttggtgttgcggaagaacgtgaagaacgtcgtgctgtgcttactggagcttggccgacgggcctggcgcttcggggtcgccgcccccaccctggtccagttggaggaagaaatcgaggaagaagtgagacgcgagctggccctgccgccccttccccaacctggccctgacggcgctgaaccctgcgaacccctgcatgtcccttctgcggtcctccacgggcagagcgtttacgtttttctggggcctgcaaggcagccccctaaagatagactgttgcgcgctgtgttaggctcaaagggaggtgaggcttcacgggtcgatggagccagtgtgggcgaagaagaggaagagggaaaggaggaaaaggagccagccgctcccctggagagttctccgcagccaccagagggcctgcagcctcattggctcaatcaagcacctctgccacctgaggaagagtcttgggtgtag

SEQ ID NO: 15015 - DNA, 1554 bp, Artificial Sequence
  Description of Artificial Sequence: Synthetic coding sequence
atggagaccgaccttaattcacaggatcgcaaggacctggacaaatttataaagtttttcgcgttgaaaaccgtacaagtaatagtccaggccagattgggggaaaagatttgtacccgttccagcagctctcctacaggatcagactggttcaacctggctatcaaggatatacccgaagtgacacatgaggccaagaaggccctggcgggccagctcccagccgtggggcgaagcatgtgcgtggagatttccttaaagacaagcgaaggagacagtatggaactggagatttggtgtctggagatgaatgaaaagtgcgacaaggagataaaagtttcctacaccgtatataatcggctcagccttctgcttaagagtcttctggccatcacacgcgtcacaccggcttataggctttctcggaaacagggacatgaatacgtcatcctctaccgaatctacttcggagaggttcagctgtctggactgggtgagggcttccaaactgtccgagtaggcaccgttggtactcccgtcggcaccataacactgagctgcgcataccggattaacctcgcttttatgtcgacccgtcagtttgagcgaacccccccaattatgggcattattatagatcactttgtggacaggccctacccctccagcagccccatgcacccatgtaattaccgtactgcaggcgaagataccggggtgatctatcctagtgtcgaagactctcaggaggtgtgtactacgagcttttccacatctccaccgagtcagttgtcatcttcaagactgagctatcagccagcagcactgggtgtggggtccgcggatctcgcctatcctgttgtcttcgccgccgggctcaacgccacccatccccaccagctgatggtgcctggtaaggagggaggagtgcccctagcacctaatcaacctgtgcacggtacacaagcggatcaagaacggttagccacctgcactccgtctgatcgaacacattgtgccgctactccgagctccagtgaggataccgagaccgtaagcaatagtagtgaggggagggcttcgccgcatgacgtgctcgagactatattcgtgcgcaaagtcggcgcgtttgtcaacaaaccaataaaccaggtgacactgacaagcttggacatccccttcgctatgttcgcccctaaaaatcttgagcttgaggataccgatcctatggtgaacccgcctgatagccctgagaccgagtcacccctgcagggaagcctccactcagatgggtcaagtggaggctcttcgggcaatactcacgacgacttcgtgatgatcgatttcaagcccgccttttccaaggatgacatactgccaatggaccttggcaccttctatcgggaattccagaatcctccccaactgagctctctctccatcgacataggcgcacagagtatggccgaggatctcgatagcctcccagagaagctggccgtccatgagaaaaatgtccgggaattcgatgcttttgtggagacactgcaatag

SEQ ID NO: 15016 - DNA, 951 bp, Artificial Sequence
  Description of Artificial Sequence: Synthetic coding sequence
atggctacttttgttgagttaagtacaaaggctaagatgcccattgtggggctcggaacttggaaaagccccctgggcaaagtaaaagaagccgtcaaagtggcaatcgatgccggctaccggcatattgattgtgcctatgtgtatcagaatgaacatgaggttggggaagccatacaggaaaagattcaggagaaagctgtgaagcgagaggatctgttcatcgtgtcaaagttatggccaacctttttcgaacggccactggtgcggaaggcatttgaaaagactctgaaagacctgaaattaagttaccttgacgtctatttgattcactggccgcagggcttcaagagtggcgacgaccttttcccaaaggatgacaaaggaaacgctatcggaggaaaagctacgtttttagacgcctgggaagctatggaggagttggtcgacgaaggattggtgaaggcattgggagtcagtaacttcagtcactttcagattgaaaagctacttaacaagccggggctgaagtataagcccgtgacaaatcaggtggagtgccatccctatctcacccaggagaagttgattcagtactgccattccaaagggattacagtgaccgcctactcacctctaggcagccctgatagaccttgggccaagccggaggaccccagcctactcgaggaccccaagatcaaagagatcgcggccaagcataagaaaacagccgcccaggtcttgattcgcttccacattcagcgaaatgtgatagtcattccaaagagcgtgaccccagcccggattgttgaaaatatccaggtgttcgattttaagctcagtgacgaagagatggccactatcctgagctttaatagaaactggagggcgtgcaacgtgcttcagtctagtcatctggaagactatccctttaatgccgaatactag

SEQ ID NO: 15017 - DNA, 8274 bp, Artificial Sequence
  Description of Artificial Sequence: Synthetic coding sequence
gagccaaaggtagtgtttgcgaaagagcagcctgtccacagagaggtccaggcgcaggcaggagcctccacgaccctgagctgtgaagtggcccaagcgcagacagaggttatgtggtataaagacggcaagaagctttccttcagctccaaggtgcgcatggaagcagtcgggtgtaccaggcgcttggtcgtccagcaggccggccaggccgtagccggagagtacagctgtgaagccgggtctcagagactctcctttcaccttcatgtcgccgaaccaaaggccgtcttcgccaaggagcagccagcccacagggaagtgcaggccgaagccggggccagcgcgactctgagttgcgaggtggcccaagcgcagacagaagtgacttggtacaaggacggtaaaaaactgagctcatcactgaaagtgcatgtagaagccgccggatgtactagaaggctcgtagttcagcaagcaggacaggccgatactggagaatacagttgcgaggctggtgggcagcagttatcctttagactccaggtagccgaacctaaagctgtcttcgctaaggaacaaccagcttcccgcgaggtccaagccgaggccgggaccagcgctactctatcctgtgaagtggcacaagcccagaccgaagtgacctggtacaaagatggaaaaaagttgagcagctccagcaaagttagaatggaggcggtgggctgtaccagacgtctcgtcgtgcaggaagccggccaggctgatgccggcgagtatagctgcaaggccggtgatcaacgattgtcattccatctgcatgtagccgagcctaaggtagtttttgctaaagaacagcctgctcaccgagaagttcaggctgaagctggcgccagtgctacactcagttgcgaggtcgctcaggcccagactgaagtgacatggtacaaggacggcaagaaactctcttcgtctagcaaagtgcgggtggaagctgtcggctgtactcggaggttggtggtccaacaggccggacaggcagaggctggcgaatactcatgcgaggctgggggccagcagcttagcttccggctacaggtggccgaacctaaagctgtctttgctaaggaacaggtcgtgttcgcgaaggatcagcctgtgcatcgggaggtgcaggcagaggctggaacatctacgatgctgtcttgcgaagtcgcccaggcacagaccgaggttatgtggtataaagacggaaaaaaactcagttcctcaagcaagatgagagtggaagcggtggggtgcactcgccgcttagttgtgcaggaagcaggccaggctgacgctggagagtactcatgtgaggcgggagggcagcgcctctcctttcatctgcacgtggcggagcccaaggtggtgttcgctaaggaacagcccgcttgcagggaagtgcaagcagaggcaggtgcctccgctaccttatcctgcgaggtggcacagggccaaatggaggtcacctggtataaagatggcaaaaaactgtcaagctccagcaaggtccacatggaggccagcggctataccaggcgcctcgtggttcagcaggcaggacaggctgacgctggcgagtattcctgcgaggctggaggccaaagattatccttcagactccacgttgccgaactagagccccagatttctgaacgaccgtgcaggcgcgagcctttggttgtgaaagaacacgaggacatcattttaacagcgacgttggctactcctagtgccgccactgtgacatggctgaaagatggcgttgagatccgacgttccaagagacatgagacagcttcccagggggatacacatacactcactgttcacggggctcaagtgttagattccgccatctactcttgcagagtaggtgcagagggccaagattttccagtacaggttgaggaggtggccgctaaattctgccgcctattggagccagtctgcggtgaacttggcggaactgttacgctggcctgtgagctcagccccgcgtgtgcagaagtcgtctggcggtgcgggaacacccagctgagagtaggtaagcgatttcagatggtagctgaaggcccggtgagatccctgaccgtgctgggtctgcgggccgaagacgcaggagagtatgtttgcgaaagccgtgacgaccatactagcgcacagctcactgtcagcgtgccacgcgtcgttaagtttatgtcaggactctccaccgttgttgctgaagaggggggcgaagcaacttttcagtgtgtggtaagccccagcgatgtggctgttgtatggtttagagatggggcgctgttgcaaccgtcagaaaagttcgccatttcacaatctggcgccagtcactccctaaccatatccgacctggttcttgaggacgccggccagattaccgtcgaggctgaaggggcctcgagttccgccgccctgagggtacgggaggcacctgttctgtttaagaaaaagttagaacctcagaccgtggaggaacgctcctccgtcacactcgaagtggagctgaccaggccttggcccgaactccgatggaccaggaatgccacagcgctggcccccggcaagaacgtggagattcacgcggaaggtgccaggcaccggttggtgctgcataacgtgggcttcgccgaccgtggctttttcgggtgcgaaaccccagacgacaaaacacaggccaagctcacggtggagatgcgccaggtacgtctggttcgaggattacaggctgtcgaggctagagagcaaggcaccgctactatggaagtgcagctgtcgcacgccgatgtagacggaagctggacacgggacggcctgagatttcaacaggggcctacctgtcacctggccgtgcgcggccctatgcacacattgaccctgtcgggacttcgccctgaagacagcgggctaatggtgtttaaggccgagggcgtgcatacgagtgcaagactggtcgtgaccgagcttcctgtttccttctcccgaccgcttcaggatgtggtgactactgagaaggagaaagtcactctggagtgcgaactgagccgtccaaatgtggacgtgcgctggctgaaggatggtgttgaacttagggccgggaaaaccatggcgatagcagcccaaggagcgtgccgcagtctcactatttaccggtgtgagtttgctgaccagggtgtttacgtgtgtgacgctcatgatgctcagtcttcagctagcgtgaaggtccaaggaaggacatatacactgatatacagacgcgtgcttgcggaggacgccggggaaatccaatttgtggccgagaatgccgagtctcgcgcacagctcagagtgaaagaactgcccgtgacactagtgaggcccttgcgggataagatcgctatggagaagcataggggagtgttggagtgccaagtgagccgcgcttcagcacaagttagatggtttaaaggtagccaggagttacaaccaggaccaaaatatgaactggtgagtgatggactctaccgcaaactcatcattagtgacgtgcacgcagaggacgaagatacatacacatgcgacgccggagatgttaagacatcagcacagttcttcgtcgaggagcagagcattaccattgtccgcggtcttcaggacgtgacagtcatggagcccgcccctgcgtggtttgagtgcgagacttcaattccgtcagttaggccacccaaatggttactcggtaagactgtcctacaggcaggaggtaatgtgggcttggaacaggaggggacagtgcaccgcctgatgcttagacggacatgcagtaccatgaccggccccgtgcacttcacagtgggaaaatctcggtcgagtgcccgcctcgtcgtgtctgatatccccgttgtgttaacccgcccgctggagccaaagaccgggcgcgaactacaaagtgttgtgctgagctgtgacttccgccctgctcccaaagctgtgcagtggtataaagacgacacacccctgagtccaagcgagaagttcaagatgtcccttgaagggcagatggcggagcttaggattctgagactcatgcccgctgacgctggtgtgtatcgatgtcaggcgggatctgctcacagcagcactgaagtgaccgtggaagctagggaagtcaccgtgactggtcccctccaagacgccgaggccacggaggaaggatgggccagtttctcttgcgaactgtcgcacgaggatgaagaggttgagtggagcctgaatggcatgcctctctataacgacagcttccacgagatttcccacaaaggacgccgccatacactcgtgctgaagtctatccaacgagctgatgccggtatcgtgcgggctagctctctgaaggtgagcacttccgctcgactcgaggtgagagtaaaaccggtagtttttttaaaagcccttgatgatttgagcgccgaggagcgaggaactcttgcactacaatgcgaggtgtcagaccccgaggcgcatgtggtctggaggaaagacggggtgcagctgggcccctccgacaaatacgacttcctacacacggctggcacccggggcctggtggtccatgacgtgagtcccgaggacgcaggcctgtatacatgccacgttgggtctgaggaaacaagggcacgcgttcgggtgcacgatttacacgttgggatcacgaaacggttgaagacaatggaggtgctggaaggagaatcttgttcttttgagtgtgtgttgtcccacgagtctgcttctgatccagccatgtggacagtgggaggaaagacagtgggttcatcttctcgtttccaggcaacccgtcaggggaggaagtacatcctcgtcgtgcgggaagctgctccctccgatgccggggaagtggtattctccgtaaggggcttgacatctaaagcttctctgatcgttagggaacgacccgcggctatcattaagcctctggaggatcagtgggtggctccaggtgaggacgtcgaactgagatgcgaactatcccgggctggtacgcccgtgcactggcttaaggacagaaaggcaatacgaaaatctcagaaatacgatgtggtatgtgagggcacaatggccatgctggtgattcggggcgcctccttgaaagatgccggagagtacacctgcgaagtggaagccagcaagtctacagcaagcctccacgtggaggaaaaagccaactgtttcaccgaggaactgactaacctgcaagtggaagaaaagggaaccgccgtctttacctgcaaaaccgagcaccctgccgcaacagtcacctggagaaaggggctgttggaactccgtgccagcggtaaacaccagccctcccaggagggcttgacactgcggctgacaatatcagccctggaaaaagctgatagtgacacctacacgtgtgacattggacaggcacagtcacgcgctcagctactcgtccagggacggcgggtgcacatcatcgaggatctggaggatgtggacgtccaggaagggagttctgccacattcagatgccgaatttcaccggcaaattacgagcccgtccactggtttctggacaagacccccctccacgctaatgaactgaacgaaatcgacgctcaaccaggcggttatcatgttctcactttgcggcagctggcgctgaaggattccgggactatctacttcgaagccggggaccagagggccagtgcagctctacgcgtcactgagaaaccctctgtcttttctcgggagttaaccgacgccaccattacggaaggcgaggacctgactctcgtgtgtgagacttccacctgcgatattccagtgtgttggacaaaggatggaaagacgttgcgcggaagcgctaggtgccaactatcccacgagggccaccgggctcagctgctgataaccggagctacattgcaggactccggccgatacaaatgtgaggctggtggagcgtgttcctcgtcaattgtgcgtgtccatgcaagacccgtacgtttccaggaagccctcaaggatcttgaggtgctggaagggggagcagccacccttcggtgtgtcctgtcatctgtggcagcccctgtaaagtggtgttatggcaacaatgtcctccgccccggggacaaatattccttaaggcaggaaggtgccatgctcgagctggtggtgagaaatctccggcctcaggattcagggagatactcttgctctttcggagatcagacgacatctgctaccctgaccgtgacagccctgccagcgcagttcattggcaagctccgtaacaaggaggccaccgagggagcaactgcgacactacggtgtgaacttagcaaagctgcgccggtcgaatggaggaaggggagtgaaaccttaagggatggggacagatactgtttacgacaggatggcgcgatgtgtgaactccagattagaggactcgccatggtagatgcggccgaatacagttgcgtgtgtggcgaggaacgcacgtcggcatcacttacaatccgacctatgcctgcccattttattggaagactgcggcatcaagaaagcatcgagggggcaacggccacgcttcgatgcgagctgtctaaggcagcacctgtggaatggcggaaaggacgggaaagtttgcgtgatggggatcgccacagtctacggcaggatggcgccgtctgtgagctccagatctgtggtttagcggtggccgacgccggtgaatatagctgtgtgtgtggggaagagagaacctcagctactttgacagttaaggcgttgcccgcaaagtttacagagggccttcgcaacgaggaagctgttgagggggccacagccatgctgtggtgtgaactgtcaaaggttgcccccgtcgagtggcgtaaaggacctgaaaatctgcgggacggcgatcgctatatcttgcgacaagaagggacccgctgcgagctgcagatatgcggactcgccatggcagatgcgggggagtatttgtgcgtctgtggccaggagaggaccagcgctactctgaccattagagctctgcctgcacgattcatcgaagacgtcaaaaaccaggaagctagggaaggggcaaccgccgtgctgcagtgcgaacttaattccgccgcacccgtcgagtggcggaagggctctgaaaccctgcgggatggggacaggtacagtctgcgacaggatgggactaaatgcgaactccaaattcggggtctcgctatggcagacactggagagtattcttgcgtgtgtgggcaggagcgcacctcagcgatgctaacagtgcgagccctgcccattaagttcacggaggggcttaggaacgaagaggccactgaaggggccacagctgtgttacgatgtgaattgtctaaaatggccccagtggaatggtggaagggacacgaaaccctacgggatggggataggcactctttgcgccaggacggtgcccgctgcgagcttcaaatcagaggactggtggctgaggacgccggcgaatacctctgcatgtgtggcaaagagcgaaccagcgctatgctgaccgtgcgcgccatgccgtccaaattcattgagggattgagaaacgaggaggccacggagggtgatactgcaaccctttggtgcgaactatccaaggctgcgcccgtggagtggcggaaagggcacgaaaccttacgggacggggatcggcactctcttcggcaagacggcagtcggtgcgagctccagattagaggcctagctgtagtggacgctggagagtattcatgcgtgtgcgggcaggagcgaactagtgcgaccctgaccgtaagggcgctgccagcccgatttatagaagatgtgaaaaaccaagaggcgagagaaggtgccaccgctgttcttcaatgtgagctttccaaagccgcacccgtggagtggcgtaaaggaagtgagactctgagaggcggtgacaggtactcattgcggcaagacgggacaagatgtgagctgcagatccatggcctgtctgtggcggacactggcgaatactcctgtgtgtgcggccaggagagaacaagcgcaacactgaccgtgcgggcgcttccagccaggcattcaaggtccgaggatcaaggtggccttcggagaggacacagctacacagccgtatag

SEQ ID NO: 15018 - DNA, 1449 bp, Artificial Sequence
  Description of Artificial Sequence: Synthetic coding sequence
atggtcatggaaaaaccttcaccgctcttggtgggtagagaattcgtgcgtcagtactatacgctgcttaacaaagcaccagagtaccttcatcgtttttatggccgaaattccagctatgtgcacggcggagtagatgcgtccggcaagccacaggaggctgtttacggccagaacgatattcatcacaaagtcttgtctctgaactttagcgagtgccataccaaaatcagacatgttgacgcccacgctactctctctgatggagtggttgtacaggtgatggggcttctcagcaatagtgggcagcctgaacggaagtttatgcaaacgttcgtactcgcaccagaaggctccgtgccaaacaaattttacgttcacaacgatatgtttcggtatgaggacgaggtctttggcgatagtgaacctgaacttgatgaagaaagcgaagacgaggtggaggaagagcaagaggaacggcagccatcacctgagcctgtgcaggagaacgccaactcggggtactacgaagcccaccctgtaactaatggcattgaggaacccctcgaggagtcatcacacgagcccgaacccgaaccagaatcagagactaaaactgaagaactaaagccccaggtggaagaaaagaacttagaggaattagaagagaaaagcactacacccccacccgccgaacctgtgtctctgcctcaagaaccacctaaagccttcagctgggccagcgtgacaagtaagaacctgccacctagtggcaccgtctcgtctagtggaattcccccccacgtgaaggcaccagtgagccaaccccgcgtagaggctaagcctgaggtccagtctcagccccctcgggtgcgagagcaacgccccagagagaggcccgggttccccccacgcggaccccggcctgggcggggcgacatggaacagaacgatagtgataacagacgaattattagatatcctgattcccatcagctgtttgtggggaatctgcctcacgacattgacgagaatgagttaaaggagttcttcatgtcctttggtaatgtggttgaactgcgaatcaataccaagggcgtcggaggaaaattacccaattttggatttgttgtgtttgatgattcggagccagttcagcgtatcttaattgccaaacctatcatgttccggggcgaagtacgcctaaatgtcgaagaaaaaaaaacccgcgcagccagagaacgcgaaacgcgcggcgggggcgacgatcgccgcgacattagacgcaatgacaggggccccggcgggccccgaggtatcgtcggaggaggcatgatgcgggaccgcgacggccgcggcccgcccccccgcgggggcatggcccaaaaactcgggagcgggagaggaaccggccagatggaaggcagatttacaggccaaagaagatag

SEQ ID NO: 15019 - DNA, 807 bp, Artificial Sequence
  Description of Artificial Sequence: Synthetic coding sequence
atgtctgggaggaaacgatcattcacattcggggcttatgggggagttgataaaagttttacctcccgacggtccgtatggcgatctgacggtcagaatcagcatttcccacaggctctagaccttagcagggtgaatcttgttccatcatacacaccttcactatatccaaaaaataccgatcttttcgagatgatcgaaaaaatgcagggcagtcgcatggacgagcagcggtgtagcttccctccccctctcaaaactgaggaagactatattccttacccctccgtccacgaagtgctggggcgggaaggcccctttccactcatcttgctgcctcaatttgggggttactggattgagggcaccaaccacgagattacaagcattccagaaacagagcccttacagtcgcccaccactaaagtgaagcttgaatgtaatccaactgctcggatctacaggaaacacttcctgggaaaagagcattttaactactatagcttggacgctgctctggggcacctcgtgttcagtctgaagtacgacgtcattggtgatcaagagcaccttagactcttgctacgtacgaaatgtcgaacctaccacgacgtgatccccattagctgcctgaccgagtttccaaacgtggtacaaatggccaaactggtgtgtgaggatgtaaacgttgaccggttttatccagttctgtatcccaaggctagtcgcttgattgtcacctttgatgagcacgtgatatcaaataacttcaaattcggcgtaatctatcagaaacttggacagtag

SEQ ID NO: 15020 - DNA, 606 bp, Artificial Sequence
  Description of Artificial Sequence: Synthetic coding sequence
atgtacacattactctccgggctgtataaatacatgtttcagaaggatgaatattgcatcttaatacttggcctggacaatgctggtaagaccacctttctggaacagtccaaaacacgttttaacaagaactataaaggtatgagtctcagcaagatcacgacaactgttggcctaaatattgggaccgtcgacgtgggaaaggcacggctgatgttctgggatctcggcggtcaggaagagctgcagtcactgtgggataagtattacgcagagtgccatggcgtaatttacgttatcgattccacagatgaagaacggctcgccgagtccaaacaggccttcgaaaaagtggtaacgtcggaagcactgtgcggagtgccagttctcgttttggccaacaaacaagatgtggaaacatgcctgagcattcctgacatcaagaccgctttctcagactgcacgtccaaaattggccgaagagattgtctaacgcaagcttgttctgcattgactgggaagggggtgcgggagggcatcgagtggatggtgaaatgcgtggtgcgtaatgttcacaggccacctcgtcagagggacattacctag

SEQ ID NO: 15021 - DNA, 1707 bp, Artificial Sequence
  Description of Artificial Sequence: Synthetic coding sequence
atggggctgctcacgtttcgggatgtggctatagagtttagtttggaggagtggcaatgcttagatacagcacagagaaacctgtacaagaatgtgatcctcgaaaactatcgcaacctggtgttcttaggcatcgctgtctcaaaacaggacctgattacttgcctggaacaggagaaggaacctctgacagtgaaacggcacgagatggtcaatgagcctcccgtgatgtgcagccacttcgcccaagagttctggccagagcaaaatatcaaagattcctttgaaaaagtgacacttcggcgatacgaaaaatgtggtaacgacaattttcaactcaaaggctgcaagagcgttgacgaatgtaaactgcacaaggggggttacaatggcctaaaccaatgcctccccactatgcagtctaaaatgttccaatgtgacaaatacgttaaggtgtttaacaagttcagtcacagcgaccgacataaaatcaagcacatggaaaataagcccttcaaatgtaaagagtgcggcagaagcttctgtatgctcagtcacctgactaggcatgaacgcaattacacaaaagttaatttctgtaaatgcgaagaatgtgagaaggctgtgaatcaatccagcaaactgaccaaacacaagcggatctacacatgcgagaagctctacaagtgtcaggagtgtgatcgtacatttaaccagttttcaaacttgactgagtataaaaaagattacgcacgcgaaaaaccttacaagtgtgaggagtgcggcaaggccttcaatcagtccagtcatctaaccacgcataaaatcattcacactggcgaaaagccatataaatgcgaagagtgcggcaaagcttttaaccagttttcgaaccttactacgcacaaaaaaattcatacaggcgaacagccctacatatgtgaggagtgtggcaaagcttttacccagtcctcaacactgacaactcataagaggatacataccggtgaaaagccctataaatgtgaagaatgcggcaaagcgtttaatcggtcttctaaactgactgagcacaagaatatccatacaggggagcagccttataaatgcgaagaatgcggtaaagctttcaatcgcagttctaacttgactgagcacaggaaaatccacacagaggagaagccttacaagtgcaaagagtgcggtaaagcattcaaacactcctctgccctcacaacacataaaaggattcacaccggggagaaaccttacaagtgcgaagagtgtggaaaagcatttaaccgcagtagcaagttaacagagcataaaaagctgcacaccggcaagaagccctacaaatgtgaggagtgcggaaaggcatttatacagtccagcaaattgactgagcataagaagatccatagtggagagatcccctacaaatgcgaggagtgtggaaaggctttcaagcacagttcatccctcactacccataaacgcatacacaccggagaaaaaccctacaagtgcgaggagtgcggtaaggcattctcaagatcaagtaaactcacagagcacaaaattatacacacgggcgaaaagccttataaatgcgagcgctgtgacaaggcattcaatcagagcgcaaatctgacaaagcataaaaagattcatacgggggagaaacttcagaactggaacgtctag

SEQ ID NO: 15022 - DNA, 1383 bp, Artificial Sequence
  Description of Artificial Sequence: Synthetic coding sequence
atggatagcgaactcatgcacagcattgtgggcagttatcacaaacccccagaacgggtgttcgtgccgtcatttactcagaacgaaccttctcagaactgtcatcctgctaatctcgaggtgaccagccctaagatcctgcattcccccaacagccaggccctgattctggcactcaaaacgcttcaggaaaagattcatagattggagctggagcgtactcaggccgaggataatctgaacatactttcccgagaggccgctcagtataaaaaggctctggagaatgaaactaatgagagaaatctggcacatcaggagctaataaaacaaaagaaggacatcagtatccagttatctagcgcacaaagcaggtgcacacttctggagaagcaattggagtatacaaagcgaatggtgctcaatgtagaacgggagaaaaacatgatcctggaacagcaggctcaattacagcgggagaaggaacaagaccagatgaagctgtacgccaagctggaaaagctcgacgtgctagagaaagagtgtttcagacttactaccacgcagaaaactgctgaggataagatcaagcatctggaagagaaactcaaagaagaagagcaccagaggaagctattccaagataaagcttctgaacttcagacgggcctggaaatcagcaagataatcatgtcctccgtctctaatttaaagcactctaaggaaaagaagaagtcctccaaaaagactaaatgtatcaaacgaaggccgccctggcagatttgctctaaattcggtgccctcccgtttgtagccgaaaaaatgagacagcatcgcgatcctcatatcttgcagaaacctttcaacgtgacagagaccaggtgtttgcccaagcccagcaggactactagttggtgcaaggcaatccctcctgattctgagaagtccatcagtatttgcgacaacctgtccgagcttttgatggccatgcaggacgaacttgatcagatgagtatggaacatcaggagcttctgaagcagatgaaggaaacggagtcgcattcagtctgcgatgacatcgagtgtgagctagagtgcctgcttaagaaaatggaaattaagggagagcagattagtaaattgaaaaagcatcaggacagtgtctgtaagctgcagcagaaagtacagaatagtaagatgtctgaagcaagcggcatacagcaagaagattcatatcccaaaggatctaaaaacatcaagaatagtccacggaagtgcttgaccgataccaaccttttccagaagaactcgtcctttcatccgataagagtccacaacctacagatgaagttgcgcagggatgatattatgtgggagcagtag

SEQ ID NO: 15023 - DNA, 1833 bp, Artificial Sequence
  Description of Artificial Sequence: Synthetic coding sequence
atgagccaaacctccctgaaacagaaaaagaatgagcctggaatgcgctcttctaaagaaagcctggaggccgagaagagaaaagaatccgacaaaacaggtgtccggttgtcaaaccagatgagacgcgccgtaaacccaaaccattctttgaggtgctgtccatttcagggccacagttcctgcaggcgatgcctgtgcgcagccgaaggaacagccctgggcccgtgccatacaatcaggatctatatccacatgtgcctgctgtgggagcagggtcagcaaattacaatgatgcgagggtctcaggagagttcacttaggaagactgacagtagggggtatctggttaggtctcaatggtctagaatcagcagatctcccagtaccaaagcgccaagcatcgacgagccacggtctcgcaacaccagcgcaaaattgcccagcagctctacttctagccggacaccttctaccagtccgtcccttcacgattcctctccgcctccactttctggccagccatccctccagccgcccgcttctccacagctgcccaggagtctggattctcggccccccactccccccgagccagaccccggcagtcgacgctcaaccaagatgcaggaaaaccctgaagcttgggcgcagggtatagtgcgggagatcaggcaaactcgcgatagtcagcccctcgagtattccagaacttcccctacagaatggaagagcagtagtcagaggcgcgggatataccctgcctctacacagctcgacagaaattctctatctgagcagcagcagcagcagcgcgaggacgaggatgattacgaagcagcctactgggcatctatgcgctcattttacgagaaaaacccaagctgcagcaggccttggccacccaagcctaaaaacgccatcactattgctctgagtagttgtgccctcttcaacatggttgatggcaggaagatctatgaacaagagggcttggaaaaatatatggaatatcagttaacgaacgagaatgtgattctgacaccggggcccgcctttaggtttgtcaaagcattgcagtacgtgaacgctcggctaagagacctgtaccctgacgagcaggatctgttcgacatcgttcttatgacaaacaaccacgctcaggtcggcgtgaggttaataaattcagtgaatcattacggattgctcattgacagattttgtctcactggtggcaaggacccaataggctatctcaaggcctacctgacaaacctgtatattgctgctgactccgaaaaagtgcaagaagccattcaggagggcatcgcatccgctaccatgttcgatggagcaaaggacatggcatactgtgacacacagctgcgggtcgcgtttgacggcgacgccgtactgttcagtgatgaaagcgaacactttacaaaagagcacgggctagataagttcttccagtacgatacactctgcgaatccaaaccactggcccaggggccgctgaagggattcctggaagacctgggacgactccagaagaagttctatgctaaaaacgagaggctgctgtgccctatacgcacataccttgtgactgcgcggtccgccgcctcctcaggagctcgggttctcaaaaccctgagacgttggggactagaaatcgacgaggctctatttctggcaggagcacccaagagtccaatccttgtgaaaattcgtcctcatatttttttcgatgaccacatgttccacatcgaaggtgctcagagactggggagtatcgctgcatatgggtttaacaaaaaattctcgtcctag

SEQ ID NO: 15024 - DNA, 456 bp, Artificial Sequence
  Description of Artificial Sequence: Synthetic coding sequence
atgtccaaaaacaccgtgtcctctgctcgcttccgtaaggtcgatgttgatgaatacgatgaaaacaagttcgtcgacgaagaggacggcggcgacggccaggccgggcctgacgagggagaagtggattcatgcctgcgtcaggggaacatgacagctgcccttcaggcagcccttaaaaatcctcctattaatacaaaaagccaggccgttaaggaccgggcgggctccatcgtcctgaaagtgctgatctccttcaaagcgaacgatattgaaaaggcagtacagtccttggataaaaacggcgtggatctgctgatgaagtatatctataaaggatttgagtcaccttcagataatagttcagctatgctgttgcaatggcatgagaaggctctcgccgctgggggcgtgggcagcatagtaagggtgctgactgctagaaaaactgtctag

SEQ ID NO: 15025 - DNA, 3522 bp, Artificial Sequence
  Description of Artificial Sequence: Synthetic coding sequence
atggtgaccgtgggtactaatatcctcccatccaggcctgcagcatctgcgaacactgctcgagaagatgcagcacttttctcacgccgcataccgccccgccataagaacggagcagcccagccaggcgccgctcccggaccaggagcgcctggggcaaacatgggtaatgcccactccaaaagcggggaccggcactccgccctgcccggtaggccagaactcagcttctacggttcttttccgagaaaatggagtgaaaacgtgttcctggacaatgagctcttaacctccaagatcttatctgtccttaggcctcagtcagaacggggctttagagctggagatttgagatatccgacccactttttgtcaacaaatagcgtattggccagcgtcaccgcaagcctgaaggagcacccgaggggaacattgctttcagacggttcgccggctttatccaggaatgttggaatgactgtatcacaaaagggaggccctcagcccactccatcccctgccggtcccggcacccagctcggacccataaccggcgagatggatgaggctgatagtgcctttctcaagttcaagcagactgccgatgattccctgagcctgaccagccccaacaccgagtccatcttcgtggaggatccttacactgcttctctgcgttccgaaatcgagagtgatgggcacgagttcgaagccgagagctggtctttagctgtagatgcagcatacgcaaagaagcagaagcgagaagtcgtgaaaaggcaggacgtcctctacgagctgatgcagacagaggttcaccacgtcaggacactgaaaattatgctgaaggtgtatagcagggcactgcaggaagagctgcaattctcatccaaggcaattgggcgactgtttccgtgtgccgatgacctgttggagactcacagccactttctggccagactgaaggagcgacgccaagaatccctggaggaaggaagcgaccgcaattatgtgatacaaaagatcggtgaccttctcgtacagcagttcagcggcgagaatggcgaacgaatgaaggagaaatacggcgtgttctgttccggccataacgaggcagtgagtcactacaagctcctgcttcaacagaacaaaaagttccagaatctgataaagaaaattggtaacttctccattgtgagaaggctcggggtgcaagaatgcattctcttggtgacacaaagaatcacaaagtacccagtgctggttgagcgtattatccaaaatactgaggcaggaacagaggattatgaagacctgacacaggccctgaatctgattaaggacatcatttcccaggttgatgcaaaggtgagtgaatgtgaaaaaggtcagagacttcgggagatagccggtaagatggatctgaagtcctccagtaagctgaaaaacggcctgaccttcagaaaagaagacatgttgcagaggcagctccaccttgaggggatgttatgctggaaaacaacatccgggcgccttaaggacatacttgctatcctcctgactgacgttctcctcctgctgcaggagaaggaccagaagtacgtctttgcctctgtggatagcaagccccctgtgatctctctccagaagcttatagttagggaggtggcgaatgaagaaaaggccatgtttcttatttcggcatcacttcaaggacctgaaatgtacgagatttacaccagcagcaaagaagatcgaaatgcctggatggctcatattcagcgcgcagtagagtcttgccctgacgaagaggagggccccttttctcttcccgaagaggaaagaaaagtggtggaggcgcgagccactagactgcgtgatttccaagagcggttgtctatgaaggatcaactcatcgcccagtctctgttggagaagcagcaaatctatttggagatggctgagatgggaggtctggaggatctcccccaaccgcggggtctttttcgaggcggggatccctccgagaccctgcagggtgagctcatcctgaaaagcgccatgtctgaaatcgaaggcattcagtcactgatttgtcgccagttgggaagcgccaacggccaagccgaggatggtggttcatcaaccggtccgccaaggcgcgcagagactttcgctgggtatgactgtacaaacagcccaactaagaatggtagcttcaagaaaaaagtgtcatcaactgatccacgcccccgggactggagaggaccacccaatagccctgatttaaagctgagcgactctgacatcccaggcagctccgaggaatctccgcaggtggtggaggctcctggaacagagagtgatcccagactgcccaccgtgctcgaatccgagcttgtgcagaggatccaaactctgtctcagctgctgttaaatctgcaggcggtcattgctcatcaagacagctatgtcgaaacacagcgagccgctatccaggagagagagaagcagttcaggctccagagtaccagagggaacctcctgcttgagcaggaacggcagaggaactttgagaagcagagagaggagagggctgcacttgagaagctccagagccagcttcgtcacgaacagcagcgttgggagcgggaacggcaatggcagcatcaggaattggagcgcgctggtgcacgccttcaggaaagagaaggggaagcccggcaactccgggaaagattggaacaagaaagagccgagctggaacgccagagacaagcatatcagcacgacctggaacggctaagggaagctcagagggcggtcgagcgcgagcgggaacgtctggaactgctgaggagactgaaaaagcagaacacggcccccggcgcattgccaccagacacactagcagaagcccaacctccgtcccaccccccttcattcaatggtgagggcttggaaggaccacgagtttcaatgttacctagcggggttggtcctgagtacgcggagagacccgaggtggccaggcgcgactcagcaccgaccgagaatagactcgctaagtccgacgtccccatccaactgctaagcgctactaatcagttccagcggcaggccgccgtacagcaacagataccaacaaagctggcagcatccacaaaggggggtaaagacaagggcggaaagagcagaggctcacaacgatgggaatcatcagcttccttcgacctcaaacagcaattactgctgaacaaattaatgggcaaggatgagtctacatcgcggaatcggaggtcccttagccccatcttgcctgggcggcactctcctgccccacccccagatcctggctttccagctcctagccctcccccagctgattcgccaagcgagggtttctcccttaaagccggagggacagctctgctacccggtcccccagcgccttccccactgcctgccactcccctatctgccaaagaggatgcctccaaagaagatgtgatattcttctag

SEQ ID NO: 15026 - DNA, 1674 bp, Artificial Sequence
  Description of Artificial Sequence: Synthetic coding sequence
atggattctacagtgccatctgccttggagctgccccagcgactggcgctgaatcctcgcgaatcaccgcgatctcctgaagaagaagagccccacctgcttagttccctagccgccgtgcagacactggctagcgtgatccgaccctgctacgggccgcacggaagacagaagttcctggtgacgatgaaaggtgaaacggtatgtactggttgcgctacagcaatcttgcgtgctctggaactagagcacccggccgcctggctgcttagagaagcaggtcaaactcaagcagaaaatagcggggacggcactgctttcgtggtcctactcacggaggctctcctggagcaggcggaacagctgttaaaggccggtctgcccaggcctcagctccgagaggcctacgccaccgccaccgctgaagtcttagccacattgccctctctcgcaatccagtcgctggggcctctggaggatccatcatgggcactgcactcagtaatgaatactcatacactttctccaatggaccacctcactaaactcgtggcccacgcctgctgggccatcaaagaactcgacggaagtttcaaaccagaaagggttggtgtctgcgccctgccaggaggtactctggaagatagctgtctcctgcctggacttgctatttcaggcaagctgtgcgggcagatggccacggtactgtccggggcccgcgtcgccctgttcgcctgcccttttggtcccgctcatccgaacgctccagcaaccgcacgcctgagctccccagcggatctagcccaattctcaaaggggtctgaccagctcttggaaaaacaggtggggcagctcgccgctgccggtattaacgtcgctgtggtgttgggagaggtggacgaagagacactgaccttggctgacaaatatggaatcgtggtgattcaggctcgatcctggatggagattatatacttatccgaggtattggacaccccattgctcccacggctcctccctccccagagaccgggcaagtgccagcgcgtctacagacaggagcttggagacggtctggccgtggtgttcgagtgggagtgcaccggcacccctgctctcactgtagtgctccggggcgcaacaacacaagggctcaggtccgcggagcaggccgtttatcacgggatcgacgcctactttcagctatgtcaggatccacgcctcatccccggagctggcgccaccgaaatggccttggcgaaaatgctgtcagataaaggatctagactggaggggccgagtggaccagcttttctagcctttgcttgggcactcaaatatctgcctaagacattagcggagaatgccggcttggccgtgagtgacgtgatggcagaaatgtctggggtgcaccagggtgggaatctgcttatgggcgttgggacagaggggattatcaatgtggcccaggagggtgtgtgggacaccctgattgtgaaagctcaaggcttccgagcagtcgctgaagtcgtgctgcagctggtgaccgtcgatgagatcgtagttgccaaaaagtcccccacgcatcaggaaatctggaatcccgactctaagaagacaaaaaagcacccaccgccagtcgaaacaaagaaaatcctggggctaaacaattag
